(12) United States Patent
Rigoutsos et al.

(10) Patent No.: US 8,178,503 B2
(45) Date of Patent: *May 15, 2012

(54) RIBONUCLEIC ACID INTERFERENCE MOLECULES AND BINDING SITES DERIVED BY ANALYZING INTERGENIC AND INTRONIC REGIONS OF GENOMES

(75) Inventors: Isidore Rigoutsos, Astoria, NY (US); Tien Huynh, Yorktown Heights, NY (US); Aristotelis Tsirigos, Astoria, NY (US); Alice Carolyn McHardy, New York, NY (US)

(73) Assignee: International Business Machines Corporation, Armonk, NY (US)

( * ) Notice: Subject to any disclaimer, the term of this patent is extended or adjusted under 35 U.S.C. 154(b) by 1657 days.

This patent is subject to a terminal disclaimer.

(21) Appl. No.: 11/408,557

(22) Filed: Apr. 21, 2006

(65) Prior Publication Data

US 2011/0178283 A1    Jul. 21, 2011

Related U.S. Application Data

(63) Continuation-in-part of application No. 11/367,512, filed on Mar. 3, 2006.

(51) Int. Cl.
*C12N 15/11* (2006.01)
(52) U.S. Cl. .................................... 514/44 A
(58) Field of Classification Search .................. 514/44 A
See application file for complete search history.

(56) References Cited

U.S. PATENT DOCUMENTS

| | | | | |
|---|---|---|---|---|
| 8,065,091 B2 * | 11/2011 | Rigoutsos et al. | ............... | 702/19 |
| 2005/0244879 A1 | 11/2005 | Schumm et al. | | |
| 2007/0050146 A1 * | 3/2007 | Bentwich et al. | ............... | 702/19 |

OTHER PUBLICATIONS

Krutzfeldt et al. (Nature Genetics, 2006, 38: S14-S19).*
I. Rigoutsos et al., "Combinatorial Pattern Discovery in Biological Sequences: the Teiresias Algorithm," Bioinformatics 1, Jan. 1998, pp. 55-67, vol. 14, No. 1.
G. Bejerano et al., "Ultraconserved Elements in the Human Genome," Science Magazine, May 2004, pp. 1321-1325, vol. 304.
M. Ashburner et al. "Gene Ontology: Tool for the Unification of Biology, The Gene Ontology Consortium," Nature Genetics, May 2000, pp. 25-29, vol. 25.
S. Iwashita et al., "A Transposable Element-Mediated Gene Divergence that Directly Produces a Novel Type Boeine Bent Protein Including the Endonuclease Domain of RTE-1," Society of Molecular Biology and Evolution, 2003, pp. 1556-1563, vol. 20, No. 9.
G. Lev-Maor et al., "The Birth of an Alternatively Spliced Exon: 3' Splice-Site Selection in Alu Exons," Science Magazine, May 2003, pp. 1288-1291, vol. 300.
N. Jiang et al., "Pack-MULE Transposable Elements Mediate Gene Evolution in Plants," Nature, Sep. 2004, pp. 569-573, vol. 431.
R.A. Jorgensen, "Restructuring the Genome in Response to Adaptive Challenge: McClintock's Bold Conjecture Revisited," Cold Spring Harbor Symposia on Quantitative Biology, 2004, pp. 349-354, vol. LXIX.
J.C. Wootton et al., "Statistics of Local Complexity in Amino Acid Sequences and Sequence Databases," Computers in Chemistry, 1993, pp. 149-163, vol. 17, No. 2.
X. Xie et al., "Systematic Discovery of Regulatory Motifs in Human Promoters and 3' UTRs by Comparison of Several Mammals," Nature, Mar. 2005, pp. 338-345, vol. 434.
R. Chenna et al., "Multiple Sequence Alignment with the Clustal Series of Programs," Nucleic Acids Research, 2003, pp. 3497-3500, vol. 31, No. 13.
A. Stabenau et al., "The Ensembl Core Software Libraries," Genome Research, 2004, pp. 929-933, vol. 14.
S.F. Altschul et al., "Basic Local Alignment Search Tool," J Mol Biol., 1990, pp. 403-410), vol. 215.
I.L. Hofacker et al., "Fast Folding and Comparison of RNA Secondary Structures," Monatshefte fur Chemie, 1994, pp. 167-188, vol. 125.
S. Griffiths-Jones et al., "Rfam: an RNA Family Database," Nucleic Acids Research, 2003, pp. 439-441, vol. 31, No. 1.

* cited by examiner

*Primary Examiner* — Brian Whiteman
(74) *Attorney, Agent, or Firm* — Ryan, Mason & Lewis, LLP

(57) ABSTRACT

In one aspect of the invention, a method for regulating the expression of a transcript comprises using at least one interfering RNA molecule that binds to an area of transcript containing a region that corresponds to at least one sequence having SEQ ID NO: 1, the interfering RNA molecule regulating the expression of the transcript through post-transcriptional silencing. In another aspect, a method for regulating the expression of a transcript comprises at least one of the provided sequences having SEQ ID NO: 1 being used to design an interfering RNA molecule that contains a region that corresponds to the reverse complement of one or more sequences having SEQ ID NO: 1, the interfering molecule regulating, through post-transcriptional silencing, transcripts that contain the sequence having SEQ ID NO: 1.

1 Claim, 23 Drawing Sheets

NOTE: THE PROBABILTY DENSITY AND CUMULATIVE FUNCTIONS FOR THE LENGTHS THE ENTIRE COLLECTION OF BLOCKS, $P_{init}$, THAT THE PATTERN DISCOVERY STEP IDENTIFIED IN THE HUMAN INTERGENIC AND INTRONIC REGIONS.

FIG. 3

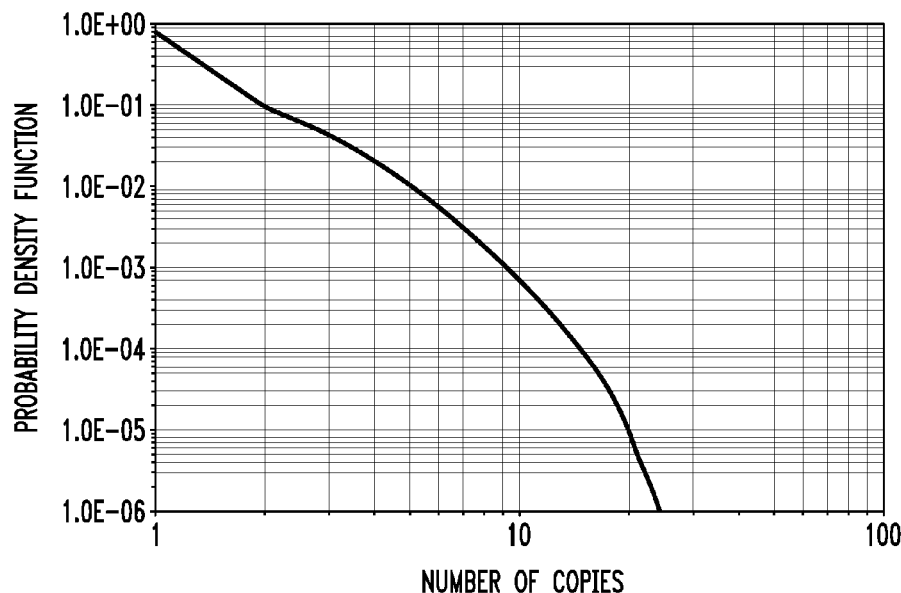

NOTE: THE PROBABILITY DENSITY FUNCTION FOR THE NUMBER OF INTERGENIC/INTRONIC COPIES OF FIXED-SIZE 16-mers THAT ARE DISCOVERED IN A RANDOMLY-SHUFFLED VERSION OF THE INPUT SET.

FIG. 4

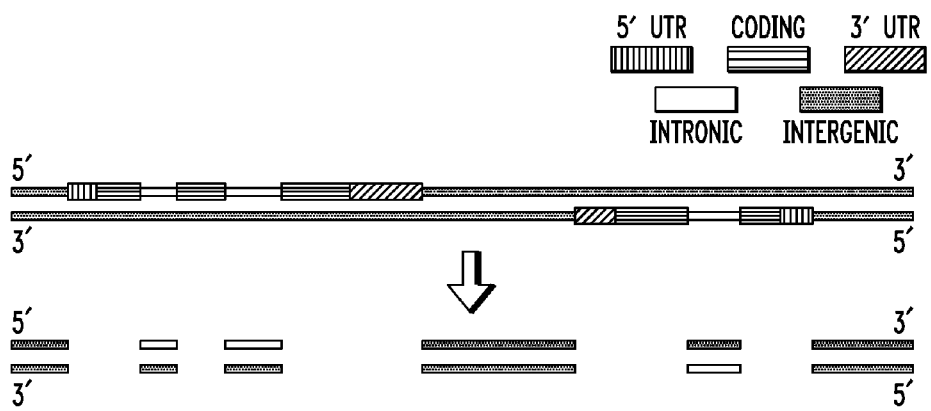

NOTE: PREPROCESSING OF THE INTERGENIC/INTRONIC SEQUENCES PRIOR TO CARRYING OUT PATTERN DISCOVERY. ALL SEQUENCE SEGMENTS THAT CORRESPOND TO THE UNTRANSLATED AND CODING REGIONS OF KNOWN GENES OR THAT ARE THE REVERSE COMPLEMENT OF THE UNTRANSLATED AND CODING REGIONS OF KNOWN GENES ARE REMOVED. TOP: GENOMIC INPUT BEFORE THE PREPROCESSING. BOTTOM: INPUT ON WHICH PATTERN DISCOVERY WILL BE RUN.

FIG. 5

| | | |
|---|---|---|
| 10 | TCCCATACCACGGGGATT | (SEQ ID NO: 747,328) |
| 9 | TCCCATACCACGGGGATTA | (SEQ ID NO: 747,329) |
| 9 | CTCCCATACCACGGGGATT | (SEQ ID NO: 747,330) |
| 8 | CTCCCATACCACGGGGATTA | (SEQ ID NO: 747,331) |
| 8 | TCCCATACCACGGGGATTAC | (SEQ ID NO: 747,332) |
| 7 | GCCTCCCATACCACGGGGATT | (SEQ ID NO: 747,333) |
| 7 | TCCCATACCACGGGGATTACA | (SEQ ID NO: 747,334) |
| 5 | GCCTCCCATACCACGGGGATTA | (SEQ ID NO: 747,335) |
| 4 | GCCTCCCATACCACGGGGATTACA | (SEQ ID NO: 747,336) |
| 4 | GGCCTCCCATACCACGGGGATTA | (SEQ ID NO: 747,337) |

NOTE: AN EXAMPLE OF VARIATIONS ON THE SAME THEME. SEVERAL VARIATIONS OF THE SAME CORE PATTERN (SHOWN IN BOX) ARE LISTED IN ORDER OF INCREASING SPECIFICITY AND THUS IN ORDER OF DECREASING NUMBER OF APPEARANCES. THE NUMBER OF APPEARANCES PRECEDES EACH PATTERN.

FIG. 6

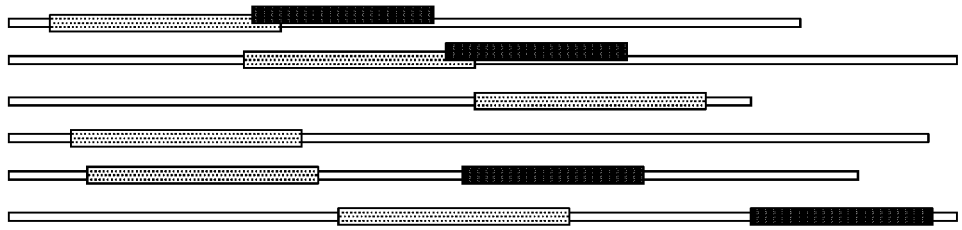

NOTE: DETERMINING LOGICALLY DISTINCT PATTERNS. THE LIGHTER RECTANGLE REPRESENTS ONE BLOCK WITH SIX INSTANCES WHEREAS THE DARKER RECTANGLE REPRESENTS ANOTHER BLOCK WITH FOUR INSTANCES.

NOTE: THE PROBABILITY DENSITY FUNCTION FOR THE LENGTHS OF THE PYKNONS - IT IS SHOWN SEPARATELY FOR EACH OF $P_{5'UTR}$ (LINE MARKED WITH △ ), $P_{CODING}$ (LINE MARKED WITH (○) AND $P_{3'UTR}$ (LINE MARKED WITH □).

NOTE: NUMBER OF BLOCKS THAT ARE SHARED BY THE THREE SETS WHOSE UNION MAKES UP THE PYKNON COLLECTION.

NOTE: THE CUMULATIVE FUNCTION FOR THE NUMBER OF INTERGENIC AND INTRONIC COPIES OF THE PYKNONS – IT IS SHOWN SEPARATELY FOR EACH OF THE SET $P_{5'UTR}$ (DASHED LINE), $P_{CODING}$ (DASHED-DOT LINE) AND $P_{3'UTR}$ (SOLID LINE).

NOTE: CUMULATIVE FUNCTION THAT SHOWS WHAT PERCENTAGE OF THE AFFECTED 30,675 TRANSCRIPTS CONTAINS N OR MORE PYKNON INSTANCES IN THEM.

FIG. 11A

Note: Combinatorial arrangements of pyknons in 3'UTRs are shown for the apoptosis inhibitor birc4 (shown above the horizontal line) and nine more genes. The sequences below the horizontal line contain some of birc4's pyknons but in different arrangements: they also contain instances of other pyknons that are not present in birc4's 3'UTR. Each of the ten shown 3'UTRs is a mosaic pyknons. The pyknons in this Figure, have by definition 40 or more instances in the genome's intergenic/intronic regions and *additional* copies in the untranslated and coding regions of these and other genes. The string -(xx)- indicates that xx nucleotides separate the pyknons that surround it. To appreciate the importance of this picture it suffices to keep track of the number of copies and the relative position of the four pyknons TGCACTCCAGCCTGGG (SEQ ID NO: 747,338), TAATCCAGCACTTTGGGA (SEQ ID NO: 747,339), GGCTGAGGCAGGAGAAT (SEQ ID NO: 747,340) and GAGGTTGCAGTGAGCC (SEQ ID NO: 747,341) in these ten 3'UTRs. Of the nine transcripts shown below the horizontal line: ENST00000338356 encodes a carboxypeptidase M precursor; ENST00000313852 encodes a protein with a bipartite nuclear localization signal; ENST00000361561 encodes a protein with an instance of the RUN domain; ENST00000305513 encodes a protein with a zinc-finger domain; ENST00000259393 encodes a high-affinity copper-uptake protein; ENST00000356694 encodes a protein with an ankyrin repeat; ENST00000295102 encodes a protein phosphatase 2A regulatory subunit that contains a WD-40 repeat; and, ENST00000360166 and ENST00000362058 encode proteins with unknown function.

(SEQ ID NO: 747,342).

>3'UTR OF ENST00000245836[ENSG00000101966_CHR=X_STRAND=FORWARD
-(162)-TTTCTTGATTTTCAG-(104)-ATACTGATTAATTC-(208)-ATTTCTTTTAAAGTT-(91)-ACTGACATGGAAAGAT-(243)-TGTATTACTTTTGTAA-(5)-AT
TTTAGAAAGTATT-(146)-TGGATGAAAAATATTT-(591)-CTCACACAACAAACCTAT-(139)-ATTCATTTAAACATT-(27)-CTTTTTGAGATGGAGTCTT-(8)-CCCA
GGCAGAGTGCA-(8)-ATCTCTGCTCACTGCA-(6)-GCCTTCTGGGTTCAAG-(2)-ATTCTCGTGCCTCAGC-(6)-AGTAGTGGAATTACAG-(6)-GCCACCATGCC
CGACTA-(39)-TTGGCCAGGCTGGTAT-(2)-AACTCCTGACCCTCAG-(19)-TCCCAAAGTGCCAGGCTTGAGCACCTA-(724)-TTATTTTACATTTA
G-(333)-AAATTTGTATTTTGAA-(186)-CAGTGCCGGGGCGTGGTGG-(7)-CTGTAGTCCCAGCACTT-(5)-GGCTGAGGCAGGAGAATGGTGTGAACCCGGGAGG-(2)-G
A-(13)-TCTCTACTAAAAAACA-(5)-TTAGCGCGGGCAGCCTGG-(4)-AGAGCAAGACTCTGTC-(101)-TCTGTGAAAGGAAAT-(69)-ACTCCCATCCTAATAC-(137)-CGGT
AGCTTGCAGTGAGCC-(13)-TGCACTCCAGCCACTTTGGGA-(14)-GATCACCTGAGGTCGGGAGG-(3)-AGACCAGCCTGAGGTGGAGCG-(13)-TAAGCTGGGCGTGGTG-(8)-CTGTA
ATCCCAGCTACT-(5)-GGCTGAGGCAGGAGAAT-(2)-CTTGAACCCAGGAGG-(1)-GAGGTTGTGTGAGCA-(13)-TGCACTCCAGCCTGGGCAACAAGAGCA
AAACT-(58)-TTAGCCAGGCGTGGTG-(16)-GCAGCTACTCTGGAGG-(1)-AGAGGCAGGAGGATCACTTGAGCCATGAATT-(1)-GAGGCAGCAGTGAGCT-(13
)-TGTACTCCAGTCTGGG-(2)-ACAGAGTGAGACCCCA-(50)-TTGAAAAGATTATTCT-(166)-TCATTTTACAGGTGAG-(258)-CCAGCCTGGACAAAAG-(3)-AAACCCTGTC
TTGTTAAGCAACA-(3)-TAACAACTATTTACAT-(37)-AGCAATTATTTTTAAA-(12)-ATTGTATTAGGTATTA-(33)-TGGAAAAGTGCTCAGTGAGCT-(13)-TGCATTCCAGCC
TCTACAAAA-(10)-TTAGCTGGGCATGGTG-(9)-TGTAGTCCCAGCTACT-(15)-GGAGGATCGCTTGAGT-(10)-GAGGCTGCATTGAGCT-(13)-TGCATTCCAGCC
TGGG-(10)-AGACCTTGTCTCAGAA-(31)-GTGCCCAGTTAATTTTTTTTTGTATTCTTAGTAGAGA-(15)-TTGGCCAGGCTAGTCT-(2)-AATTTCTGACCTCAGGCTCAT-(20)-C
AGCTGGACAGG-(11)-GTGCCGATTACAGGCGTGAGCACGGGCCACCA-(47)-TTGACCAGGCTGGTCT-(2)-AACTCCTGAGGCAGG-(3)-CTCACCTGAGGTCAGGAGTT-(2)-AGACCAGCCTGGGATTACA
GTGCTGGGATTACAGGCGTGAGCACGGGCCACCA-(125)-GGCACGGTGGCTCACGCCT-(16)-CCGAGGTCCCAGATGGTG-(8)-CTGTAGTCCCAGCATGGTG-(8)-CTGTAGTCCCAGCATGGTG-(8)-GAGGT
CCTGCTGTACAAAAA-(7)-ATAGCTGGGCATGGTG-(8)-CTGTAGTCCCAGCTACT-(6)-ACTGAGGCAGGAGAAT-(2)-CTTGAACCTGGGAGGC-(1)-GAGGT
GGAGAGCC-(13)-CGCACTCCAGCCTAGG-(1)-GATAGAGTGAGACTCC-(327)-ATGTTTTGAGACAGAG-(56)-GAAAACTAAGAAAATT-(41)-TTATTTTCT
GTGAAT-(10)-CAATAAAATACTATTC-(10)

FIG. 11B (SEQ ID NO: 747,343):
>3'UTR OF ENST00000305513|ENSG00000186532_CHR=17_STRAND=REVERSE
-(66)-GCCAGGTATGGTGGCT-(8)-TAATCCCAGCACTTTGGGA-(15)-ATCACCTGATGTCAGGAGTT-(2)-AGACCAGCCTGGCCAA-(36)-ACTAGCCAGGCGTG-(8)-CTGTAATCCCAGCTACT-(5)-GGCTGAGGCAGGAGAAT-(2)-CTTGAACCCAGGAGGC-(1)-GAGGTTGCAGTGAGCC-(10)-CACTGCACTCCAGCC-(2)-GTGACAGTGAGACT-(32)-CGGTGGCTCAAGCCTGTAATCCCAGCACTTTGGGA-(14)-GATCACGAGGTCAGGAG-(4)-AGACCATCCTGGCTAACA-(37)-TAGTCGGGCGTGGTGG-(6)-CCTGTATTCACAGCTA-(5)-GAGGTTGAGGCAGGAG-(4)-GGGTGAACCCGGGAGG-(2)-GAGCTTGCAGTGAGCC-(13)-TGCAC-TCCAGCCTGGG-(1)-GACAGAGCCAGACTCC-(140)-AGGCTCACACCTGTAATCC-(11)-GACGCTGAGGTGGGAGGATCACTTGAGCCCAGGAGTT-(1)-TGG-GCAATATAGTGAGA-(8)-CTACAAAAAAGTTTT-(1)-AGCATGGTGGCACATG-(1)-CTGTAGTCCCACCTACT-(14)-AGGGTCACCTGAGCCT-(8)-GAGGCTG-CAGTGAGCC-(13)-TGCACTCCAGCCTGGG-(4)-AGAGTAAGACCCTGTC-(547)-TTTTATTGAGCAGTTT-(121)-

(SEQ ID NO: 747,344):
>3'UTR OF ENST00000338356|ENSG00000135678_CHR=12_STRAND=REVERSE
-(312)-AAAGAAGATCATTTTG-(83)-AGCAGTGGCTCACACCT-(2)-TAATCCCAGCACTTTGGGA-(5)-AGGTGGGCGGATCACCC-(16)-AAACCAGCCTGACCA-ACATGGTGAAACCCTGTCTCTACTAAAT-(1)-TTAGCGGGGTGGGTG-(4)-GCACCTGTAATCGCAG-(8)-GAGGCTGAGACAGGAG-(5)-CTTGAACCCTAGAG-GC-(1)-GAGTTGCAGTGAGCC-(9)-CCATTGTACTCCAGCT-(10)-AGTAAGACTCTGTCTC-(525)-TGGGAGTCATCCTTGA-(56)-GGCCAGGCATGGTGGC-(9)-TAATCCCAGCATTTGGGA-(21)-TGAGGTCAGGAGCTCAAGACCAGCCTGGCCAA-(40)-TAGTCGGGGCGTGGTGG-(7)-CTGTAATCCCAGCTACT-(5)-GGCT-GAGGCAGGAGAAT-(2)-CTTGAACCTGAGGTCAGGAGC-(1)-GAGGTTGCAGTGAGCC-(13)-TGTACTCCAGCCTGGG-(6)-AGTGAGACTCTGTCTT-(17)-CTGATAAA-TATTGATG-(279)-CAGCTCCACTAGGAAG-(18)-CCATTCAATTCAATT-(132)-GAGCTCTTTGAGGCCA-(46)-CCTAGCACATAGTAGG-(3)-TGAATGAATGAA-TGAA-(60)-TCATTTTATGAAGCTA-(171)-TTTTATCAGAAAAAAAA-(305)-ACTTAATCCCAGCTGT-(132)-ACAAAGGAATGAAGAG-(7)-AGCATTTAGGCCATT-(646)-AAATGGTATTTAGAAA-(14)-CGGTGGCTCATGCCTGTAATCCCAGCTACT-(4)-AGGCTGAGGCAGGAGAAA-(3)-CCTGAACCCAGAAGGC-(1)-GAGGTTGCAGTGAGCC-(15)-GG-0)-TTAGCCCGGGCGTGG-(7)-CTGTAACCCCAGCT-(4)-AGGCTGAGGCAGGAGAAA-(3)-CCTGAACCCAGAAGGC-(1)-GAGGTTGCAGTGAGCC-(15)-GG-CACTGCACTCCAGCCG-(15)-CCTCTGTCTCAAAAAAA-(65)-TTTCTTTATCTGTAAA-(419)-GTTTAGAAAGTAAAAA-(458)-CCCAGGTTGGAGTGCA-(13)-GG-CTCACTGCAACCTC-(1)-GCCTCCCGGGTTCAAG-(5)-CTCCTGTCTCAGCCTC-(2)-GAGTACCTGGGACTAC-(16)-GCCCGGCTAATTTTTGTATTTGTAGTAG-AGA-(13)-TGTTAGCCAGGATGGTCT-(4)-CTCCTGACCTCATGATC-(20)-TCCCAAAGTGCTGGGATTACAGGCGTGAGCCCCCG-(151)-

(SEQ ID NO: 747,345):
>3'UTR OF ENST00000360166|ENSG00000197291_CHR=17_STRAND=REVERSE
-(62)-CCTGTTGTGGGAGGG-(794)-CGGTGGCTCATGCCTG-(1)-CATCCCAGCACTTTGGGA-(17)-AACCTGAGGTCAGGAGTT-(13)-AACAACATGGTGAAA-C-(42)-TGCCTGCCTGTAATCC-(10)-GAGGCTGAGGCAGGAAAGGC-(1)-GAGGTTGCAGTGTGCC-(10)-CACTGAACTCCAGCCT-(3)-CAACAAGAGTGAAACT-(111)-TATTGAACACTTACTA-(148)-GCAGAGCCAGGATTT-(244)-TGTTTTTAAAAGAA-(386)-TTTACAGACAAGGAAA-(23)-GGCCAGGCATGGTGGC-(9)-TAATCCCAGCAGTTTGGGAGGGCTGAGGTGGGAGGA-(6)-CTTGAGCCCAGAAGTTGAGGCTGCAGTGAGCC-(11)-CCATCTCTACAAAAA-(1)-TTAT-CTGGGCCTGGTG-(8)-CTGTAGTCCCAGCTACT-(2)-AGAGGCTGAGGCAGGAGGTGGGA-(6)-CTTGAGCCCAGAAGTTGAGGCTGCAGTGAGCC-(13)-TGTACTCCAGCC-TGGG-(3)-CAAAGCAAAACCCTGT-(27)-CGGTGGCTCACACCTGTAATCCCAACACTTTGGGA-(15)-ATCACCTGAGGTCAGGAGTT-(2)-AGACCAGCCTGGC-CAA-(14)-CCTCTACTGAAAATACAAA-(9)-GCATTGTGGCACATG-(12)-ATCACCTGAGGTCAGGAGTT-(12)-AGACCAGCCTGGCCAA-(36)-TTAGCTGGGC-GTGGTG-(8)-CTGTAGTCCCAGCTACT-(5)-GGCTGAGGCAGGAGAAT-(2)-CTTGAACCTGGCAGT-(1)-GAGGTTGCAGTAAGCC-(13)-TGCACTCCAGCCTG-GG-(6)-

FIG. 11C (SEQ ID NO. 747,346):

>3'UTR OF ENST00000313852|ENSG00000180488_CHR=1_STRAND=FORWARD
-(140)-ACTGTACTGTATTTAT-(86)-AGACTAGCCTGGACAA-(16)-TCTCTACAAAAACATAAAATAATTAGCTGG-(45)-AAAAATAGGCTGGGTGTGGTTCATGCC
-(1)-TTGAGGCCAGGAG-(4)-AGACTAGCCTGGACAA-(16)-TCTCTACAAAAACATAAAATAATTAGCTGG-(45)-AAAAATAGGCTGGGTGTGGTTCATGCC
TGTAATCCAGCACTTTGGGA-(13)-GGATCACCTGAGGTCAGGT-(16)-CCCAATATGGTGAAAC-(26)-TAGCCAGGTGTGGTGG-(7)-CTGTAGTCCAGCTAC
T-(3)-GAGGCTGACAGGAG-(5)-CTTGAACCCAGGAAGT-(1)-GAGGCTGCAGTGAGCC-(13)-TGCACTCCAGCCTGGG-(6)-AGTGAGACTGTCTC-(36)-G
TGTGGTGGCATGTGT-(1)-TGTGGTCCCAGCTACT-(31)-CCAGAAGGTCAAGCT-(4)-TGAGCTGTGATTGCAT-(3)-TGCACTCCAGCCTGGG-(44)-AGCAAGAC
CCTATCTC-(51)-AATTTACAATTTACAA-(60)-CTGAAGAACTTCTTT-(418)-ATTTTGTTTCTAAATA-(140)-AGAGATGGGGTCTCGCT-(6)-CCCAGGCTGGAG
TGCA-(15)-TAGCTCACTGCAGTCT-(45)-AAATGCATTTTAAAA-(27)-TTCTGATTAATAAAT-(55)-TGTATGTGCCACATTT-(276)-CACACACATGTGTG-(5
9)-CAGTGGCTCAGCGCCTGTAATCCCAGCACTTTGGGA-(17)-AACCTGAGGTCAGGAGTT-(2)-AGACCAGCCTGACCAA-(36)-TTAGCCAGGCATGGTG-(8)-C
TGTAATCCCAGCACT-(5)-GGCTGAGGCAGGAGAAT-(2)-CTGAACCCGGGAGGC-(1)-GAGGTTGCAGTTAGCC-(13)-TGCACTCCAGCCTGGGCAACAAG
AGTAAAACT-(7)-

(SEQ ID NO. 747,347):

>3'UTR OF ENST00000259393|ENSG00000136868_CHR=9_STRAND=FORWARD
-(128)-CACACACACACCCCTG-(50)-AATTGTTTTTCTAAT-(135)-CTTTTGAATTTTTAA-(153)-CAGTGCCCATGCCTGTAATCCCAGCACTTTGGGG-(16)-
ATCACCTGAGGACAGGAGAGTT-(2)-AGACCAGTCTGGCAA-(37)-TAGCCGGGCATGGTGG-(7)-CTGTAATCCCAGCTACT-(5)-GGCTGAGGCAGGAGAAT-(2)-
CTTGAACCCTAGGAGGC-(1)-GAGGTTGCAGTGAGCC-(13)-TGCACTCCAGCCTGGG-(1)-GACAAGAGTGAAACTC-(340)-TTTGAATTAATTTTC-(23)-GCCTC
TAAACTGTGA-(17)-GCATCAGAATCACCTG-(1)-AGGGCTGTGTTAAACA-(227)-ACATTTATTGAGCTCC-(502)-AGGGCAGGAGAAACAA-(424)-CAATGGC
TCATGCTGTAATCCCAACACTTTGGGAGGCCAAGGTGGGAGGA-(21)-AGACCAGCCTGAGCACAA-(3)-AGTGAGATCCTATCTC-(16)-TTAGCCAGGCATGGT
G-(7)-CCTATAGTCCTGGCTA-(8)-GCTGAGGCAGGAGGAT-(20)-AGGCTGGGCAGGAGCC-(7)-GCCACTCCAGCCTGGG-(10)-AGCAAGAGCCTGTCTC-(880)-C
TCTGGGCTGGGCACAG-(7)-CACACTTGGGAGGCC-(14)-ATCACCTGAGGTCAGGAGTT-(12)-AGACCAGCCTGGCCAA-(36)-TTAGCTGGGCGTGGTG-(8)-C
TGTAATCCCAGCTACT-(5)-GGCTGAGGCAGGAGAAT-(2)-CTTGAACCCAGGAGGC-(1)-GAGGTTGCAGTGAGCC-(1)-GAGGTTGCAGTGAGCC-(13)-TGCACTCCAGCCTGGG-(1)-GACAA
GAGCAAAACTC-(183)-

(SEQ ID NO. 747,348):

>3'UTR OF ENST00000362058|ENSG00000186543_CHR=1_STRAND=REVERSE
-(776)-TGTCACCCAGCTGGAG-(90)-TGGTTGGAGCAGGAGG-(330)-CAGTGGCTCACGCCTA-(17)-GAAGCCGAGGCGGGTGGATCACC-(16)-AGACCATCCT
GGCTAACA-(9)-CCTATCTCTACAAAAA-(1)-TTAGCTGGGTGTGGTG-(8)-CTGTAGTCCCAGCTACT-(5)-GGCTGAGGCAGGAGAAT-(6)-AACCTCTGCCTCCG
GG-(14)-CCTGCCTCAGCGTCC-(1)-AGTAGCAGGGACTACA-(2)-CGTGCACCACCACATGCCCG-(10)-GTATTTTAGTAGAGA-(15)-TTGGCCAGGCTGGTCT-(
2)-AACTCTTGACCTCAAG-(10)-GCCAAAGTGCTGGGATTATAGGCGTGAGCCACCG-(116)-CTGCCAGGACTGGTT-(688)-TGGGGACTTGGGGGAA-(142
)-CCTCTCTGGGCTGCAG-(699)-AGTTTCACTCTTGTTGCCCAGGCTGGAGTGCA-(14)-GCTCAACCTCCCAGGTTCAAG-(2)-ATTCTCCTGC
CTCAGCC-(5)-AGTAGCTGGGATTACAG-(12)-ATGCCTGGCTAATTTTGTATTTTAGTAGAGA-(22)-AGCTGGTCTCGAACTC-(13)-ATCTGCCCACTTCGGCC
TCCAAAGTGCTGGGATTA-(1)-AGGCATGAGCCACCGC-(21)-GAGACAGAGTCTCACT-(7)-CCCAGGTTGGAGTGCA-(8)-ATCTGAGCTCACTGCA-(6)-GCC
TCTGGGTTCAAG-(2)-ATTCTCCTGCCTCAGCC-(5)-AGTAGCTAGGACTACA-(9)-CACCATGCCCAGCACCTG-(90)-GGAAAGGGGTCAGGGC-(23)-GGAAACTGGA
GCCCAG-(51)-CTCTGCCTCTGGGATT-(213)-GTGGGCAGCCCAGGAG-(107)-CATCTGTGAAATGGGA-(289)-TGCCTGGGTTTGAATC-(37)-TCTGTGCCTTC
ATTTC-(318)-GCTGGGATTCCAGGCA-(61)-TAATCCCAGCCACTTTGGGA-(14)-GATCACGAGGTCAGGAG-(4)-AGACCATCCAGCTAACA-(1)-AGTGAAACC
CTATCTC-(18)-TTAGCTGGGCATGGTGG-(9)-TGTAGTCCCAGATACT-(8)-TAAGGCAGGAGAATGCTTCAACCTGGGAGGC-(1)-GAGGTTGCAGTGAGCC-(13
)-TGCACTCCAGCCTGGG-(21)-

FIG. 11D (SEQ ID NO: 747,349):
>3'UTR OF ENST00000361561|ENSG00000198863_CHR=17_STRAND=FORWARD
-(225)-CGGTGAGTCCAGCTACT-(6)-GGCTGAGGCAGGAGAATGGCGTGAACCAGGAGG-(2)-GAGCTTGCAGTGAGCC-(13)-TGCACTCCAGCCTGGG-(1)-GA
CAGAGTGAGACTCC-(86)-CAGTGGCTCACGCCTG-(9)-CACATTGGAGGCTGAGG-(7)-ATCACCTGAGGTCAGGAGTT-(2)-AGACCAGCCTGGCCAA-(60)-C
TGTAATCCCAGCTACT-(3)-CTTGAGCCCGAGAA-(3)-CTTGAGCCCAAGATCATGCCA-(1)-TGCACTCCAGCCTGGGCAACA
CAGGGAGACTC-(84)-TTTGAGAGGCTAGGC-(160)-TTTTTCTTGTAGAGGT-(492)-CAAAAATGGGCAAAT-(344)-

(SEQ ID NO: 747,350):
>3'UTR OF ENST00000356694|ENSG00000197256_CHR=19_STRAND=REVERSE
-(41)-TTTTGTTTTGAGGC-(14)-TCGCCCAGGGTGGAGT-(16)-GGCTCATTGCAACCTC-(1)-GCCTCCCGGCTTCAAG-(5)-CTGCTGCCTCAGCCTC-(2)-GAG
TAGCTGGGGATAACAGGTGTGTGGCGCATGCCT-(7)-CAGCTATTCTGGAGGT-(15)-CTTGAACCCAGGAGGT-(1)-GAGGTTGCAGTGAGCC-(18)-CAACAA
GCAGCAAAACT-(82)-AAGAGAATGACATTTGA-(8)-TGCAAAGGCCCTGAGG-(59)-TAATCCCAGCACTTTGGGA-(15)-GCTGAGGCCTGAGGTCAGGAGTT-(2)-AGA
CCAGCCTGGCAA-(36)-TTAGCTGGGTGTGTG-(8)-CTGTAATCCCAGATACT-(6)-GGAGGTTGCAGTGAGGC-(6)-TGCAGTGA
GCTGAGAT-(8)-TGCACTCCAGCCTGGC-(6)-TAGCTGGGCCTGGTGG-(8)-TATAGTCCCAGCTACT-(3)-GAGGCTAAGGCAGGAG-(29)-CTGTGAGCTATGA
TTG-(6)-TATACTCCAGCCTGGC-(6)-GCAAGACCCTGTCTT-(4)-AAAAAAAATCTAGGC-(2)-GGCACGGTGGCTCACGCCT-(1)-TAATCTCAACACTTTG-(18
)-ATCACCTGAGGTCAGGAGTT-(2)-AGACCAGACTGAGCAA-(1)-TCTCTACTAAAAACGCAA-(15)-TTAGCCGGGCGTGTGG-(7)-CTGTAATCCCAGCTAC
T-(5)-GGCTGAGGCAGGAGAAT-(2)-CTTGAACCCAGGAGGC-(6)-TGCACTCCAGCCTGGGCAACAAGAGTGAAACT-(7)-

(SEQ ID NO: 747,351):
>3'UTR OF ENST00000295102|ENSG00000143940_CHR=2_STRAND=FORWARD
-(112)-TCCTCTGTCTCTGCCT-(363)-TTGAATTTTGTAAAAT-(182)-CAGTGGCTCACACCTGTAATCCCAGCCCTTTGGGA-(2)-CTGAGGCAGGTGGATT-(1)-C
TTGAGCCCAGGAGTT-(16)-CTCATCTCTACAAAAA-(11)-GTGGTGGGCGTGTACCTCTAGTCCCAGCTACCC-(43)-CTAGGCTGCAGTGAGC-(14)-TGCACTCC
AGCCTGGGT-(2)-ACAGTGGCCTGTC-(175)-AAAAAAAATTTTTCTG-(54)-ACTGAGCACTTAAAAT-(148)-AAAATGTTACTGAAAT-(43)-ATCATGTTATTT
TCT-(116)-TTGGAAAATATTTTAA-(284)-TTTTGTTGAAAGCAAA-(1695)-ATATTCACTTTTTAAA-(826)-ATACATATTTACATAA-(63)-ATAGAAACTTTTAAAA-
(10)-GGGCATGGTGGCTCAC-(5)-TAATCCCAGCCGTGGT-(6)-GAGGTGGGCGGATCTCCTGAGGTCAGGAGTTC-(1)-AGACCAGCCTGGCCAA-(1)-ATGGTG
AAACCCGTCTT-(17)-TAGCCAGGCCTGG-(1)-GACAGAGTGAGACTCC-(413)-TGAGAATATTTTAAAT-(80)-ATTTTATTTTCAAGAT-(130)-TCATTCCAATTTAGT-(
AGCC-(13)-TGCACTCCAGCCTGGG-(1)-TAATCCCAGCACGCGG-(13)-TAATCCCAGCACTTTGGGA-(14)-GATCACGAGGTCAGGAG-(4)-AGACCATCCTGGCTAACA-(34)-ATTAGCCAGGCCT
258)-CAAAGGCCGGCGCGG-(13)-TAATCCCAGCACTCCAGCTACT-(3)-GAGGCTGAGGCAGGAGAACCCGGCAGGAGGAACGGCGTGAACCCAGG-(2)-GAGCTTGCAGTGAGCC-(13)-TGCACTCCAGCCTAGG
GGT-(9)-CTGTAGTCCCAGACTCC-(5)
-(1)-GGCAGAGCCAGACTCC-(5)

| FIG. 11A |
|---|
| FIG. 11B |
| FIG. 11C |
| FIG. 11D |

Note: 5'UTRs for ENSG00000196809 a human gene of unknown function and eight more genes. The shown 5'UTRs are mosaics composed of pyknons. The shown pyknons have 40 or more copies in the genome's intergenic and intronic regions. The string (xx) indicates the number of nucleotides, xx, that separate the surrounding pyknons. To appreciate the importance of the result in this Figure, it suffices to keep track of the number of copies and relative arrangement in each of the shown 9 genes of the four pyknons TCCCAAAGTGCTGGGATTA (SEQ ID NO: 747,352), CCCAGGCTGGAGTGCA (SEQ ID NO: 747,353), AGTAGCTGGGATTACAG (SEQ ID NO: 747,354) and AACTCCTGACCTCAGGTGAT (SEQ ID NO: 747,355). Below the solid line are the 5'UTRs for eight other transcripts: ENST00000314752, a monoamine-sulfating phenol sulfotransferase which is involved in catecholamine/lipid/steroid metabolism; ENST00000287474, a gene whose product has dopamine beta-monooxygenase activity and is involved in catecholamine metabolism; ENST00000344420, that encodes a centromere protein involved in nucleosome assembly, chromosome organization and biogenesis; ENST00000355921 a zinc finger protein involved in transcription regulation; ENST00000358920, that encodes a gene of unknown function; ENST00000357256, a surfeit locus protein; ENST00000355587, a Huntingtin interacting protein; and, ENST00000326880, that encodes a peptide-chain release factor.

(SEQ ID NO: 747,356)

>5'UTR OF ENST00000358509|ENSG00000196809_CHR=22_STRAND=FORWARD_UPSTREAM_UTR
-(704)-TTCTTCATTCATTCA-(53)-GACAGTCTCGCTCTGT-(2)-CCCAGGCTGGAGTGCA-(8)-ATCTCAGCTCACTGCA-(6)-GCCTTCCAGGTTCAAG-(2)-AGTC
TCCTGCCCTCAGCCTC-(3)-AGTAGCTGGGATTACAG-(9)-ACCACGCCTGGCTAATT-(4)-CATTTTAGTAGAGACG-(3)-CTTCACCATGTTGGCCA-(11)-AACTC
CTGACCTCAGGTAAT-(11)-TCCCAAAGTGCTGAGATTA-(5)-GTGAGCTACCGTGCCC-(216)-GGTGGTCAGGGAAGGC-(64)-AGGGAGGAGGAACAGC-(192)-
TTCATTCAACAAATAT-(931)-TGCCCAGGCTGGAGTT-(10)-AGCTCACTGCAACCTCCCAGATTCAAGATTCT-(17)-AATAGCTGGGACTACA-(5)
-ATGTCACCATGCCCAG-(42)-TTGGCCAGGCTGGAGTGCA-(13)-GGCTCATTGCAACCTC-(1)-AATCTACCTGCCTTGG-(2)-TCCAAAGTGCTAGGATTACAGGTGT
GAGCCACCG-(87)-CCCAGGCTGGAGTGCA-(13)-GGCTCATTGCAACCTC-(1)-ACCTCCCGGGTTCAAG-(13)-TCAGCTTCCTGAGTAGCT-(5)-TACAGGCACT
TGCCAC-(32)-GACAGGGTTTTGCCAT-(1)-TTGGCCAGGCTGGCCAT-(2)-AACTCCTGACCTCAGGTGAT-(15)-TCCCAAAGTGCTGGCATTA-(2)-GGCTTGAGC
CACCACG-(351)-GGAGTCTCGCTCTGTC-(6)-GCTGGAGTGCAGTGAC-(1)-TGATCTCGGCTCACTGCAG-(1)-CTCCGCCTTCTGGGTTCA-(4)-ATTCTCCTGC
CCTCCC-(3)-AGTAGCTGGGACTACAG-(7)-COACCTCGGCTGGCTA-(36)-TGTTAGCCAGGATGGTCT-(4)-CTCGTGACCTCGTGATC-(2)-CCAGCCTCGG
CCTCCC-(20)-TGAGATGGAGTTCGC-(9)-TCAGGCTGGAGTGCAATG-(5)-ATCTCAGCTCACTGCA-(6)-GCCTCCCAGGTTCAAG-(2)-ATTCTCCCACCTCAG
C-(6)-AGTAGCTGGGATTACAG-(45)-GGGGTTTCACTATGTTGGCCAGGCTGGTCTTGAACCTCTGACCTCAGGTGAT-(15)-TCCCAAAGTGCTGGGATTA-(14
5)-TGGAGGTAGGGCCTGG-(49)-TGAATGAAAGAAATGAA-(4)-TTTGGGAGGCCAAGGTGGGT-(2)-ATCACCTGAGGTCAGGAGTT-(2)-AGACCAGCCTGGCC
AA-(15)-CCTCTACTAAAATACAAAAAATTAGCTGGGCGT-(9)-TGCCTGTAATCACAGC-(7)-GAGGCTGAGGCAGGAGAAT-(19)-GAGGTTGCAGTGAGCC-(
7)-TGCCATTGCACTCCAG-(4)-GGCAACAGAGCGAGACT-(584)-

FIG. 12B (SEQ ID NO: 747,357):

>5'UTR OF ENST00000314752|ENSG00000132207_CHR=16_STRAND=FORWARD_UPSTREAM_UTR
-(5)-GAGTCTTGCTCTGTTG-(2)-GAGGCTGGAGTGGATCTCAGCTCACTGGA-(6)-GCCTCCTGGGTTCAAG-(11)-TCTCAACCTCCCAAGT-(1)-TGCCAC
CACACCTGCC-(11)-TTTTAGTGGGATGG-(11)-TTGGGCAGGCGTGCT-(2)-AACTCCTGACCTCAAG-(19)-TCCCAGGCTGTGGGATTA-(6)-TGAGCCAC
CATGCCTG-(8)-CCTGTCTCTAAAACAA-(190)-CAGAAATTTCTTTT-(23)-GAGACAGAGTCTTACT-(3)-TCGCTCAGGCTGGAGT-(11)-ATCTCAGCTCACTG
CAACCTCGCCTCCCTGGT-(11)-CTCCTTCCTCAGCCTC-(3)-AGTAGCTGGGATTACAC-(7)-CCACCGCGCCTGGCTA-(38)-TTGGCCAGGCTGGTCT-(2)-AACT
CCTGACCTCAGGTGAT-(12)-AGCCTGCCCAAATGCT-(7)-CAGGCATGAGCCACCG-(239)-CTCAGTTTCTTCATTT-(77)-GGGGTTGCTGCCAGCTG-(262)-

(SEQ ID NO: 747,358):

>5'UTR OF ENST00000287474|ENSG00000156869_CHR=1_STRAND=REVERSE_UPSTREAM_UTR
-(4)-TGCTGGGATTACAGGCGC-(5)-ACCACGCCCGGCTAAT-(23)-GGGTTTCACTGTGTTG-(3)-AGGATGGTCTCTATCTC-(8)-GTGATATGCCCGCCTC-(4)-TC
CCAAAGTGCTGGGATTACAGGCTTGAGCCACCG-(5)-GGCCTATTTATTTATT-(6)-GAGACGGAGTGTTGCT-(7)-CCCAGGCTGGAGTGCA-(13)-GGCTCACT
GCAACCTC-(1)-GCCTCCCGGGTTCAAG-(2)-ATTCTCCTGCCTCAGCCTC-(3)-AGTAGCTGGGATTACAG-(12)-ACACCCGGCTAATTTGTATTTTAGTAGAA
A-(2)-GGGTTTCTCCATGTTG-(6)-CTGGTTTCGAACTCCC-(8)-GTCATCTGCCTGCCTC-(4)-TCCCAAAGTGCTGGGATTACAGGCGTGAGCCACCG-(12)-TCT
GTATTTTAAAAA-(21)-TAAATGATTTGCCCAA-(72)-

(SEQ ID NO: 747,359):

>5'UTR OF ENST00000344420|ENSG00000115163_CHR=2_STRAND=FORWARD_UPSTREAM_UTR
-(1260)-ACAACACCCAAGTCCT-(47)-GCCTGAGTGCAGTGGC-(142)-TTCTTCAAAGAAGAAA-(53)-TTTGAGACAGAGTCTC-(9)-CCCAGGCTGGAGTCTG-(1
8)-GGCTCACTACAACCTC-(1)-GCCTCCCAGGTTCAAA-(2)-ATTCTCCTGCCTCAGCCTC-(3)-AGTAGCTGGGATTACAG-(26)-ATAGAGATGGGGTTTC-(6)-TT
GCCAGGCTGGTCT-(2)-AACTCCTGACCTCAGGTGAT-(15)-TCCCAAAGTGCTGGGATTA-(8)-ATTATGTTTCTAAAA-(46)-C
AGACTCCTGCCTCAAA-(237)-GAGTCTTGCTCTGTTG-(3)-CGCTGGAGTGCAGTGG-(9)-GGCTCACTGCAACCTC-(2)-GCTCCCAGGTTCAAGC-(10)-AGTAGC
TGGGACTACAG-(12)-ACATCCGGCTAATTTT-(12)-ATAGAGACGGGGTTTT-(6)-TTGGCCAGGATGGTCT-(4)-CTCCTGACCTCATGATC-(10)-AGCCTCCCAA
AGTGCTGGGG-(4)-AGGCATGAGCCACCACG-(42)-GTCTTGCTCTGTCAC-(14)-TGCAGCCTTGAACTCC-(14)-CCTCCTGCCTCAGCCTCCCGA-(13)-ACAG
GTATGTACCACC (SEQ ID NO: 747,360):

>5'UTR OF ENST00000358820|ENSG00000198037_CHR=12_STRAND=FORWARD_UPSTREAM_UTR
-(504)-AGAGTCTTGCTCTGTCGCCCAGGCTGGAGTGCA-(13)-GGCTCACTGCAACCTC-(1)-GCCTCCCAGGTTCAAG-(2)-ATTCTCCTGCCTCAGCCTC-(3)-T
GTAGCTGGGATTACAGGC-(6)-CACCATGCCCGGCTAAT-(4)-TTATTTTTAGTAGAGA-(15)-TTGGCCAGGCTGGTCT-(2)-AACTCCTGACCTCAGTGAT-(15)-
TCCCAAAGTGCTGGGATTACAGGCCG-(29)-TGCTCTTGCTGTGTCCACCAGGCTGGAGTGCA-(25)-TCTTGAATTCCTGGGC-(19)-AAGCCTC
CCAAGTAGCT-(7)-CAGGCACATACTACCA-(21)-TTTTTGTAGAGACAGG-(4)-TTACTATGTTGCCCAGACTGGTCTTGAACTCC-(41)-ATTACAGGTGTGAGCC
T-(57)-GTTTTTTGAGACAGAGT-(12)-GGCTCACTGCAGCCTC-(13)-GGCTCACTGGGAGTGCA-(13)-GGCTCACTGCAGCCTC-(2)-CCTCCCAAGGCTCAGG-(2)-ATCCTCTTGCCTCAGC-(16)
)-ACCAAGTAGCTGGGAC-(1)-

FIG. 12C

| FIG. 12A |
| FIG. 12B |
| FIG. 12C |

FIG. 12

(SEQ ID NO: 747,361):

>5'UTR OF ENST00000357256|ENSG00000148297_CHR=9_STRAND=REVERSE_UPSTREAM_UTR
-(66)-GGCTGGACGGCAGAGG-(128)-CCCAGGCTGGAGTGCA-(7)-GATCTCGGCTCACTGCG-(24)-ATTCTCCTGCCTCAGCCTC-(3)-AGTAGCTGGGATTACA
G-(7)-CCATCACGCCCGGCTA-(37)-TTGGTCAGGCTAGTCT-(2)-AACTCCTGACCTCAGGTGAT-(13)-TCCCAAAGTGCTGGGATTACAGGCGTGAGCCACCG-
(44)-GCAGAGACTGGAGGGA-(63)-

(SEQ ID NO: 747,362):

>5'UTR OF ENST00000355921|ENSG00000174652_CHR=19_STRAND=REVERSE_UPSTREAM_UTR
-(7)-TCTGTTGCCAGGCTGGAGTGCGTGGTCTTGCTCTGTGATCTCGGCTCACTGCAACCTC-(3)-CTCTCAGGTTCAAGCGATTCTCCTGCCTCAGCCTCAGTAGCT
GGGATT-(3)-AGGCATGCACTACCAT-(25)-TAGAGATGGGGTTTCACCAC-(1)-TTGCCCAGGCTGGTCT-(2)-AACTCCTGACCTCAAC-(19)-TCCCAAAGTGCT
GGGATTACAGGCGTGAGCCACCG-(2)-CCCGGCCTGATTTTT-(257)-CTGGATAAAGAGAATG-(295)-GAGTCTTGCTCTGTTGCTCAGCCTGGAGTGCA-(7)-
GATCTCAGCTCATTGC-(7)-GCCCCCCAGGTTCAAG-(5)-TTCCTGCCTCAGCCTC-(3)-AGTAGCTGGGATTACAG-(12)-ACACCTGGCTAATTT-(5)-ATTTTAG
TAGAGATGG-(12)-TGGCCAGGATGGTCT-(11)-CCTCAAGTGATCTGCCTG-(8)-TCCCAAAGTGCTAGGATTACAGGTGAGCCATCA-(80)-TTCCTTATCT
GTAAA-(156)-GAATGACTTTGGGGTA-(41)-TTCTTTCTTTCCATG-(633)-

(SEQ ID NO: 747,363):

>5'UTR OF ENST00000355587|ENSG00000140264_CHR=15_STRAND=FORWARD_UPSTREAM_UTR
-(255)-ACATATTTTAAATTCT-(1004)-GAGTCTTGCTCTGTTGCCAGGCTGGAGTGCA-(8)-GTCTCAGGTTCACTGCA-(6)-GCCCTCTTGGGTTCAAG-(6)-TCCTA
CCTGCCTCCT-(1)-AGTAGCTGGGATTACAG-(5)-TACCACCATGTCCAGC-(12)-TTTTACTAGAGATGGGGTTT-(7)-TTGGCCAGGCTGGTCT-(4)-CTCCTGA
CCTCATGATC-(14)-TCCCAAAGTGCTGGGATTACAGGCATGAGCCACCG-(253)-GAATGGGCAAAAGCTG-(125)-GTCTTGCTCTGTCACC-(1)-AGGCTAGAG
TGCAGTG-(7)-TTCAGCTCACTGCAACCT-(2)-GCCTCCCGGGTTCAAG-(10)-GCCTCCACCTCCTGAGCAGCTGGGATTACAGG-(7)-CACCATGCCCGGCTAA
T-(34)-TGTTAGCCAGGATTGTCT-(4)-CTCTTGACCTCGTGATC-(14)-TCCCAAAGTGCTGGGATTACAGGCGTGAGCCACTG-(379)-CAATGTTTTACAGTTT-(7
0)-CTGAAGGTTACACAGAGC-(321)-GAGTGTGTGTGAGAGA-(406)-AACCCAGGAGGGTTGAA-(124)-ATCTGACCTTTCTCTC-(214)-TGTGCCAGGCCCAGGG-(3
03)-

(SEQ ID NO: 747,364):

>5'UTR OF ENST00000326880|ENSG00000120662_CHR=13_STRAND=REVERSE_UPSTREAM_UTR
-(101)-TTGTCGCCCACGCTGG-(13)-ATCTCAGTTCACTGCA-(6)-GCCTCCCAGGTTCAAG-(9)-TGCCTCAGCCTCCGA-(2)-AGCTAGGACTACAGGT-(10)-ACG
CTCAGCTAATTT-(18)-GATGGGGTTTCCCAT-(1)-TTGGCCAGGCTGGTCT-(2)-AACTCCTGACCTCAGA-(38)-CAGGCGTGAGCCACTG-(8)-ACATTTGGTAT
GTTT-(282)-TGAACAGGCAACTTACA-(105)-AATAATATTTTCTTCA-(312)-TGCTGGAGTGCAATGG-(9)-GGCTCACTGCAACCTC-(1)-GCCTCCTGGGTTCAGG-
(5)-CTCCTGCCTCAGACTC-(3)-AGTAGCTGGGATTACAG-(2)-GCCTCGCACCACCACGCCCGG-(27)-GTGTTTCACTATGTTG-(3)-GGGCGTGGTCTCGAACT-(1)-CTG
CCCTCAGGTGATC-(14)-TCCCAAAGTGCTGGGATTA-(2)-GGCGTGAGCCACCGCT-(46)-TAGATGAAACAAGATT-(24)-TATGCATGTATCTTA-(7)-TTTTTTTT
AAAGACT-(26)-

FIG. 13A

Note: Amino acid-coding regions for ten genes. The shown coding regions are mosaics composed of the 124 instances of 11 pyknons in various arrangements. It is important to remember that the shown pyknons have 40 or more copies in the genome's intergenic and intronic regions. The string (xx) indicates the number of nucleotides, xx, that separate the surrounding pyknons. To appreciate the importance of this picture it suffices to keep track of the number of copies and relative arrangement of the four pyknons AAATGTGAAGAATGTG (SEQ ID NO: 747,369), TCATACTGGAGAGAAA (SEQ ID NO: 747,366), ACAAGTGTGAAGAATG (SEQ ID NO: 747,367) and CATACTGAAGAGAAAC (SEQ ID NO: 747,368) in each of the shown sequences. All of these genes encode C2H2 type zinc-finger proteins: ENST00000356096 codes for a negative regulator of osteoclast differentiation and is involved in DNA-dependent regulation of transcription; ENST00000357002 encodes a hematopoietic-cell-derived zinc-finger protein that is involved in the negative regulation of transcription from the Pol-II promoter; the products of ENST00000335117 and ENST00000331027 are known to be involved in DNA-dependent transcription regulation.

(SEQ ID NO: 747,369):

>AMINO-ACID CODING REGION OF ENST00000335117||ENSG00000160321_CHR=19_STRAND=REVERSE
-(166)-AAGGAAAAAACCTTT-(74)-AGCAGAGCATAAAAGA-(50)-ATTTACAGTTTAAAAA-(259)-AAATGTGAAGAATGTG-(46)-TCATACTGGAGAGAAA-(90)-AAATGTGAAGAATGTG-(46)-TCATACTGGAGAGAAA-(6)-AAATGTGAAGAATGTG-(68)-AAATGTGAAGAATGTG-(46)-TCATACTGGAGAGAAA-(6)-AAATGTGAAGAATGTG-(68)-AAATGTGAAGAATGTG-(46)-TCATACTGGAGAGAAA-(6)-AAATGTGAAGAATGTG-(130)-TCATACTGGAGAGAAA-(6)-AAATGTGAAGAATGTG-(46)-TCATACTGGAGAGAAA-(66)-

(SEQ ID NO: 747,370):

>AMINO-ACID CODING REGION OF ENST00000331027||ENSG00000182111_CHR=7_STRAND=FORWARD
-(48)-AAATGTGAAGAATGTG-(83)-AAATGTGAAGAATGTG-(46)-TCATACTGGAGAGAAA-(68)-TCATACTGGAGAGAAA-(65)-TCATACTGGAGAGAAA-(90)-AAATGTGAAGAATGTG-(130)-TCATACTGGAGAGAAA-(68)-TCATACTGGAGAGAAA-(6)-AAATGTGAAGAATGTG-(46)-TCATACTGGAGAGAAA-(6)-AAATGTGAAGAATGTG-(80)-AAATGTGAAGAATGTG-(46)-TCATACTGGAGAGAAA-(6)-AAATGTGAAGAATGTG-(46)-TCATACTGGAGAGAAA-(6)-AAATGTAAAGAATGTG-(46)-TCATACTGGAGAGAAA-(6)-AAATGTGAAGAATGTG-

FIG. 13B (SEQ ID NO: 747,371):

>AMINO-ACID CODING REGION OF ENST00000341265||ENSG00000182141_CHR=13_STRAND=REVERSE
-(204)-AAATGTGAAGAATGTG-(46)-TCATACTGGAGAGAAA-(6)-AAATGTGAAGAATGTG-(236)-AAATGTGAAGAATGTG-(47)-CATACTGAAGAGAAAC-(5)-AAATGTGAAGAATGTG-(56)-TGTGAAAAATGTGGCA-(191)-AAATGTGAAGAATGTG-(65)-AAATGTGAAGAATGTG-(68)-AAATGTGAAGAATGTG-(46)-TCATACTGGAGAGAAA-(36)-

(SEQ ID NO: 747,372):

>AMINO-ACID CODING REGION OF ENST00000357002||ENSG00000183850_CHR=19_STRAND=FORWARD
-(93)-AATTTATATAGAAATG-(185)-TCTTTTCAAAAAGCAA-(34)-TTTACAGTTAAGAAAA-(95)-TGATAAATATTTGAAA-(147)-AAATGTAAAGAATGTG-(152)-AAATGTGAAGAATGTG-(46)-TCATACTGGAGAGAAA-(68)-ACAAGTGTGAAGAATG-(50)-ACACTGGAGAGAAACC-(4)-AAATGTGAAGAATGTG-(46)-TCATACTGGAGAGAAA-(152)-ACAAGTGTGAAGAATG-(4)-ACAAGTGTGAAGAATG-(70)-AAATGTGAAGAATGTG-(48)-ACACTGGAGAGAAACC-(4)-AAATGTGAAGAATGTG-(46)-TCATACTGGAGAGAAA-(6)-AAATGTGAAGAATGTG-(47)-CATACTGAAGAGAAAC-(8)-TGTGAAAAATGTGGCA-(43)-TCATACTGGAGAGAAA-(6)-AAATGTGAAGAATGTG-(68)-AAATGTGAAGAATGTG-(158)-

(SEQ ID NO: 747,373):

>AMINO-ACID CODING REGION OF ENST00000330020||ENSG00000184624_CHR=18_STRAND=FORWARD
-(204)-AAATGTGAAGAATGTG-(10)-TAAACAATTCTCAAAA-(20)-TCATACTGGAGAGAAA-(6)-AAATGTGAAGAATGTG-(236)-AAATGTGAAGAATGTG-(47)-CATACTGAAGAGAAAC-(5)-AAATGTGAAGAATGTG-(31)-TCATACTGGAGAGAAA-(9)-TGTGAAAAATGTGGCA-(197)-AAATGTGAAGAATGTG-(47)-CATACTGAAGAGAAAC-(68)-CATACTGAAGAGAAAC-(5)-AAATGTGAAGAATGTG-(46)-TCATACTGGAGAGAAA-(36)-

(SEQ ID NO: 747,374):

>AMINO-ACID CODING REGION OF ENST00000355326||ENSG00000185037_CHR=7_STRAND=REVERSE
-(21)-CAGCCAGAGCCAGGGCA-(232)-AAAGAAACATTTCAAA-(143)-TCATACTGGAGAGAAA-(68)-TCATACTGGAGAGAAA-(90)-AAATGTGAAGAATGTG-(4)-6)-TCATACTGGAGAGAAA-(149)-TCATACTGGAGAGAAA-(174)-AAATGTGAAGAATGTG-(130)-TCATACTGGAGAGAAA-(6)-AAATGTGAAGAATGTG-(152)

FIG. 13C (SEQ ID NO: 747,375):

>AMINO-ACID CODING REGION OF ENST00000356194||ENSG00000196081_CHR=7_STRAND=FORWARD
-(132)-AAATGTGAAGAGAATGTG-(65)-AAATGTGAAGAATGTG-(68)-AAATGTGAAGAATGTG-(130)-TCATACTGGAGAGAAA-(68)-TCATACTGGAGAGAAA-(6
8)-TCATACTGGAGAGAAA-(65)-AATTCATATGAATTG-(9)-AAATGTGAAGAATGTG-(29)-ACTAATCATAAGAGAA-(3)-ACACTGGAGAGAAACC-(4)-AAAT
GTGAAGAATGTG-(68)-AAATGTGAAGAATGTG-(13)-

(SEQ ID NO: 747,376):

>AMINO-ACID CODING REGION OF ENST00000356096||ENSG00000197372_CHR=19_STRAND=REVERSE
-(307)-AAAAATGTGGAAATGA-(130)-TTTAATAAATTTTCAC-(44)-AAATGTAAAGAATGTG-(39)-AAAGAAAATTATACCAA-(94)-AAATGTGAAGAATGTG-(68)-
AAATGTGAAGAATGTG-(152)-AAATGTGAAGAATGTG-(13)-ACACTCCTCAGCCCTT-(19)-ACACTGGAGAGAAACC-(4)-AAA
TGTGAAGAATGTG-(66)-ACAAGTGTGAAGAATG-(70)-AAATGTGAAGAATGTG-(46)-TCATACTGGAGAGAAA-(105)-

(SEQ ID NO: 747,377):

>AMINO-ACID CODING REGION OF ENST00000345030||ENSG00000198153_CHR=7_STRAND=FORWARD
-(21)-CAGCCAGAGCAGGGCA-(232)-AAAGAAACATTTCAAA-(143)-TCATACTGGAGAGAAA-(68)-TCATACTGGAGAGAAA-(90)-AAATGTGAAGAATGTG-(4
6)-TCATACTGGAGAGAAA-(152)-AAATGTGAAGAATGTG-(174)-AAATGTGAAGAATGTG-(130)-TCATACTGGAGAGAAA-(6)-AAATGTGAAGAATGTG-(253)
-TCATACTGGAGAGAAA-(17)-

(SEQ ID NO: 747,378):

>AMINO-ACID CODING REGION OF ENST00000357051||ENSG00000198584_CHR=10_STRAND=REVERSE
-(230)-TTTACAAATAAGAAAA-(174)-AAATGTAAAGAATGTG-(47)-CATACTGAAGAGAAAC-(87)-ACAAGTGTGAAGAATG-(70)-AAATGTGAAGAATGTG-(16
1)-AAATGTGAAGAATGTG-(68)-AAATGTGAAGAATGTG-(47)-CATACTGAAGAGAAAC-(5)-AAATGTGAAGAATGTG-(47)-CATACTGAAGAGAAAC-(10)-TG
AAGAATGTATCAGA-(41)-TCATACTGGAGAGAAA-(30)-

FIG. 13

| FIG. 13A |
| FIG. 13B |
| FIG. 13C |

NOTE: PROBABILITY DENSITY FUNCTION (SOLID LINE) AND THE CORRESPONDING CUMULATIVE (DASHED LINE) FOR THE VARIABLE REPRESENTING THE FRACTION OF THE INSTANCES OF PYKNONS WHICH ARE LOCATED IN REGIONS THAT ARE FREE OF REPEATS.

FIG. 15

| GO TERM | 5' UTR | | CODING | | 3' UTR | |
|---|---|---|---|---|---|---|
| | ENRICHMENT DEPLETION | \|log(p-value)\| | ENRICHMENT DEPLETION | \|log(p-value)\| | ENRICHMENT DEPLETION | \|log(p-value)\| |
| DNA CATABOLISM | 39.54 | 19.88 | | | 89.64 | 23.05 |
| MUSCLE CELL DIFFERENTIATION | 33.85 | 27.11 | 47.16 | 28.08 | | |
| REGULATION OF TRANSCRIPTION, DNA-DEPENDENT | 255.36 | 10.88 | 381.97 | 5.49 | 965.04 | 27.11 |
| REGULATION OF PHYSIOLOGICAL PROCESS | 244.20 | 8.66 | 425.77 | 5.14 | 1096.37 | 22.11 |
| NUCLEO-BASE, SIDE, TIDE, AND NUCLEIC ACID METABOLISM | 290.72 | 11.57 | 1269.93 | 46.78 | 743.14 | 10.27 |
| REGULATION OF METABOLISM | 233.19 | 9.58 | 494.99 | 8.95 | 1018.81 | 27.33 |
| DNA TRANSPOSITION | | | 462.51 | 229.02 | 337.92 | 13.86 |
| DNA METABOLISM | 82.90 | 2.84 | 1219.01 | 155.71 | -316.64 | 8.61 |
| DNA REPLICATION | | | 660.51 | 154.68 | -149.86 | 7.10 |
| MORPHOGENESIS | -117.73 | 3.27 | 287.34 | 4.43 | -488.46 | 9.93 |
| ORGANOGENESIS | -195.48 | 6.58 | -208.11 | 2.34 | -428.31 | 9.26 |
| DEFENSE RESPONSE TO BACTERIA | -27.87 | 4.33 | -94.99 | 10.88 | -185.21 | 34.41 |
| DETECTION OF EXTERNAL STIMULUS | -74.31 | 5.18 | -351.11 | 13.97 | -318.25 | 15.72 |
| ORGANISMAL PHYSIOLOGICAL PROCESS | -136.14 | 3.06 | -607.27 | 15.84 | -616.45 | 11.86 |
| RESPONSE TO EXTERNAL STIMULUS | -156.15 | 7.91 | -725.13 | 34.01 | -694.40 | 23.25 |

NOTE: PARTIAL LIST OF BIOLOGICAL PROCESSES WHOSE CORRESPONDING GENES SHOW SIGNIFICANT ENRICHMENT (LIGHT SHADED CELLS) OR DEPLETION (DARK SHADED CELLS) IN PYKNON INSTANCES IN THEIR 5'UTR, CR OR 3'UTR. ALL SHOWN log(p-values) HAVE BEEN BONFERRONI-CORRECTED. THOSE OF THE TERMS THAT ARE CONSISTENTLY ENRICHED (RESP. DEPLETED) IN ALL THREE REGIONS ARE COLORED LIGHT SHADE (RESP. DARK SHADE).

NOTE: PYKNONS AND THEIR NATURAL BOUNDARIES: PROBABILITY DENSITY FUNCTIONS FOR THE DISTANCE BETWEEN THE STARTING POINTS OF CONSECUTIVE INSTANCES OF THE PYKNONS, SHOWN SEPARATELY FOR EACH OF THE THREE STUDIED REGIONS, NAMELY 5'UTRs, CRs AND 3'UTRs. THE DISTRIBUTIONS ARE TAIL-HEAVY AND ONLY A PORTION OF THEM IS SHOWN. NOTE THE PEAKS AT ABSCISSAS 18, 22, 24, 26, 29, 30 AND 31.

NOTE: PYKNONS AND THEIR NATURAL BOUNDARIES. PROBABILITY DENSITY FUNCTIONS FOR THE NUMBER OF INTERGENIC (TOP) AND INTRONIC (BOTTOM) COPIES OF THE VARIABLE-LENGTH STRINGS DERIVED BY COUNTING THE INSTANCES OF 3'UTR-CONSERVED PYKNONS AFTER HAVING SHIFTED THEM TO THE RIGHT BY d POSITIONS. IN BOTH CASES, THE CURVES THAT CORRESPOND TO d=0 ARE FOR THE PYKNONS IN $P_{3'UTR}$.

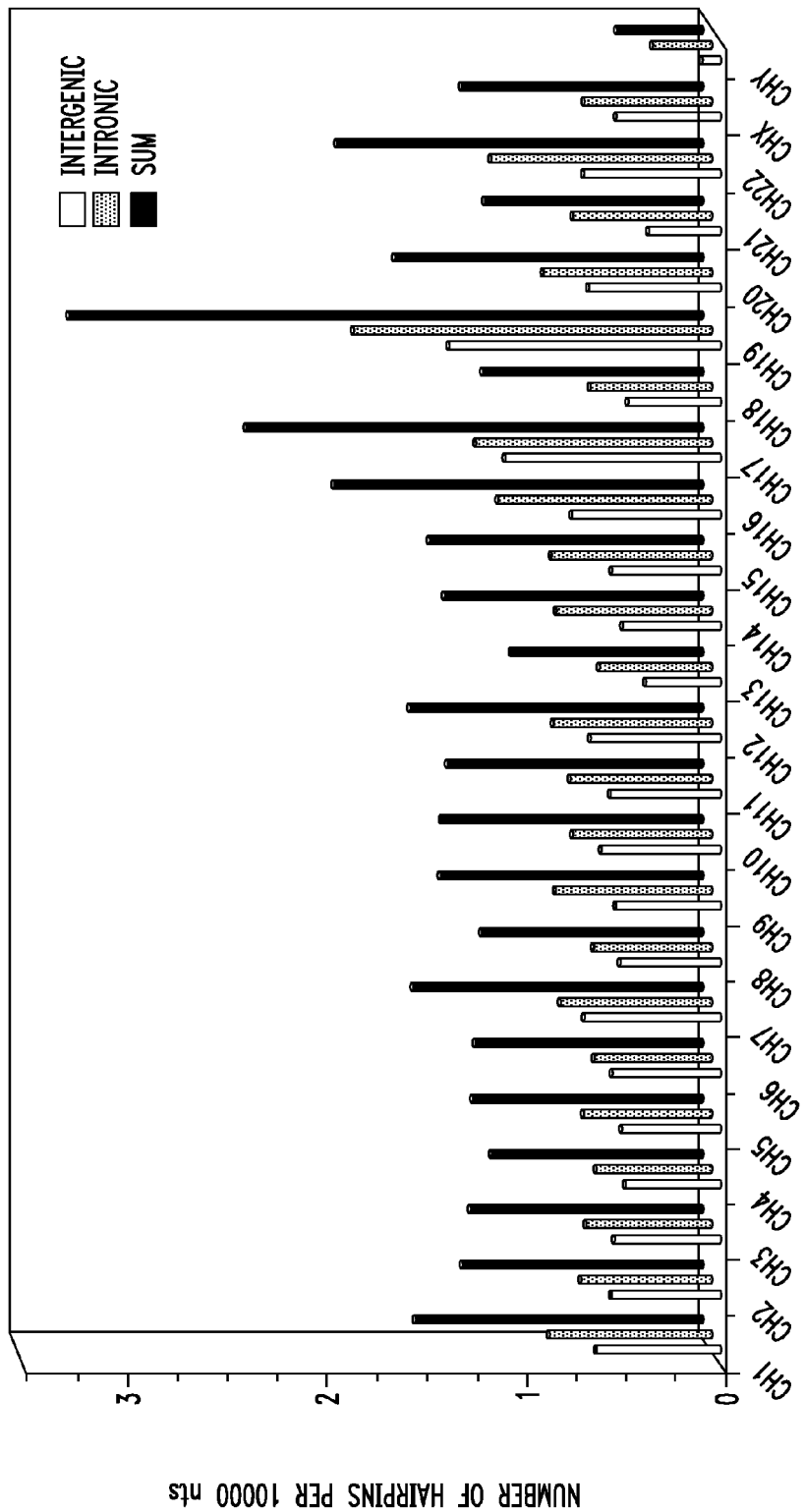

FIG. 18

NOTE: NUMBER OF INTERGENIC/INTRONIC NEIGHBORHOODS, GENERALLY 60 TO 80 NUCLEOTIDES IN LENGTH, EACH OF WHICH CONTAINS THE REVERSE-COMPLEMENT OF A PYKNON AND IS PREDICTED TO FORM DOUBLE-STRANDED, ENERGETICALLY-STABLE, HAIRPIN-SHAPED RNA SECONDARY STRUCTURES – THE NUMBER IS GIVEN PER 10,000 nts OF SEQUENCE. RESULTS ARE SHOWN SEPARATELY FOR EACH CHROMOSOME AND FOR THE INTERGENIC AND INTRONIC REGIONS. THE AVERAGE NUMBER OF HAIRPINS PER 10,000 nts INDEPENDENT OF PROVENANCE IS ALSO SHOWN IN SUM.

FIG. 19

| PATTERN SET/ REGION | POSITIONS COVERED IN CORRESPONDING REGION OF LISTED GENOME PER 10,000 NUCLEOTIDES | | | | | | |
|---|---|---|---|---|---|---|---|
| | HAS | CFA | MMU | RNO | GGA | DME | CEL |
| $P_{5'UTR}$/5'UTR | 382.2 | 43.0 | 20.7 | 14.2 | 9.7 | 22.4 | 5.8 |
| $P_{CODING}$/CODING | 304.1 | 88.3 | 57.4 | 61.1 | 28.4 | 25.2 | 14.7 |
| $P_{3'UTR}$/3'UTR | 733.3 | 152.4 | 82.6 | 64.9 | 42.1 | 65.9 | 57.1 |

NOTE: FOR EACH OF THE THREE REGIONS AND EACH GENOME IN TURN, WE REPORT THE NUMBER OF POSITIONS PER 10,000 NUCLEOTIDES THAT ARE COVERED BY INSTANCES OF THE HUMAN PYKNONS: WE USE THE PATTERNS CONTAINED IN THE SET $P_X$ TO SEARCH REGION X OF THE GENOME X={5'UTR, CODING, 3'UTR} - HSA=HUMAN, CFA=DOG, MMU=MOUSE, RNO=RAT, GGA=CHICKEN, DME=FRUIT-FLY, CEL=WORM.

FIG. 20

| GENOME | NUMBER OF HUMAN PYKNONS WITH ≥ 1 INSTANCE IN THE CORRESPONDING REGION OF LISTED GENOME | | | TOTAL SIZE OF INTERGENIC/INTRONIC REGION (BOTH STRANDS) | INTERGENIC/INTRONIC POSITIONS (BOTH STRANDS) COVERED BY HUMAN PYKNONS | |
|---|---|---|---|---|---|---|
| | $P_{5'UTR}$ | $P_{CODING}$ | $P_{3'UTR}$ | | in nts | per 10,000 nts |
| HSA | 12,267 | 54,396 | 67,544 | 6,093,304,675 | 692,393,548 | 1,136 |
| CFA | 234 | 6,170 | 1,351 | 4,826,002,769 | 87,572,989 | 181.5 |
| MMU | 400 | 8,767 | 6,160 | 5,216,777,897 | 89,568,584 | 171.7 |
| RNO | 170 | 3,424 | 1,644 | 5,409,179,291 | 82,635,080 | 152.8 |
| GGA | 51 | 1,786 | 718 | 1,855,717,211 | 9,262,198 | 49.91 |
| DME | 174 | 1,335 | 1,175 | 228,181,521 | 1,562,508 | 68.5 |
| CEL | 20 | 996 | 790 | 170,879,577 | 1,634,993 | 95.7 |

NOTE: SEEKING INSTANCES OF THE HUMAN PYKNONS IN THE INTERGENIC/INTRONIC REGIONS OF OTHER GENOMES. SEPARATELY FOR SEVEN GENOMES AND FOR EACH 5'UTR, CR AND 3'UTR WE SHOW THE NUMBER OF HUMAN PYKNONS THAT ARE CONSERVED IN THE HUMAN GENOME AND THE CORRESPONDING REGION OF THE j-th GENOME. ALSO, FOR ALL THE PYKNONS WHOSE INSTANCES APPEAR IN COUNTERPART REGIONS OF BOTH THE HUMAN AND THE j-th GENOME, WE SEARCH THE j-th GENOME'S INTERGENIC/INTRONIC REGIONS FOR INSTANCES OF THESE COMMON PYKNONS AND REPORT THE TOTAL NUMBER OF POSITIONS COVERED BY THEIR COPIES; ALSO LISTED IS THE NUMBER OF COVERED POSITIONS PER 10,000 NUCLEOTIDES. HSA=HUMAN, CFA=DOG, MMU=MOUSE, RNO=RAT, GGA=CHICKEN, DME=FRUIT-FLY, CEL=WORM.

RIBONUCLEIC ACID INTERFERENCE MOLECULES AND BINDING SITES DERIVED BY ANALYZING INTERGENIC AND INTRONIC REGIONS OF GENOMES

CROSS-REFERENCE TO RELATED APPLICATIONS

The present application is a continuation-in-part of, and claims priority to, pending U.S. patent application identified as Ser. No. 11/367,512, filed Mar. 3, 2006, and entitled "Techniques for Linking Non-Coding and Gene-Coding Deoxyribonucleic Acid Sequences and Applications Thereof," the disclosure of which is incorporated by reference herein.

FIELD OF THE INVENTION

The present invention relates to genes and, more particularly, to ribonucleic acid interference molecules.

BACKGROUND OF THE INVENTION

It is known that the intergenic and intronic regions comprise most of the genomic sequence of higher organisms. The intergenic and intronic regions are collectively referred to as the "non-coding region" of an organism's genome, as opposed to the "gene-" or "protein-coding region" of the genome. Even though recent work suggested participation of the intergenic and intronic regions in a regulatory role, for the most part, their true function remains elusive. The search for conserved motifs, presumed to be regulatory and control signals, in regions upstream of the 5' untranslated regions (5'UTRs) of genes, has been the focus of research activities for many years.

More recently, researchers began studying the 3' untranslated regions (3'UTRs) of genes where they discovered conserved regions and showed them to be functionally significant, in direct analogy to the cis-motifs of promoter regions. Large-scale comparative analyses allowed researchers to also study conservation in the vicinity of genes and elsewhere in the genome with great success. However, these studies were carried out on only a handful of organisms at a time because of the magnitude of the necessary computations.

The analysis of 3'UTRs intensified further after it was discovered that they contain binding sites that are targeted by short interfering ribonucleic acids (RNAs) that induce the post-transcriptional control of the corresponding gene's expression through either messenger RNA (mRNA) degradation or translational inhibition. Accumulating evidence that non-coding RNAs control developmental and physiological processes and that a considerable part of the human genome is transcribed, has helped researchers identify "functional" elements in areas of the genome that are not associated with protein-coding regions.

SUMMARY OF THE INVENTION

Sequences that can be used in the context of gene regulation are provided. Such sequences may be referred to herein as "pyknon sequences" or simply "pyknons."

In one aspect of the invention, at least one sequence comprising at least one of one or more sequences having SEQ ID NO: 1 through SEQ ID NO: 747,326 is provided. One or more of the provided sequences may be computationally predicted, e.g., from publicly available genomes, using a method based on pattern discovery.

In another aspect of the invention, a method for regulating the expression of a transcript comprises the step of said transcript containing a region that corresponds to at least one of the provided sequences having SEQ ID NO: 1 through SEQ ID NO: 747,326, the region being targeted either by a naturally occurring, or appropriately designed, interfering RNA molecule that regulates the expression of said transcript through post-transcriptional silencing.

In yet another aspect of the invention, a method for regulating the expression of a transcript comprises the step of at least one of the provided sequences having SEQ ID NO: 1 through SEQ ID NO: 747,326 being used to design an interfering RNA molecule that contains a region that corresponds to the reverse complement of one or more of the one or more sequences having SEQ ID NO: 1 through SEQ ID NO: 747,326, the interfering molecule regulating, through post-transcriptional silencing, one or more transcripts that contain said sequence of the one or more sequences having SEQ ID NO: 1 through SEQ ID NO: 747,326, or a substantial fraction thereof.

A more complete understanding of the present invention, as well as further features and advantages of the present invention, will be obtained by reference to the following detailed description and drawings.

BRIEF DESCRIPTION OF THE DRAWINGS

FIG. 3 is a diagram illustrating a probability density function for a number of 16-mers with a given number of copies in a random input set, according to an embodiment of the present invention;

FIG. 4 is a diagram illustrating a preprocessing methodology, according to an embodiment of the present invention;

FIG. 5 is a diagram illustrating pattern specificity and number of appearances, according to an embodiment of the present invention;

FIG. 6 is a diagram illustrating a process for determining logically distinct patterns, according to an embodiment of the present invention;

FIG. 11 is a diagram illustrating combinatorial arrangements of pyknons in 3'UTRs, according to an embodiment of the present invention;

FIG. 12 is a diagram illustrating combinatorial arrangements of pyknons in 5'UTRs, according to an embodiment of the present invention;

FIG. 13 is a diagram illustrating combinatorial arrangements of pyknons in amino acid-coding regions, according to an embodiment of the present invention;

FIG. 15 is a diagram illustrating a partial list of biological processes whose corresponding genes show significant enrichment or depletion in pyknon instances in their 5'UTRs, CRs or 3'UTRs, according to an embodiment of the present invention;

FIG. 18 is a diagram illustrating the number of intergenic/intronic neighborhoods each of which contains the reverse complement of a pyknon and is predicted to fold into a hairpin-like structure, according to an embodiment of the present invention;

FIG. 19 is a diagram illustrating the number of positions per 10,000 nucleotides that human pyknons cover in other genomes, according to an embodiment of the present invention;

FIG. 20 is a diagram illustrating the number of human pyknons that can be found in the untranslated and coding regions of other genomes, and the number of intergenic/intronic positions that human pyknons cover in other genomes, according to an embodiment of the present invention;

DETAILED DESCRIPTION OF PREFERRED EMBODIMENTS

Figure 1:
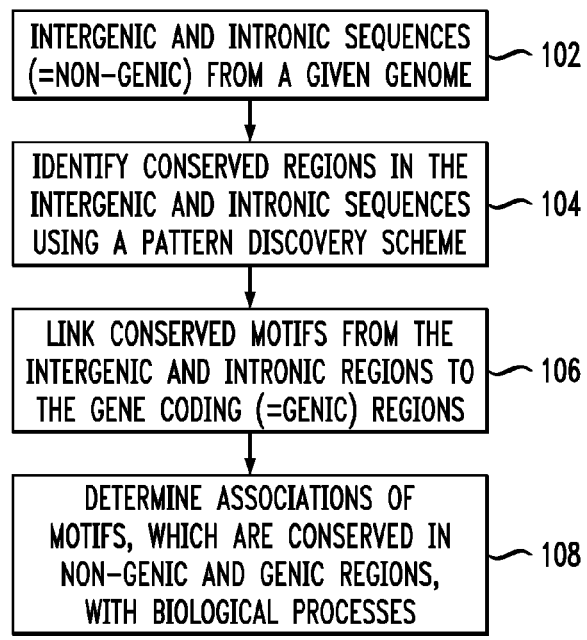
FIG. 1 is a diagram illustrating an exemplary methodology for determining associations between non-coding and gene coding sequences in a genome of an organism, according to an embodiment of the present invention.

FIG. 1 is a diagram illustrating exemplary methodology 100 for determining associations between non-coding and gene coding sequences in a genome of an organism. In step 102, non-coding sequences from the genome of an organism are obtained. Preferably, the non-coding sequences comprise intergenic and/or intronic sequences. As used herein, the term "intergenic" refers generally to any portion of a deoxyribonucleic acid (DNA) strand that is between gene sequences. Further, as used herein, the term "intronic" refers to any portion of a DNA strand that is encompassed by an intron.

According to one exemplary embodiment, the genome comprises the human genome. Further, as will be described below, the starting point of the present techniques may be the genome of a single organism, e.g., the human genome.

In step 104, conserved regions in the intergenic/intronic sequences are identified. As will be described in detail below, these conserved regions may be identified by used pattern discovery techniques to identify patterns existing in the sequences.

In step 106, the identified conserved regions (also referred to as 'conserved motifs') of the intergenic/intronic non-coding sequences are linked to gene coding regions of the genome. Specifically, instances of the patterns, described, for example, in conjunction with the description of step 104, above, may be searched for in gene coding regions of the genome. For example, as will be described in detail below, sequences will be identified, e.g., that are at least 16 nucleotide bases in length and appear a minimum of 40 times in the non-coding region of a genome, and which also appear at least one time in the coding region of the genome. These identified sequences (motifs) link the coding and non-coding regions of the genome. As will also be described in detail below, linking the conserved regions and gene coding regions of the genome provides for an association to be made with the biological processes of the organism.

In step 108, as will be described in detail below, the identified motifs that link the non-genic and genic regions of a genome also provide for an association between these motifs and specific biological processes that even persists in organisms beyond the human genome.

As used herein, the phrase "conserved region" may also be referred to as a "conserved motif" or a "conserved block" or "an exceptionally-well-conserved block (EWCB)" or a "pyknon." The term "pyknon" is from the Greek adjective πυκνός/πυκνή/πυκνόν meaning "serried, dense, frequent."

Accordingly, using an unsupervised pattern discovery method, we processed the human intergenic and intronic regions and catalogued all variable-length patterns with identically conserved copies and multiplicities above what is expected by chance. Among the millions of discovered patterns, we found a subset of 127,998 patterns, termed pyknons, which have one or more additional non-overlapping instances in the untranslated and protein-coding regions of 30,675 transcripts from 20,059 human genes. The pyknons are found to arrange combinatorially in the 5' untranslated, coding, and 3' untranslated regions of numerous human genes where they form mosaics. Consecutive instances of pyknons in these regions exhibit a strong bias in their relative placement favoring distances of about 22 nucleotides. We also found that pyknons are enriched in a statistically significant manner in genes involved in specific processes, e.g., cell communication, transcription, regulation of transcription, signaling, transport, etc. For about $1/3^{rd}$ VP of the pyknons, the intergenic/intronic instances of their reverse complement lie within 382,244 non-overlapping regions, typically 60-80 nucleotides long, which are predicted to form double-stranded, energetically stable, hairpin-shaped RNA secondary structures; additionally, the pyknons subsume about 40% of the known microRNA sequences, thus suggesting a possible link with post-transcriptional gene silencing and RNA interference. Cross-genome comparisons revealed that many of the pyknons are also present in the 3'UTRs of genes from other vertebrates and invertebrates where they are over-represented in similar biological processes as in the human genome. These novel and unexpected findings suggest potential functional connections between the coding and non-coding parts of the human genome.

Thus, in accordance with an illustrative methodology of the invention, we examine whether highly specific patterns exist within a single genome that may act as targets or sources for such putative regulatory activity or as a 'vocabulary' for yet undiscovered mechanisms. Our analysis represents a substantial point of departure from previous efforts. First, we carry out all of the analysis on a single genome. Second, we seek patterns in the intergenic and intronic regions of the genome (not the UTRs or protein coding) regions. Third, the pattern instances transcend chromosomal boundaries. And, fourth, we rely on the unsupervised discovery of conserved motifs instead of searching schemes. In particular, we sought to discover identically conserved, variable-length motifs of certain minimum length but unlimited maximum length in human intergenic and intronic regions. We discovered more than 66 million motifs with multiplicities well above what is expected by chance. A sizeable subset of these motifs, referred to as the pyknons, have one or more additional instances in the untranslated and coding regions of almost all known human genes and exhibit properties that suggest the possibility of an extensive link between the non-genic and genic regions of the genome and a connection with post-transcriptional gene silencing (PTGS) and RNA interference (RNAi).

Figure 2:
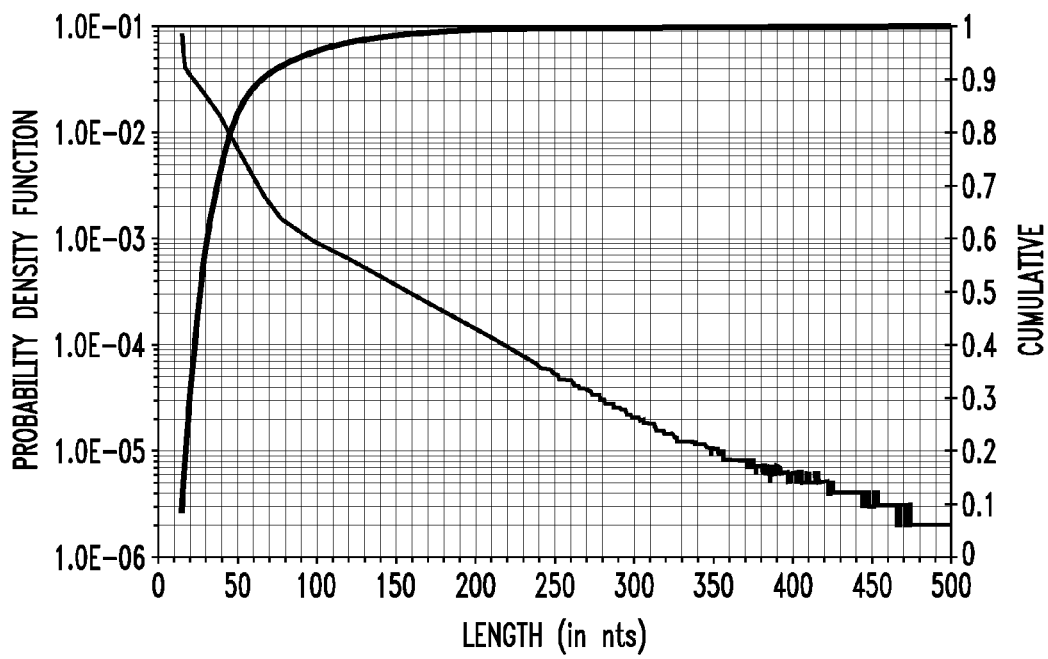
FIG. 2 is a diagram illustrating a probability density function and a cumulative distribution for lengths of patterns discovered in analyzed intergenic and intronic sequences of the human genome, according to an embodiment of the present invention.

As described, for example, in conjunction with the description of step 104 of FIG. 1, above, according to the techniques described herein, a pattern discovery step may be performed. We used the parallel version of a pattern discovery algorithm described in I. Rigoutsos et al., *Combinatorial Pattern Discovery in Biological Sequences: the TEIRESIAS Algorithm*, 14 BIOINFORMATICS 1, pgs. 55-67 (Jan. 1998) (hereinafter "Rigoutsos"), the disclosure of which is incorporated by reference herein. The pattern discovery (Teiresias) algorithm seeks variable-length motifs that are identically conserved across all of their instances, comprise a minimum of L=16 nucleotides and appear a minimum of K=40 copies in the processed input (see below regarding the values of L, K). The algorithm guarantees the reporting of all composition-maximal and length-maximal patterns satisfying these parameters. The input comprised the intergenic and intronic sequences (step 102 of FIG. 1) of the human genome from ENSEMBL Rel. 31 (see Stabenau, A., McVicker, G., Melsopp, C., Proctor, G., Clamp, M. & Birney, E. (2004) *Genome Res* 14, 929-33) for a total of 6,039,720,050 nucleotides. The input did not include the reverse complement of the 5' untranslated, amino acid coding or 3' untranslated regions of any human genes. This exclusion ensures that any discovered patterns are not connected in any way to sequences of known genes, protein motifs or domains. The algorithm ran on a shared-memory architecture with 128 Gigabytes of main memory and 8 processors running at a clock frequency of 1.75 GHz, and generated an initial set $P_{init}$ of 66+ million statistically significant patterns (see below). Most of the patterns in $P_{init}$ were a few tens of nucleotides in length. FIG. 2 shows the probability density function (in black) and cumulative distribution (in light gray) for the lengths of the more than 66 million patterns discovered in the analyzed intergenic and intronic sequences of the human genome. These patterns form the set $P_{init}$. As can be seen from FIG. 2, more than 95% of all discovered patterns are shorter than 100 nucleotides. Note that the primary Y-axis is logarithmic whereas the secondary is linear.

The Teiresias discovery algorithm that we used for this analysis requires the setting of three parameters: L, W and K. The parameter L controls the minimum possible size of the discovered patterns but has no bearing on the patterns' maximum length; the latter is not constrained in any way. The parameter W satisfies the inequality $W \geq L$ and controls the 'degree of conservation' across the various instances of the reported patterns: smaller (respectively, larger) values of W will tolerate fewer (respectively, more) mismatches across the instances. Since for this analysis, we are interested only in patterns with identically conserved instances, we set W=L (i.e., the patterns contained no "wild cards"). Finally, the parameter K controls the minimum required number of appearances before a pattern can be reported by the algorithm.

For a given choice of L, W and K, the algorithm guarantees the reporting of all patterns that have K or more appearances in the processed input and are such that any L consecutive (but not necessarily contiguous) positions span at most W positions. These patterns are generally overlapping: a given sequence location can simultaneously appear in multiple, distinct, non-redundant patterns. It is also important to stress three properties of the algorithm. First, as stated above, the value L does not impose any constraint on the maximum length of a pattern which is unbounded. Second, each reported pattern will be maximal in composition, i.e., it cannot be made more specific by specifying the value of a wildcard without decreasing the number of locations where it appears. And, third, each reported pattern will be maximal in length, i.e., it cannot be made longer without decreasing the number of locations where it appears. In this discussion, we use the terms pattern, block and motif interchangeably.

Opting for small L values generally permits the identification of shorter conserved motifs that may be present in the processed input, in addition to all longer ones—see above properties. Generally, for short motifs to be claimed as statistically significant they need to have a large number of copies in the processed input; requiring a lot of copies runs the risk of discarding bona fide motifs. On the other hand, larger values of L will generally permit the identification of statistically significant motifs even if these motifs repeat only a small number of times. This happens at the expense of significant decreases in sensitivity; i.e. bona fide motifs will be missed.

For our analysis, we have selected L=16, a value that strikes a balance between the desirable sensitivity (which favors lower L values) and achievable specificity (which favors higher L values). We stress that the maximality properties of the pattern discovery step ensure that we will be able to report any and all motifs that are 16 nucleotides or longer. And as explained above, we will set W=L.

The last parameter that needs to be set is K, the required number of appearances for a pattern to be reported. K needs to be set to a value that can ensure that the reported patterns could not have been derived from a random database with the same size as the input at hand. In order to determine this value, we used several randomly-shuffled versions of our intergenic and intronic input (of approximately 6 billion bases) and in there sought frequent, fixed-size 16-mers with all low-complexity 16-mers removed by NSEG (see Wootton, J. C. & Federhen, S. (1993) *Computers in Chemistry* 17, 149-163). The idea here is that if a randomly-shuffled version of our input set cannot give rise to any 16-mers that appear more than $K_X$ times, then it will also be true that no patterns exist in the input set that are longer than 16 nucleotides and have more than $K_X$ copies. Several iterations of this process allowed us to establish that $K_X$=23. FIG. 3 shows the probability density function for the number of 16-mers with a given number of copies in the random input set—note that both the X and Y axes are logarithmic. From this, it follows that a randomly-shuffled version of our input set cannot possibly give rise to patterns which are longer than 16 nucleotides and have more than 23 copies: in fact, as a pattern increases in length, the number of times it appears in a given input set can only decrease. We thus opted for the even larger threshold of K=40 for our pattern discovery step.

Before we sought to discover patterns in the intergenic and intronic regions of the human genome, we preprocessed the sequences and removed: a) all the regions that corresponded to 5' untranslated, coding and 3' untranslated regions of known genes; and, b) all the regions that were the reverse complement of 5' untranslated, coding and 3' untranslated regions of known genes. We show this preprocessing step pictorially in FIG. 4. The genomic input before the preprocessing step is shown above the arrow, and the input upon which pattern discovery is run is shown below the arrow.

Under the assumption that all four nucleotides are equiprobable (i.e., $p_A=p_T=p_C=p_G=\frac{1}{4}$), independent, and, identically distributed, we estimate the probability p of a pattern of length l to be $p=4^{-l}$. We can compute the probability $Pr_k$ to observe k instances of a given pattern in a database of size D (D>>1) to be $Pr_k \approx (pD)^k e^{-pD}/k!$ (Poisson distribution). The least specific pattern that our method will discover is one that is the shortest possible (i.e., l=L=16) and appears the smallest allowed number of times (i.e., k=K=40): if D=6.0× $10^9$ bases (=all chromosomes and both strands), then $Pr_k=1.95\times 10^{-43}$.

We now revisit this calculation by taking into account the nucleotides' natural probability of occurrence. Using ENSEMBL Release 31 from May 2005 (based on NCBI Assembly 35 from July 2004) as our database D, we see that the fraction of bases that are undetermined across the 24 human chromosomes ranges from roughly 1.2 to 61.0% for the Y chromosome. Of course, the following constraints should apply: $p_A=p_T$ and $p_C=p_G$. Since the fractions of nucleotides that are undetermined are not equal, the required balance between A/T and C/G is only approximately preserved. Ignoring the unspecified positions and recomputing ratios based on the remaining bases, we find that $p_A=p_T\approx 3/10$ and $p_C=p_G\approx 2/10$.

Let us consider a block of size 1 and let "match" indicate the match between the i-th character of this block and a character c at position in a database D of nucleotide sequences. Then it is easy to see that:

$$Pr(\text{match}) = Pr(\text{match with } c)$$
$$= Pr(\text{match} \wedge (c \text{ is one of } A, C, G, T))$$
$$= Pr((\text{match} \wedge c = A) \vee (\text{match} \wedge c = C) \vee (\text{match} \wedge c = G) \vee (\text{match} \wedge c = T))$$
$$= Pr(\text{match} | A)Pr(A) + Pr(\text{match} | C)Pr(C) + Pr(\text{match} | G)Pr(G) + Pr(\text{match} | T)P(T)$$
$$= Pr(A)Pr(A) + Pr(C)Pr(C) + Pr(G)Pr(G) + Pr(T)P(T)$$
$$= Pr(A)^2 + Pr(C)^2 + Pr(G)^2 + Pr(T)^2$$
$$= p_A^2 + p_C^2 + p_G^2 + p_T^2$$
$$= 0.3^2 + 0.3^2 + 0.2^2 + 0.2^2$$
$$= 0.26$$

In this analysis, we consider blocks of length l with $l \geq 16$. Naturally, these shortest blocks will be associated with the largest probability p of observing a pattern accidentally—the value p decreases as the value of l increases. The probability that a block of length l=16 will have one instance in the database D is then $p_1 \triangleq Pr(\text{match})^{16} = (0.26)^{16}$ or $p_1=4.4*10^{-10}$.

An alternative way to approach this is to assume that the block of length l is constructed by drawing from the same nucleotide distribution that gives rise to the database D. Then, a block of length l=16 would comprise $p_A*16\approx 5$ A's, $p_C*16\approx 3$ C's, $p_G*16 \approx 3$ G's and $p_T*16\approx 5$ T's. Then, the probability that this block will arise accidentally is $p_2 \triangleq p_A^5 * p_C^3 * p_G^3 * p_T^5 = 3.8*10^{-10}$.

We can compute the probability of finding k accidental instances in a database D that contains $6\times 10^9$ bases where each of the instances is independent of all the preceding instances using the Poisson distribution $Pr_k \approx (pD)^k e^{-pD}/k!$. The probability $Pr_k$ that a 16-mer will appear k times with k=40 is equal to $4.5*10^{-33}$ (resp. $2.6*10^{-35}$) if $p_1$ (resp. $p_2$) is used in the calculation.

We thus can see that even if we take into account the natural frequency of appearance in the human genome of each of the four nucleotides, the probability that one of our discovered blocks is accidental remains very small even for blocks of size 16 that appear only 40 times.

Alternatively, we can estimate the significance of our patterns using z-scores: for the least specific patterns of length 16 that have exactly 40 identical copies we obtain the remarkably-high value of z=32.66. Longer patterns and patterns with more intergenic/intronic copies have even higher z-scores. These analyses confirm in different ways that every one of our discovered patterns is statistically significant and not the result of a random process. These conclusions hold true for the reverse complements of the discovered patterns as well and for the pyknons that are a subset of the discovered patterns $P_{init}$.

It is to be noted that we will use the terms "coding" and "coding region" (abbreviated as CR and CRs) to refer to the translated, amino-acid coding part of exons.

We now describe the step of determining which of the discovered patterns have additional instances in the 5'UTRs, CRs or 3'UTRs of known genes. Once the pattern discovery step has produced the set $P_{init}$ of variable length patterns, we processed it to identify 'logically distinct' patterns using the following approach. Let there be a recurrent logical unit which appears several times in the intergenic/intronic regions of the human genome; each one of its instances is assumed to have different lengths that reflect varying degrees of conservation. For simplicity, we assume here that different degrees of conservation will result in variable length instances of the pattern. We only seek patterns with identically-conserved instances so this is a correct assumption. For example's sake, we will assume that all variations of the logical unit contain an intact copy of an 18-nucleotide core motif; let TCCCATAC-CACGGGGAT (SEQ ID NO: 747,327) represent this core. As the instances of the logical unit become longer and thus more specific, the number of appearances in the input decreases. FIG. 5 shows this example in more detail. Several hypothetical variations of the logical unit are aligned around the common core motif and the number of instances is listed next to each variation.

We reasoned that these patterns should be processed in order of decreasing value of the total number of positions that they span: this number is simply the product of each pattern's length by the number of times it appears in the input. As patterns are examined in turn, some of them are selected and kept whereas others collide with earlier-made selections.

Two collision scenarios are possible and we examine them with the help of FIG. 6. Two blocks, light and darker gray, are shown therein together with a 'reference set' of sequences. The light gray block corresponds to a pattern that has already been examined and placed at all its instances. The instances of the darker gray block show the intended placements for the pattern currently under consideration. The blocks collide at two locations (they overlap in the first and second sequence) but the rest of their instances are disjoint. We have two possibilities regarding the handling of collisions. The darker gray block is kept if and only if there is at least one other location in the reference sequence set where it can be placed without generating a collision (e.g. the fifth and sixth sequences in FIG. 6). Alternatively, the darker gray block is kept if and only if it generates no collisions whatsoever with any block that has already been selected and placed. We have opted for the stricter, second choice: if a pattern's instance uses a position that has already been claimed by an earlier-selected pattern, then the pattern under consideration will be discarded and not considered further. Generally, it will be redundant variations of the same pattern that will generate collisions: only one pattern will be used to represent a core motif such as the one shown in FIG. 5.

The one remaining element is to decide which sequences to use as the reference set. We have chosen to use each of the 5'UTRs, CRs, and 3'UTRs in turn. Sub-selecting among the patterns in $P_{init}$ with the help of each of the 5' untranslated, coding and 3' untranslated regions gives rise to the pattern collections $P_{5'UTR}$, $P_{CODING}$ and $P_{3'UTR}$ respectively. The union of these sets, $P_{5'UTR} \cup P_{CODING} \cup P_{3'UTR}$ comprises the pyknons, i.e., patterns that were originally discovered in the intergenic and intronic regions of the human genome and which have additional instances in the 5' untranslated, coding and 3' untranslated regions of known human genes.

We used the above steps to determine which of the discovered patterns has additional instances in the untranslated and coding regions of genes. After filtering the surviving patterns for low-complexity with NSEG (Wootton, J. C. & Federhen, S. (1993) *Computers in Chemistry* 17, 149-163), we generated three patterns sets $P_{5'UTR}$, $P_{CODING}$ and $P_{3'UTR}$ that contained 12,267, 54,396 and 67,544 patterns respectively and had additional instances in 5'UTRs, CRs and 3'UTRs. The union of $P_{5'UTR} \cup P_{CODING} \cup P_{3'UTR}$ contained 127,998 patterns indicating that the three pattern sets are largely disjoint. We refer to these 127,998 patterns as pyknons.

Figure 7:
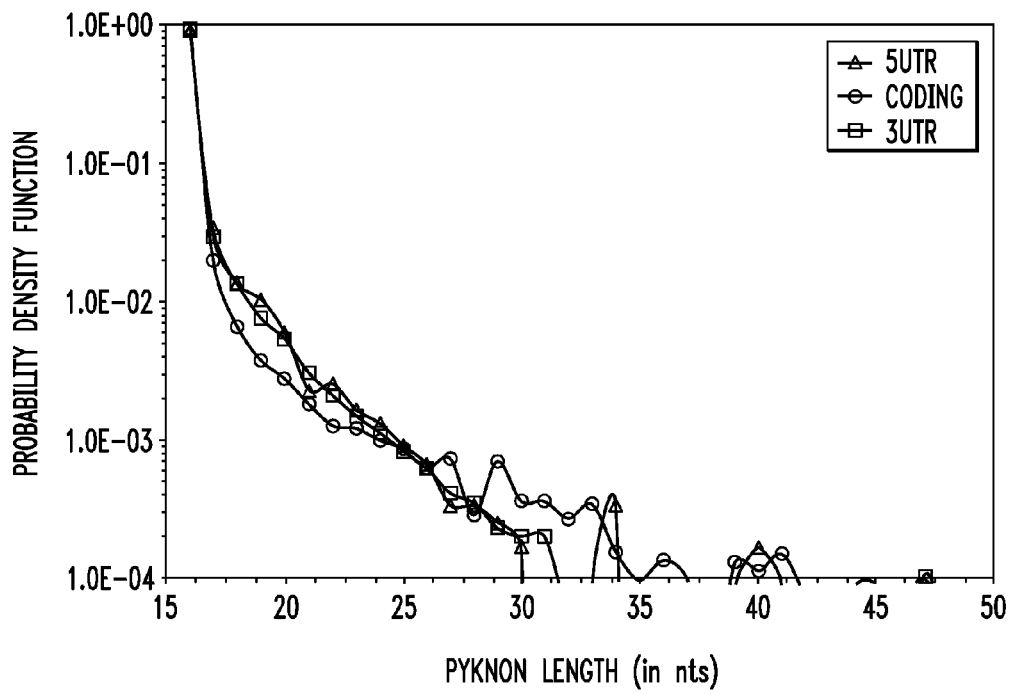
FIG. 7 is a diagram illustrating a probability density function for lengths of pyknons, according to an embodiment of the present invention.

We know describe some properties of the pyknons. The three patterns sets $P_{5'UTR}$, $P_{CODING}$ and $P_{3'UTR}$ contain 12,267, 54,396 and 67,544 blocks respectively. The union $P_{5'UTR} \cup P_{CODING} \cup P_{3'UTR}$ comprises the 127,998 pyknons. In FIG. 7, we show the probability density function for the length of the pyknons; the function is shown separately for each of the three subsets that make up the pyknon collection. Note that the Y-axis is logarithmic.

The patterns in each of the three collections, $P_{5'UTR}$, $P_{CODING}$ and $P_{3'UTR}$, fall into one of two types. "Type-A" patterns are patterns whose reverse complement is also present in the same collection (note that reverse palindromes are included among the type-A patterns). "Type-B" patterns are patterns whose reverse complement is absent from the collection. The breakdown for each of $P_{5'UTR}$, $P_{CODING}$ and $P_{3'UTR}$ is as follows: $P_{5'UTR}$ contains 217 type-A blocks and 11,835 type-B blocks; $P_{CODING}$ contains 1,038 type-A blocks and 52,330 type-B blocks; and $P_{3'UTR}$ contains 2,501 type-A blocks and 62,577 type-B blocks. The clear majority of the blocks in each of the three collections are type-B blocks.

Figure 8:
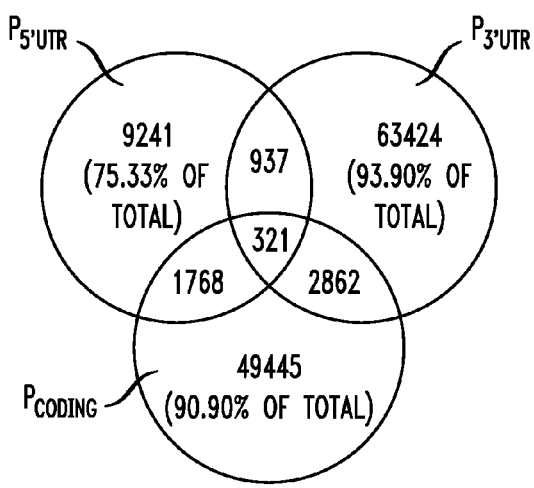
FIG. 8 is a diagram illustrating a number of blocks that are shared by three sets whose union makes up a pyknon collection, according to an embodiment of the present invention.

With respect to their content, the three collections are largely disjoint, a characteristic that presumably reflects sequence differences that are inherent to the actual 5'UTRs, CRs and 3'UTRs. FIG. 8 shows pictorially the relationship among the members of the three sets $P_{5'UTR}$, $P_{CODING}$ and $P_{3'UTR}$: note the small cardinalities of the various intersections.

Figure 9:
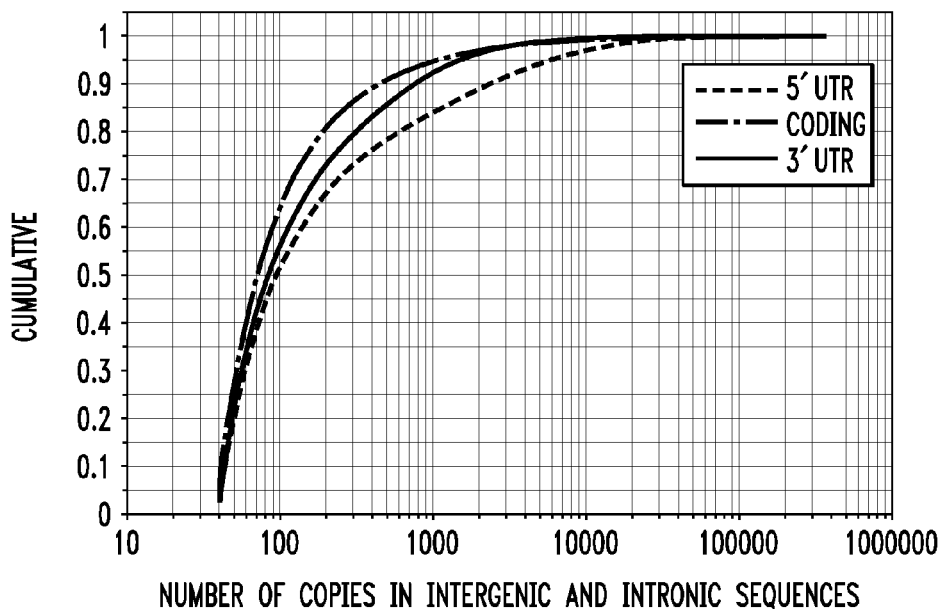
FIG. 9 is a diagram illustrating a cumulative function for a number of intergenic and intronic copies of pyknons, according to an embodiment of the present invention.

Finally, we comment on the number of intergenic and intronic copies of a pyknon. This number spans a very wide range of values with the most frequent pyknon having 356,989 copies—the minimum number of copies is, by design, equal to K=40. For about 95% of the pyknons, their intergenic/intronic copies are fewer than 2,000. FIG. 9 shows the cumulative distributions for the number of intergenic and intronic copies of the pyknons—the distribution is again shown separately for each of $P_{5'UTR}$, $P_{CODING}$ and $P_{3'UTR}$ in order to highlight the similarities and differences of the three sets.

Figure 10:
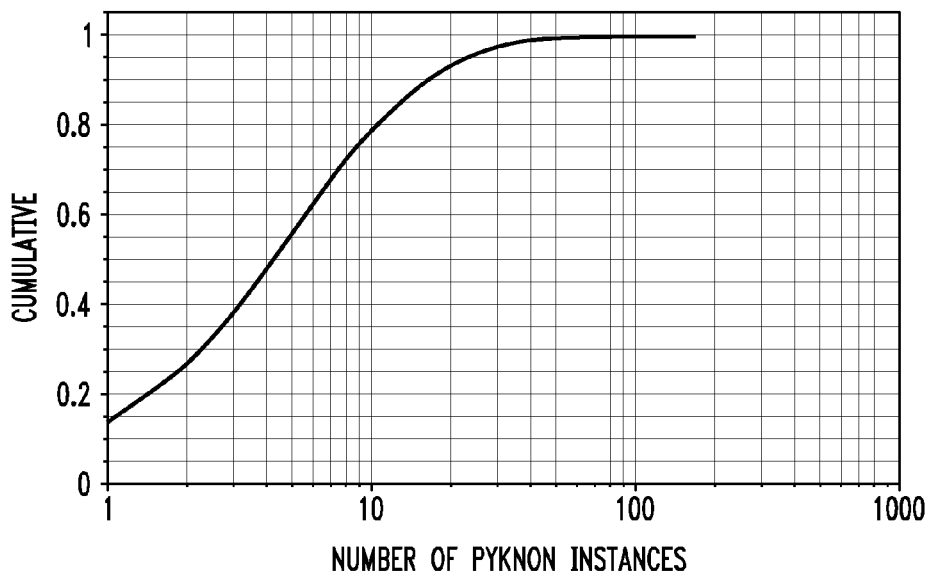
FIG. 10 is a diagram illustrating a cumulative function showing what percentage of affected transcripts contain N or more pyknon instances, according to an embodiment of the present invention.

The pyknons also exhibit a number of properties that connect the non-genic and genic regions of the human genome, as well as other genomes, in unexpected ways. In particular:

The pyknons have one or more instances within nearly all known genes. The 127,998 pyknons that we originally discovered in the human intergenic and intronic regions have an additional 226,874 non-overlapping copies in the 5'UTRs, CRs or 3'UTRs of 20,059 genes (30,675 transcripts). That is, more than 90% of all human genes contain one or more pyknon instances. The pyknons in $P_{5'UTR}$ cover 3.82% of the 6,947,437 nucleotides in human 5'UTRs; the pyknons in $P_{CODING}$ cover 3.04% of the 50,737,024 nucleotides in human CRs; and, the pyknons in $P_{3'UTR}$ cover 7.33% of the 25,597,040 nucleotides in human 3'UTRs. The distribution of pyknons in the various transcripts is not uniform. FIG. 10 shows the cumulative for the number of transcripts with a given number of pyknons instances in them. As can be seen, about 52% of the 30,675 affected transcripts contain four or more pyknon instances; of these about 2,200 transcripts contain 20 or more pyknon instances in them.

The pyknons arrange combinatorially in many human 5'UTRs, CRs and 3'UTRs forming mosaics. In those cases where we find many pyknons in one transcript, the pyknons arrange combinatorially and form mosaics. FIG. 11 shows an example of such a combinatorial arrangement in the 3'UTRs of birc4 (an apoptosis inhibitor) and nine other human genes. The 3'UTR of birc4 contains 100 instances of 95 distinct pyknons: of these, 22 are also present in the 3'UTRs of the other nine genes shown. One or more instances of the 95 pyknons from birc4's 3'UTR exist in the 3'UTRs of 2,306 transcripts (data not shown).

We next show two more examples, one involving 5' untranslated and the other involving coding regions. It is important to stress here that the pyknons are initially discovered in an input that includes neither untranslated/amino-acid-coding sequences nor their reverse-complement; thus, pyknon arrangements such as the ones shown in the following two examples represent non-trivial findings from the standpoint of statistical significance. FIG. 12 shows an example of combinatorial rearrangement in the 5'UTRs of ENSG00000196809 a gene of unknown function and 8 more human genes. 63 distinct pyknons have a total of 65 instances in the 5'UTR of ENSG00000196809. Of the 63 pyknons in the 5'UTR of ENSG00000196809, nine are also shared with the remaining eight genes of the shown group.

FIG. 13 shows an example of combinatorial rearrangement in human coding regions with the help of the amino-acid-coding sequences from 10 distinct genes: 9 pyknons have a total of 124 instances in the coding regions of the shown transcripts with several of the conserved pyknons appearing twice or more in a given sequence.

Recall that we initially discovered the pyknons in an input that included neither transcribed gene-related sequences nor their reverse-complement. Thus, finding so many pyknons with instances in human 5'UTRs, CRs and 3'UTRs is significant, especially in view of the three striking examples of combinatorial rearrangements shown above.

The pyknons account for $\frac{1}{6}^{th}$ of the human intergenic and intronic regions. The intergenic and intronic copies of the pyknons span 692,393,548 positions on the forward and reverse strands. For those pyknons whose reverse complements are not already in the list of 127,998 pyknons, their Watson-strand instances impose constraints on their Crick-strand instances. Considering this and recalculating shows that 898,424,004 positions, i.e., about $\frac{1}{6}^{th}$ of the human intergenic/intronic regions, are covered by pyknons and their reverse complement.

The pyknons are non-redundant. We clustered the pyknons using a scheme based on BLASTN (Altschul, S. F., Gish, W., Miller, W., Myers, E. W. & Lipman, D. J. (1990) *J Mol Biol* 215, 403-10). Two pyknons are redundant if they agree on at least X % of their positions. Since our collection includes pyknon pairs whose members are the reverse complement of one another, we had to ensure that the clustering scheme did not over-count: when comparing sequences A and B, we examined for redundancy the pair (A,B) and the pair (reverse-complement-of-A,B). Clustering at X=70, 80 and 90%, we generated clusters with 32621, 44417 and 89159 pyknons respectively. The high numbers of surviving clusters show that the pyknons are largely distinct.

We next describe the BLASTN-based clustering scheme. Let us assume that we are given a set of N sequences of nucleic acids of variable length, and a user-defined threshold X for the permitted, maximum remaining pair-wise sequence similarity. Then, we carry out the following steps:

```
sort the N sequences in order of decreasing length ;
let S_i denote the i-th sequence of the sorted set ;
let S_l be the longest sequence of the sorted set ;
CLEANED_UP_SET ← S_l
for i = 2 through N do
    use S_i as query to run BLAST against the current contents of CLEAN
    if the top BLAST hit T agrees with S_i or with the reverse complement
    of S_i at more than X% of T 's positions
    then
        make S_i a member of the cluster represented by T ;
        discard S_i ;
    else
        CLEANED_UP_SET ← CLEANED_UP_SET U { S_i } ;
end-for-loop
```

Upon termination, the set CLEANED_UP_SET contains sequences no pair of which agrees on more than X % of the positions in the shorter of the two sequences.

Figure 14:
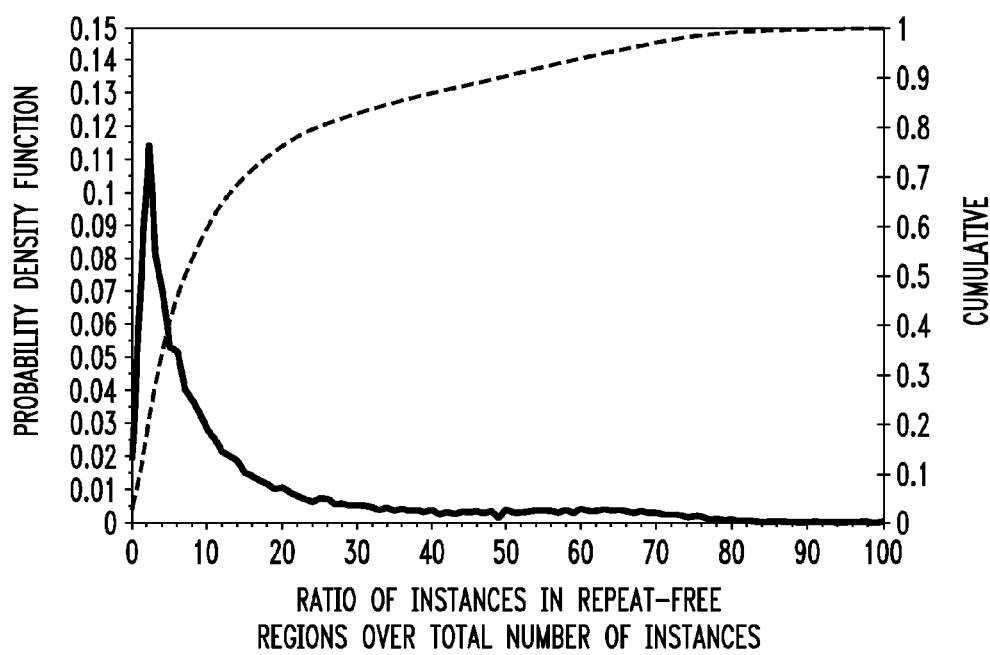
FIG. 14 is a diagram illustrating a probability density function and corresponding cumulative function for variable representing the fraction of pyknon instances located in repeat-free regions, according to an embodiment of the present invention.

On pyknons and repeat elements. 1,292 pyknons (1.0%) have instances occurring exclusively inside repeat elements as determined with the help of RepeatMasker (Smit, A. & Green, P. RepeatMasker: ftp.genome.washington.edu/RM/RepeatMasker.html). Seventy-nine pyknons have instances exclusively in repeat-free regions. And, the remaining 126,627 pyknons (98.9% of total) have instances both inside repeat elements and in repeat-free regions. A question that arises here is what fraction, on average, of the total number of copies of pyknons is generated from repeat-free regions. We have computed the probability density and cumulative functions for this fraction, and plot them in FIG. 14. As can be seen, about 60% of the pyknons have more than 90% of their copies inside repeat elements. However, the remaining 40% of the pyknons, which amounts to a little more than 50,000 pyknons, have between 10% and 100% of their instances in regions that are free of repeats.

The pyknons are distinct from the "ultraconserved elements." 52 pyknons have instances in 46 of the 481 ultraconserved elements (Bejerano, G., Pheasant, M., Makunin, I., Stephen, S., Kent, W. J., Mattick, J. S. & Haussler, D. (2004) *Science* 304, 1321-5) and cover 0.67% of the 126,007 positions: uc.73+ contains four pyknons; uc.23+, uc.66+, uc.143+ and uc.414+ each contain two pyknons; the remaining 41 elements contain a single pyknon each.

The pyknons are associated with specific biological processes. For 663 GO terms (Ashburner, M., Ball, C. A., Blake, J. A., Botstein, D., Butler, H., Cherry, J. M., Davis, A. P., Dolinski, K., Dwight, S. S., Eppig, J. T., Harris, M. A., Hill, D. P., Issel-Tarver, L., Kasarskis, A., Lewis, S., Matese, J. C., Richardson, J. E., Ringwald, M., Rubin, G. M. & Sherlock, G. (2000) *Nat Genet* 25, 25-9) describing biological processes at varying levels of detail, we found that the corresponding genes had either a significant enrichment or a significant depletion in pyknon instances. FIG. 15 shows a partial list of GO terms that are enriched or depleted in pyknons. We determined these associations as follows: each gene was included in a list n times, where n is the number of pyknons found in its 5' untranslated, coding or 3' untranslated region, respectively—to avoid over-counting, pyknons with multiple instances in the transcript(s) of a given gene were counted only once. For the sets of sequences belonging to human 5'UTRs, CRs and 3'UTRs, respectively, the binomial distribution was used to estimate the significance of enrichment (or depletion) of pyknons encountered in a group of genes associated with a certain term, compared to the expected frequency of this term in a background set comprising all genes with 5' untranslated, coding or 3' untranslated regions respectively.

Two control tests helped ensure the significance of our findings. First, we generated gene lists identical to the ones derived from the real data but which were created by random associations with pyknons: we found that only 1 of the generated 84,780 p-values exceeded our selected significance threshold of a Bonferroni-corrected|log(p-value)|of about 2.3 (data not shown). Second, we examined the relation between GO-process associations and the amount of sequence covered by the pyknons: this test allowed us to rule out the possibility that the derived significant enrichment/depletion were due to variations in sequence length for the genes associated with given cellular processes.

Figure 16:
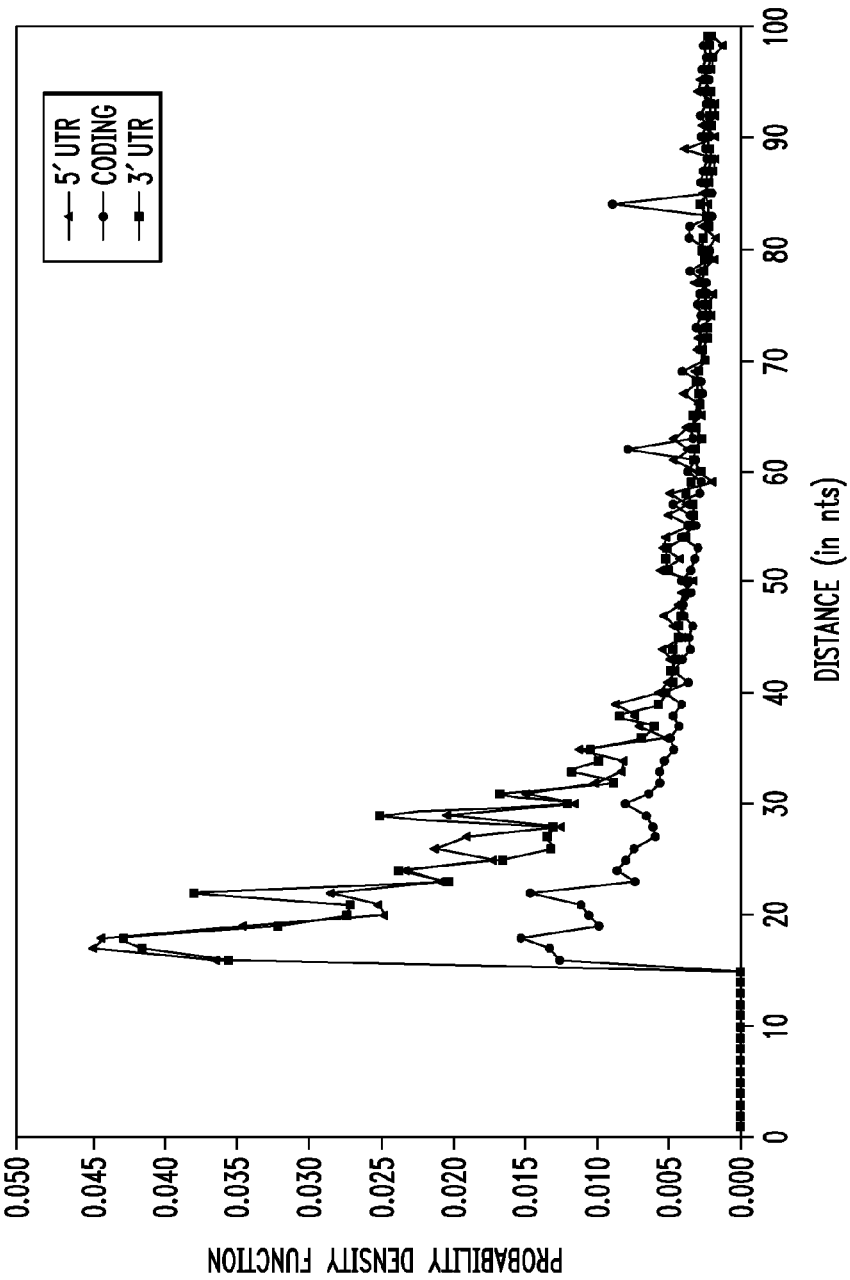
FIG. 16 is a diagram illustrating probability density functions for the distance between starting points of consecutive instances of pyknons, according to an embodiment of the present invention.

The relative positioning of pyknons in 5'UTRs, CRs and 3'UTRs is strongly biased but consecutive pyknon instances are not correlated. We examined the distances between consecutive pyknons, independently for each of the 5'UTRs, CRs and 3'UTRs. FIG. 16 shows the calculated probability density functions. Given the stringent criteria, we used when selecting pyknons, the coverage of each region is not dense, hence the tail-heavy distributions. The three curves have similar shapes, pronounced peaks at abscissas 18 and 22, and an overall preference for distances between 18 and 31 nucleotides.

Figure 17A:
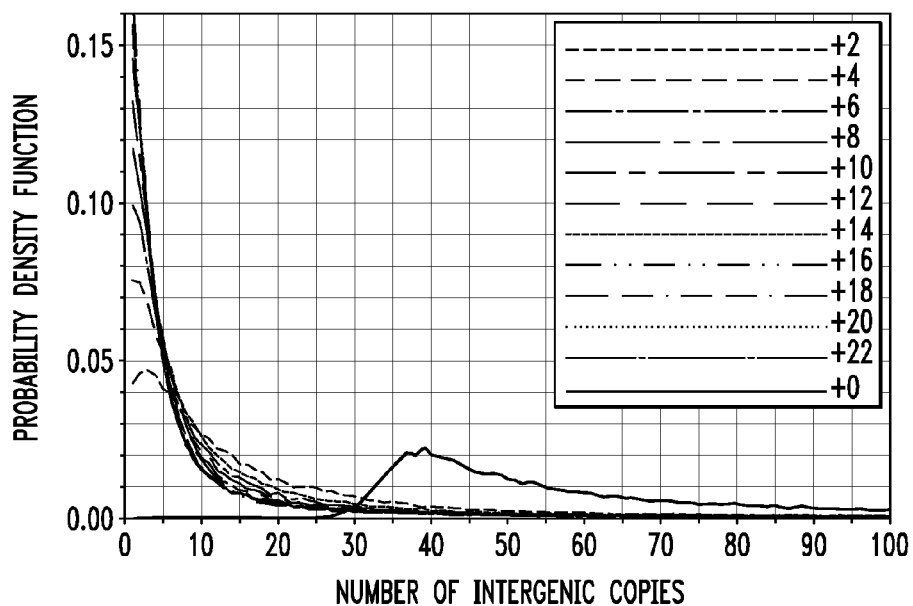
FIG. 17 is a diagram illustrating probability density functions for the number of intergenic and intronic copies of variable-length strings derived by counting instances of 3'UTR-conserved pyknons after shifting, according to an embodiment of the present invention.
Figure 17B:
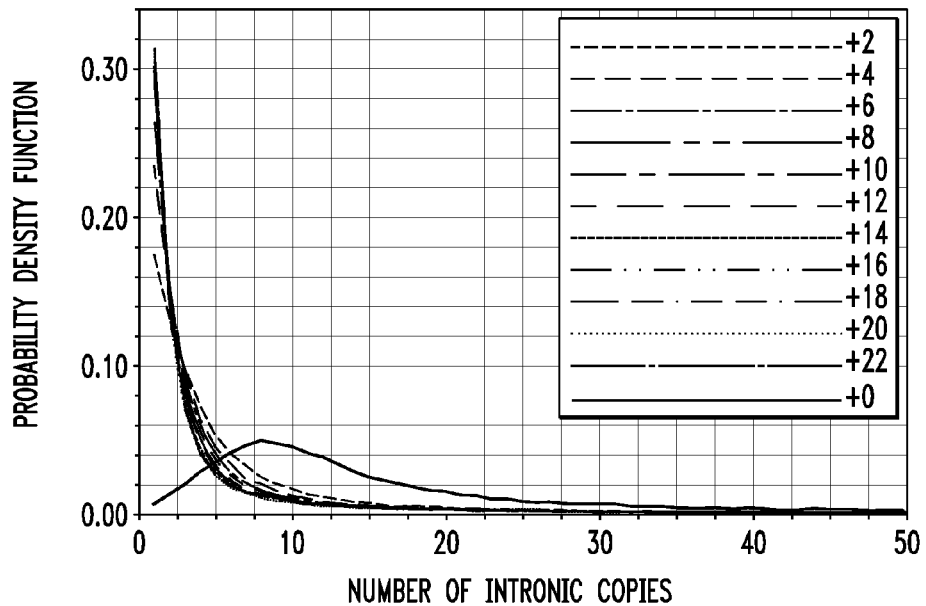

We next examined whether or not the pyknons are fragments of larger conserved regions. Let b denote a pyknon and let us assume that, unbeknownst to us, b is part of a larger-size conserved unit B. Then B will correspond to a larger area than the instance carved out by b, and thus there will be length(B)−length(b)+1 strings in the immediate neighborhood of b whose intergenic and intronic counterparts have as many identically-conserved copies as b. We tested this possibility in 3'UTRs by taking each instance of a pyknon, shifting it by +d (resp. −d), generating a new string and locating the new string's instances in the human intergenic and intronic regions. Had b been part of a larger logical unit, then for some values of d the number of intergenic and intronic copies of the newly formed string would have remained identical to those of b. On the other hand, if b were not part of a larger unit, then the new string would now cross the "natural boundaries" of the underlying presumed logical units and the new string's intergenic/intronic copies would be reduced drastically. Given the strict criteria that we used in identifying pyknons, it is possible that we discarded blocks that are conserved in intergenic/intronic regions and have instances in human coding regions. In this case, a shift of +/−d may end up generating a string that was not included in our set of pyknons but continues to have numerous intergenic/intronic copies. FIG. 17 shows the results obtained for the 3'UTRs for d ∈ and separately for intergenic (top half) and intronic (bottom half) regions; the curves for d=0 correspond to the pyknons in $P_{3'UTR}$. Note that even for a small shift of d=2 positions, the derived, shifted strings have strikingly fewer copies than the pyknons in $P_{3'UTR}$, and this holds true for both the intergenic and intronic instances. We obtained similar results for negative d's (data not shown).

The pyknons are possibly linked to PTGS. The most conspicuous feature of FIG. 16 is the strong preference for distances typically encountered in the context of PTGS. By definition, the 127,998 pyknons have one or more instances in the untranslated and coding regions of human genes: for each pyknon, we generated its reverse complement $\bar{\beta}$, identified all of $\bar{\beta}$'s intergenic and intronic instances, and predicted the RNA structure and folding energy of the immediately surrounding neighborhoods using the Vienna package (Hofacker, I. L., Fontana, W., Stadler, P., Bonhoeffer, L. S., Tacker, M. & Schuster, P. (1994) *Monatshefte f Chemie* 125, 167-188). We discarded structures whose predicted folding energies were >−30 Kcal/mol, and structures (including ones with favorable folding energies) that were predicted to locally self-hybridize, even if the involved positions represented a miniscule fraction of the total length of the regions under consideration. We also discarded structures that contained either a single large bulge or many unmatched bases. Each of the surviving regions was predicted to fold into a hairpin-shaped RNA structure that had a straightforward arm-loop-arm architecture, contained very small bulges if any, and was energetically very stable. The analysis identified 380,084 non-overlapping regions predicted to form hairpin-shaped structures (298,197 in intergenic and 81,887 in intronic sequences). These 380,084 regions contained instances of the reverse complement of 37,421 pyknons (29.23% of total). In terms of length, the clear majority of these regions are between 60 and 80 nucleotides long.

FIG. 18 shows the density of the surviving regions per 10,000 nucleotides and for each chromosome separately. The density is reported for each chromosome and separately for the intergenic and intronic regions. Per unit length, there are more predicted hairpins in intronic rather than intergenic regions but the shear difference in the magnitude of these regions results in the intergenic regions contributing the bulk of the hairpins. Interestingly, the density of discovered hairpins is not constant across chromosomes: chromosomes 16, 17, 19 and 22 who are the most densely-packed in terms of predicted hairpins are also among the shortest in length. We emphasize that the average pyknon has length similar to that of a typical microRNA and that there is a straightforward sense-antisense relationship between segments of the 380,084 hairpins and the pyknons instances in human 5'UTRs/CRs/3'UTRs. Also note that the regions containing the 81,887 intronic hairpins will be transcribed: these regions account for 21,727 of the 37,421 pyknons that are linked to hairpins.

If pyknons are indeed connected to PTGS, then two hypotheses arise from FIG. 16: a) in addition to 3'UTRs, gene silencing is likely effected through the 5'UTRs and amino acid coding regions; and, b) RNAi products in animals likely form distinct quantized categories based on size and have preferences for lengths of 18, 22, 24, 26, 29, 30 and 31 nucleotides.

The pyknons relate to known microRNAs. We formed the union of the RFAM (Griffiths-Jones, S., Bateman, A., Marshall, M., Khanna, A. & Eddy, S. R. (2003) *Nucleic Acids Res* 31, 439-41) and pyknon collections, and clustered it with the above-described BLASTN-based scheme, using a threshold of pair-wise remaining sequence similarity of 70%; i.e., we allowed up to six mismatches in 22 nucleotides. When comparing two sequences A and B, we avoided over-counting by examining for redundancy the pairs (A,B) and (reverse-complement-of-A,B). In total, 1,087 known microRNAs clustered with 689 pyknons across 279 of the 32,994 formed clusters.

The pyknons relate to recently discovered 3'UTR motifs. We compared the pyknons in $P_{3'UTR}$ to the 72 8-mer motifs that were recently reported to be conserved in human, mouse, rat and dog 3'UTRs (Xie, X., Lu, J., Kulbokas, E. J., Golub, T. R., Mootha, V., Lindblad-Toh, K., Lander, E. S. & Kellis, M. (2005) *Nature* 434, 338-45). We say that one of these 8-mers coincides with a pyknon of length l if one of the following conditions holds: the 8-mer agrees with letters 1-7 through l of a pyknon ('type 0' agreement); the 8-mer agrees with letters 1-8 through l-1 ('type 1' agreement); or, the 8-mer agrees with letters 1-9 through l-2 ('type 2' agreement). Of the 72 reported conserved 8-mers, 39 were in 'type 0' agreement, 10 in 'type 1' agreement, and seven in 'type 2' agreement with one or more pyknons from $P_{3'UTR}$. Six of the 8-mers did not match at all any of the pyknons in $P_{3'UTR}$. In summary, the pyknons that we have derived by intragenomic analysis overlap with 56 out of the 72 motifs that were discovered through cross-species comparisons.

Human pyknons are also present in other genomes where they associate with similar biological processes. In FIG. 19, and for each of 7 genomes in turn, we show how many positions in region X of the genome at hand are covered by the human pyknons contained in set $P_X$, X={5'UTR,CODING, 3'UTR}. We account for length differences across genomes by reporting the number of covered positions per 10,000 nucleotides. FIG. 20 shows how many of the human pyknons contained in set $P_X$ can also be found in the region X of the genome under consideration, X={5'UTR,CODING,3'UTR}. FIG. 20 also shows the total number of intergenic and intronic positions covered by those of the human pyknons that are also in other genomes. Notably, the human genome contains more than 600 million nucleotides that are associated with identical copies of pyknons and are absent from the mouse and rat genomes. Interestingly, the human pyknons have many instances in the intergenic and intronic regions of the phylogenetically distant worm and fruit-fly genomes covering about 1.6 million nucleotides in each.

A set of 6,160 human-genome-derived pyknons are simultaneously present in human 3'UTRs (5,752 genes) and mouse 3'UTRs (4,905 genes) whereas a second set of 388 pyknons are simultaneously present in human 3'UTRs (565 genes), mouse 3'UTRs (673 genes) and fruit-fly 3'UTRs (554 genes). Strikingly, we found these two sets of common pyknons to be significantly over-represented in the same biological processes in these other genomes (i.e. mouse and fruit-fly) as in the human genome, even though the pyknons were initially discovered by processing the human genome in isolation (data not shown). The common processes include regulation of transcription, cell communication, signal transduction etc. Finally, for each of the 388 pyknons in this second set, we manually analyzed about 130 nucleotide-long neighborhoods centered on the instances of each pyknon across the human, mouse and fruit-fly 3'UTRs and for a total of more than 4,000 such neighborhoods: notably, we did not find any instance of syntenic conservation across the three genomes.

Accordingly, as explained above, we explored the existence of sequence-based links between coding and non-coding regions of the human genome and identified 127,998 pyknons with a combined 226,874 non-overlapping instances in the 5'UTRs, CRs or 3' UTRs of 30,675 transcripts from 20,059 human genes. In transcripts that contained multiple pyknon instances, we found that the pyknons arrange themselves combinatorially forming mosaics. Statistical analysis revealed that the untranslated and/or coding regions of genes associated with specific biological processes are significantly enriched/depleted in pyknons.

We also found that the pyknon placement in 5'UTRs, CRs and 3'UTRs is strongly biased: the starting positions of consecutive pyknons show a clear preference for distances between 18 and 31 nucleotides. Importantly, we found an apparent lack of correlation between consecutive pyknon instances in these regions. The observed bias in the relative placement of the pyknons is conspicuously reminiscent of lengths that are associated with small RNA molecules that induce PTGS, suggesting the hypothesis that the pyknons' instances correspond to binding sites for microRNAs. Analysis of the regions immediately surrounding the intergenic and intronic instances of the reverse complement of the 127,998 discovered pyknons revealed that 30.0% of the pyknons have instances within about 380,000 distinct, non-overlapping regions between 60 and 80 nucleotides in length that are predicted to fold into hairpin-shaped RNA secondary structures with folding energies $\leq -30$ Kcal/mol. Many of these predicted hairpin-shaped structures are located inside known introns and thus will be transcribed. Our analysis also suggests that PTGS may be effected though the genes' 5'UTR and amino acid regions, in addition to their 3'UTRs. Another resulting hypothesis is that RNAi products in animals likely fall into distinct categories that are quantized in terms of size and have preferences for lengths of 18, 22, 24, 26, 29, 30 and 31 nucleotides. Notably, through sequence-based analysis, we showed that about 40% of the known microRNAs are similar to 689 pyknons, and that the pyknons subsume 56 of the 72 recently reported 3'UTR motifs, lending further support to the possibility of a connection between the pyknons and RNAi/PTGS.

The intergenic/intronic copies of the 127,998 pyknons constrain approximately 900 million nucleotides of the human genome. Instances of human pyknons can also be found in other genomes namely C. elegans, D. melanogaster, G. gallus, M. musculus, R. norvegicus and C. familiaris. The number of human pyknons that can be located in the 5'UTRs, CRs and 3'UTRs of other genomes decreases with phylogenetic distance. Strikingly, the pyknons that we found inside mouse and fruit-fly 3'UTRs were over-represented in the same biological processes as in the human genome. On a related note, more than 600 million bases, which correspond to identically conserved intergenic and intronic copies of human pyknons, are not present in the mouse and rat genomes.

The fact that some of the intergenic/intronic copies of pyknons originate in repeat elements may lead one to assume that our analysis has merely 'rediscovered' such elements. However, as mentioned above, more than 50,000 of the pyknons have many of their instances in repeat-free regions. Moreover, the typical length of a pyknon is substantially smaller than, e.g., that of an ALU. It was recently reported that genes can achieve evolutionary novelty through the 'careful' incorporation of ALUs in their coding regions (Iwashita, S., Osada, N., Itoh, T., Sezaki, M., Oshima, K., Hashimoto, E., Kitagawa-Arita, Y., Takahashi, I., Masui, T., Hashimoto, K. & Makalowski, W. (2003) *Mol Biol Evol* 20, 1556-63; and Lev-Maor, G., Sorek, R., Shomron, N. & Ast, G. (2003) *Science* 300, 1288-91). Also, the "pack-mule" paradigm revealed that entire genes, large fragments from a single gene, or fragments from multiple genes can be 'hijacked' by transposable elements (Jiang, N., Bao, Z., Zhang, X., Eddy, S. R. & Wessler, S. R. (2004) *Nature* 431, 569-73). However, 'fortuitous coincidence' is generally considered the prevailing mechanism by which such potential is unleashed. Contrasting this, the combinatorial arrangement of the pyknons within the untranslated and coding regions of genes together with the large number of instances in these regions and the association of pyknons with specific biological processes suggests that their placement is not accidental and likely serves a specific purpose. Our findings do not rule out a link with transposable elements. On the contrary, the findings seem to support a dynamic view of a genome (Jorgensen, R. A. (2004) *Cold Spring Harb Symp Quant Biol* 69, 349-54) that has learned to respond, and likely continues to respond, to environmental challenges or "stress" in a controlled, organized manner.

Taken together, the results suggest the existence of an extensive link between the non-coding and gene-coding parts in animal genomes. It is conceivable that this link could be the result of integration into the genome of dsRNA-breakdown products. Since many genes are known to give rise to antisense transcripts, it is possible that these genes were at some point subjected to RNAi-mediated dsRNA breakdown which in turn gave rise to products about 20 nucleotides in length. The latter, through repeated integration, could have eventually given rise to the numerous intergenic and intronic copies of the pyknons that we have identified. However, this explanation would have to be reconciled with four of our findings. First, the pyknons have identically conserved copies in non-genic regions. Second, pyknons appear to favor a specific size and, in genic regions, a specific relative placement. Third, slight modification of the 3'UTR instances of the pyknons by either prepending or appending immediately neighboring positions results in new strings whose intergenic and intronic copies are markedly decreased. And fourth, we can discover human pyknons in other organisms such as the mouse and the fruit-fly where they exhibit a persistent enrichment within specific processes yet are not the result of syntenic conservation. It may well be that we are seeing traces of an organized, coordinated activity that involves nearly all known genes. The existence of a pyknon-based regulatory layer that is massive in scope and extent, originates in the non-coding part of the genome, operates through the genes' untranslated and coding regions, and, is likely linked to PTGS, is a tantalizing possibility. Moreover, the observed disparity in the number of intergenic/intronic positions covered by human pyknons in the human and the phylogenetically-close mouse/rat genomes suggests that pyknons and thus the presumed regulatory layer may be organism-specific to some degree ("pyknome"). Addressing such questions might eventually help explain the apparent lack of correlation between the number of amino-acid coding genes in an organism and the organism's apparent complexity.

In the above description, and in order to identify motifs that are present in both non-genic and genic regions, we proceeded by first carrying out pattern discovery in the intergenic and intronic regions of the human genome. Once those patterns were determined, we identified additional instances for them in the genic regions of the genome and in particular in the 5' untranslated, amino acid coding and 3' untranslated regions of the genes. In other words, the computational analysis flowed from the non-genic to the genic-regions. But there is nothing that inherently prevents us from carrying out the computation in the other direction, i.e., from the genic to the non-genic regions, although there is potential for a loss in sensitivity that might result in the identification of smaller sets of motifs linking non-genic with genic regions. One could carry out the genic/non-genic analysis in a number of ways. For example, one could use a pattern discovery method to process the full collection of 5' untranslated, amino acid coding and 3' untranslated regions (with the regions processed separately or together), identifying recurrent motifs contained therein, and finally establishing links with the non-genic regions of the genome by locating the intergenic and intronic copies for these motifs. Instead of working with the full length sequences of the genes' untranslated and coding regions, an alternative method would be to delineate areas of interest in these regions (effectively subselecting), analyzing those areas to derive motifs, and finally locating additional instances of these motifs in the non-genic parts of the genome. Such areas of interest could, for example, be known or putative microRNA binding sites. Alternatively, the areas of interest could be what, in our work on the problem of RNA interference, we refer to as "target islands." A detailed description of the work is described in the U.S. patent application identified as Ser. No. 11/351,821, filed on Feb. 10, 2006, and entitled "System and Method for Identification of MicroRNA Target Sites and Corresponding Targeting MicroRNA Sequences," the disclosure of which is incorporated herein.

Summarily, our approach for finding target islands (i.e. putative microRNA binding sites) is known as rna22 and proceeds as follows: it discovers statistically significant patterns that are contained in the sequences of known microRNAs, generates their reverse complement, identifies all the instances of these reverse-complement patterns in a region of interest (namely one of 5'UTRs, CRs or 3'UTRs) and finally reports groups of consecutive locations from the region of interest as long as they are 'hit' a minimum number of times by these patterns. Generally, the groups of consecutive locations that rna22 reports will be variable in length and may correspond to one or more binding sites: consequently, and so as to not loose generality, we have been referring to them as "target islands."

Let us assume that target islands are available for the region of interest. One could proceed by doing an all-against-all comparison of the target islands forming clusters. Any two target-islands that end up in the same cluster have the property that their corresponding sequences share a substantial portion of their extent, say a minimum of N locations. Initially, each target island is in its own cluster. There is always the possibility that the thresholds used in the various stages of the process are too stringent, thus resulting in the method to miss some target-islands that could have otherwise become members of some cluster c. In order to account for this, one could enhance the cluster-forming process as follows. Using the Clustal-W multiple alignment algorithm (Chenna, R., Sugawara, H., Koike, T., Lopez, R., Gibson, T. J., Higgins, D. G. & Thompson, J. D. (2003) *Nucleic Acids Res* 31, 3497-500), we could align the sequences in cluster c and extract the core region of the alignment, then use it to search the sequences of interest for instances of the core region that were skipped because of the employed thresholds. If a given cluster contains more than one core regions then it can be replaced by as many new clusters as the number of its distinct core regions. For each one of the formed clusters whose core region that resulted from the Clustal-W alignment of its members is at least N nucleotides in length, we report the region as a (genic) motif.

Optionally, one can discard core regions that exhibit low-complexity using the NSEG algorithm (Wootton, J. C. & Federhen, S. (1993) *Computers in Chemistry* 17, 149-163). These motifs are then sought in the corresponding genome's intergenic/intronic regions instances to establish links between coding and non-coding parts of the genome. Finally, it is clear that instead of clustering the target islands to determine motifs, one could simply use a pattern discovery approach and subselect among the reported patterns to keep only those that, for example, satisfy a minimum length requirement, or some other property.

Given the above description, a few points should be noted. First, it is clear that the method which we have described and the ensuing analysis is not specific to the human genome; in fact, it can be carried out separately in other eukaryotic genomes such as chimpanzee, mouse, rat, dog, chicken, fruitfly, worm, etc. It is expected that the resulting pyknomes will have non-zero intersections with one another but will likely also contain organism-specific pyknons. Whether generated from the human or some other genome, the pyknons are statistically significant and link the non-genic and genic regions of the genome at hand. The links that are instantiated by the pyknons are 'natural' in that they involve large numbers of sequences that occur naturally in the genome at hand. Consequently, the pyknons would form natural candidates for a number of processes that to date have been carried out using schemes that make use of local information alone and do not take into account long-range conservations of the kind that we presented in our discussion.

Figure 21:
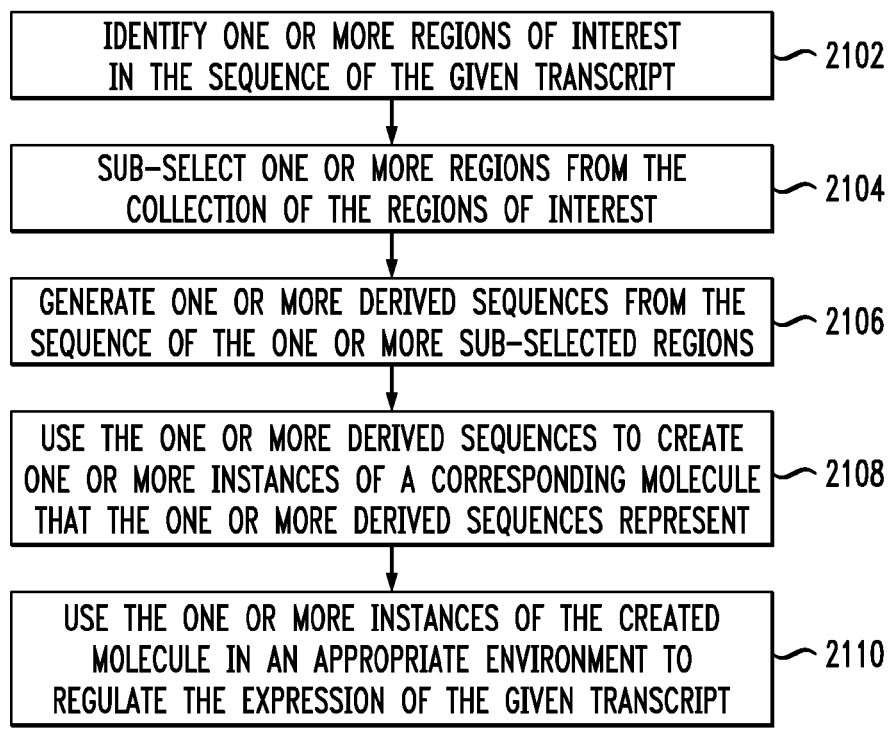
FIG. 21 is a diagram illustrating a first methodology for using pyknons, according to an embodiment of the present invention.

One such application would be the design of interfering RNA molecules to regulate the gene expression of one specific gene. Some of our pyknons have the property of being shared by two or more genes which allows the design of siRNAs that can interfere with a cluster of genes at once. In the flow diagram of FIG. 21, we illustrate a method for designing one or more sequences of interfering RNA molecules that can interact with one or more sites in a given transcript of a given sequence in a given organism and result in the down-regulation of the expression of the protein product encoded by the given transcript can comprise the following steps. One or more regions of interest are identified in the sequence of a given transcript (step 2102). One or more regions are sub-selected from the collection of these regions (step 2104). One or more derived sequences are generated from the sequence of the one or more sub-selected regions (step 2106). The one or more derived sequences are used to create one more instances of the corresponding molecule that the one or more derived sequences represent (step 2108). The one or more instances of the created molecule are used in an appropriate environment to regulate the expression of the given transcript (step 2110).

Further, the method of designing one or more interfering RNA molecules may use a region of interest in the collection of regions of interest identified to be an instance of a motif that has one or more copies in the intergenic and intronic regions of the genome of interest, and one or more copies in the untranslated and amino acid coding regions of one or more genes in the genome of interest, each such region of interest being computed using the method and system for finding pyknons described above.

The method may use a region of interest in the collection of regions of interest identified using a method that is based on pattern discovery, for example, the method described in the above-referenced U.S. patent application identified as Ser. No. 11/351,821. A region of interest in the collection of regions of interest can also be identified to be a target island that is computed using the method also described in the above-referenced U.S. patent application identified as Ser. No. 11/351,821.

The method of designing one or more interfering RNA molecules may also use a region of interest, for example, located in the 5' untranslated region of the given transcript, located in the amino acid coding region of the given transcript, or located in the 3' untranslated region of the given transcript.

As detailed above, the method of designing one or more interfering RNA molecules can be used where the genome of interest is a eukaryotic genome, and wherein the eukaryotic genome is, for example, the human genome, the mouse genome, the rat genome, the dog genome, the fruit fly genome, or the worm genome.

Also, the method of designing one or more interfering RNA molecules may use a region of interest that is sub-selected based on one or more of its attributes. These attributes may include, for example, the region's length and the region's location in the transcript.

The method of designing one or more interfering RNA molecules can also use a derived sequence that is, for example, the reverse complement of the sequence of the one or more sub-selected regions, or a near-reverse complement of the sequence of the one or more sub-selected regions, i.e. it contains mismatches at one or more locations.

The method of designing one or more interfering RNA molecules can be used such that the one or more copies of the molecule can be built using any of a set of biochemical processes.

Another application would involve the rational use of pyknons to appropriately engineer a transcript of interest in order to control its expression (either up-regulate or down-regulate) in a specific tissue or for a specific cellular process. For example, one could remove one or more of the pyknons existing in the transcript of interest leading to an up-regulation of the transcript. Alternatively, one could down-regulate the transcript of interest by adding more instances of existing pyknons and rely on the naturally occurring agent that targets this pyknon to induce down-regulation. Or one could add the sequence of a pyknon that is not among those contained in the transcript and selectively control the transcript's expression by adding or removing appropriately generated instances of the reverse complement of the pyknon.

Figure 22:
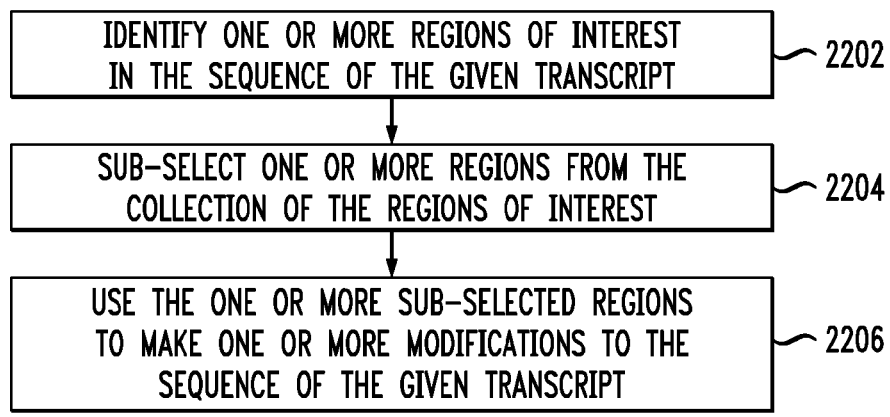
FIG. 22 is a diagram illustrating a second methodology for using pyknons, according to an embodiment of the present invention.

As illustrated in the flow diagram of FIG. 22, a method for engineering a given transcript of a given gene in a given organism in order to regulate its expression may comprise the following steps. One or more regions of interest are identified in the sequence of a given transcript (step 2202). One or more regions are sub-selected from the collection of these regions (step 2204). The one or more sub-selected regions are used to make one or more modifications to the sequence of the given transcript (step 2206).

Further, the method of engineering a given transcript to regulate gene expression can comprise many of the same steps as mentioned above in the method for designing one or more interfering RNA molecules. For example, the method of engineering a given transcript to regulate gene expression may use a region of interest in the collection of regions of interest identified to be an instance of a motif that has one or more copies in the intergenic and intronic regions of the genome of interest, and one or more copies in the untranslated and amino acid coding regions of one or more genes in the genome of interest. The motif can be computed, for example, using the pyknons discovery method and system described above.

Also, as above, the method of engineering a given transcript to regulate gene expression may use a region of interest in the collection of regions of interest computed using a method that is based on pattern discovery, for example, the method described in the above-referenced U.S. patent application identified as Ser. No. 11/351,821.

The present method may also use a region of interest, for example, located in the 5' untranslated region of the given transcript, located in the amino acid coding region of the given transcript, or located in the 3' untranslated region of the given transcript.

Also, similar to the above methodology, the method of engineering a given transcript to regulate gene expression may use a region of interest that is sub-selected based on one or more of its attributes including, for example, the region's length and the region's location in the transcript. Additional attributes may include the association of the region with a given biological process, the region's association with a given tissue, and the region's association with a given cellular compartment.

Further, the method of engineering a given transcript to regulate gene expression can include a modification that, for example, comprises an extension of the sequence of the given transcript, or a shortening of the sequence of the given transcript. The extension can, for example, comprise one or more instances of a region of interest, and the shortening can, for example, comprise one or more instances of a region of interest.

Another application of pyknons, for example, would be the measuring of the impact that one or more pyknons can have on a gene's regulation "by proxy." This would entail the engineering of an assay that involves a reporter gene (for example, luciferase) and instances of the one or more pyknons placed downstream from the region that codes for the reporter's amino acid sequence. Then, one can measure the impact on the expression of the reporter gene by using various combinations of appropriately generated instances of the reverse complement of these pyknons. The observations made in the context of the reporter assay can then be carried over to the gene that is studied. Additional applications are also possible if one assumes that for the organism that is being studied the sequences of the corresponding pyknons are available.

Figure 23:
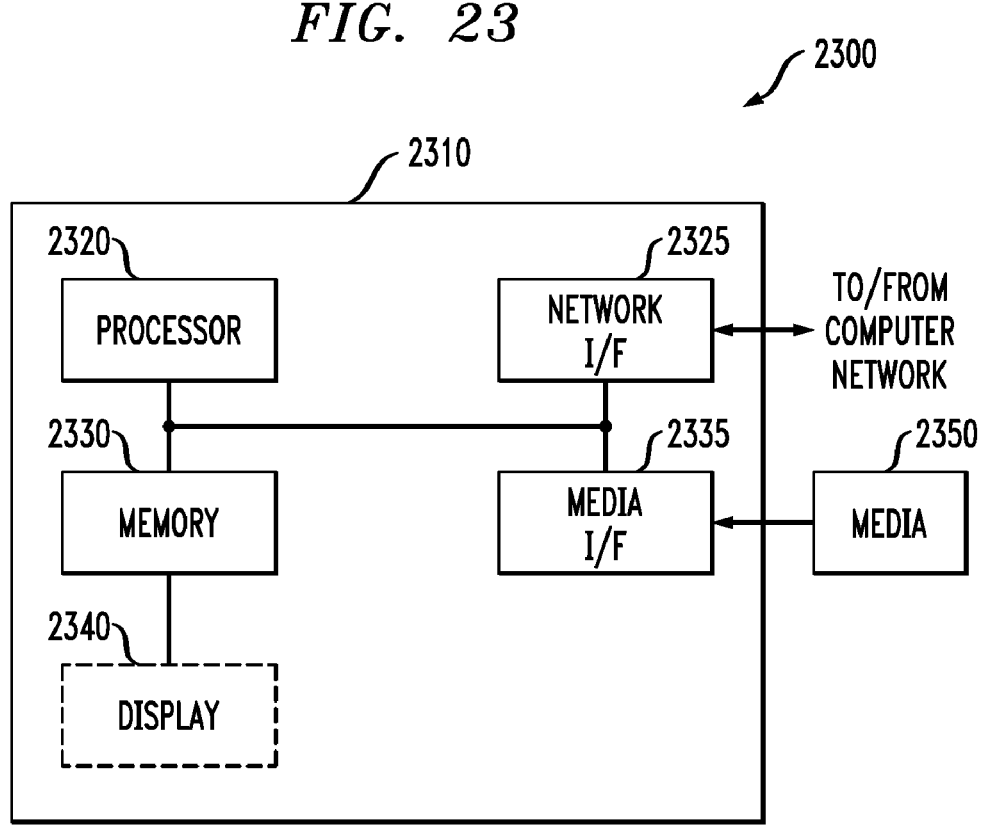
FIG. 23 is a block diagram of an exemplary hardware implementation of one or more of the methodologies of the present invention, according to an embodiment of the present invention.

FIG. 23 is a block diagram of an exemplary hardware implementation of one or more of the methodologies of the present invention. That is, apparatus 2300 may implement one or more of the steps/components described above in the context of FIGS. 1-22. Apparatus 2300 comprises a computer system 2310 that interacts with media 2350. Computer system 2310 comprises a processor 2320, a network interface 2325, a memory 2330, a media interface 2335 and an optional display 2340. Network interface 2325 allows computer system 2310 to connect to a network, while media interface 2335 allows computer system 2310 to interact with media 2350, such as a Digital Versatile Disk (DVD) or a hard drive.

As is known in the art, the methods and apparatus discussed herein may be distributed as an article of manufacture that itself comprises a computer-readable medium having computer-readable code means embodied thereon. The computer-readable program code means is operable, in conjunction with a computer system such as computer system 2310, to carry out all or some of the steps to perform one or more of the methods or create the apparatus discussed herein. For example, the computer-readable code is configured to implement a method of determining associations between non-coding sequences and gene coding sequences in a genome of an organism, by the steps of: identifying at least one conserved region from a plurality of the non-coding sequences; and linking the at least one conserved region with one or more of the gene coding sequences of the genome to associate the at least one conserved region with one or more biological processes of the organism. The computer-readable medium may be a recordable medium (e.g., floppy disks, hard drive, optical disks such as a DVD, or memory cards) or may be a transmission medium (e.g., a network comprising fiber-optics, the world-wide web, cables, or a wireless channel using time-division multiple access, code-division multiple access, or other radio-frequency channel). Any medium known or developed that can store information suitable for use with a computer system may be used. The computer-readable code means is any mechanism for allowing a computer to read instructions and data, such as magnetic variations on a magnetic medium or height variations on the surface of a compact disk.

Memory 2330 configures the processor 2320 to implement the methods, steps, and functions disclosed herein. The memory 2330 could be distributed or local and the processor 2320 could be distributed or singular. The memory 2330 could be implemented as an electrical, magnetic or optical memory, or any combination of these or other types of storage devices. Moreover, the term "memory" should be construed broadly enough to encompass any information able to be read from or written to an address in the addressable space accessed by processor 2320. With this definition, information on a network, accessible through network interface 2325, is still within memory 2330 because the processor 2320 can retrieve the information from the network. It should be noted that each distributed processor that makes up processor 2320 generally contains its own addressable memory space. It should also be noted that some or all of computer system 2310 can be incorporated into an application-specific or general-use integrated circuit.

Optional video display 2340 is any type of video display suitable for interacting with a human user of apparatus 2300. Generally, video display 2440 is a computer monitor or other similar video display.

Pattern-discovery techniques, such as those described above, have been used in conjunction with recently released, publicly available genomic sequences to predict pyknons related to the following organisms: *C. elegans* (Wormbase release 150); *D. melanogaster* (Berkely *Drosophila* Genome Project release 4); *G. gallus* (Washington University in St. Louis release 1.0); *M. musculus* (Ensembl assembly based on the NCBI 34 assembly); *R. norvegicus* (Genome assembly RGSC3.4); *C. familiaris* (Genome assembly BROADD1); *P. troglodytes* (Genome assembly CHIMP1A); and *H. sapiens* (Ensembl assembly based on the NCBI 31 assembly). Namely, pyknon sequences having SEQ ID NO: 1 through SEQ ID NO: 180,269 derived from the genome of *H. sapiens* are presented; pyknon sequences having SEQ ID NO: 180,270 through SEQ ID NO: 295,005 derived from the genome of *P. troglodytes* are presented; pyknon sequences having SEQ ID NO: 295,006 through SEQ ID NO: 335,709 derived from the genome of *C. familiaris* are presented; pyknon sequences having SEQ ID NO: 335,710 through SEQ ID NO: 463,044 derived from the genome of *M. musculus* are presented; pyknon sequences having SEQ ID NO: 463,045 through SEQ ID NO: 534,157 derived from the genome of *R. norvegicus* are presented; pyknon sequences having SEQ ID NO: 534,158 through SEQ ID NO: 541,832 derived from the genome of *G. gallus* are presented; pyknon sequences having SEQ ID NO: 541,833 through SEQ ID NO: 682,206 derived from the genome of *D. melanogaster* are presented; and, pyknon sequences having SEQ ID NO: 682,207 through SEQ ID NO: 747,326 derived from the genome of *C. elegans* are presented. While the pattern discovery embodiments described herein are preferred methods, alternatives and variations can also be used to predict pyknons.

The predicted pyknon sequences generated using the pattern discovery techniques described herein are submitted herewith in electronic text format as the file 1500-696 Complete Sequence Listing.ST25, created on Monday Nov. 20, 2006, having a size of 109 Megabytes on compact disc, the contents of which are incorporated by reference herein. Two identical copies of the sequences are submitted herewith.

With respect to the sequences submitted herewith, each pyknon sequence is listed and numbered consecutively, and the organism from which the sequence was derived is also identified.

All of the sequences presented herein, SEQ ID NO: 1 through SEQ ID NO: 747,326 are listed as DNA sequences. RNA transcripts corresponding to these DNA sequences can also be derived for use with the present invention. As such, the RNA forms of these DNA sequences are considered to be within the scope of the present teachings.

Sequences that are either homologous or orthologous to the sequences presented herein, e.g., sequences that are related by vertical descent from a common ancestor or through other means (e.g., through horizontal gene transfer), will likely be present in genomes other than the ones mentioned herein. Such homologous/orthologous sequences are expected to generally differ from the sequences listed herein at only a small fraction of the locations. Thus, the teachings presented herein should be construed as being broadly applicable to such homologous/orthologous sequences from species other from those listed above.

Furthermore, sequences that are derived from the sequences presented herein through appending or prepending a small number of nucleotides to the presented sequences should also be considered to fall under the teachings presented herein. Sequences that are derived by taking the reverse complement of the sequences presented herein should also be considered to fall under the teachings presented herein.

According to an exemplary embodiment, interfering RNA molecules may be generated based on the sequences of the predicted pyknon sequences. These interfering molecules may be generated so that they target for repression (post-transcriptional silencing activity) transcripts (both naturally occurring sequences as well as designed constructs) that contain one or more of the pyknon sequences described herein, i.e. they target the area of the transcript that corresponds to an instance of a pyknon from the collection of pyknons described herein.

Alternatively, an interfering RNA molecule can be generated from the reverse complement of the pyknon sequences described herein. In this case, the interfering RNA molecule will target for repression transcripts that contain an instance of a pyknon from the collection of pyknons described herein or a sequence only slightly different from the sequence of the considered pyknon. The RNA molecules generated in this manner may then be used to regulate gene expression by inducing post-transcriptional silencing of the gene. Also, pyknon sequences can be used to derive an inducer of post-transcriptional silencing activity, wherein the sequence of the inducer is derived by taking the reverse complement of at least one of one or more pyknon sequences. Using the predicted pyknon sequences to study or affect gene expression may be conducted using techniques and procedures commonly known to those skilled in the art.

In accordance with the embodiments detailed above, the expression of a transcript can be regulated by using at least one nucleic acid molecule that binds to an area of said transcript that corresponds to at least one of one or more pyknon sequences having SEQ ID NO: 1 through SEQ ID NO: 747,326. Also, the expression of a transcript can be regulated by using at least one interfering RNA molecule that contains a region that corresponds to the reverse complement of at least one of one or more pyknon sequences having SEQ ID NO: 1 through SEQ ID NO: 747,326.

Although illustrative embodiments of the present invention have been described herein with reference to the accompanying drawings, it is to be understood that the invention is not limited to those precise embodiments, and that various other changes and modifications may be made by one skilled in the art without departing from the scope or spirit of the invention.

SEQUENCE LISTING (747378 sequences)

SEQ ID NO: 1 - DNA, 16 bp, H. sapiens
aaaaaaaaaaccctgt

SEQ ID NO: 2 - DNA, 16 bp, H. sapiens
aaaaaaaaaacctgtg

SEQ ID NO: 3 - DNA, 16 bp, H. sapiens
aaaaaaaaaacttgct

SEQ ID NO: 4 - DNA, 16 bp, H. sapiens
aaaaaaaaaagccctc

SEQ ID NO: 5 - DNA, 16 bp, H. sapiens
aaaaaaaaaagccctg

SEQ ID NO: 6 - DNA, 16 bp, H. sapiens
aaaaaaaaaagccgtg

SEQ ID NO: 7 - DNA, 16 bp, H. sapiens
aaaaaaaaaagcctgt

SEQ ID NO: 8 - DNA, 16 bp, H. sapiens
aaaaaaaaaaggctgt

SEQ ID NO: 9 - DNA, 16 bp, H. sapiens
aaaaaaaaaagtcctc

SEQ ID NO: 10 - DNA, 16 bp, H. sapiens
aaaaaaaaaagtctgg

SEQ ID NO: 11 - DNA, 16 bp, H. sapiens
aaaaaaaaaagtgctt

SEQ ID NO: 12 - DNA, 16 bp, H. sapiens
aaaaaaaaaagtttcc

SEQ ID NO: 13 - DNA, 16 bp, H. sapiens
aaaaaaaaaatctgtg

SEQ ID NO: 14 - DNA, 16 bp, H. sapiens
aaaaaaaaaatggctt

SEQ ID NO: 15 - DNA, 16 bp, H. sapiens
aaaaaaaaaattctgt

SEQ ID NO: 16 - DNA, 16 bp, H. sapiens
aaaaaaaaaattgctg

SEQ ID NO: 17 - DNA, 16 bp, H. sapiens
aaaaaaaaaatttgtc

SEQ ID NO: 18 - DNA, 16 bp, H. sapiens
aaaaaaaaacagggtc

SEQ ID NO: 19 - DNA, 16 bp, H. sapiens
aaaaaaaaacagtcct

SEQ ID NO: 20 - DNA, 16 bp, H. sapiens
aaaaaaaaacccatgc

SEQ ID NO: 21 - DNA, 16 bp, H. sapiens
aaaaaaaaaccctgag

SEQ ID NO: 22 - DNA, 16 bp, H. sapiens
aaaaaaaaacctattg

SEQ ID NO: 23 - DNA, 16 bp, H. sapiens
aaaaaaaaacctttga

SEQ ID NO: 24 - DNA, 16 bp, H. sapiens
aaaaaaaaactccttt

SEQ ID NO: 25 - DNA, 16 bp, H. sapiens
aaaaaaaaactgtgct

SEQ ID NO: 26 - DNA, 16 bp, H. sapiens
aaaaaaaaactttgac

SEQ ID NO: 27 - DNA, 16 bp, H. sapiens
aaaaaaaaacttttga

SEQ ID NO: 28 - DNA, 16 bp, H. sapiens
aaaaaaaaacttttgc

SEQ ID NO: 29 - DNA, 16 bp, H. sapiens
aaaaaaaaagacttct

SEQ ID NO: 30 - DNA, 16 bp, H. sapiens
aaaaaaaaagactttg

SEQ ID NO: 31 - DNA, 16 bp, H. sapiens
aaaaaaaaagatctgt

SEQ ID NO: 32 - DNA, 16 bp, H. sapiens
aaaaaaaaagatgccc

SEQ ID NO: 33 - DNA, 16 bp, H. sapiens
aaaaaaaaagatgctt

SEQ ID NO: 34 - DNA, 16 bp, H. sapiens
aaaaaaaaagatgtct

SEQ ID NO: 35 - DNA, 16 bp, H. sapiens
aaaaaaaaagcactgg

SEQ ID NO: 36 - DNA, 16 bp, H. sapiens
aaaaaaaaagcattgc

SEQ ID NO: 37 - DNA, 16 bp, H. sapiens
aaaaaaaaagccagct

SEQ ID NO: 38 - DNA, 16 bp, H. sapiens
aaaaaaaaagccaggt

SEQ ID NO: 39 - DNA, 16 bp, H. sapiens
aaaaaaaaagcctttc

SEQ ID NO: 40 - DNA, 16 bp, H. sapiens
aaaaaaaaagctcatt

SEQ ID NO: 41 - DNA, 16 bp, H. sapiens
aaaaaaaaagctcctg

SEQ ID NO: 42 - DNA, 16 bp, H. sapiens
aaaaaaaaagctgtta

SEQ ID NO: 43 - DNA, 16 bp, H. sapiens
aaaaaaaaagcttgct

SEQ ID NO: 44 - DNA, 16 bp, H. sapiens
aaaaaaaaagcttttc

SEQ ID NO: 45 - DNA, 16 bp, H. sapiens
aaaaaaaaagcttttt

SEQ ID NO: 46 - DNA, 16 bp, H. sapiens
aaaaaaaaaggcagtt

SEQ ID NO: 47 - DNA, 16 bp, H. sapiens
aaaaaaaaaggcatcc

SEQ ID NO: 48 - DNA, 16 bp, H. sapiens
aaaaaaaaaggctctt

SEQ ID NO: 49 - DNA, 16 bp, H. sapiens
aaaaaaaaaggctggt

SEQ ID NO: 50 - DNA, 16 bp, H. sapiens
aaaaaaaaaggtcatt

SEQ ID NO: 51 - DNA, 16 bp, H. sapiens
aaaaaaaaaggtctct

SEQ ID NO: 52 - DNA, 16 bp, H. sapiens
aaaaaaaaaggtttct

SEQ ID NO: 53 - DNA, 16 bp, H. sapiens
aaaaaaaaagtattct

SEQ ID NO: 54 - DNA, 16 bp, H. sapiens
aaaaaaaaagtcccat

SEQ ID NO: 55 - DNA, 16 bp, H. sapiens
aaaaaaaaagtctgct

SEQ ID NO: 56 - DNA, 16 bp, H. sapiens
aaaaaaaaagtctgta

SEQ ID NO: 57 - DNA, 16 bp, H. sapiens
aaaaaaaaagtctttt

SEQ ID NO: 58 - DNA, 16 bp, H. sapiens
aaaaaaaaagtgcctt

SEQ ID NO: 59 - DNA, 16 bp, H. sapiens
aaaaaaaaagtggctg

SEQ ID NO: 60 - DNA, 16 bp, H. sapiens
aaaaaaaaagttctat

SEQ ID NO: 61 - DNA, 16 bp, H. sapiens
aaaaaaaaagttctct

SEQ ID NO: 62 - DNA, 16 bp, H. sapiens
aaaaaaaaagtttctc

SEQ ID NO: 63 - DNA, 16 bp, H. sapiens
aaaaaaaaagtttgct

SEQ ID NO: 64 - DNA, 16 bp, H. sapiens
aaaaaaaaagtttggt

SEQ ID NO: 65 - DNA, 16 bp, H. sapiens
aaaaaaaaatagttct

SEQ ID NO: 66 - DNA, 16 bp, H. sapiens
aaaaaaaaatccctag

SEQ ID NO: 67 - DNA, 16 bp, H. sapiens
aaaaaaaaatcctgtt

SEQ ID NO: 68 - DNA, 16 bp, H. sapiens
aaaaaaaaatctaggc

SEQ ID NO: 69 - DNA, 16 bp, H. sapiens
aaaaaaaaatctcctg

SEQ ID NO: 70 - DNA, 16 bp, H. sapiens
aaaaaaaaatctcttg

SEQ ID NO: 71 - DNA, 16 bp, H. sapiens
aaaaaaaaatctgcta

SEQ ID NO: 72 - DNA, 16 bp, H. sapiens
aaaaaaaaatcttctg

SEQ ID NO: 73 - DNA, 16 bp, H. sapiens
aaaaaaaaatctttga

SEQ ID NO: 74 - DNA, 16 bp, H. sapiens
aaaaaaaaatgaccct

SEQ ID NO: 75 - DNA, 16 bp, H. sapiens
aaaaaaaaatgcagct

SEQ ID NO: 76 - DNA, 16 bp, H. sapiens
aaaaaaaaatgctgag

SEQ ID NO: 77 - DNA, 16 bp, H. sapiens
aaaaaaaaatggcctt

SEQ ID NO: 78 - DNA, 16 bp, H. sapiens
aaaaaaaaatgtgttc

SEQ ID NO: 79 - DNA, 16 bp, H. sapiens
aaaaaaaaatgttcat

SEQ ID NO: 80 - DNA, 16 bp, H. sapiens
aaaaaaaaattacctg

SEQ ID NO: 81 - DNA, 16 bp, H. sapiens
aaaaaaaaattactgt

SEQ ID NO: 82 - DNA, 23 bp, H. sapiens
aaaaaaaaattagctgggcgtgg

SEQ ID NO: 83 - DNA, 16 bp, H. sapiens
aaaaaaaaattaggtc

SEQ ID NO: 84 - DNA, 16 bp, H. sapiens
aaaaaaaaattccatg

SEQ ID NO: 85 - DNA, 16 bp, H. sapiens
aaaaaaaaattccctt

SEQ ID NO: 86 - DNA, 16 bp, H. sapiens
aaaaaaaaattctgct

SEQ ID NO: 87 - DNA, 16 bp, H. sapiens
aaaaaaaaattcttag

SEQ ID NO: 88 - DNA, 16 bp, H. sapiens
aaaaaaaaattgatgc

SEQ ID NO: 89 - DNA, 16 bp, H. sapiens
aaaaaaaaattgattc

SEQ ID NO: 90 - DNA, 16 bp, H. sapiens
aaaaaaaaattgctgc

SEQ ID NO: 91 - DNA, 16 bp, H. sapiens
aaaaaaaaattttctg

SEQ ID NO: 92 - DNA, 16 bp, H. sapiens
aaaaaaaacaactggc

SEQ ID NO: 93 - DNA, 16 bp, H. sapiens
aaaaaaaacagatttc

SEQ ID NO: 94 - DNA, 16 bp, H. sapiens
aaaaaaaacagctgga

SEQ ID NO: 95 - DNA, 16 bp, H. sapiens
aaaaaaaaccctgctt

SEQ ID NO: 96 - DNA, 16 bp, H. sapiens
aaaaaaaacctccaga

SEQ ID NO: 97 - DNA, 16 bp, H. sapiens
aaaaaaaacctttgaa

SEQ ID NO: 98 - DNA, 16 bp, H. sapiens
aaaaaaaactcttcta

SEQ ID NO: 99 - DNA, 16 bp, H. sapiens
aaaaaaaactggtttt

SEQ ID NO: 100 - DNA, 16 bp, H. sapiens
aaaaaaaacttcagtt

SEQ ID NO: 101 - DNA, 16 bp, H. sapiens
aaaaaaaacttgctca

SEQ ID NO: 102 - DNA, 16 bp, H. sapiens
aaaaaaaactttattg

SEQ ID NO: 103 - DNA, 16 bp, H. sapiens
aaaaaaaactttgcct

SEQ ID NO: 104 - DNA, 16 bp, H. sapiens
aaaaaaaactttttgt

SEQ ID NO: 105 - DNA, 16 bp, H. sapiens
aaaaaaaagaactttg

SEQ ID NO: 106 - DNA, 16 bp, H. sapiens
aaaaaaaagaattctt

SEQ ID NO: 107 - DNA, 16 bp, H. sapiens
aaaaaaaagacttctt

SEQ ID NO: 108 - DNA, 16 bp, H. sapiens
aaaaaaaagaggcctg

SEQ ID NO: 109 - DNA, 16 bp, H. sapiens
aaaaaaaagatacctt

SEQ ID NO: 110 - DNA, 16 bp, H. sapiens
aaaaaaaagatctcag

SEQ ID NO: 111 - DNA, 16 bp, H. sapiens
aaaaaaaagattccct

SEQ ID NO: 112 - DNA, 16 bp, H. sapiens
aaaaaaaagattcttc

SEQ ID NO: 113 - DNA, 16 bp, H. sapiens
aaaaaaaagattttct

SEQ ID NO: 114 - DNA, 16 bp, H. sapiens
aaaaaaaagcaatggc

SEQ ID NO: 115 - DNA, 16 bp, H. sapiens
aaaaaaaagcagccat

SEQ ID NO: 116 - DNA, 16 bp, H. sapiens
aaaaaaaagcatttac

SEQ ID NO: 117 - DNA, 16 bp, H. sapiens
aaaaaaaagccacatt

SEQ ID NO: 118 - DNA, 16 bp, H. sapiens
aaaaaaaagccagtgt

SEQ ID NO: 119 - DNA, 16 bp, H. sapiens
aaaaaaaagcccaggg

SEQ ID NO: 120 - DNA, 16 bp, H. sapiens
aaaaaaaagcccttca

SEQ ID NO: 121 - DNA, 16 bp, H. sapiens
aaaaaaaagcttaatt

SEQ ID NO: 122 - DNA, 16 bp, H. sapiens
aaaaaaaagcttcaag

SEQ ID NO: 123 - DNA, 16 bp, H. sapiens
aaaaaaaaggaactcc

SEQ ID NO: 124 - DNA, 16 bp, H. sapiens
aaaaaaaaggacattt

SEQ ID NO: 125 - DNA, 16 bp, H. sapiens
aaaaaaaaggagagct

SEQ ID NO: 126 - DNA, 16 bp, H. sapiens
aaaaaaaaggattcag

SEQ ID NO: 127 - DNA, 16 bp, H. sapiens
aaaaaaaaggcaattg

SEQ ID NO: 128 - DNA, 16 bp, H. sapiens
aaaaaaaaggccatta

SEQ ID NO: 129 - DNA, 16 bp, H. sapiens
aaaaaaaaggtctttc

SEQ ID NO: 130 - DNA, 16 bp, H. sapiens
aaaaaaaaggtttttg

SEQ ID NO: 131 - DNA, 16 bp, H. sapiens
aaaaaaaagtatcagt

SEQ ID NO: 132 - DNA, 16 bp, H. sapiens
aaaaaaaagtatctct

SEQ ID NO: 133 - DNA, 16 bp, H. sapiens
aaaaaaaagtcactgg

SEQ ID NO: 134 - DNA, 16 bp, H. sapiens
aaaaaaaagtcatcca

SEQ ID NO: 135 - DNA, 16 bp, H. sapiens
aaaaaaaagtcatgat

SEQ ID NO: 136 - DNA, 16 bp, H. sapiens
aaaaaaaagtccacag

SEQ ID NO: 137 - DNA, 16 bp, H. sapiens
aaaaaaaagtctatat

SEQ ID NO: 138 - DNA, 16 bp, H. sapiens
aaaaaaaagtctattt

SEQ ID NO: 139 - DNA, 16 bp, H. sapiens
aaaaaaaagtcttgca

SEQ ID NO: 140 - DNA, 16 bp, H. sapiens
aaaaaaaagtgggatt

SEQ ID NO: 141 - DNA, 16 bp, H. sapiens
aaaaaaaagtgtatct

SEQ ID NO: 142 - DNA, 16 bp, H. sapiens
aaaaaaaagtgtattc

SEQ ID NO: 143 - DNA, 16 bp, H. sapiens
aaaaaaaagtgtattg

SEQ ID NO: 144 - DNA, 16 bp, H. sapiens
aaaaaaaagtgttaca

SEQ ID NO: 145 - DNA, 16 bp, H. sapiens
aaaaaaaagttcaact

SEQ ID NO: 146 - DNA, 16 bp, H. sapiens
aaaaaaaagttcatga

SEQ ID NO: 147 - DNA, 16 bp, H. sapiens
aaaaaaaagttcttaa

SEQ ID NO: 148 - DNA, 16 bp, H. sapiens
aaaaaaaagttcttta

SEQ ID NO: 149 - DNA, 16 bp, H. sapiens
aaaaaaaagttgaact

SEQ ID NO: 150 - DNA, 16 bp, H. sapiens
aaaaaaaagttgatct

SEQ ID NO: 151 - DNA, 16 bp, H. sapiens
aaaaaaaagtttcaga

SEQ ID NO: 152 - DNA, 16 bp, H. sapiens
aaaaaaaagtttcatc

SEQ ID NO: 153 - DNA, 16 bp, H. sapiens
aaaaaaaagtttcttt

SEQ ID NO: 154 - DNA, 16 bp, H. sapiens
aaaaaaaagtttgcca

SEQ ID NO: 155 - DNA, 16 bp, H. sapiens
aaaaaaaagtttgttg

SEQ ID NO: 156 - DNA, 16 bp, H. sapiens
aaaaaaaagttttcat

SEQ ID NO: 157 - DNA, 16 bp, H. sapiens
aaaaaaaatagctcta

SEQ ID NO: 158 - DNA, 16 bp, H. sapiens
aaaaaaaatagctggg

SEQ ID NO: 159 - DNA, 16 bp, H. sapiens
aaaaaaaatcaagtgc

SEQ ID NO: 160 - DNA, 16 bp, H. sapiens
aaaaaaaatcacttgt

SEQ ID NO: 161 - DNA, 16 bp, H. sapiens
aaaaaaaatcagattt

SEQ ID NO: 162 - DNA, 16 bp, H. sapiens
aaaaaaaatcagtatt

SEQ ID NO: 163 - DNA, 16 bp, H. sapiens
aaaaaaaatcagtgtg

SEQ ID NO: 164 - DNA, 16 bp, H. sapiens
aaaaaaaatcatgact

SEQ ID NO: 165 - DNA, 16 bp, H. sapiens
aaaaaaaatcatgatg

SEQ ID NO: 166 - DNA, 16 bp, H. sapiens
aaaaaaaatcatggta

SEQ ID NO: 167 - DNA, 16 bp, H. sapiens
aaaaaaaatcatgttt

SEQ ID NO: 168 - DNA, 16 bp, H. sapiens
aaaaaaaatcattgat

SEQ ID NO: 169 - DNA, 16 bp, H. sapiens
aaaaaaaatccaagcc

SEQ ID NO: 170 - DNA, 16 bp, H. sapiens
aaaaaaaatccatcct

SEQ ID NO: 171 - DNA, 16 bp, H. sapiens
aaaaaaaatccatgtt

SEQ ID NO: 172 - DNA, 16 bp, H. sapiens
aaaaaaaatccctcag

SEQ ID NO: 173 - DNA, 16 bp, H. sapiens
aaaaaaaatcctgact

SEQ ID NO: 174 - DNA, 16 bp, H. sapiens
aaaaaaaatcctgatt

SEQ ID NO: 175 - DNA, 16 bp, H. sapiens
aaaaaaaatcctggag

SEQ ID NO: 176 - DNA, 16 bp, H. sapiens
aaaaaaaatcctggtg

SEQ ID NO: 177 - DNA, 16 bp, H. sapiens
aaaaaaaatctcactg

SEQ ID NO: 178 - DNA, 16 bp, H. sapiens
aaaaaaaatctccaag

SEQ ID NO: 179 - DNA, 16 bp, H. sapiens
aaaaaaaatctcttga

SEQ ID NO: 180 - DNA, 16 bp, H. sapiens
aaaaaaaatctctttt

SEQ ID NO: 181 - DNA, 16 bp, H. sapiens
aaaaaaaatctgaatt

SEQ ID NO: 182 - DNA, 16 bp, H. sapiens
aaaaaaaatctgtatt

SEQ ID NO: 183 - DNA, 16 bp, H. sapiens
aaaaaaaatctgttgc

SEQ ID NO: 184 - DNA, 16 bp, H. sapiens
aaaaaaaatcttggga

SEQ ID NO: 185 - DNA, 16 bp, H. sapiens
aaaaaaaatcttggta

SEQ ID NO: 186 - DNA, 16 bp, H. sapiens
aaaaaaaatctttctt

SEQ ID NO: 187 - DNA, 16 bp, H. sapiens
aaaaaaaatcttttgt

SEQ ID NO: 188 - DNA, 16 bp, H. sapiens
aaaaaaaatctttttg

SEQ ID NO: 189 - DNA, 16 bp, H. sapiens
aaaaaaaatgaatgct

SEQ ID NO: 190 - DNA, 16 bp, H. sapiens
aaaaaaaatgcatatt

SEQ ID NO: 191 - DNA, 16 bp, H. sapiens
aaaaaaaatgctgcag

SEQ ID NO: 192 - DNA, 16 bp, H. sapiens
aaaaaaaatgctgctg

SEQ ID NO: 193 - DNA, 16 bp, H. sapiens
aaaaaaaatgctggaa

SEQ ID NO: 194 - DNA, 16 bp, H. sapiens
aaaaaaaatgcttgct

SEQ ID NO: 195 - DNA, 16 bp, H. sapiens
aaaaaaaatgctttta

SEQ ID NO: 196 - DNA, 16 bp, H. sapiens
aaaaaaaatggttttc

SEQ ID NO: 197 - DNA, 16 bp, H. sapiens
aaaaaaaatgtacagt

SEQ ID NO: 198 - DNA, 16 bp, H. sapiens
aaaaaaaatgtacatg

SEQ ID NO: 199 - DNA, 16 bp, H. sapiens
aaaaaaaatgtatctt

SEQ ID NO: 200 - DNA, 16 bp, H. sapiens
aaaaaaaatgtattca

SEQ ID NO: 201 - DNA, 16 bp, H. sapiens
aaaaaaaatgtcagtg

SEQ ID NO: 202 - DNA, 16 bp, H. sapiens
aaaaaaaatgtcttca

SEQ ID NO: 203 - DNA, 16 bp, H. sapiens
aaaaaaaatgtggtac

SEQ ID NO: 204 - DNA, 16 bp, H. sapiens
aaaaaaaatgtgtgct

SEQ ID NO: 205 - DNA, 16 bp, H. sapiens
aaaaaaaatgttcaat

SEQ ID NO: 206 - DNA, 16 bp, H. sapiens
aaaaaaaatgttgact

SEQ ID NO: 207 - DNA, 16 bp, H. sapiens
aaaaaaaatgttgcta

SEQ ID NO: 208 - DNA, 16 bp, H. sapiens
aaaaaaaatgtttttg

SEQ ID NO: 209 - DNA, 16 bp, H. sapiens
aaaaaaaattaagtct

SEQ ID NO: 210 - DNA, 16 bp, H. sapiens
aaaaaaaattactgca

SEQ ID NO: 211 - DNA, 16 bp, H. sapiens
aaaaaaaattagccag

SEQ ID NO: 212 - DNA, 16 bp, H. sapiens
aaaaaaaattatttgc

SEQ ID NO: 213 - DNA, 16 bp, H. sapiens
aaaaaaaattcactct

SEQ ID NO: 214 - DNA, 16 bp, H. sapiens
aaaaaaaattcaggcc

SEQ ID NO: 215 - DNA, 16 bp, H. sapiens
aaaaaaaattcagtat

SEQ ID NO: 216 - DNA, 16 bp, H. sapiens
aaaaaaaattcagttt

SEQ ID NO: 217 - DNA, 16 bp, H. sapiens
aaaaaaaattccctgg

SEQ ID NO: 218 - DNA, 16 bp, H. sapiens
aaaaaaaattcctgac

SEQ ID NO: 219 - DNA, 16 bp, H. sapiens
aaaaaaaattcctttc

SEQ ID NO: 220 - DNA, 16 bp, H. sapiens
aaaaaaaattctgatt

SEQ ID NO: 221 - DNA, 16 bp, H. sapiens
aaaaaaaattctgtaa

SEQ ID NO: 222 - DNA, 16 bp, H. sapiens
aaaaaaaattcttttc

SEQ ID NO: 223 - DNA, 16 bp, H. sapiens
aaaaaaaattgaagcc

SEQ ID NO: 224 - DNA, 16 bp, H. sapiens
aaaaaaaattgcagta

SEQ ID NO: 225 - DNA, 16 bp, H. sapiens
aaaaaaaattgccttt

SEQ ID NO: 226 - DNA, 16 bp, H. sapiens
aaaaaaaattgcttaa

SEQ ID NO: 227 - DNA, 16 bp, H. sapiens
aaaaaaaattggaggc

SEQ ID NO: 228 - DNA, 16 bp, H. sapiens
aaaaaaaattgtaagc

SEQ ID NO: 229 - DNA, 16 bp, H. sapiens
aaaaaaaattgtactt

SEQ ID NO: 230 - DNA, 16 bp, H. sapiens
aaaaaaaattgtctta

SEQ ID NO: 231 - DNA, 16 bp, H. sapiens
aaaaaaaattgtcttc

SEQ ID NO: 232 - DNA, 16 bp, H. sapiens
aaaaaaaattgtgtag

SEQ ID NO: 233 - DNA, 16 bp, H. sapiens
aaaaaaaattgttctt

SEQ ID NO: 234 - DNA, 16 bp, H. sapiens
aaaaaaaatttctaga

SEQ ID NO: 235 - DNA, 16 bp, H. sapiens
aaaaaaaatttttctg

SEQ ID NO: 236 - DNA, 16 bp, H. sapiens
aaaaaaacaagtttat

SEQ ID NO: 237 - DNA, 16 bp, H. sapiens
aaaaaaacacctgttt

SEQ ID NO: 238 - DNA, 16 bp, H. sapiens
aaaaaaacagattttc

SEQ ID NO: 239 - DNA, 16 bp, H. sapiens
aaaaaaacaggtttta

SEQ ID NO: 240 - DNA, 16 bp, H. sapiens
aaaaaaacagtaattt

SEQ ID NO: 241 - DNA, 16 bp, H. sapiens
aaaaaaacagtttata

SEQ ID NO: 242 - DNA, 16 bp, H. sapiens
aaaaaaacagtttatt

SEQ ID NO: 243 - DNA, 16 bp, H. sapiens
aaaaaaacagtttttt

SEQ ID NO: 244 - DNA, 16 bp, H. sapiens
aaaaaaacccacagtg

SEQ ID NO: 245 - DNA, 16 bp, H. sapiens
aaaaaaaccctatgaa

SEQ ID NO: 246 - DNA, 16 bp, H. sapiens
aaaaaaaccctgaatt

SEQ ID NO: 247 - DNA, 16 bp, H. sapiens
aaaaaaaccctgcaga

SEQ ID NO: 248 - DNA, 16 bp, H. sapiens
aaaaaaaccctggaaa

SEQ ID NO: 249 - DNA, 16 bp, H. sapiens
aaaaaaacctgaggaa

SEQ ID NO: 250 - DNA, 16 bp, H. sapiens
aaaaaaactccaggac

SEQ ID NO: 251 - DNA, 16 bp, H. sapiens
aaaaaaactgcatcaa

SEQ ID NO: 252 - DNA, 16 bp, H. sapiens
aaaaaaactgtgagaa

SEQ ID NO: 253 - DNA, 16 bp, H. sapiens
aaaaaaactttcagaa

SEQ ID NO: 254 - DNA, 16 bp, H. sapiens
aaaaaaactttgtaaa

SEQ ID NO: 255 - DNA, 16 bp, H. sapiens
aaaaaaacttttgtaa

SEQ ID NO: 256 - DNA, 16 bp, H. sapiens
aaaaaaagaaactgcc

SEQ ID NO: 257 - DNA, 16 bp, H. sapiens
aaaaaaagaaactgtg

SEQ ID NO: 258 - DNA, 16 bp, H. sapiens
aaaaaaagaaagcctt

SEQ ID NO: 259 - DNA, 16 bp, H. sapiens
aaaaaaagaaagtctt

SEQ ID NO: 260 - DNA, 16 bp, H. sapiens
aaaaaaagaacatttt

SEQ ID NO: 261 - DNA, 16 bp, H. sapiens
aaaaaaagaactttgg

SEQ ID NO: 262 - DNA, 16 bp, H. sapiens
aaaaaaagaagattcc

SEQ ID NO: 263 - DNA, 16 bp, H. sapiens
aaaaaaagaagcttta

SEQ ID NO: 264 - DNA, 16 bp, H. sapiens
aaaaaaagaatagctt

SEQ ID NO: 265 - DNA, 16 bp, H. sapiens
aaaaaaagaatcactt

SEQ ID NO: 266 - DNA, 16 bp, H. sapiens
aaaaaaagaatcattt

SEQ ID NO: 267 - DNA, 16 bp, H. sapiens
aaaaaaagaatcccag

SEQ ID NO: 268 - DNA, 16 bp, H. sapiens
aaaaaaagaatctctt

SEQ ID NO: 269 - DNA, 16 bp, H. sapiens
aaaaaaagaatgctca

SEQ ID NO: 270 - DNA, 16 bp, H. sapiens
aaaaaaagaatgctgt

SEQ ID NO: 271 - DNA, 16 bp, H. sapiens
aaaaaaagaatggact

SEQ ID NO: 272 - DNA, 16 bp, H. sapiens
aaaaaaagaattccat

SEQ ID NO: 273 - DNA, 16 bp, H. sapiens
aaaaaaagaatttttc

SEQ ID NO: 274 - DNA, 16 bp, H. sapiens
aaaaaaagacagggtc

SEQ ID NO: 275 - DNA, 16 bp, H. sapiens
aaaaaaagacagttga

SEQ ID NO: 276 - DNA, 16 bp, H. sapiens
aaaaaaagactggaga

SEQ ID NO: 277 - DNA, 16 bp, H. sapiens
aaaaaaagactgtctc

SEQ ID NO: 278 - DNA, 16 bp, H. sapiens
aaaaaaagacttgaga

SEQ ID NO: 279 - DNA, 16 bp, H. sapiens
aaaaaaagacttgttt

SEQ ID NO: 280 - DNA, 16 bp, H. sapiens
aaaaaaagagaacttt

SEQ ID NO: 281 - DNA, 16 bp, H. sapiens
aaaaaaagagagacct

SEQ ID NO: 282 - DNA, 16 bp, H. sapiens
aaaaaaagagatttca

SEQ ID NO: 283 - DNA, 16 bp, H. sapiens
aaaaaaagatgtttgt

SEQ ID NO: 284 - DNA, 16 bp, H. sapiens
aaaaaaagattacagg

SEQ ID NO: 285 - DNA, 16 bp, H. sapiens
aaaaaaagattacttt

SEQ ID NO: 286 - DNA, 16 bp, H. sapiens
aaaaaaagcaaatttc

SEQ ID NO: 287 - DNA, 16 bp, H. sapiens
aaaaaaagcaagattt

SEQ ID NO: 288 - DNA, 16 bp, H. sapiens
aaaaaaagcaagggtt

SEQ ID NO: 289 - DNA, 16 bp, H. sapiens
aaaaaaagcaattttt

SEQ ID NO: 290 - DNA, 16 bp, H. sapiens
aaaaaaagcagcagct

SEQ ID NO: 291 - DNA, 16 bp, H. sapiens
aaaaaaagcattttca

SEQ ID NO: 292 - DNA, 16 bp, H. sapiens
aaaaaaagccaaattt

SEQ ID NO: 293 - DNA, 16 bp, H. sapiens
aaaaaaagccactttc

SEQ ID NO: 294 - DNA, 16 bp, H. sapiens
aaaaaaagcccacatt

SEQ ID NO: 295 - DNA, 16 bp, H. sapiens
aaaaaaagcctccaag

SEQ ID NO: 296 - DNA, 16 bp, H. sapiens
aaaaaaagctcaacct

SEQ ID NO: 297 - DNA, 16 bp, H. sapiens
aaaaaaagctgaaatt

SEQ ID NO: 298 - DNA, 16 bp, H. sapiens
aaaaaaagctgaattt

SEQ ID NO: 299 - DNA, 16 bp, H. sapiens
aaaaaaagctgtattt

SEQ ID NO: 300 - DNA, 16 bp, H. sapiens
aaaaaaagcttttaaa

SEQ ID NO: 301 - DNA, 16 bp, H. sapiens
aaaaaaaggaaactgt

SEQ ID NO: 302 - DNA, 16 bp, H. sapiens
aaaaaaaggaatctga

SEQ ID NO: 303 - DNA, 16 bp, H. sapiens
aaaaaaaggaatggca

SEQ ID NO: 304 - DNA, 16 bp, H. sapiens
aaaaaaaggaattcag

SEQ ID NO: 305 - DNA, 16 bp, H. sapiens
aaaaaaaggcttagaa

SEQ ID NO: 306 - DNA, 16 bp, H. sapiens
aaaaaaagggtattca

SEQ ID NO: 307 - DNA, 16 bp, H. sapiens
aaaaaaaggtttttat

SEQ ID NO: 308 - DNA, 16 bp, H. sapiens
aaaaaaagtaattcta

SEQ ID NO: 309 - DNA, 16 bp, H. sapiens
aaaaaaagtacatgta

SEQ ID NO: 310 - DNA, 16 bp, H. sapiens
aaaaaaagtcaatttt

SEQ ID NO: 311 - DNA, 16 bp, H. sapiens
aaaaaaagtccaggaa

SEQ ID NO: 312 - DNA, 16 bp, H. sapiens
aaaaaaagtccttttt

SEQ ID NO: 313 - DNA, 16 bp, H. sapiens
aaaaaaagtgatttgg

SEQ ID NO: 314 - DNA, 16 bp, H. sapiens
aaaaaaagtgttcatt

SEQ ID NO: 315 - DNA, 16 bp, H. sapiens
aaaaaaagtgtttgca

SEQ ID NO: 316 - DNA, 16 bp, H. sapiens
aaaaaaagttaatctc

SEQ ID NO: 317 - DNA, 16 bp, H. sapiens
aaaaaaagttagccag

SEQ ID NO: 318 - DNA, 16 bp, H. sapiens
aaaaaaagttcaaatg

SEQ ID NO: 319 - DNA, 16 bp, H. sapiens
aaaaaaagttcagcat

SEQ ID NO: 320 - DNA, 16 bp, H. sapiens
aaaaaaagttgatctc

SEQ ID NO: 321 - DNA, 16 bp, H. sapiens
aaaaaaagttgtattt

SEQ ID NO: 322 - DNA, 16 bp, H. sapiens
aaaaaaagttgtttta

SEQ ID NO: 323 - DNA, 16 bp, H. sapiens
aaaaaaagttgttttt

SEQ ID NO: 324 - DNA, 16 bp, H. sapiens
aaaaaaagtttatgtt

SEQ ID NO: 325 - DNA, 16 bp, H. sapiens
aaaaaaagtttgaagc

SEQ ID NO: 326 - DNA, 16 bp, H. sapiens
aaaaaaagtttgctaa

SEQ ID NO: 327 - DNA, 16 bp, H. sapiens
aaaaaaagtttgtctt

SEQ ID NO: 328 - DNA, 16 bp, H. sapiens
aaaaaaagttttactt

SEQ ID NO: 329 - DNA, 16 bp, H. sapiens
aaaaaaataagcattt

SEQ ID NO: 330 - DNA, 16 bp, H. sapiens
aaaaaaataagcttat

SEQ ID NO: 331 - DNA, 16 bp, H. sapiens
aaaaaaataagttcta

SEQ ID NO: 332 - DNA, 16 bp, H. sapiens
aaaaaaataattagct

SEQ ID NO: 333 - DNA, 16 bp, H. sapiens
aaaaaaatacagatgc

SEQ ID NO: 334 - DNA, 16 bp, H. sapiens
aaaaaaatacagcttc

SEQ ID NO: 335 - DNA, 16 bp, H. sapiens
aaaaaaatacattcag

SEQ ID NO: 336 - DNA, 16 bp, H. sapiens
aaaaaaatagccatgc

SEQ ID NO: 337 - DNA, 16 bp, H. sapiens
aaaaaaatagctgaat

SEQ ID NO: 338 - DNA, 16 bp, H. sapiens
aaaaaaatagtttgtg

SEQ ID NO: 339 - DNA, 16 bp, H. sapiens
aaaaaaatatcctttt

SEQ ID NO: 340 - DNA, 16 bp, H. sapiens
aaaaaaatcaactctg

SEQ ID NO: 341 - DNA, 16 bp, H. sapiens
aaaaaaatcaagattt

SEQ ID NO: 342 - DNA, 16 bp, H. sapiens
aaaaaaatcaaggtat

SEQ ID NO: 343 - DNA, 16 bp, H. sapiens
aaaaaaatcaaggttt

SEQ ID NO: 344 - DNA, 16 bp, H. sapiens
aaaaaaatcacaagtc

SEQ ID NO: 345 - DNA, 16 bp, H. sapiens
aaaaaaatcacagtgt

SEQ ID NO: 346 - DNA, 16 bp, H. sapiens
aaaaaaatcactgttt

SEQ ID NO: 347 - DNA, 16 bp, H. sapiens
aaaaaaatcagaattt

SEQ ID NO: 348 - DNA, 16 bp, H. sapiens
aaaaaaatcagacatt

SEQ ID NO: 349 - DNA, 16 bp, H. sapiens
aaaaaaatcagagatt

SEQ ID NO: 350 - DNA, 16 bp, H. sapiens
aaaaaaatcagagttt

SEQ ID NO: 351 - DNA, 16 bp, H. sapiens
aaaaaaatcagcagca

SEQ ID NO: 352 - DNA, 16 bp, H. sapiens
aaaaaaatcagtcaat

SEQ ID NO: 353 - DNA, 16 bp, H. sapiens
aaaaaaatcagttgac

SEQ ID NO: 354 - DNA, 16 bp, H. sapiens
aaaaaaatcagtttta

SEQ ID NO: 355 - DNA, 16 bp, H. sapiens
aaaaaaatcagttttt

SEQ ID NO: 356 - DNA, 16 bp, H. sapiens
aaaaaaatcatatgta

SEQ ID NO: 357 - DNA, 16 bp, H. sapiens
aaaaaaatcatcttct

SEQ ID NO: 358 - DNA, 16 bp, H. sapiens
aaaaaaatcatgattt

SEQ ID NO: 359 - DNA, 16 bp, H. sapiens
aaaaaaatcatgttct

SEQ ID NO: 360 - DNA, 16 bp, H. sapiens
aaaaaaatcattcaag

SEQ ID NO: 361 - DNA, 16 bp, H. sapiens
aaaaaaatcattcagt

SEQ ID NO: 362 - DNA, 16 bp, H. sapiens
aaaaaaatcattctga

SEQ ID NO: 363 - DNA, 16 bp, H. sapiens
aaaaaaatcattgcca

SEQ ID NO: 364 - DNA, 16 bp, H. sapiens
aaaaaaatcattgttt

SEQ ID NO: 365 - DNA, 16 bp, H. sapiens
aaaaaaatcatttgta

SEQ ID NO: 366 - DNA, 16 bp, H. sapiens
aaaaaaatccagaatc

SEQ ID NO: 367 - DNA, 16 bp, H. sapiens
aaaaaaatccatgctt

SEQ ID NO: 368 - DNA, 16 bp, H. sapiens
aaaaaaatccatgtgt

SEQ ID NO: 369 - DNA, 16 bp, H. sapiens
aaaaaaatcccattta

SEQ ID NO: 370 - DNA, 16 bp, H. sapiens
aaaaaaatccctttct

SEQ ID NO: 371 - DNA, 16 bp, H. sapiens
aaaaaaatcctccaga

SEQ ID NO: 372 - DNA, 16 bp, H. sapiens
aaaaaaatcctggaag

SEQ ID NO: 373 - DNA, 16 bp, H. sapiens
aaaaaaatcctttact

SEQ ID NO: 374 - DNA, 16 bp, H. sapiens
aaaaaaatcctttcaa

SEQ ID NO: 375 - DNA, 16 bp, H. sapiens
aaaaaaatctactttt

SEQ ID NO: 376 - DNA, 16 bp, H. sapiens
aaaaaaatctagaatt

SEQ ID NO: 377 - DNA, 16 bp, H. sapiens
aaaaaaatctagtatt

SEQ ID NO: 378 - DNA, 16 bp, H. sapiens
aaaaaaatctctgctg

SEQ ID NO: 379 - DNA, 16 bp, H. sapiens
aaaaaaatctctggaa

SEQ ID NO: 380 - DNA, 16 bp, H. sapiens
aaaaaaatctgaagtt

SEQ ID NO: 381 - DNA, 16 bp, H. sapiens
aaaaaaatctgggaaa

SEQ ID NO: 382 - DNA, 16 bp, H. sapiens
aaaaaaatctgtgcat

SEQ ID NO: 383 - DNA, 16 bp, H. sapiens
aaaaaaatctgttgaa

SEQ ID NO: 384 - DNA, 16 bp, H. sapiens
aaaaaaatctgttttt

SEQ ID NO: 385 - DNA, 16 bp, H. sapiens
aaaaaaatcttggcca

SEQ ID NO: 386 - DNA, 16 bp, H. sapiens
aaaaaaatcttgttat

SEQ ID NO: 387 - DNA, 16 bp, H. sapiens
aaaaaaatgaagactt

SEQ ID NO: 388 - DNA, 16 bp, H. sapiens
aaaaaaatgaatcttt

SEQ ID NO: 389 - DNA, 16 bp, H. sapiens
aaaaaaatgaatttca

SEQ ID NO: 390 - DNA, 16 bp, H. sapiens
aaaaaaatgacatttc

SEQ ID NO: 391 - DNA, 16 bp, H. sapiens
aaaaaaatgagttttt

SEQ ID NO: 392 - DNA, 16 bp, H. sapiens
aaaaaaatgatttcaa

SEQ ID NO: 393 - DNA, 16 bp, H. sapiens
aaaaaaatgcaagttt

SEQ ID NO: 394 - DNA, 16 bp, H. sapiens
aaaaaaatgcactgaa

SEQ ID NO: 395 - DNA, 16 bp, H. sapiens
aaaaaaatgcagatta

SEQ ID NO: 396 - DNA, 16 bp, H. sapiens
aaaaaaatgcagtgaa

SEQ ID NO: 397 - DNA, 16 bp, H. sapiens
aaaaaaatgcattctt

SEQ ID NO: 398 - DNA, 16 bp, H. sapiens
aaaaaaatgccttttc

SEQ ID NO: 399 - DNA, 16 bp, H. sapiens
aaaaaaatgctactga

SEQ ID NO: 400 - DNA, 16 bp, H. sapiens
aaaaaaatgctgaaag

SEQ ID NO: 401 - DNA, 16 bp, H. sapiens
aaaaaaatgctgtgat

SEQ ID NO: 402 - DNA, 16 bp, H. sapiens
aaaaaaatgcttcttt

SEQ ID NO: 403 - DNA, 16 bp, H. sapiens
aaaaaaatggagacag

SEQ ID NO: 404 - DNA, 16 bp, H. sapiens
aaaaaaatggatttca

SEQ ID NO: 405 - DNA, 16 bp, H. sapiens
aaaaaaatggcatttt

SEQ ID NO: 406 - DNA, 16 bp, H. sapiens
aaaaaaatgggtaact

SEQ ID NO: 407 - DNA, 16 bp, H. sapiens
aaaaaaatgtacatat

SEQ ID NO: 408 - DNA, 16 bp, H. sapiens
aaaaaaatgtatctga

SEQ ID NO: 409 - DNA, 16 bp, H. sapiens
aaaaaaatgtatcttt

SEQ ID NO: 410 - DNA, 16 bp, H. sapiens
aaaaaaatgtattcaa

SEQ ID NO: 411 - DNA, 16 bp, H. sapiens
aaaaaaatgtattctg

SEQ ID NO: 412 - DNA, 16 bp, H. sapiens
aaaaaaatgtatttca

SEQ ID NO: 413 - DNA, 16 bp, H. sapiens
aaaaaaatgtgtttat

SEQ ID NO: 414 - DNA, 16 bp, H. sapiens
aaaaaaatgtgtttga

SEQ ID NO: 415 - DNA, 16 bp, H. sapiens
aaaaaaatgttaagtg

SEQ ID NO: 416 - DNA, 16 bp, H. sapiens
aaaaaaatgttaatgg

SEQ ID NO: 417 - DNA, 16 bp, H. sapiens
aaaaaaatgtttagtt

SEQ ID NO: 418 - DNA, 16 bp, H. sapiens
aaaaaaatgtttgttt

SEQ ID NO: 419 - DNA, 16 bp, H. sapiens
aaaaaaattaacctgg

SEQ ID NO: 420 - DNA, 16 bp, H. sapiens
aaaaaaattaaggtca

SEQ ID NO: 421 - DNA, 16 bp, H. sapiens
aaaaaaattacagttt

SEQ ID NO: 422 - DNA, 16 bp, H. sapiens
aaaaaaattagacttt

SEQ ID NO: 423 - DNA, 19 bp, H. sapiens
aaaaaaattagccaggcgc

SEQ ID NO: 424 - DNA, 22 bp, H. sapiens
aaaaaaattagccaggcgtggc

SEQ ID NO: 425 - DNA, 19 bp, H. sapiens
aaaaaaattagccgggtgt

SEQ ID NO: 426 - DNA, 16 bp, H. sapiens
aaaaaaattagctggg

SEQ ID NO: 427 - DNA, 16 bp, H. sapiens
aaaaaaattagtcagg

SEQ ID NO: 428 - DNA, 16 bp, H. sapiens
aaaaaaattatccttt

SEQ ID NO: 429 - DNA, 16 bp, H. sapiens
aaaaaaattattgaac

SEQ ID NO: 430 - DNA, 16 bp, H. sapiens
aaaaaaattatttcct

SEQ ID NO: 431 - DNA, 16 bp, H. sapiens
aaaaaaattcaagtca

SEQ ID NO: 432 - DNA, 16 bp, H. sapiens
aaaaaaattcagaagg

SEQ ID NO: 433 - DNA, 16 bp, H. sapiens
aaaaaaattcagcctg

SEQ ID NO: 434 - DNA, 16 bp, H. sapiens
aaaaaaattcagcttt

SEQ ID NO: 435 - DNA, 16 bp, H. sapiens
aaaaaaattcaggata

SEQ ID NO: 436 - DNA, 16 bp, H. sapiens
aaaaaaattcagtaga

SEQ ID NO: 437 - DNA, 16 bp, H. sapiens
aaaaaaattcatgata

SEQ ID NO: 438 - DNA, 16 bp, H. sapiens
aaaaaaattcatgtaa

SEQ ID NO: 439 - DNA, 16 bp, H. sapiens
aaaaaaattcatgtat

SEQ ID NO: 440 - DNA, 16 bp, H. sapiens
aaaaaaattcattgtt

SEQ ID NO: 441 - DNA, 16 bp, H. sapiens
aaaaaaattccaggaa

SEQ ID NO: 442 - DNA, 16 bp, H. sapiens
aaaaaaattcctggaa

SEQ ID NO: 443 - DNA, 16 bp, H. sapiens
aaaaaaattctacaga

SEQ ID NO: 444 - DNA, 16 bp, H. sapiens
aaaaaaattctatgaa

SEQ ID NO: 445 - DNA, 16 bp, H. sapiens
aaaaaaattctccaga

SEQ ID NO: 446 - DNA, 16 bp, H. sapiens
aaaaaaattctcctgt

SEQ ID NO: 447 - DNA, 16 bp, H. sapiens
aaaaaaattctgctga

SEQ ID NO: 448 - DNA, 16 bp, H. sapiens
aaaaaaattctgttgt

SEQ ID NO: 449 - DNA, 16 bp, H. sapiens
aaaaaaattcttcaac

SEQ ID NO: 450 - DNA, 16 bp, H. sapiens
aaaaaaattcttcaga

SEQ ID NO: 451 - DNA, 16 bp, H. sapiens
aaaaaaattgaaactt

SEQ ID NO: 452 - DNA, 16 bp, H. sapiens
aaaaaaattgaacttt

SEQ ID NO: 453 - DNA, 16 bp, H. sapiens
aaaaaaattgatttct

SEQ ID NO: 454 - DNA, 16 bp, H. sapiens
aaaaaaattgcagaat

SEQ ID NO: 455 - DNA, 16 bp, H. sapiens
aaaaaaattgcttttg

SEQ ID NO: 456 - DNA, 16 bp, H. sapiens
aaaaaaattgtccagg

SEQ ID NO: 457 - DNA, 16 bp, H. sapiens
aaaaaaattgttctta

SEQ ID NO: 458 - DNA, 16 bp, H. sapiens
aaaaaaattgttgttt

SEQ ID NO: 459 - DNA, 39 bp, H. sapiens
aaaaaaatttagacgaatgtataactagaataaccaata

SEQ ID NO: 460 - DNA, 16 bp, H. sapiens
aaaaaaatttccattt

SEQ ID NO: 461 - DNA, 16 bp, H. sapiens
aaaaaaatttgctgga

SEQ ID NO: 462 - DNA, 16 bp, H. sapiens
aaaaaaatttggtttt

SEQ ID NO: 463 - DNA, 16 bp, H. sapiens
aaaaaaatttgttttc

SEQ ID NO: 464 - DNA, 16 bp, H. sapiens
aaaaaaattttaaagc

SEQ ID NO: 465 - DNA, 16 bp, H. sapiens
aaaaaaattttttgag

SEQ ID NO: 466 - DNA, 16 bp, H. sapiens
aaaaaacaaaccttga

SEQ ID NO: 467 - DNA, 16 bp, H. sapiens
aaaaaacaaactttct

SEQ ID NO: 468 - DNA, 16 bp, H. sapiens
aaaaaacaaatattgt

SEQ ID NO: 469 - DNA, 16 bp, H. sapiens
aaaaaacaaattagtt

SEQ ID NO: 470 - DNA, 16 bp, H. sapiens
aaaaaacaaattttga

SEQ ID NO: 471 - DNA, 16 bp, H. sapiens
aaaaaacaagctacag

SEQ ID NO: 472 - DNA, 16 bp, H. sapiens
aaaaaacaattttctt

SEQ ID NO: 473 - DNA, 16 bp, H. sapiens
aaaaaacagaatgcct

SEQ ID NO: 474 - DNA, 16 bp, H. sapiens
aaaaaacagatatttt

SEQ ID NO: 475 - DNA, 16 bp, H. sapiens
aaaaaacagcagatgc

SEQ ID NO: 476 - DNA, 16 bp, H. sapiens
aaaaaacagctcctgg

SEQ ID NO: 477 - DNA, 16 bp, H. sapiens
aaaaaacatgttttca

SEQ ID NO: 478 - DNA, 16 bp, H. sapiens
aaaaaacattttgaag

SEQ ID NO: 479 - DNA, 16 bp, H. sapiens
aaaaaacattttgaga

SEQ ID NO: 480 - DNA, 16 bp, H. sapiens
aaaaaaccccagaaat

SEQ ID NO: 481 - DNA, 16 bp, H. sapiens
aaaaaaccctgaaatc

SEQ ID NO: 482 - DNA, 16 bp, H. sapiens
aaaaaaccctgaaatt

SEQ ID NO: 483 - DNA, 16 bp, H. sapiens
aaaaaacctcaaaatg

SEQ ID NO: 484 - DNA, 16 bp, H. sapiens
aaaaaacctgtatttt

SEQ ID NO: 485 - DNA, 16 bp, H. sapiens
aaaaaactattttctt

SEQ ID NO: 486 - DNA, 19 bp, H. sapiens
aaaaaactcaaggatagag

SEQ ID NO: 487 - DNA, 16 bp, H. sapiens
aaaaaactcagtatca

SEQ ID NO: 488 - DNA, 16 bp, H. sapiens
aaaaaactcatttttt

SEQ ID NO: 489 - DNA, 16 bp, H. sapiens
aaaaaactgaagagga

SEQ ID NO: 490 - DNA, 16 bp, H. sapiens
aaaaaactgaggaaga

SEQ ID NO: 491 - DNA, 16 bp, H. sapiens
aaaaaactgataaatt

SEQ ID NO: 492 - DNA, 16 bp, H. sapiens
aaaaaactgctttaaa

SEQ ID NO: 493 - DNA, 16 bp, H. sapiens
aaaaaactggaggaat

SEQ ID NO: 494 - DNA, 16 bp, H. sapiens
aaaaaactgtgtgtgt

SEQ ID NO: 495 - DNA, 16 bp, H. sapiens
aaaaaacttcaaaagt

SEQ ID NO: 496 - DNA, 16 bp, H. sapiens
aaaaaacttgaaaatt

SEQ ID NO: 497 - DNA, 16 bp, H. sapiens
aaaaaacttgaaatat

SEQ ID NO: 498 - DNA, 16 bp, H. sapiens
aaaaaactttcatttt

SEQ ID NO: 499 - DNA, 16 bp, H. sapiens
aaaaaacttttaaaag

SEQ ID NO: 500 - DNA, 16 bp, H. sapiens
aaaaaacttttttgta

SEQ ID NO: 501 - DNA, 16 bp, H. sapiens
aaaaaagaaaactgtt

SEQ ID NO: 502 - DNA, 16 bp, H. sapiens
aaaaaagaaaacttct

SEQ ID NO: 503 - DNA, 16 bp, H. sapiens
aaaaaagaaaagtctg

SEQ ID NO: 504 - DNA, 16 bp, H. sapiens
aaaaaagaaaatcttt

SEQ ID NO: 505 - DNA, 16 bp, H. sapiens
aaaaaagaaaatgctt

SEQ ID NO: 506 - DNA, 16 bp, H. sapiens
aaaaaagaaaatggct

SEQ ID NO: 507 - DNA, 16 bp, H. sapiens
aaaaaagaaacattgt

SEQ ID NO: 508 - DNA, 16 bp, H. sapiens
aaaaaagaaacatttc

SEQ ID NO: 509 - DNA, 16 bp, H. sapiens
aaaaaagaaacatttt

SEQ ID NO: 510 - DNA, 16 bp, H. sapiens
aaaaaagaaactgttt

SEQ ID NO: 511 - DNA, 16 bp, H. sapiens
aaaaaagaaacttcct

SEQ ID NO: 512 - DNA, 16 bp, H. sapiens
aaaaaagaaacttttt

SEQ ID NO: 513 - DNA, 16 bp, H. sapiens
aaaaaagaaagctgag

SEQ ID NO: 514 - DNA, 16 bp, H. sapiens
aaaaaagaaaggctca

SEQ ID NO: 515 - DNA, 16 bp, H. sapiens
aaaaaagaaagtctta

SEQ ID NO: 516 - DNA, 16 bp, H. sapiens
aaaaaagaaagtgctt

SEQ ID NO: 517 - DNA, 16 bp, H. sapiens
aaaaaagaaatctcca

SEQ ID NO: 518 - DNA, 16 bp, H. sapiens
aaaaaagaaatcttat

SEQ ID NO: 519 - DNA, 16 bp, H. sapiens
aaaaaagaaatgactc

SEQ ID NO: 520 - DNA, 16 bp, H. sapiens
aaaaaagaaatgcttt

SEQ ID NO: 521 - DNA, 16 bp, H. sapiens
aaaaaagaaattatct

SEQ ID NO: 522 - DNA, 16 bp, H. sapiens
aaaaaagaaattcctg

SEQ ID NO: 523 - DNA, 16 bp, H. sapiens
aaaaaagaaatttctg

SEQ ID NO: 524 - DNA, 16 bp, H. sapiens
aaaaaagaacattttt

SEQ ID NO: 525 - DNA, 16 bp, H. sapiens
aaaaaagaacccatat

SEQ ID NO: 526 - DNA, 16 bp, H. sapiens
aaaaaagaactttttt

SEQ ID NO: 527 - DNA, 16 bp, H. sapiens
aaaaaagaagacttca

SEQ ID NO: 528 - DNA, 16 bp, H. sapiens
aaaaaagaagttcaag

SEQ ID NO: 529 - DNA, 16 bp, H. sapiens
aaaaaagaatatttca

SEQ ID NO: 530 - DNA, 16 bp, H. sapiens
aaaaaagaatgaggtt

SEQ ID NO: 531 - DNA, 16 bp, H. sapiens
aaaaaagaatgtgtgt

SEQ ID NO: 532 - DNA, 16 bp, H. sapiens
aaaaaagaattatcca

SEQ ID NO: 533 - DNA, 16 bp, H. sapiens
aaaaaagaattcagag

SEQ ID NO: 534 - DNA, 16 bp, H. sapiens
aaaaaagaattccaga

SEQ ID NO: 535 - DNA, 16 bp, H. sapiens
aaaaaagaattcttaa

SEQ ID NO: 536 - DNA, 16 bp, H. sapiens
aaaaaagaattgccca

SEQ ID NO: 537 - DNA, 16 bp, H. sapiens
aaaaaagaatttccaa

SEQ ID NO: 538 - DNA, 16 bp, H. sapiens
aaaaaagaatttctgt

SEQ ID NO: 539 - DNA, 16 bp, H. sapiens
aaaaaagaatttgtgt

SEQ ID NO: 540 - DNA, 16 bp, H. sapiens
aaaaaagaattttctt

SEQ ID NO: 541 - DNA, 16 bp, H. sapiens
aaaaaagacaatttta

SEQ ID NO: 542 - DNA, 16 bp, H. sapiens
aaaaaagacagaattt

SEQ ID NO: 543 - DNA, 16 bp, H. sapiens
aaaaaagacatttcca

SEQ ID NO: 544 - DNA, 16 bp, H. sapiens
aaaaaagacattttaa

SEQ ID NO: 545 - DNA, 16 bp, H. sapiens
aaaaaagagaagatcc

SEQ ID NO: 546 - DNA, 16 bp, H. sapiens
aaaaaagagactgaga

SEQ ID NO: 547 - DNA, 16 bp, H. sapiens
aaaaaagagactttta

SEQ ID NO: 548 - DNA, 16 bp, H. sapiens
aaaaaagagagacatg

SEQ ID NO: 549 - DNA, 16 bp, H. sapiens
aaaaaagagagagact

SEQ ID NO: 550 - DNA, 16 bp, H. sapiens
aaaaaagagcaggagt

SEQ ID NO: 551 - DNA, 16 bp, H. sapiens
aaaaaagagcccatat

SEQ ID NO: 552 - DNA, 16 bp, H. sapiens
aaaaaagagcccttat

SEQ ID NO: 553 - DNA, 18 bp, H. sapiens
aaaaaagagcctgcattg

SEQ ID NO: 554 - DNA, 16 bp, H. sapiens
aaaaaagagcctggat

SEQ ID NO: 555 - DNA, 16 bp, H. sapiens
aaaaaagatatttcac

SEQ ID NO: 556 - DNA, 16 bp, H. sapiens
aaaaaagatatttttc

SEQ ID NO: 557 - DNA, 16 bp, H. sapiens
aaaaaagatcattttt

SEQ ID NO: 558 - DNA, 16 bp, H. sapiens
aaaaaagattcattct

SEQ ID NO: 559 - DNA, 16 bp, H. sapiens
aaaaaagattcctttt

SEQ ID NO: 560 - DNA, 16 bp, H. sapiens
aaaaaagattctgaaa

SEQ ID NO: 561 - DNA, 16 bp, H. sapiens
aaaaaagatttcagaa

SEQ ID NO: 562 - DNA, 16 bp, H. sapiens
aaaaaagcaaggtgca

SEQ ID NO: 563 - DNA, 16 bp, H. sapiens
aaaaaagcaattttta

SEQ ID NO: 564 - DNA, 16 bp, H. sapiens
aaaaaagcaggtgttg

SEQ ID NO: 565 - DNA, 16 bp, H. sapiens
aaaaaagcagttattt

SEQ ID NO: 566 - DNA, 16 bp, H. sapiens
aaaaaagcattttaaa

SEQ ID NO: 567 - DNA, 16 bp, H. sapiens
aaaaaagccaggtgta

SEQ ID NO: 568 - DNA, 16 bp, H. sapiens
aaaaaagccctgattt

SEQ ID NO: 569 - DNA, 16 bp, H. sapiens
aaaaaagccctggacc

SEQ ID NO: 570 - DNA, 16 bp, H. sapiens
aaaaaagcctgtacat

SEQ ID NO: 571 - DNA, 16 bp, H. sapiens
aaaaaagccttttttt

SEQ ID NO: 572 - DNA, 16 bp, H. sapiens
aaaaaagctattttta

SEQ ID NO: 573 - DNA, 16 bp, H. sapiens
aaaaaagctggagaca

SEQ ID NO: 574 - DNA, 16 bp, H. sapiens
aaaaaagctggatgtg

SEQ ID NO: 575 - DNA, 16 bp, H. sapiens
aaaaaagcttatagaa

SEQ ID NO: 576 - DNA, 16 bp, H. sapiens
aaaaaagctttcaaaa

SEQ ID NO: 577 - DNA, 16 bp, H. sapiens
aaaaaagcttttcttt

SEQ ID NO: 578 - DNA, 16 bp, H. sapiens
aaaaaaggaaaacttc

SEQ ID NO: 579 - DNA, 16 bp, H. sapiens
aaaaaaggaaactgag

SEQ ID NO: 580 - DNA, 16 bp, H. sapiens
aaaaaaggaaatctga

SEQ ID NO: 581 - DNA, 16 bp, H. sapiens
aaaaaaggaaattttg

SEQ ID NO: 582 - DNA, 16 bp, H. sapiens
aaaaaaggaattgttt

SEQ ID NO: 583 - DNA, 16 bp, H. sapiens
aaaaaaggaatttgga

SEQ ID NO: 584 - DNA, 16 bp, H. sapiens
aaaaaaggacaatatt

SEQ ID NO: 585 - DNA, 16 bp, H. sapiens
aaaaaaggcagcagca

SEQ ID NO: 586 - DNA, 16 bp, H. sapiens
aaaaaaggccgggcgc

SEQ ID NO: 587 - DNA, 16 bp, H. sapiens
aaaaaagggaattttt

SEQ ID NO: 588 - DNA, 16 bp, H. sapiens
aaaaaaggtatttttt

SEQ ID NO: 589 - DNA, 16 bp, H. sapiens
aaaaaaggtgaaattt

SEQ ID NO: 590 - DNA, 16 bp, H. sapiens
aaaaaaggtttatttt

SEQ ID NO: 591 - DNA, 16 bp, H. sapiens
aaaaaagtaaaactgt

SEQ ID NO: 592 - DNA, 16 bp, H. sapiens
aaaaaagtaaattttc

SEQ ID NO: 593 - DNA, 16 bp, H. sapiens
aaaaaagtactttaaa

SEQ ID NO: 594 - DNA, 16 bp, H. sapiens
aaaaaagtagtttttt

SEQ ID NO: 595 - DNA, 16 bp, H. sapiens
aaaaaagtatgtattt

SEQ ID NO: 596 - DNA, 16 bp, H. sapiens
aaaaaagtattcatat

SEQ ID NO: 597 - DNA, 16 bp, H. sapiens
aaaaaagtatttattg

SEQ ID NO: 598 - DNA, 16 bp, H. sapiens
aaaaaagtatttcatt

SEQ ID NO: 599 - DNA, 16 bp, H. sapiens
aaaaaagtattttcat

SEQ ID NO: 600 - DNA, 16 bp, H. sapiens
aaaaaagtcaaactct

SEQ ID NO: 601 - DNA, 16 bp, H. sapiens
aaaaaagtcaggaaac

SEQ ID NO: 602 - DNA, 16 bp, H. sapiens
aaaaaagtcattttca

SEQ ID NO: 603 - DNA, 16 bp, H. sapiens
aaaaaagtccaggagc

SEQ ID NO: 604 - DNA, 16 bp, H. sapiens
aaaaaagtctcaacaa

SEQ ID NO: 605 - DNA, 16 bp, H. sapiens
aaaaaagtgaagattt

SEQ ID NO: 606 - DNA, 16 bp, H. sapiens
aaaaaagtggctagtt

SEQ ID NO: 607 - DNA, 16 bp, H. sapiens
aaaaaagttaatttct

SEQ ID NO: 608 - DNA, 16 bp, H. sapiens
aaaaaagttagaacta

SEQ ID NO: 609 - DNA, 16 bp, H. sapiens
aaaaaagttatttctt

SEQ ID NO: 610 - DNA, 16 bp, H. sapiens
aaaaaagttcaatatt

SEQ ID NO: 611 - DNA, 16 bp, H. sapiens
aaaaaagttgatttca

SEQ ID NO: 612 - DNA, 16 bp, H. sapiens
aaaaaagttgttttaa

SEQ ID NO: 613 - DNA, 16 bp, H. sapiens
aaaaaagtttacattt

SEQ ID NO: 614 - DNA, 16 bp, H. sapiens
aaaaaagtttatttca

SEQ ID NO: 615 - DNA, 16 bp, H. sapiens
aaaaaagtttatttct

SEQ ID NO: 616 - DNA, 16 bp, H. sapiens
aaaaaagtttcaataa

SEQ ID NO: 617 - DNA, 16 bp, H. sapiens
aaaaaagtttcagaaa

SEQ ID NO: 618 - DNA, 16 bp, H. sapiens
aaaaaagtttcagtaa

SEQ ID NO: 619 - DNA, 16 bp, H. sapiens
aaaaaagtttctattt

SEQ ID NO: 620 - DNA, 16 bp, H. sapiens
aaaaaagtttctttga

SEQ ID NO: 621 - DNA, 16 bp, H. sapiens
aaaaaagttttcaaaa

SEQ ID NO: 622 - DNA, 16 bp, H. sapiens
aaaaaagttttggatt

SEQ ID NO: 623 - DNA, 16 bp, H. sapiens
aaaaaataaacatttg

SEQ ID NO: 624 - DNA, 16 bp, H. sapiens
aaaaaataaagcactt

SEQ ID NO: 625 - DNA, 16 bp, H. sapiens
aaaaaataaatctgta

SEQ ID NO: 626 - DNA, 16 bp, H. sapiens
aaaaaataactttgaa

SEQ ID NO: 627 - DNA, 16 bp, H. sapiens
aaaaaataatagctga

SEQ ID NO: 628 - DNA, 16 bp, H. sapiens
aaaaaataatttcaga

SEQ ID NO: 629 - DNA, 16 bp, H. sapiens
aaaaaatacagaagtt

SEQ ID NO: 630 - DNA, 16 bp, H. sapiens
aaaaaatacagtttga

SEQ ID NO: 631 - DNA, 16 bp, H. sapiens
aaaaaatacatatgta

SEQ ID NO: 632 - DNA, 16 bp, H. sapiens
aaaaaatacattgaac

SEQ ID NO: 633 - DNA, 16 bp, H. sapiens
aaaaaatacatttgaa

SEQ ID NO: 634 - DNA, 16 bp, H. sapiens
aaaaaatacatttgag

SEQ ID NO: 635 - DNA, 16 bp, H. sapiens
aaaaaatactgagata

SEQ ID NO: 636 - DNA, 16 bp, H. sapiens
aaaaaatactgctgga

SEQ ID NO: 637 - DNA, 16 bp, H. sapiens
aaaaaatacttaggaa

SEQ ID NO: 638 - DNA, 16 bp, H. sapiens
aaaaaatacttgatat

SEQ ID NO: 639 - DNA, 16 bp, H. sapiens
aaaaaatacttggaaa

SEQ ID NO: 640 - DNA, 16 bp, H. sapiens
aaaaaatagacatttt

SEQ ID NO: 641 - DNA, 16 bp, H. sapiens
aaaaaatagactttat

SEQ ID NO: 642 - DNA, 16 bp, H. sapiens
aaaaaatagtatttca

SEQ ID NO: 643 - DNA, 16 bp, H. sapiens
aaaaaatagtttatgt

SEQ ID NO: 644 - DNA, 16 bp, H. sapiens
aaaaaatataccttca

SEQ ID NO: 645 - DNA, 16 bp, H. sapiens
aaaaaatatggatttt

SEQ ID NO: 646 - DNA, 16 bp, H. sapiens
aaaaaatatgtatgtg

SEQ ID NO: 647 - DNA, 16 bp, H. sapiens
aaaaaatatgtgtgta

SEQ ID NO: 648 - DNA, 16 bp, H. sapiens
aaaaaatattaaatgc

SEQ ID NO: 649 - DNA, 16 bp, H. sapiens
aaaaaatatttcaaga

SEQ ID NO: 650 - DNA, 16 bp, H. sapiens
aaaaaatatttcttgt

SEQ ID NO: 651 - DNA, 16 bp, H. sapiens
aaaaaatattttttgg

SEQ ID NO: 652 - DNA, 16 bp, H. sapiens
aaaaaatcaaaagttt

SEQ ID NO: 653 - DNA, 16 bp, H. sapiens
aaaaaatcaaatgtat

SEQ ID NO: 654 - DNA, 16 bp, H. sapiens
aaaaaatcaagaaggc

SEQ ID NO: 655 - DNA, 16 bp, H. sapiens
aaaaaatcaagtatat

SEQ ID NO: 656 - DNA, 16 bp, H. sapiens
aaaaaatcaagtattt

SEQ ID NO: 657 - DNA, 16 bp, H. sapiens
aaaaaatcacaaggca

SEQ ID NO: 658 - DNA, 16 bp, H. sapiens
aaaaaatcacttcttt

SEQ ID NO: 659 - DNA, 16 bp, H. sapiens
aaaaaatcacttgaaa

SEQ ID NO: 660 - DNA, 16 bp, H. sapiens
aaaaaatcagcaaatg

SEQ ID NO: 661 - DNA, 16 bp, H. sapiens
aaaaaatcagtatttt

SEQ ID NO: 662 - DNA, 16 bp, H. sapiens
aaaaaatcagtcattt

SEQ ID NO: 663 - DNA, 16 bp, H. sapiens
aaaaaatcagtgaaat

SEQ ID NO: 664 - DNA, 16 bp, H. sapiens
aaaaaatcagtgaata

SEQ ID NO: 665 - DNA, 16 bp, H. sapiens
aaaaaatcagttttaa

SEQ ID NO: 666 - DNA, 16 bp, H. sapiens
aaaaaatcataagtca

SEQ ID NO: 667 - DNA, 16 bp, H. sapiens
aaaaaatcattctgaa

SEQ ID NO: 668 - DNA, 16 bp, H. sapiens
aaaaaatcattgcaaa

SEQ ID NO: 669 - DNA, 16 bp, H. sapiens
aaaaaatcattgtttt

SEQ ID NO: 670 - DNA, 16 bp, H. sapiens
aaaaaatcattttact

SEQ ID NO: 671 - DNA, 16 bp, H. sapiens
aaaaaatcattttcca

SEQ ID NO: 672 - DNA, 16 bp, H. sapiens
aaaaaatcattttttc

SEQ ID NO: 673 - DNA, 16 bp, H. sapiens
aaaaaatccaaaagtt

SEQ ID NO: 674 - DNA, 16 bp, H. sapiens
aaaaaatccatgctca

SEQ ID NO: 675 - DNA, 16 bp, H. sapiens
aaaaaatccatttttt

SEQ ID NO: 676 - DNA, 16 bp, H. sapiens
aaaaaatcccagaaat

SEQ ID NO: 677 - DNA, 16 bp, H. sapiens
aaaaaatctacatttt

SEQ ID NO: 678 - DNA, 16 bp, H. sapiens
aaaaaatctatattct

SEQ ID NO: 679 - DNA, 16 bp, H. sapiens
aaaaaatctgcattta

SEQ ID NO: 680 - DNA, 16 bp, H. sapiens
aaaaaatctgtaattt

SEQ ID NO: 681 - DNA, 16 bp, H. sapiens
aaaaaatctgtatata

SEQ ID NO: 682 - DNA, 16 bp, H. sapiens
aaaaaatcttatttca

SEQ ID NO: 683 - DNA, 16 bp, H. sapiens
aaaaaatcttgaaaat

SEQ ID NO: 684 - DNA, 16 bp, H. sapiens
aaaaaatcttttaaga

SEQ ID NO: 685 - DNA, 16 bp, H. sapiens
aaaaaatgaaaacttt

SEQ ID NO: 686 - DNA, 16 bp, H. sapiens
aaaaaatgaaattctt

SEQ ID NO: 687 - DNA, 16 bp, H. sapiens
aaaaaatgaacagagc

SEQ ID NO: 688 - DNA, 16 bp, H. sapiens
aaaaaatgaacttcaa

SEQ ID NO: 689 - DNA, 16 bp, H. sapiens
aaaaaatgaagcagag

SEQ ID NO: 690 - DNA, 16 bp, H. sapiens
aaaaaatgaagcagga

SEQ ID NO: 691 - DNA, 16 bp, H. sapiens
aaaaaatgaagctgaa

SEQ ID NO: 692 - DNA, 16 bp, H. sapiens
aaaaaatgaagtcata

SEQ ID NO: 693 - DNA, 16 bp, H. sapiens
aaaaaatgaatgaact

SEQ ID NO: 694 - DNA, 16 bp, H. sapiens
aaaaaatgaattacat

SEQ ID NO: 695 - DNA, 16 bp, H. sapiens
aaaaaatgaattctga

SEQ ID NO: 696 - DNA, 16 bp, H. sapiens
aaaaaatgaattttct

SEQ ID NO: 697 - DNA, 16 bp, H. sapiens
aaaaaatgacaattta

SEQ ID NO: 698 - DNA, 16 bp, H. sapiens
aaaaaatgacagatgt

SEQ ID NO: 699 - DNA, 16 bp, H. sapiens
aaaaaatgagaagttt

SEQ ID NO: 700 - DNA, 16 bp, H. sapiens
aaaaaatgagaatgtt

SEQ ID NO: 701 - DNA, 16 bp, H. sapiens
aaaaaatgagtatttt

SEQ ID NO: 702 - DNA, 16 bp, H. sapiens
aaaaaatgataactat

SEQ ID NO: 703 - DNA, 16 bp, H. sapiens
aaaaaatgatttcaaa

SEQ ID NO: 704 - DNA, 16 bp, H. sapiens
aaaaaatgcaattatt

SEQ ID NO: 705 - DNA, 16 bp, H. sapiens
aaaaaatgcactttta

SEQ ID NO: 706 - DNA, 16 bp, H. sapiens
aaaaaatgctaaatat

SEQ ID NO: 707 - DNA, 16 bp, H. sapiens
aaaaaatgctatttaa

SEQ ID NO: 708 - DNA, 16 bp, H. sapiens
aaaaaatgctgggcac

SEQ ID NO: 709 - DNA, 16 bp, H. sapiens
aaaaaatgctgggcat

SEQ ID NO: 710 - DNA, 16 bp, H. sapiens
aaaaaatgcttaatat

SEQ ID NO: 711 - DNA, 16 bp, H. sapiens
aaaaaatgcttgaaaa

SEQ ID NO: 712 - DNA, 16 bp, H. sapiens
aaaaaatgctttaaaa

SEQ ID NO: 713 - DNA, 16 bp, H. sapiens
aaaaaatggaaaatct

SEQ ID NO: 714 - DNA, 16 bp, H. sapiens
aaaaaatggaagcaac

SEQ ID NO: 715 - DNA, 16 bp, H. sapiens
aaaaaatggaattttt

SEQ ID NO: 716 - DNA, 16 bp, H. sapiens
aaaaaatggagatttt

SEQ ID NO: 717 - DNA, 16 bp, H. sapiens
aaaaaatggatacatt

SEQ ID NO: 718 - DNA, 16 bp, H. sapiens
aaaaaatggcaaatat

SEQ ID NO: 719 - DNA, 16 bp, H. sapiens
aaaaaatggcaaatga

SEQ ID NO: 720 - DNA, 16 bp, H. sapiens
aaaaaatggcagtgtt

SEQ ID NO: 721 - DNA, 16 bp, H. sapiens
aaaaaatggcattttt

SEQ ID NO: 722 - DNA, 16 bp, H. sapiens
aaaaaatggccaaaag

SEQ ID NO: 723 - DNA, 16 bp, H. sapiens
aaaaaatggtttattt

SEQ ID NO: 724 - DNA, 16 bp, H. sapiens
aaaaaatgtacattat

SEQ ID NO: 725 - DNA, 16 bp, H. sapiens
aaaaaatgtacattct

SEQ ID NO: 726 - DNA, 16 bp, H. sapiens
aaaaaatgtagctggg

SEQ ID NO: 727 - DNA, 16 bp, H. sapiens
aaaaaatgtatacaat

SEQ ID NO: 728 - DNA, 16 bp, H. sapiens
aaaaaatgtatgcata

SEQ ID NO: 729 - DNA, 16 bp, H. sapiens
aaaaaatgtatttact

SEQ ID NO: 730 - DNA, 16 bp, H. sapiens
aaaaaatgtattttct

SEQ ID NO: 731 - DNA, 16 bp, H. sapiens
aaaaaatgtattttgt

SEQ ID NO: 732 - DNA, 16 bp, H. sapiens
aaaaaatgtcatttat

SEQ ID NO: 733 - DNA, 16 bp, H. sapiens
aaaaaatgtcattttt

SEQ ID NO: 734 - DNA, 16 bp, H. sapiens
aaaaaatgtcttgaaa

SEQ ID NO: 735 - DNA, 16 bp, H. sapiens
aaaaaatgtgtgtatt

SEQ ID NO: 736 - DNA, 23 bp, H. sapiens
aaaaaatgttaagggcagccaca

SEQ ID NO: 737 - DNA, 16 bp, H. sapiens
aaaaaatgttatgttt

SEQ ID NO: 738 - DNA, 16 bp, H. sapiens
aaaaaatgttcagaat

SEQ ID NO: 739 - DNA, 16 bp, H. sapiens
aaaaaatgttcatcat

SEQ ID NO: 740 - DNA, 16 bp, H. sapiens
aaaaaatgttctatat

SEQ ID NO: 741 - DNA, 16 bp, H. sapiens
aaaaaatgtttaacat

SEQ ID NO: 742 - DNA, 16 bp, H. sapiens
aaaaaatgtttatagt

SEQ ID NO: 743 - DNA, 16 bp, H. sapiens
aaaaaatgtttccttt

SEQ ID NO: 744 - DNA, 16 bp, H. sapiens
aaaaaatgtttgacat

SEQ ID NO: 745 - DNA, 16 bp, H. sapiens
aaaaaatgttttcatg

SEQ ID NO: 746 - DNA, 16 bp, H. sapiens
aaaaaatgttttctta

SEQ ID NO: 747 - DNA, 16 bp, H. sapiens
aaaaaatgtttttaac

SEQ ID NO: 748 - DNA, 16 bp, H. sapiens
aaaaaatgtttttcaa

SEQ ID NO: 749 - DNA, 16 bp, H. sapiens
aaaaaatgtttttggt

SEQ ID NO: 750 - DNA, 16 bp, H. sapiens
aaaaaattaaacctga

SEQ ID NO: 751 - DNA, 16 bp, H. sapiens
aaaaaattaaagcatt

SEQ ID NO: 752 - DNA, 16 bp, H. sapiens
aaaaaattaaagcttt

SEQ ID NO: 753 - DNA, 16 bp, H. sapiens
aaaaaattaaatgtct

SEQ ID NO: 754 - DNA, 16 bp, H. sapiens
aaaaaattaagctttt

SEQ ID NO: 755 - DNA, 16 bp, H. sapiens
aaaaaattaattgaca

SEQ ID NO: 756 - DNA, 16 bp, H. sapiens
aaaaaattacaaggca

SEQ ID NO: 757 - DNA, 16 bp, H. sapiens
aaaaaattacatgaat

SEQ ID NO: 758 - DNA, 16 bp, H. sapiens
aaaaaattactgaaga

SEQ ID NO: 759 - DNA, 16 bp, H. sapiens
aaaaaattactttgaa

SEQ ID NO: 760 - DNA, 17 bp, H. sapiens
aaaaaattagccaggca

SEQ ID NO: 761 - DNA, 16 bp, H. sapiens
aaaaaattagccgggc

SEQ ID NO: 762 - DNA, 16 bp, H. sapiens
aaaaaattagctgggc

SEQ ID NO: 763 - DNA, 17 bp, H. sapiens
aaaaaattagctgggca

SEQ ID NO: 764 - DNA, 17 bp, H. sapiens
aaaaaattagctgggct

SEQ ID NO: 765 - DNA, 16 bp, H. sapiens
aaaaaattagctgggt

SEQ ID NO: 766 - DNA, 16 bp, H. sapiens
aaaaaattattcagaa

SEQ ID NO: 767 - DNA, 16 bp, H. sapiens
aaaaaattattcagga

SEQ ID NO: 768 - DNA, 16 bp, H. sapiens
aaaaaattcagagaat

SEQ ID NO: 769 - DNA, 16 bp, H. sapiens
aaaaaattcattgttt

SEQ ID NO: 770 - DNA, 16 bp, H. sapiens
aaaaaattcatttcca

SEQ ID NO: 771 - DNA, 16 bp, H. sapiens
aaaaaattcctggaaa

SEQ ID NO: 772 - DNA, 16 bp, H. sapiens
aaaaaattcctgtttt

SEQ ID NO: 773 - DNA, 16 bp, H. sapiens
aaaaaattctcttttc

SEQ ID NO: 774 - DNA, 16 bp, H. sapiens
aaaaaattctgttatt

SEQ ID NO: 775 - DNA, 16 bp, H. sapiens
aaaaaattcttaatgt

SEQ ID NO: 776 - DNA, 16 bp, H. sapiens
aaaaaattctttgaaa

SEQ ID NO: 777 - DNA, 16 bp, H. sapiens
aaaaaattgacaaatt

SEQ ID NO: 778 - DNA, 16 bp, H. sapiens
aaaaaattgcaaatta

SEQ ID NO: 779 - DNA, 16 bp, H. sapiens
aaaaaattgtaaaact

SEQ ID NO: 780 - DNA, 16 bp, H. sapiens
aaaaaattgtaaagac

SEQ ID NO: 781 - DNA, 16 bp, H. sapiens
aaaaaattgtcatttt

SEQ ID NO: 782 - DNA, 16 bp, H. sapiens
aaaaaattgtttccaa

SEQ ID NO: 783 - DNA, 16 bp, H. sapiens
aaaaaattgttttatg

SEQ ID NO: 784 - DNA, 16 bp, H. sapiens
aaaaaatttacatctt

SEQ ID NO: 785 - DNA, 16 bp, H. sapiens
aaaaaatttactttct

SEQ ID NO: 786 - DNA, 16 bp, H. sapiens
aaaaaatttattttgc

SEQ ID NO: 787 - DNA, 16 bp, H. sapiens
aaaaaatttcatttca

SEQ ID NO: 788 - DNA, 16 bp, H. sapiens
aaaaaatttcttcttt

SEQ ID NO: 789 - DNA, 16 bp, H. sapiens
aaaaaatttgaaatca

SEQ ID NO: 790 - DNA, 16 bp, H. sapiens
aaaaaattttcaggaa

SEQ ID NO: 791 - DNA, 16 bp, H. sapiens
aaaaaattttcagtaa

SEQ ID NO: 792 - DNA, 16 bp, H. sapiens
aaaaaattttcccaaa

SEQ ID NO: 793 - DNA, 16 bp, H. sapiens
aaaaaattttgtttga

SEQ ID NO: 794 - DNA, 16 bp, H. sapiens
aaaaaatttttgaagt

SEQ ID NO: 795 - DNA, 16 bp, H. sapiens
aaaaaatttttggaat

SEQ ID NO: 796 - DNA, 16 bp, H. sapiens
aaaaacaaaaccctgt

SEQ ID NO: 797 - DNA, 16 bp, H. sapiens
aaaaacaaaactcttt

SEQ ID NO: 798 - DNA, 16 bp, H. sapiens
aaaaacaaaactttct

SEQ ID NO: 799 - DNA, 16 bp, H. sapiens
aaaaacaaaagatgtt

SEQ ID NO: 800 - DNA, 16 bp, H. sapiens
aaaaacaaaaggtttt

SEQ ID NO: 801 - DNA, 16 bp, H. sapiens
aaaaacaaacattgta

SEQ ID NO: 802 - DNA, 16 bp, H. sapiens
aaaaacaaacatttgt

SEQ ID NO: 803 - DNA, 16 bp, H. sapiens
aaaaacaaaccctgaa

SEQ ID NO: 804 - DNA, 16 bp, H. sapiens
aaaaacaaagcctcca

SEQ ID NO: 805 - DNA, 16 bp, H. sapiens
aaaaacaaatgacttt

SEQ ID NO: 806 - DNA, 16 bp, H. sapiens
aaaaacaaatgtattt

SEQ ID NO: 807 - DNA, 16 bp, H. sapiens
aaaaacaaatgttttt

SEQ ID NO: 808 - DNA, 16 bp, H. sapiens
aaaaacaaattagtta

SEQ ID NO: 809 - DNA, 16 bp, H. sapiens
aaaaacaacaaatctg

SEQ ID NO: 810 - DNA, 16 bp, H. sapiens
aaaaacaacacatttt

SEQ ID NO: 811 - DNA, 16 bp, H. sapiens
aaaaacaactttaaag

SEQ ID NO: 812 - DNA, 16 bp, H. sapiens
aaaaacaacttttatt

SEQ ID NO: 813 - DNA, 16 bp, H. sapiens
aaaaacaactttttat

SEQ ID NO: 814 - DNA, 16 bp, H. sapiens
aaaaacaagaaattgg

SEQ ID NO: 815 - DNA, 16 bp, H. sapiens
aaaaacaagaaatttg

SEQ ID NO: 816 - DNA, 16 bp, H. sapiens
aaaaacaagcaatccc

SEQ ID NO: 817 - DNA, 16 bp, H. sapiens
aaaaacaagcaatggg

SEQ ID NO: 818 - DNA, 20 bp, H. sapiens
aaaaacaagcaatggggaaa

SEQ ID NO: 819 - DNA, 33 bp, H. sapiens
aaaaacaagcaatggggaaaggattccctattg

SEQ ID NO: 820 - DNA, 16 bp, H. sapiens
aaaaacaagcagtagg

SEQ ID NO: 821 - DNA, 16 bp, H. sapiens
aaaaacaagctatctg

SEQ ID NO: 822 - DNA, 16 bp, H. sapiens
aaaaacaagttgacct

SEQ ID NO: 823 - DNA, 16 bp, H. sapiens
aaaaacaatacaggat

SEQ ID NO: 824 - DNA, 16 bp, H. sapiens
aaaaacaatcctgaaa

SEQ ID NO: 825 - DNA, 16 bp, H. sapiens
aaaaacaatgagatca

SEQ ID NO: 826 - DNA, 16 bp, H. sapiens
aaaaacaatgcaattt

SEQ ID NO: 827 - DNA, 16 bp, H. sapiens
aaaaacaatgttattt

SEQ ID NO: 828 - DNA, 16 bp, H. sapiens
aaaaacaatgtttaaa

SEQ ID NO: 829 - DNA, 16 bp, H. sapiens
aaaaacaatgttttta

SEQ ID NO: 830 - DNA, 16 bp, H. sapiens
aaaaacaatgtttttt

SEQ ID NO: 831 - DNA, 16 bp, H. sapiens
aaaaacaatttgcaaa

SEQ ID NO: 832 - DNA, 16 bp, H. sapiens
aaaaacaattttcttt

SEQ ID NO: 833 - DNA, 16 bp, H. sapiens
aaaaacaatttttgtt

SEQ ID NO: 834 - DNA, 16 bp, H. sapiens
aaaaacaatttttttc

SEQ ID NO: 835 - DNA, 16 bp, H. sapiens
aaaaacacaactgatt

SEQ ID NO: 836 - DNA, 16 bp, H. sapiens
aaaaacacaatgaagt

SEQ ID NO: 837 - DNA, 16 bp, H. sapiens
aaaaacacaatttctt

SEQ ID NO: 838 - DNA, 16 bp, H. sapiens
aaaaacacagtttgag

SEQ ID NO: 839 - DNA, 16 bp, H. sapiens
aaaaacacattatttt

SEQ ID NO: 840 - DNA, 16 bp, H. sapiens
aaaaacactgaatttt

SEQ ID NO: 841 - DNA, 16 bp, H. sapiens
aaaaacacttggaagc

SEQ ID NO: 842 - DNA, 16 bp, H. sapiens
aaaaacactttgggag

SEQ ID NO: 843 - DNA, 16 bp, H. sapiens
aaaaacacttttagaa

SEQ ID NO: 844 - DNA, 16 bp, H. sapiens
aaaaacagaaacttac

SEQ ID NO: 845 - DNA, 16 bp, H. sapiens
aaaaacagaaattgat

SEQ ID NO: 846 - DNA, 16 bp, H. sapiens
aaaaacagaataattt

SEQ ID NO: 847 - DNA, 16 bp, H. sapiens
aaaaacagaatttcta

SEQ ID NO: 848 - DNA, 16 bp, H. sapiens
aaaaacagacatgtag

SEQ ID NO: 849 - DNA, 16 bp, H. sapiens
aaaaacagagctgaaa

SEQ ID NO: 850 - DNA, 16 bp, H. sapiens
aaaaacagatatttta

SEQ ID NO: 851 - DNA, 16 bp, H. sapiens
aaaaacagatgttaaa

SEQ ID NO: 852 - DNA, 16 bp, H. sapiens
aaaaacagattcttat

SEQ ID NO: 853 - DNA, 16 bp, H. sapiens
aaaaacagatttgaaa

SEQ ID NO: 854 - DNA, 16 bp, H. sapiens
aaaaacagcaacaact

SEQ ID NO: 855 - DNA, 16 bp, H. sapiens
aaaaacagcagatgtt

SEQ ID NO: 856 - DNA, 16 bp, H. sapiens
aaaaacagccacagat

SEQ ID NO: 857 - DNA, 16 bp, H. sapiens
aaaaacagccaggcat

SEQ ID NO: 858 - DNA, 16 bp, H. sapiens
aaaaacagctcctgaa

SEQ ID NO: 859 - DNA, 16 bp, H. sapiens
aaaaacagtaatattt

SEQ ID NO: 860 - DNA, 16 bp, H. sapiens
aaaaacagtagatatt

SEQ ID NO: 861 - DNA, 16 bp, H. sapiens
aaaaacagtatttcaa

SEQ ID NO: 862 - DNA, 16 bp, H. sapiens
aaaaacagtgtaaacc

SEQ ID NO: 863 - DNA, 16 bp, H. sapiens
aaaaacagtgtttcaa

SEQ ID NO: 864 - DNA, 16 bp, H. sapiens
aaaaacagttttcaaa

SEQ ID NO: 865 - DNA, 16 bp, H. sapiens
aaaaacagttttccaa

SEQ ID NO: 866 - DNA, 16 bp, H. sapiens
aaaaacagtttttaaa

SEQ ID NO: 867 - DNA, 16 bp, H. sapiens
aaaaacatattttcca

SEQ ID NO: 868 - DNA, 16 bp, H. sapiens
aaaaacatattttgat

SEQ ID NO: 869 - DNA, 16 bp, H. sapiens
aaaaacatctggaaaa

SEQ ID NO: 870 - DNA, 16 bp, H. sapiens
aaaaacatcttgaaaa

SEQ ID NO: 871 - DNA, 16 bp, H. sapiens
aaaaacatgaactcat

SEQ ID NO: 872 - DNA, 16 bp, H. sapiens
aaaaacatgacaaatt

SEQ ID NO: 873 - DNA, 16 bp, H. sapiens
aaaaacatgacctcac

SEQ ID NO: 874 - DNA, 16 bp, H. sapiens
aaaaacatgcattttt

SEQ ID NO: 875 - DNA, 16 bp, H. sapiens
aaaaacatggaaatta

SEQ ID NO: 876 - DNA, 16 bp, H. sapiens
aaaaacatggaatcaa

SEQ ID NO: 877 - DNA, 16 bp, H. sapiens
aaaaacatgtaaatat

SEQ ID NO: 878 - DNA, 16 bp, H. sapiens
aaaaacatgtttgttt

SEQ ID NO: 879 - DNA, 16 bp, H. sapiens
aaaaacattaaaatgg

SEQ ID NO: 880 - DNA, 16 bp, H. sapiens
aaaaacattcagtaaa

SEQ ID NO: 881 - DNA, 16 bp, H. sapiens
aaaaacattctcagca

SEQ ID NO: 882 - DNA, 16 bp, H. sapiens
aaaaacattgtttcca

SEQ ID NO: 883 - DNA, 16 bp, H. sapiens
aaaaacatttcagaaa

SEQ ID NO: 884 - DNA, 16 bp, H. sapiens
aaaaacatttctcttt

SEQ ID NO: 885 - DNA, 16 bp, H. sapiens
aaaaacattttaagaa

SEQ ID NO: 886 - DNA, 16 bp, H. sapiens
aaaaacattttagaga

SEQ ID NO: 887 - DNA, 16 bp, H. sapiens
aaaaacattttccccc

SEQ ID NO: 888 - DNA, 16 bp, H. sapiens
aaaaacattttctttc

SEQ ID NO: 889 - DNA, 16 bp, H. sapiens
aaaaacattttggaaa

SEQ ID NO: 890 - DNA, 16 bp, H. sapiens
aaaaacatttttaaag

SEQ ID NO: 891 - DNA, 16 bp, H. sapiens
aaaaacatttttgaga

SEQ ID NO: 892 - DNA, 16 bp, H. sapiens
aaaaacattttttttc

SEQ ID NO: 893 - DNA, 16 bp, H. sapiens
aaaaaccaatacagta

SEQ ID NO: 894 - DNA, 16 bp, H. sapiens
aaaaaccacaatgaga

SEQ ID NO: 895 - DNA, 16 bp, H. sapiens
aaaaaccactgaactg

SEQ ID NO: 896 - DNA, 16 bp, H. sapiens
aaaaaccagaatgcct

SEQ ID NO: 897 - DNA, 16 bp, H. sapiens
aaaaaccaggccaggc

SEQ ID NO: 898 - DNA, 16 bp, H. sapiens
aaaaaccagtgcaaaa

SEQ ID NO: 899 - DNA, 16 bp, H. sapiens
aaaaaccattgaattg

SEQ ID NO: 900 - DNA, 16 bp, H. sapiens
aaaaacccaaaacttg

SEQ ID NO: 901 - DNA, 16 bp, H. sapiens
aaaaacccaaagaggt

SEQ ID NO: 902 - DNA, 16 bp, H. sapiens
aaaaacccacacattt

SEQ ID NO: 903 - DNA, 16 bp, H. sapiens
aaaaaccccaaagaat

SEQ ID NO: 904 - DNA, 16 bp, H. sapiens
aaaaaccctggaaggc

SEQ ID NO: 905 - DNA, 16 bp, H. sapiens
aaaaacctctttaaaa

SEQ ID NO: 906 - DNA, 16 bp, H. sapiens
aaaaacctgaaaatta

SEQ ID NO: 907 - DNA, 16 bp, H. sapiens
aaaaacctgctcctga

SEQ ID NO: 908 - DNA, 16 bp, H. sapiens
aaaaacctggcagaga

SEQ ID NO: 909 - DNA, 16 bp, H. sapiens
aaaaaccttcagtggc

SEQ ID NO: 910 - DNA, 16 bp, H. sapiens
aaaaacctttctcctt

SEQ ID NO: 911 - DNA, 16 bp, H. sapiens
aaaaaccttttatttt

SEQ ID NO: 912 - DNA, 16 bp, H. sapiens
aaaaacctttttccag

SEQ ID NO: 913 - DNA, 16 bp, H. sapiens
aaaaacgttttttaaa

SEQ ID NO: 914 - DNA, 16 bp, H. sapiens
aaaaactaaaaattgg

SEQ ID NO: 915 - DNA, 16 bp, H. sapiens
aaaaactaacagaact

SEQ ID NO: 916 - DNA, 16 bp, H. sapiens
aaaaactacagaatat

SEQ ID NO: 917 - DNA, 16 bp, H. sapiens
aaaaactactgtaaat

SEQ ID NO: 918 - DNA, 16 bp, H. sapiens
aaaaactacttttttt

SEQ ID NO: 919 - DNA, 16 bp, H. sapiens
aaaaactaggaataga

SEQ ID NO: 920 - DNA, 16 bp, H. sapiens
aaaaactatgtaaata

SEQ ID NO: 921 - DNA, 16 bp, H. sapiens
aaaaactattgggtac

SEQ ID NO: 922 - DNA, 16 bp, H. sapiens
aaaaactatttcattt

SEQ ID NO: 923 - DNA, 16 bp, H. sapiens
aaaaactattttaaga

SEQ ID NO: 924 - DNA, 16 bp, H. sapiens
aaaaactcatttattt

SEQ ID NO: 925 - DNA, 16 bp, H. sapiens
aaaaactccagaagaa

SEQ ID NO: 926 - DNA, 16 bp, H. sapiens
aaaaactccaggacca

SEQ ID NO: 927 - DNA, 17 bp, H. sapiens
aaaaactccatctcaaa

SEQ ID NO: 928 - DNA, 16 bp, H. sapiens
aaaaactcctgcagct

SEQ ID NO: 929 - DNA, 16 bp, H. sapiens
aaaaactctcagaaaa

SEQ ID NO: 930 - DNA, 16 bp, H. sapiens
aaaaactctcagcaaa

SEQ ID NO: 931 - DNA, 16 bp, H. sapiens
aaaaactctgccaaaa

SEQ ID NO: 932 - DNA, 16 bp, H. sapiens
aaaaactctttgaaaa

SEQ ID NO: 933 - DNA, 16 bp, H. sapiens
aaaaactgaaaacagc

SEQ ID NO: 934 - DNA, 16 bp, H. sapiens
aaaaactgaaatattt

SEQ ID NO: 935 - DNA, 16 bp, H. sapiens
aaaaactgaaattata

SEQ ID NO: 936 - DNA, 16 bp, H. sapiens
aaaaactgaataattt

SEQ ID NO: 937 - DNA, 16 bp, H. sapiens
aaaaactgaatatatt

SEQ ID NO: 938 - DNA, 16 bp, H. sapiens
aaaaactgaatatccc

SEQ ID NO: 939 - DNA, 16 bp, H. sapiens
aaaaactgactttaaa

SEQ ID NO: 940 - DNA, 16 bp, H. sapiens
aaaaactgagaaagtt

SEQ ID NO: 941 - DNA, 16 bp, H. sapiens
aaaaactgagggaatt

SEQ ID NO: 942 - DNA, 16 bp, H. sapiens
aaaaactgatagaaat

SEQ ID NO: 943 - DNA, 16 bp, H. sapiens
aaaaactgccaaccaa

SEQ ID NO: 944 - DNA, 16 bp, H. sapiens
aaaaactgctttaaat

SEQ ID NO: 945 - DNA, 16 bp, H. sapiens
aaaaactggaaactaa

SEQ ID NO: 946 - DNA, 16 bp, H. sapiens
aaaaactggaaataac

SEQ ID NO: 947 - DNA, 16 bp, H. sapiens
aaaaactggaaataat

SEQ ID NO: 948 - DNA, 16 bp, H. sapiens
aaaaactggaaattct

SEQ ID NO: 949 - DNA, 16 bp, H. sapiens
aaaaactggaagaatt

SEQ ID NO: 950 - DNA, 16 bp, H. sapiens
aaaaactggaagcctt

SEQ ID NO: 951 - DNA, 16 bp, H. sapiens
aaaaactggagaaaat

SEQ ID NO: 952 - DNA, 16 bp, H. sapiens
aaaaactggaggcttt

SEQ ID NO: 953 - DNA, 16 bp, H. sapiens
aaaaactggatattca

SEQ ID NO: 954 - DNA, 16 bp, H. sapiens
aaaaactggctgggca

SEQ ID NO: 955 - DNA, 16 bp, H. sapiens
aaaaactggtaaaatc

SEQ ID NO: 956 - DNA, 16 bp, H. sapiens
aaaaactgtatgatca

SEQ ID NO: 957 - DNA, 16 bp, H. sapiens
aaaaactgtattattt

SEQ ID NO: 958 - DNA, 16 bp, H. sapiens
aaaaactgtctcaaaa

SEQ ID NO: 959 - DNA, 16 bp, H. sapiens
aaaaactgtgagtgcc

SEQ ID NO: 960 - DNA, 16 bp, H. sapiens
aaaaactgtgggaaaa

SEQ ID NO: 961 - DNA, 16 bp, H. sapiens
aaaaactgttttcttt

SEQ ID NO: 962 - DNA, 16 bp, H. sapiens
aaaaactgtttttgaa

SEQ ID NO: 963 - DNA, 16 bp, H. sapiens
aaaaacttaaaaatgg

SEQ ID NO: 964 - DNA, 16 bp, H. sapiens
aaaaacttaaaaatgt

SEQ ID NO: 965 - DNA, 16 bp, H. sapiens
aaaaacttaattttgt

SEQ ID NO: 966 - DNA, 16 bp, H. sapiens
aaaaacttagaaatat

SEQ ID NO: 967 - DNA, 16 bp, H. sapiens
aaaaacttatccatgt

SEQ ID NO: 968 - DNA, 16 bp, H. sapiens
aaaaacttcagacaaa

SEQ ID NO: 969 - DNA, 16 bp, H. sapiens
aaaaacttcagataaa

SEQ ID NO: 970 - DNA, 16 bp, H. sapiens
aaaaacttcagccgaa

SEQ ID NO: 971 - DNA, 16 bp, H. sapiens
aaaaacttctgttcat

SEQ ID NO: 972 - DNA, 16 bp, H. sapiens
aaaaacttgaaagaag

SEQ ID NO: 973 - DNA, 16 bp, H. sapiens
aaaaacttgataaatt

SEQ ID NO: 974 - DNA, 16 bp, H. sapiens
aaaaacttgctttatg

SEQ ID NO: 975 - DNA, 16 bp, H. sapiens
aaaaacttggaaaata

SEQ ID NO: 976 - DNA, 16 bp, H. sapiens
aaaaacttggaaggaa

SEQ ID NO: 977 - DNA, 16 bp, H. sapiens
aaaaactttaaacttt

SEQ ID NO: 978 - DNA, 16 bp, H. sapiens
aaaaactttattcttt

SEQ ID NO: 979 - DNA, 16 bp, H. sapiens
aaaaactttcattttt

SEQ ID NO: 980 - DNA, 16 bp, H. sapiens
aaaaactttcttcttt

SEQ ID NO: 981 - DNA, 16 bp, H. sapiens
aaaaactttgaaatat

SEQ ID NO: 982 - DNA, 16 bp, H. sapiens
aaaaactttgttttgt

SEQ ID NO: 983 - DNA, 16 bp, H. sapiens
aaaaacttttactttt

SEQ ID NO: 984 - DNA, 16 bp, H. sapiens
aaaaacttttagaact

SEQ ID NO: 985 - DNA, 16 bp, H. sapiens
aaaaactttttaaaag

SEQ ID NO: 986 - DNA, 16 bp, H. sapiens
aaaaacttttttcatt

SEQ ID NO: 987 - DNA, 16 bp, H. sapiens
aaaaagaaaaactgct

SEQ ID NO: 988 - DNA, 16 bp, H. sapiens
aaaaagaaaaccttac

SEQ ID NO: 989 - DNA, 16 bp, H. sapiens
aaaaagaaaacttcag

SEQ ID NO: 990 - DNA, 16 bp, H. sapiens
aaaaagaaaactttag

SEQ ID NO: 991 - DNA, 16 bp, H. sapiens
aaaaagaaaacttttt

SEQ ID NO: 992 - DNA, 16 bp, H. sapiens
aaaaagaaaagattct

SEQ ID NO: 993 - DNA, 16 bp, H. sapiens
aaaaagaaaagccctg

SEQ ID NO: 994 - DNA, 16 bp, H. sapiens
aaaaagaaaagctatt

SEQ ID NO: 995 - DNA, 16 bp, H. sapiens
aaaaagaaaagcttct

SEQ ID NO: 996 - DNA, 16 bp, H. sapiens
aaaaagaaaaggctgg

SEQ ID NO: 997 - DNA, 16 bp, H. sapiens
aaaaagaaaagtctat

SEQ ID NO: 998 - DNA, 16 bp, H. sapiens
aaaaagaaaatatgcc

SEQ ID NO: 999 - DNA, 16 bp, H. sapiens
aaaaagaaaatcagcc

SEQ ID NO: 1000 - DNA, 16 bp, H. sapiens
aaaaagaaaatccagg

SEQ ID NO: 1001 - DNA, 16 bp, H. sapiens
aaaaagaaaatcctca

SEQ ID NO: 1002 - DNA, 16 bp, H. sapiens
aaaaagaaaatcctgg

SEQ ID NO: 1003 - DNA, 16 bp, H. sapiens
aaaaagaaaatctctg

SEQ ID NO: 1004 - DNA, 16 bp, H. sapiens
aaaaagaaaatcttta

SEQ ID NO: 1005 - DNA, 16 bp, H. sapiens
aaaaagaaaatgactt

SEQ ID NO: 1006 - DNA, 16 bp, H. sapiens
aaaaagaaaatgtcag

SEQ ID NO: 1007 - DNA, 16 bp, H. sapiens
aaaaagaaaatgtcat

SEQ ID NO: 1008 - DNA, 16 bp, H. sapiens
aaaaagaaaattccag

SEQ ID NO: 1009 - DNA, 16 bp, H. sapiens
aaaaagaaacagcatt

SEQ ID NO: 1010 - DNA, 16 bp, H. sapiens
aaaaagaaacatattt

SEQ ID NO: 1011 - DNA, 16 bp, H. sapiens
aaaaagaaacatttga

SEQ ID NO: 1012 - DNA, 16 bp, H. sapiens
aaaaagaaacatttgt

SEQ ID NO: 1013 - DNA, 16 bp, H. sapiens
aaaaagaaaccctata

SEQ ID NO: 1014 - DNA, 16 bp, H. sapiens
aaaaagaaactattga

SEQ ID NO: 1015 - DNA, 16 bp, H. sapiens
aaaaagaaactcattt

SEQ ID NO: 1016 - DNA, 16 bp, H. sapiens
aaaaagaaactctgta

SEQ ID NO: 1017 - DNA, 16 bp, H. sapiens
aaaaagaaacttcata

SEQ ID NO: 1018 - DNA, 16 bp, H. sapiens
aaaaagaaacttcctt

SEQ ID NO: 1019 - DNA, 16 bp, H. sapiens
aaaaagaaacttttaa

SEQ ID NO: 1020 - DNA, 16 bp, H. sapiens
aaaaagaaacttttct

SEQ ID NO: 1021 - DNA, 16 bp, H. sapiens
aaaaagaaagaactct

SEQ ID NO: 1022 - DNA, 16 bp, H. sapiens
aaaaagaaagacttca

SEQ ID NO: 1023 - DNA, 16 bp, H. sapiens
aaaaagaaagagctgg

SEQ ID NO: 1024 - DNA, 16 bp, H. sapiens
aaaaagaaaggcattt

SEQ ID NO: 1025 - DNA, 16 bp, H. sapiens
aaaaagaaagtgacat

SEQ ID NO: 1026 - DNA, 16 bp, H. sapiens
aaaaagaaagtgcttt

SEQ ID NO: 1027 - DNA, 16 bp, H. sapiens
aaaaagaaagttgcag

SEQ ID NO: 1028 - DNA, 16 bp, H. sapiens
aaaaagaaatacatgg

SEQ ID NO: 1029 - DNA, 16 bp, H. sapiens
aaaaagaaatacattg

SEQ ID NO: 1030 - DNA, 16 bp, H. sapiens
aaaaagaaatacctgg

SEQ ID NO: 1031 - DNA, 16 bp, H. sapiens
aaaaagaaatacttca

SEQ ID NO: 1032 - DNA, 16 bp, H. sapiens
aaaaagaaatactttt

SEQ ID NO: 1033 - DNA, 16 bp, H. sapiens
aaaaagaaatatctca

SEQ ID NO: 1034 - DNA, 16 bp, H. sapiens
aaaaagaaatatttca

SEQ ID NO: 1035 - DNA, 16 bp, H. sapiens
aaaaagaaatatttct

SEQ ID NO: 1036 - DNA, 16 bp, H. sapiens
aaaaagaaatcacatt

SEQ ID NO: 1037 - DNA, 16 bp, H. sapiens
aaaaagaaatcactga

SEQ ID NO: 1038 - DNA, 16 bp, H. sapiens
aaaaagaaatcatgtc

SEQ ID NO: 1039 - DNA, 16 bp, H. sapiens
aaaaagaaatctaatt

SEQ ID NO: 1040 - DNA, 16 bp, H. sapiens
aaaaagaaatgaactg

SEQ ID NO: 1041 - DNA, 16 bp, H. sapiens
aaaaagaaatgcaagt

SEQ ID NO: 1042 - DNA, 16 bp, H. sapiens
aaaaagaaatgctaca

SEQ ID NO: 1043 - DNA, 16 bp, H. sapiens
aaaaagaaatgcttca

SEQ ID NO: 1044 - DNA, 16 bp, H. sapiens
aaaaagaaatggggtc

SEQ ID NO: 1045 - DNA, 16 bp, H. sapiens
aaaaagaaatgtcttt

SEQ ID NO: 1046 - DNA, 16 bp, H. sapiens
aaaaagaaatgtttca

SEQ ID NO: 1047 - DNA, 16 bp, H. sapiens
aaaaagaaatgttttt

SEQ ID NO: 1048 - DNA, 16 bp, H. sapiens
aaaaagaaattcagga

SEQ ID NO: 1049 - DNA, 16 bp, H. sapiens
aaaaagaaattctgtt

SEQ ID NO: 1050 - DNA, 16 bp, H. sapiens
aaaaagaaattgccaa

SEQ ID NO: 1051 - DNA, 16 bp, H. sapiens
aaaaagaaattgtttt

SEQ ID NO: 1052 - DNA, 16 bp, H. sapiens
aaaaagaaatttcaga

SEQ ID NO: 1053 - DNA, 16 bp, H. sapiens
aaaaagaaatttcagt

SEQ ID NO: 1054 - DNA, 16 bp, H. sapiens
aaaaagaaatttgcaa

SEQ ID NO: 1055 - DNA, 16 bp, H. sapiens
aaaaagaaatttttct

SEQ ID NO: 1056 - DNA, 16 bp, H. sapiens
aaaaagaacaagagtc

SEQ ID NO: 1057 - DNA, 16 bp, H. sapiens
aaaaagaacattttat

SEQ ID NO: 1058 - DNA, 16 bp, H. sapiens
aaaaagaacctgaata

SEQ ID NO: 1059 - DNA, 16 bp, H. sapiens
aaaaagaacttaaatt

SEQ ID NO: 1060 - DNA, 16 bp, H. sapiens
aaaaagaacttcagag

SEQ ID NO: 1061 - DNA, 16 bp, H. sapiens
aaaaagaactttttaa

SEQ ID NO: 1062 - DNA, 16 bp, H. sapiens
aaaaagaagaaatctg

SEQ ID NO: 1063 - DNA, 16 bp, H. sapiens
aaaaagaagaaattcc

SEQ ID NO: 1064 - DNA, 16 bp, H. sapiens
aaaaagaagacattat

SEQ ID NO: 1065 - DNA, 16 bp, H. sapiens
aaaaagaagagctggt

SEQ ID NO: 1066 - DNA, 16 bp, H. sapiens
aaaaagaagatattac

SEQ ID NO: 1067 - DNA, 16 bp, H. sapiens
aaaaagaaggaatcct

SEQ ID NO: 1068 - DNA, 16 bp, H. sapiens
aaaaagaagtgccttt

SEQ ID NO: 1069 - DNA, 16 bp, H. sapiens
aaaaagaatatgcatt

SEQ ID NO: 1070 - DNA, 16 bp, H. sapiens
aaaaagaatcattttg

SEQ ID NO: 1071 - DNA, 16 bp, H. sapiens
aaaaagaatgaactac

SEQ ID NO: 1072 - DNA, 16 bp, H. sapiens
aaaaagaatgacatcc

SEQ ID NO: 1073 - DNA, 16 bp, H. sapiens
aaaaagaatgcttcca

SEQ ID NO: 1074 - DNA, 16 bp, H. sapiens
aaaaagaatgtcattt

SEQ ID NO: 1075 - DNA, 16 bp, H. sapiens
aaaaagaatgtgcatt

SEQ ID NO: 1076 - DNA, 16 bp, H. sapiens
aaaaagaattagccaa

SEQ ID NO: 1077 - DNA, 16 bp, H. sapiens
aaaaagaattatccag

SEQ ID NO: 1078 - DNA, 16 bp, H. sapiens
aaaaagaattattctt

SEQ ID NO: 1079 - DNA, 16 bp, H. sapiens
aaaaagaattcatttt

SEQ ID NO: 1080 - DNA, 16 bp, H. sapiens
aaaaagaatttcttaa

SEQ ID NO: 1081 - DNA, 16 bp, H. sapiens
aaaaagaattttctca

SEQ ID NO: 1082 - DNA, 16 bp, H. sapiens
aaaaagaatttttttc

SEQ ID NO: 1083 - DNA, 16 bp, H. sapiens
aaaaagacaaggatgt

SEQ ID NO: 1084 - DNA, 16 bp, H. sapiens
aaaaagacacctgcac

SEQ ID NO: 1085 - DNA, 16 bp, H. sapiens
aaaaagacacttgtac

SEQ ID NO: 1086 - DNA, 16 bp, H. sapiens
aaaaagacatccaaat

SEQ ID NO: 1087 - DNA, 16 bp, H. sapiens
aaaaagacatgaaagt

SEQ ID NO: 1088 - DNA, 16 bp, H. sapiens
aaaaagacattttaaa

SEQ ID NO: 1089 - DNA, 16 bp, H. sapiens
aaaaagacatttttga

SEQ ID NO: 1090 - DNA, 16 bp, H. sapiens
aaaaagactatatttt

SEQ ID NO: 1091 - DNA, 16 bp, H. sapiens
aaaaagactgttttca

SEQ ID NO: 1092 - DNA, 16 bp, H. sapiens
aaaaagacttcatttt

SEQ ID NO: 1093 - DNA, 16 bp, H. sapiens
aaaaagactttaaaac

SEQ ID NO: 1094 - DNA, 16 bp, H. sapiens
aaaaagacttttaaat

SEQ ID NO: 1095 - DNA, 16 bp, H. sapiens
aaaaagacttttattt

SEQ ID NO: 1096 - DNA, 16 bp, H. sapiens
aaaaagagaaagatct

SEQ ID NO: 1097 - DNA, 16 bp, H. sapiens
aaaaagagaaagtttt

SEQ ID NO: 1098 - DNA, 16 bp, H. sapiens
aaaaagagaacacttt

SEQ ID NO: 1099 - DNA, 16 bp, H. sapiens
aaaaagagacattaca

SEQ ID NO: 1100 - DNA, 16 bp, H. sapiens
aaaaagagaccaaggc

SEQ ID NO: 1101 - DNA, 16 bp, H. sapiens
aaaaagagcaaagttg

SEQ ID NO: 1102 - DNA, 16 bp, H. sapiens
aaaaagagcaagatca

SEQ ID NO: 1103 - DNA, 16 bp, H. sapiens
aaaaagagcccaggac

SEQ ID NO: 1104 - DNA, 16 bp, H. sapiens
aaaaagagcctgaatt

SEQ ID NO: 1105 - DNA, 16 bp, H. sapiens
aaaaagagcctgcata

SEQ ID NO: 1106 - DNA, 16 bp, H. sapiens
aaaaagagcctgcatg

SEQ ID NO: 1107 - DNA, 16 bp, H. sapiens
aaaaagagcgaaactc

SEQ ID NO: 1108 - DNA, 16 bp, H. sapiens
aaaaagagctatttat

SEQ ID NO: 1109 - DNA, 16 bp, H. sapiens
aaaaagaggcagctca

SEQ ID NO: 1110 - DNA, 30 bp, H. sapiens
aaaaagagggaatcctccctaactcatttg

SEQ ID NO: 1111 - DNA, 16 bp, H. sapiens
aaaaagagtaacttta

SEQ ID NO: 1112 - DNA, 16 bp, H. sapiens
aaaaagagtataattg

SEQ ID NO: 1113 - DNA, 16 bp, H. sapiens
aaaaagagtcaagacc

SEQ ID NO: 1114 - DNA, 16 bp, H. sapiens
aaaaagagtccaggac

SEQ ID NO: 1115 - DNA, 16 bp, H. sapiens
aaaaagagtttatttt

SEQ ID NO: 1116 - DNA, 16 bp, H. sapiens
aaaaagagtttcaaaa

SEQ ID NO: 1117 - DNA, 16 bp, H. sapiens
aaaaagataaaatctt

SEQ ID NO: 1118 - DNA, 16 bp, H. sapiens
aaaaagataatttttg

SEQ ID NO: 1119 - DNA, 16 bp, H. sapiens
aaaaagatacaaattt

SEQ ID NO: 1120 - DNA, 16 bp, H. sapiens
aaaaagatattccaca

SEQ ID NO: 1121 - DNA, 16 bp, H. sapiens
aaaaagatatttcaaa

SEQ ID NO: 1122 - DNA, 16 bp, H. sapiens
aaaaagatatttcata

SEQ ID NO: 1123 - DNA, 16 bp, H. sapiens
aaaaagatattttcct

SEQ ID NO: 1124 - DNA, 16 bp, H. sapiens
aaaaagatcaaaattc

SEQ ID NO: 1125 - DNA, 16 bp, H. sapiens
aaaaagatcagtggtt

SEQ ID NO: 1126 - DNA, 16 bp, H. sapiens
aaaaagatcagtgttt

SEQ ID NO: 1127 - DNA, 16 bp, H. sapiens
aaaaagatcctaaaat

SEQ ID NO: 1128 - DNA, 16 bp, H. sapiens
aaaaagatcctgaata

SEQ ID NO: 1129 - DNA, 16 bp, H. sapiens
aaaaagatgcagtttt

SEQ ID NO: 1130 - DNA, 16 bp, H. sapiens
aaaaagatgcatgcac

SEQ ID NO: 1131 - DNA, 16 bp, H. sapiens
aaaaagatgctcaaaa

SEQ ID NO: 1132 - DNA, 16 bp, H. sapiens
aaaaagatgctcagca

SEQ ID NO: 1133 - DNA, 16 bp, H. sapiens
aaaaagatggagtctc

SEQ ID NO: 1134 - DNA, 16 bp, H. sapiens
aaaaagatgtgttgaa

SEQ ID NO: 1135 - DNA, 16 bp, H. sapiens
aaaaagatgttcaata

SEQ ID NO: 1136 - DNA, 16 bp, H. sapiens
aaaaagattcttttca

SEQ ID NO: 1137 - DNA, 16 bp, H. sapiens
aaaaagattgtccaaa

SEQ ID NO: 1138 - DNA, 16 bp, H. sapiens
aaaaagatttcttatt

SEQ ID NO: 1139 - DNA, 16 bp, H. sapiens
aaaaagattttgtttt

SEQ ID NO: 1140 - DNA, 16 bp, H. sapiens
aaaaagatttttctct

SEQ ID NO: 1141 - DNA, 16 bp, H. sapiens
aaaaagcaaaactgtg

SEQ ID NO: 1142 - DNA, 16 bp, H. sapiens
aaaaagcaaaatggca

SEQ ID NO: 1143 - DNA, 16 bp, H. sapiens
aaaaagcaaatattcc

SEQ ID NO: 1144 - DNA, 16 bp, H. sapiens
aaaaagcaaattatat

SEQ ID NO: 1145 - DNA, 16 bp, H. sapiens
aaaaagcaatattttt

SEQ ID NO: 1146 - DNA, 16 bp, H. sapiens
aaaaagcaatcctaaa

SEQ ID NO: 1147 - DNA, 16 bp, H. sapiens
aaaaagcaatggggaa

SEQ ID NO: 1148 - DNA, 16 bp, H. sapiens
aaaaagcacaagcatt

SEQ ID NO: 1149 - DNA, 16 bp, H. sapiens
aaaaagcacctttata

SEQ ID NO: 1150 - DNA, 16 bp, H. sapiens
aaaaagcagaaatatt

SEQ ID NO: 1151 - DNA, 16 bp, H. sapiens
aaaaagcagaaattct

SEQ ID NO: 1152 - DNA, 16 bp, H. sapiens
aaaaagcagaactact

SEQ ID NO: 1153 - DNA, 16 bp, H. sapiens
aaaaagcagatttttt

SEQ ID NO: 1154 - DNA, 16 bp, H. sapiens
aaaaagcagcagcagc

SEQ ID NO: 1155 - DNA, 16 bp, H. sapiens
aaaaagcaggaaagat

SEQ ID NO: 1156 - DNA, 16 bp, H. sapiens
aaaaagcaggatacaa

SEQ ID NO: 1157 - DNA, 16 bp, H. sapiens
aaaaagcaggcaacat

SEQ ID NO: 1158 - DNA, 16 bp, H. sapiens
aaaaagcagtttataa

SEQ ID NO: 1159 - DNA, 16 bp, H. sapiens
aaaaagcatatttaaa

SEQ ID NO: 1160 - DNA, 16 bp, H. sapiens
aaaaagcattattatt

SEQ ID NO: 1161 - DNA, 16 bp, H. sapiens
aaaaagcatttaataa

SEQ ID NO: 1162 - DNA, 16 bp, H. sapiens
aaaaagcatttatttt

SEQ ID NO: 1163 - DNA, 16 bp, H. sapiens
aaaaagcatttgaaat

SEQ ID NO: 1164 - DNA, 16 bp, H. sapiens
aaaaagcattttgaaa

SEQ ID NO: 1165 - DNA, 16 bp, H. sapiens
aaaaagcatttttaaa

SEQ ID NO: 1166 - DNA, 16 bp, H. sapiens
aaaaagccaaactcat

SEQ ID NO: 1167 - DNA, 16 bp, H. sapiens
aaaaagccaaagcaat

SEQ ID NO: 1168 - DNA, 16 bp, H. sapiens
aaaaagccagacatgg

SEQ ID NO: 1169 - DNA, 16 bp, H. sapiens
aaaaagccagatgtgg

SEQ ID NO: 1170 - DNA, 16 bp, H. sapiens
aaaaagccaggtgcag

SEQ ID NO: 1171 - DNA, 16 bp, H. sapiens
aaaaagccagtctcaa

SEQ ID NO: 1172 - DNA, 16 bp, H. sapiens
aaaaagcctgaaaatt

SEQ ID NO: 1173 - DNA, 16 bp, H. sapiens
aaaaagcctggcatgg

SEQ ID NO: 1174 - DNA, 16 bp, H. sapiens
aaaaagcctttttaaa

SEQ ID NO: 1175 - DNA, 16 bp, H. sapiens
aaaaagctaatttaaa

SEQ ID NO: 1176 - DNA, 16 bp, H. sapiens
aaaaagctacctattg

SEQ ID NO: 1177 - DNA, 16 bp, H. sapiens
aaaaagctactagaat

SEQ ID NO: 1178 - DNA, 16 bp, H. sapiens
aaaaagctagttcttt

SEQ ID NO: 1179 - DNA, 16 bp, H. sapiens
aaaaagctcaacataa

SEQ ID NO: 1180 - DNA, 16 bp, H. sapiens
aaaaagctcaacatca

SEQ ID NO: 1181 - DNA, 16 bp, H. sapiens
aaaaagctcaatatta

SEQ ID NO: 1182 - DNA, 16 bp, H. sapiens
aaaaagctcaccatca

SEQ ID NO: 1183 - DNA, 16 bp, H. sapiens
aaaaagctctaaaaat

SEQ ID NO: 1184 - DNA, 16 bp, H. sapiens
aaaaagctctttaaaa

SEQ ID NO: 1185 - DNA, 16 bp, H. sapiens
aaaaagctgaattgct

SEQ ID NO: 1186 - DNA, 16 bp, H. sapiens
aaaaagctggaaacaa

SEQ ID NO: 1187 - DNA, 16 bp, H. sapiens
aaaaagcttaaaaagt

SEQ ID NO: 1188 - DNA, 16 bp, H. sapiens
aaaaagcttattaaaa

SEQ ID NO: 1189 - DNA, 16 bp, H. sapiens
aaaaagcttctaaaaa

SEQ ID NO: 1190 - DNA, 16 bp, H. sapiens
aaaaagcttctgcaca

SEQ ID NO: 1191 - DNA, 16 bp, H. sapiens
aaaaagctttaagaaa

SEQ ID NO: 1192 - DNA, 16 bp, H. sapiens
aaaaagctttatattt

SEQ ID NO: 1193 - DNA, 16 bp, H. sapiens
aaaaagctttggattt

SEQ ID NO: 1194 - DNA, 16 bp, H. sapiens
aaaaagcttttttttt

SEQ ID NO: 1195 - DNA, 16 bp, H. sapiens
aaaaaggaaaacattc

SEQ ID NO: 1196 - DNA, 16 bp, H. sapiens
aaaaaggaaacctcca

SEQ ID NO: 1197 - DNA, 16 bp, H. sapiens
aaaaaggaaacttcag

SEQ ID NO: 1198 - DNA, 16 bp, H. sapiens
aaaaaggaaagacatt

SEQ ID NO: 1199 - DNA, 16 bp, H. sapiens
aaaaaggaaatatcat

SEQ ID NO: 1200 - DNA, 16 bp, H. sapiens
aaaaaggaaatgacag

SEQ ID NO: 1201 - DNA, 16 bp, H. sapiens
aaaaaggaaatgtctt

SEQ ID NO: 1202 - DNA, 16 bp, H. sapiens
aaaaaggaaattctgc

SEQ ID NO: 1203 - DNA, 16 bp, H. sapiens
aaaaaggaaatttaca

SEQ ID NO: 1204 - DNA, 16 bp, H. sapiens
aaaaaggaagttttca

SEQ ID NO: 1205 - DNA, 16 bp, H. sapiens
aaaaaggaatgacatc

SEQ ID NO: 1206 - DNA, 16 bp, H. sapiens
aaaaaggaatttattg

SEQ ID NO: 1207 - DNA, 16 bp, H. sapiens
aaaaaggaatttgaga

SEQ ID NO: 1208 - DNA, 16 bp, H. sapiens
aaaaaggaattttttt

SEQ ID NO: 1209 - DNA, 16 bp, H. sapiens
aaaaaggacaagatca

SEQ ID NO: 1210 - DNA, 16 bp, H. sapiens
aaaaaggacaccaagt

SEQ ID NO: 1211 - DNA, 16 bp, H. sapiens
aaaaaggacttcaaaa

SEQ ID NO: 1212 - DNA, 16 bp, H. sapiens
aaaaaggagaaagttt

SEQ ID NO: 1213 - DNA, 16 bp, H. sapiens
aaaaaggagaaatcag

SEQ ID NO: 1214 - DNA, 16 bp, H. sapiens
aaaaaggagatattat

SEQ ID NO: 1215 - DNA, 16 bp, H. sapiens
aaaaaggagccaggca

SEQ ID NO: 1216 - DNA, 16 bp, H. sapiens
aaaaaggagctcaaat

SEQ ID NO: 1217 - DNA, 16 bp, H. sapiens
aaaaaggaggagttca

SEQ ID NO: 1218 - DNA, 16 bp, H. sapiens
aaaaaggagtgcttaa

SEQ ID NO: 1219 - DNA, 16 bp, H. sapiens
aaaaaggatacttttt

SEQ ID NO: 1220 - DNA, 16 bp, H. sapiens
aaaaaggatgagtttg

SEQ ID NO: 1221 - DNA, 16 bp, H. sapiens
aaaaaggatttagaat

SEQ ID NO: 1222 - DNA, 16 bp, H. sapiens
aaaaaggatttttttc

SEQ ID NO: 1223 - DNA, 16 bp, H. sapiens
aaaaaggcaaaattat

SEQ ID NO: 1224 - DNA, 16 bp, H. sapiens
aaaaaggcaaataatg

SEQ ID NO: 1225 - DNA, 16 bp, H. sapiens
aaaaaggcagcttaca

SEQ ID NO: 1226 - DNA, 16 bp, H. sapiens
aaaaaggcagggattg

SEQ ID NO: 1227 - DNA, 16 bp, H. sapiens
aaaaaggcctcaaagg

SEQ ID NO: 1228 - DNA, 16 bp, H. sapiens
aaaaaggctggggact

SEQ ID NO: 1229 - DNA, 16 bp, H. sapiens
aaaaaggcttttaaaa

SEQ ID NO: 1230 - DNA, 16 bp, H. sapiens
aaaaagggaaaatgtt

SEQ ID NO: 1231 - DNA, 16 bp, H. sapiens
aaaaagggaatccttt

SEQ ID NO: 1232 - DNA, 16 bp, H. sapiens
aaaaagggggaatttt

SEQ ID NO: 1233 - DNA, 16 bp, H. sapiens
aaaaaggtattttatt

SEQ ID NO: 1234 - DNA, 16 bp, H. sapiens
aaaaaggtcatggtca

SEQ ID NO: 1235 - DNA, 16 bp, H. sapiens
aaaaaggtcattatat

SEQ ID NO: 1236 - DNA, 16 bp, H. sapiens
aaaaaggtcttctcca

SEQ ID NO: 1237 - DNA, 16 bp, H. sapiens
aaaaaggtctttaaaa

SEQ ID NO: 1238 - DNA, 16 bp, H. sapiens
aaaaaggtttacagaa

SEQ ID NO: 1239 - DNA, 16 bp, H. sapiens
aaaaaggtttatttgg

SEQ ID NO: 1240 - DNA, 16 bp, H. sapiens
aaaaagtaaaacattt

SEQ ID NO: 1241 - DNA, 16 bp, H. sapiens
aaaaagtaaaatcttt

SEQ ID NO: 1242 - DNA, 16 bp, H. sapiens
aaaaagtaaacaactt

SEQ ID NO: 1243 - DNA, 16 bp, H. sapiens
aaaaagtaaatatctt

SEQ ID NO: 1244 - DNA, 16 bp, H. sapiens
aaaaagtaacatattt

SEQ ID NO: 1245 - DNA, 16 bp, H. sapiens
aaaaagtaatcatttt

SEQ ID NO: 1246 - DNA, 16 bp, H. sapiens
aaaaagtaatgaatcc

SEQ ID NO: 1247 - DNA, 16 bp, H. sapiens
aaaaagtacacagaag

SEQ ID NO: 1248 - DNA, 16 bp, H. sapiens
aaaaagtaccaaaatt

SEQ ID NO: 1249 - DNA, 16 bp, H. sapiens
aaaaagtactaaaatt

SEQ ID NO: 1250 - DNA, 16 bp, H. sapiens
aaaaagtagctgagtg

SEQ ID NO: 1251 - DNA, 16 bp, H. sapiens
aaaaagtaggccgggc

SEQ ID NO: 1252 - DNA, 16 bp, H. sapiens
aaaaagtataaaactc

SEQ ID NO: 1253 - DNA, 16 bp, H. sapiens
aaaaagtatgcaaaat

SEQ ID NO: 1254 - DNA, 16 bp, H. sapiens
aaaaagtattacatat

SEQ ID NO: 1255 - DNA, 16 bp, H. sapiens
aaaaagtattcaaaat

SEQ ID NO: 1256 - DNA, 16 bp, H. sapiens
aaaaagtattcaataa

SEQ ID NO: 1257 - DNA, 16 bp, H. sapiens
aaaaagtatttctttt

SEQ ID NO: 1258 - DNA, 16 bp, H. sapiens
aaaaagtattttcaaa

SEQ ID NO: 1259 - DNA, 16 bp, H. sapiens
aaaaagtatttttcaa

SEQ ID NO: 1260 - DNA, 16 bp, H. sapiens
aaaaagtatttttgaa

SEQ ID NO: 1261 - DNA, 16 bp, H. sapiens
aaaaagtattttttca

SEQ ID NO: 1262 - DNA, 16 bp, H. sapiens
aaaaagtattttttct

SEQ ID NO: 1263 - DNA, 16 bp, H. sapiens
aaaaagtcaaaattca

SEQ ID NO: 1264 - DNA, 16 bp, H. sapiens
aaaaagtcaaaattta

SEQ ID NO: 1265 - DNA, 16 bp, H. sapiens
aaaaagtcaagaacca

SEQ ID NO: 1266 - DNA, 16 bp, H. sapiens
aaaaagtcaataattt

SEQ ID NO: 1267 - DNA, 16 bp, H. sapiens
aaaaagtcacttaaaa

SEQ ID NO: 1268 - DNA, 16 bp, H. sapiens
aaaaagtcagaaaatg

SEQ ID NO: 1269 - DNA, 16 bp, H. sapiens
aaaaagtcataaaatt

SEQ ID NO: 1270 - DNA, 16 bp, H. sapiens
aaaaagtcattaattt

SEQ ID NO: 1271 - DNA, 16 bp, H. sapiens
aaaaagtcattttctt

SEQ ID NO: 1272 - DNA, 16 bp, H. sapiens
aaaaagtcatttttct

SEQ ID NO: 1273 - DNA, 16 bp, H. sapiens
aaaaagtcctccccta

SEQ ID NO: 1274 - DNA, 16 bp, H. sapiens
aaaaagtctccagaga

SEQ ID NO: 1275 - DNA, 16 bp, H. sapiens
aaaaagtctgaaacag

SEQ ID NO: 1276 - DNA, 16 bp, H. sapiens
aaaaagtctgaaagat

SEQ ID NO: 1277 - DNA, 16 bp, H. sapiens
aaaaagtctgtatttt

SEQ ID NO: 1278 - DNA, 16 bp, H. sapiens
aaaaagtcttcaaaat

SEQ ID NO: 1279 - DNA, 16 bp, H. sapiens
aaaaagtgaaaaactt

SEQ ID NO: 1280 - DNA, 16 bp, H. sapiens
aaaaagtgaaatgtat

SEQ ID NO: 1281 - DNA, 16 bp, H. sapiens
aaaaagtgagcaaaga

SEQ ID NO: 1282 - DNA, 16 bp, H. sapiens
aaaaagtgatatttga

SEQ ID NO: 1283 - DNA, 16 bp, H. sapiens
aaaaagtgcagcttgc

SEQ ID NO: 1284 - DNA, 17 bp, H. sapiens
aaaaagtgggcaaagga

SEQ ID NO: 1285 - DNA, 16 bp, H. sapiens
aaaaagtgtattttaa

SEQ ID NO: 1286 - DNA, 16 bp, H. sapiens
aaaaagtgtttaattt

SEQ ID NO: 1287 - DNA, 16 bp, H. sapiens
aaaaagtgtttcaaaa

SEQ ID NO: 1288 - DNA, 16 bp, H. sapiens
aaaaagtgttttataa

SEQ ID NO: 1289 - DNA, 16 bp, H. sapiens
aaaaagtgttttttct

SEQ ID NO: 1290 - DNA, 16 bp, H. sapiens
aaaaagttacaaagat

SEQ ID NO: 1291 - DNA, 16 bp, H. sapiens
aaaaagttcacagtgt

SEQ ID NO: 1292 - DNA, 16 bp, H. sapiens
aaaaagttcatagaaa

SEQ ID NO: 1293 - DNA, 16 bp, H. sapiens
aaaaagttctaaaata

SEQ ID NO: 1294 - DNA, 16 bp, H. sapiens
aaaaagttctgcagat

SEQ ID NO: 1295 - DNA, 16 bp, H. sapiens
aaaaagttctggaaat

SEQ ID NO: 1296 - DNA, 16 bp, H. sapiens
aaaaagttctggagat

SEQ ID NO: 1297 - DNA, 16 bp, H. sapiens
aaaaagttctttgaaa

SEQ ID NO: 1298 - DNA, 16 bp, H. sapiens
aaaaagttgaaaactt

SEQ ID NO: 1299 - DNA, 16 bp, H. sapiens
aaaaagttgaaagctt

SEQ ID NO: 1300 - DNA, 16 bp, H. sapiens
aaaaagttgacctcat

SEQ ID NO: 1301 - DNA, 16 bp, H. sapiens
aaaaagttgtaaaaca

SEQ ID NO: 1302 - DNA, 16 bp, H. sapiens
aaaaagttgtcaagat

SEQ ID NO: 1303 - DNA, 16 bp, H. sapiens
aaaaagtttattttga

SEQ ID NO: 1304 - DNA, 16 bp, H. sapiens
aaaaagtttattttgt

SEQ ID NO: 1305 - DNA, 16 bp, H. sapiens
aaaaagtttcagaaat

SEQ ID NO: 1306 - DNA, 16 bp, H. sapiens
aaaaagtttctgcaca

SEQ ID NO: 1307 - DNA, 16 bp, H. sapiens
aaaaagtttcttttct

SEQ ID NO: 1308 - DNA, 16 bp, H. sapiens
aaaaagtttgaatttt

SEQ ID NO: 1309 - DNA, 16 bp, H. sapiens
aaaaagtttgagattt

SEQ ID NO: 1310 - DNA, 16 bp, H. sapiens
aaaaagtttggaaacc

SEQ ID NO: 1311 - DNA, 16 bp, H. sapiens
aaaaagtttggatttt

SEQ ID NO: 1312 - DNA, 16 bp, H. sapiens
aaaaagtttgtttaaa

SEQ ID NO: 1313 - DNA, 16 bp, H. sapiens
aaaaagtttgttttct

SEQ ID NO: 1314 - DNA, 16 bp, H. sapiens
aaaaagttttatttgt

SEQ ID NO: 1315 - DNA, 16 bp, H. sapiens
aaaaagttttcaaata

SEQ ID NO: 1316 - DNA, 16 bp, H. sapiens
aaaaagttttcaaatt

SEQ ID NO: 1317 - DNA, 16 bp, H. sapiens
aaaaagtttttgtaga

SEQ ID NO: 1318 - DNA, 16 bp, H. sapiens
aaaaataaaaatggct

SEQ ID NO: 1319 - DNA, 16 bp, H. sapiens
aaaaataaaactttga

SEQ ID NO: 1320 - DNA, 16 bp, H. sapiens
aaaaataaaacttttg

SEQ ID NO: 1321 - DNA, 16 bp, H. sapiens
aaaaataaaatccttc

SEQ ID NO: 1322 - DNA, 16 bp, H. sapiens
aaaaataaacctcttt

SEQ ID NO: 1323 - DNA, 16 bp, H. sapiens
aaaaataaactgttta

SEQ ID NO: 1324 - DNA, 16 bp, H. sapiens
aaaaataaagaccttt

SEQ ID NO: 1325 - DNA, 16 bp, H. sapiens
aaaaataaagatgtca

SEQ ID NO: 1326 - DNA, 16 bp, H. sapiens
aaaaataaagattctg

SEQ ID NO: 1327 - DNA, 16 bp, H. sapiens
aaaaataaagctgaat

SEQ ID NO: 1328 - DNA, 16 bp, H. sapiens
aaaaataaagctgttt

SEQ ID NO: 1329 - DNA, 16 bp, H. sapiens
aaaaataaagtcatca

SEQ ID NO: 1330 - DNA, 16 bp, H. sapiens
aaaaataaagtctatt

SEQ ID NO: 1331 - DNA, 16 bp, H. sapiens
aaaaataaagtgttga

SEQ ID NO: 1332 - DNA, 16 bp, H. sapiens
aaaaataaagtttgca

SEQ ID NO: 1333 - DNA, 16 bp, H. sapiens
aaaaataaagttttgt

SEQ ID NO: 1334 - DNA, 16 bp, H. sapiens
aaaaataaatagcttt

SEQ ID NO: 1335 - DNA, 16 bp, H. sapiens
aaaaataaatgagcta

SEQ ID NO: 1336 - DNA, 16 bp, H. sapiens
aaaaataaatgcatga

SEQ ID NO: 1337 - DNA, 16 bp, H. sapiens
aaaaataaatgcttaa

SEQ ID NO: 1338 - DNA, 16 bp, H. sapiens
aaaaataaatgcttat

SEQ ID NO: 1339 - DNA, 16 bp, H. sapiens
aaaaataaatgtaact

SEQ ID NO: 1340 - DNA, 16 bp, H. sapiens
aaaaataaatgtcata

SEQ ID NO: 1341 - DNA, 16 bp, H. sapiens
aaaaataaatgtgtca

SEQ ID NO: 1342 - DNA, 16 bp, H. sapiens
aaaaataaattcagtg

SEQ ID NO: 1343 - DNA, 16 bp, H. sapiens
aaaaataaattctaga

SEQ ID NO: 1344 - DNA, 16 bp, H. sapiens
aaaaataaattgaact

SEQ ID NO: 1345 - DNA, 16 bp, H. sapiens
aaaaataaattggact

SEQ ID NO: 1346 - DNA, 16 bp, H. sapiens
aaaaataacaggtgct

SEQ ID NO: 1347 - DNA, 16 bp, H. sapiens
aaaaataacatgaatt

SEQ ID NO: 1348 - DNA, 16 bp, H. sapiens
aaaaataacccaaatg

SEQ ID NO: 1349 - DNA, 16 bp, H. sapiens
aaaaataaccttttta

SEQ ID NO: 1350 - DNA, 16 bp, H. sapiens
aaaaataactcaaagt

SEQ ID NO: 1351 - DNA, 16 bp, H. sapiens
aaaaataactttcaga

SEQ ID NO: 1352 - DNA, 16 bp, H. sapiens
aaaaataagcatttca

SEQ ID NO: 1353 - DNA, 16 bp, H. sapiens
aaaaataagctttatt

SEQ ID NO: 1354 - DNA, 16 bp, H. sapiens
aaaaataaggaaactg

SEQ ID NO: 1355 - DNA, 16 bp, H. sapiens
aaaaataagtagcatt

SEQ ID NO: 1356 - DNA, 16 bp, H. sapiens
aaaaataagtcagaag

SEQ ID NO: 1357 - DNA, 16 bp, H. sapiens
aaaaataagtctttaa

SEQ ID NO: 1358 - DNA, 16 bp, H. sapiens
aaaaataagtcttttt

SEQ ID NO: 1359 - DNA, 16 bp, H. sapiens
aaaaataatacatgct

SEQ ID NO: 1360 - DNA, 16 bp, H. sapiens
aaaaataatcacagta

SEQ ID NO: 1361 - DNA, 16 bp, H. sapiens
aaaaataatcactttt

SEQ ID NO: 1362 - DNA, 16 bp, H. sapiens
aaaaataatcagtttt

SEQ ID NO: 1363 - DNA, 16 bp, H. sapiens
aaaaataatctgtaat

SEQ ID NO: 1364 - DNA, 16 bp, H. sapiens
aaaaataatgctgaca

SEQ ID NO: 1365 - DNA, 16 bp, H. sapiens
aaaaataatgtttcca

SEQ ID NO: 1366 - DNA, 16 bp, H. sapiens
aaaaataattctgata

SEQ ID NO: 1367 - DNA, 16 bp, H. sapiens
aaaaataattgtggtt

SEQ ID NO: 1368 - DNA, 16 bp, H. sapiens
aaaaataatttcagtg

SEQ ID NO: 1369 - DNA, 16 bp, H. sapiens
aaaaatacaaaattgc

SEQ ID NO: 1370 - DNA, 16 bp, H. sapiens
aaaaatacaaaggtta

SEQ ID NO: 1371 - DNA, 16 bp, H. sapiens
aaaaatacaaatatgt

SEQ ID NO: 1372 - DNA, 16 bp, H. sapiens
aaaaatacaaatttga

SEQ ID NO: 1373 - DNA, 16 bp, H. sapiens
aaaaatacaaccaagg

SEQ ID NO: 1374 - DNA, 16 bp, H. sapiens
aaaaatacaagatgag

SEQ ID NO: 1375 - DNA, 16 bp, H. sapiens
aaaaatacaatctttt

SEQ ID NO: 1376 - DNA, 16 bp, H. sapiens
aaaaatacacttattt

SEQ ID NO: 1377 - DNA, 16 bp, H. sapiens
aaaaatacagaaagtt

SEQ ID NO: 1378 - DNA, 16 bp, H. sapiens
aaaaatacagaattta

SEQ ID NO: 1379 - DNA, 16 bp, H. sapiens
aaaaatacagtaacta

SEQ ID NO: 1380 - DNA, 16 bp, H. sapiens
aaaaatacagtattat

SEQ ID NO: 1381 - DNA, 16 bp, H. sapiens
aaaaatacatatatag

SEQ ID NO: 1382 - DNA, 16 bp, H. sapiens
aaaaatacatatgcca

SEQ ID NO: 1383 - DNA, 16 bp, H. sapiens
aaaaatacatgaaatt

SEQ ID NO: 1384 - DNA, 16 bp, H. sapiens
aaaaatacatgatatt

SEQ ID NO: 1385 - DNA, 16 bp, H. sapiens
aaaaatacatgtaaag

SEQ ID NO: 1386 - DNA, 16 bp, H. sapiens
aaaaatacatgtatat

SEQ ID NO: 1387 - DNA, 16 bp, H. sapiens
aaaaatacatgtattt

SEQ ID NO: 1388 - DNA, 16 bp, H. sapiens
aaaaatacatgtttat

SEQ ID NO: 1389 - DNA, 16 bp, H. sapiens
aaaaatacatttcttt

SEQ ID NO: 1390 - DNA, 16 bp, H. sapiens
aaaaatacattttgga

SEQ ID NO: 1391 - DNA, 16 bp, H. sapiens
aaaaatacctggaaaa

SEQ ID NO: 1392 - DNA, 16 bp, H. sapiens
aaaaatacgtattttt

SEQ ID NO: 1393 - DNA, 16 bp, H. sapiens
aaaaatactcagcaaa

SEQ ID NO: 1394 - DNA, 16 bp, H. sapiens
aaaaatactcattttt

SEQ ID NO: 1395 - DNA, 16 bp, H. sapiens
aaaaatactctttttt

SEQ ID NO: 1396 - DNA, 16 bp, H. sapiens
aaaaatactgacattt

SEQ ID NO: 1397 - DNA, 16 bp, H. sapiens
aaaaatactgactttt

SEQ ID NO: 1398 - DNA, 16 bp, H. sapiens
aaaaatactgattttt

SEQ ID NO: 1399 - DNA, 16 bp, H. sapiens
aaaaatactggccagg

SEQ ID NO: 1400 - DNA, 16 bp, H. sapiens
aaaaatactgtatttt

SEQ ID NO: 1401 - DNA, 16 bp, H. sapiens
aaaaatactgtgaaaa

SEQ ID NO: 1402 - DNA, 16 bp, H. sapiens
aaaaatacttctgcaa

SEQ ID NO: 1403 - DNA, 16 bp, H. sapiens
aaaaatacttgaaatt

SEQ ID NO: 1404 - DNA, 16 bp, H. sapiens
aaaaatacttgaagaa

SEQ ID NO: 1405 - DNA, 16 bp, H. sapiens
aaaaatacttgcaaac

SEQ ID NO: 1406 - DNA, 16 bp, H. sapiens
aaaaatacttggaaat

SEQ ID NO: 1407 - DNA, 16 bp, H. sapiens
aaaaatactttctctt

SEQ ID NO: 1408 - DNA, 16 bp, H. sapiens
aaaaatactttgtaaa

SEQ ID NO: 1409 - DNA, 16 bp, H. sapiens
aaaaatacttttcctt

SEQ ID NO: 1410 - DNA, 16 bp, H. sapiens
aaaaatagaaattagc

SEQ ID NO: 1411 - DNA, 16 bp, H. sapiens
aaaaatagaaattatc

SEQ ID NO: 1412 - DNA, 16 bp, H. sapiens
aaaaatagaacttttt

SEQ ID NO: 1413 - DNA, 16 bp, H. sapiens
aaaaatagaaggaagc

SEQ ID NO: 1414 - DNA, 16 bp, H. sapiens
aaaaatagaatggttg

SEQ ID NO: 1415 - DNA, 16 bp, H. sapiens
aaaaatagaattagca

SEQ ID NO: 1416 - DNA, 16 bp, H. sapiens
aaaaatagacatgtag

SEQ ID NO: 1417 - DNA, 16 bp, H. sapiens
aaaaatagatttcttt

SEQ ID NO: 1418 - DNA, 16 bp, H. sapiens
aaaaatagcattttca

SEQ ID NO: 1419 - DNA, 16 bp, H. sapiens
aaaaatagcattttct

SEQ ID NO: 1420 - DNA, 16 bp, H. sapiens
aaaaatagccaaagca

SEQ ID NO: 1421 - DNA, 16 bp, H. sapiens
aaaaatagccaggcgt

SEQ ID NO: 1422 - DNA, 16 bp, H. sapiens
aaaaatagccaggtgt

SEQ ID NO: 1423 - DNA, 16 bp, H. sapiens
aaaaatagccatgtgt

SEQ ID NO: 1424 - DNA, 16 bp, H. sapiens
aaaaatagctaatgca

SEQ ID NO: 1425 - DNA, 16 bp, H. sapiens
aaaaatagctttaaaa

SEQ ID NO: 1426 - DNA, 16 bp, H. sapiens
aaaaataggaacattt

SEQ ID NO: 1427 - DNA, 16 bp, H. sapiens
aaaaataggctgggtg

SEQ ID NO: 1428 - DNA, 16 bp, H. sapiens
aaaaataggtaaattg

SEQ ID NO: 1429 - DNA, 16 bp, H. sapiens
aaaaatagtaaacatt

SEQ ID NO: 1430 - DNA, 16 bp, H. sapiens
aaaaatagtttgattt

SEQ ID NO: 1431 - DNA, 16 bp, H. sapiens
aaaaatagtttttgaa

SEQ ID NO: 1432 - DNA, 16 bp, H. sapiens
aaaaatataattctga

SEQ ID NO: 1433 - DNA, 16 bp, H. sapiens
aaaaatatatcatgaa

SEQ ID NO: 1434 - DNA, 16 bp, H. sapiens
aaaaatatatgcattt

SEQ ID NO: 1435 - DNA, 16 bp, H. sapiens
aaaaatatatgtccat

SEQ ID NO: 1436 - DNA, 16 bp, H. sapiens
aaaaatatattgcaaa

SEQ ID NO: 1437 - DNA, 16 bp, H. sapiens
aaaaatatatttcatg

SEQ ID NO: 1438 - DNA, 16 bp, H. sapiens
aaaaatatatttgttg

SEQ ID NO: 1439 - DNA, 16 bp, H. sapiens
aaaaatatcatttgat

SEQ ID NO: 1440 - DNA, 16 bp, H. sapiens
aaaaatatcatttttc

SEQ ID NO: 1441 - DNA, 16 bp, H. sapiens
aaaaatatcctccaaa

SEQ ID NO: 1442 - DNA, 16 bp, H. sapiens
aaaaatatccttgaaa

SEQ ID NO: 1443 - DNA, 16 bp, H. sapiens
aaaaatatcttaaaga

SEQ ID NO: 1444 - DNA, 16 bp, H. sapiens
aaaaatatcttccatg

SEQ ID NO: 1445 - DNA, 16 bp, H. sapiens
aaaaatatctttagaa

SEQ ID NO: 1446 - DNA, 16 bp, H. sapiens
aaaaatatgaacattt

SEQ ID NO: 1447 - DNA, 16 bp, H. sapiens
aaaaatatgatttcat

SEQ ID NO: 1448 - DNA, 16 bp, H. sapiens
aaaaatatgcagagaa

SEQ ID NO: 1449 - DNA, 16 bp, H. sapiens
aaaaatatgccttttt

SEQ ID NO: 1450 - DNA, 16 bp, H. sapiens
aaaaatatgctcaaaa

SEQ ID NO: 1451 - DNA, 16 bp, H. sapiens
aaaaatatgcttattt

SEQ ID NO: 1452 - DNA, 16 bp, H. sapiens
aaaaatatgctttaaa

SEQ ID NO: 1453 - DNA, 16 bp, H. sapiens
aaaaatatggcattat

SEQ ID NO: 1454 - DNA, 16 bp, H. sapiens
aaaaatatgggacaat

SEQ ID NO: 1455 - DNA, 16 bp, H. sapiens
aaaaatatggtgttat

SEQ ID NO: 1456 - DNA, 16 bp, H. sapiens
aaaaatatggttttat

SEQ ID NO: 1457 - DNA, 16 bp, H. sapiens
aaaaatatgtacaaat

SEQ ID NO: 1458 - DNA, 16 bp, H. sapiens
aaaaatatgtagagta

SEQ ID NO: 1459 - DNA, 16 bp, H. sapiens
aaaaatatgtatatgt

SEQ ID NO: 1460 - DNA, 16 bp, H. sapiens
aaaaatatgtatgtgt

SEQ ID NO: 1461 - DNA, 16 bp, H. sapiens
aaaaatatgtcttttt

SEQ ID NO: 1462 - DNA, 16 bp, H. sapiens
aaaaatatgtgcaaag

SEQ ID NO: 1463 - DNA, 16 bp, H. sapiens
aaaaatatgtgtatat

SEQ ID NO: 1464 - DNA, 16 bp, H. sapiens
aaaaatatgttacttt

SEQ ID NO: 1465 - DNA, 16 bp, H. sapiens
aaaaatatgttttctg

SEQ ID NO: 1466 - DNA, 16 bp, H. sapiens
aaaaatattcaaagat

SEQ ID NO: 1467 - DNA, 16 bp, H. sapiens
aaaaatattcaagtaa

SEQ ID NO: 1468 - DNA, 16 bp, H. sapiens
aaaaatattcacattt

SEQ ID NO: 1469 - DNA, 16 bp, H. sapiens
aaaaatattcagattt

SEQ ID NO: 1470 - DNA, 16 bp, H. sapiens
aaaaatattcaggaaa

SEQ ID NO: 1471 - DNA, 16 bp, H. sapiens
aaaaatattcagtttt

SEQ ID NO: 1472 - DNA, 16 bp, H. sapiens
aaaaatattcatttca

SEQ ID NO: 1473 - DNA, 16 bp, H. sapiens
aaaaatattctaaatg

SEQ ID NO: 1474 - DNA, 16 bp, H. sapiens
aaaaatattctccaaa

SEQ ID NO: 1475 - DNA, 16 bp, H. sapiens
aaaaatattcttagct

SEQ ID NO: 1476 - DNA, 16 bp, H. sapiens
aaaaatattgctaatt

SEQ ID NO: 1477 - DNA, 16 bp, H. sapiens
aaaaatatttaacaga

SEQ ID NO: 1478 - DNA, 16 bp, H. sapiens
aaaaatatttcaagaa

SEQ ID NO: 1479 - DNA, 16 bp, H. sapiens
aaaaatatttcagaaa

SEQ ID NO: 1480 - DNA, 16 bp, H. sapiens
aaaaatatttcatgaa

SEQ ID NO: 1481 - DNA, 16 bp, H. sapiens
aaaaatatttcccaaa

SEQ ID NO: 1482 - DNA, 16 bp, H. sapiens
aaaaatatttcctgtt

SEQ ID NO: 1483 - DNA, 16 bp, H. sapiens
aaaaatatttcttcca

SEQ ID NO: 1484 - DNA, 16 bp, H. sapiens
aaaaatattttctcta

SEQ ID NO: 1485 - DNA, 16 bp, H. sapiens
aaaaatattttgaact

SEQ ID NO: 1486 - DNA, 16 bp, H. sapiens
aaaaatattttgagat

SEQ ID NO: 1487 - DNA, 16 bp, H. sapiens
aaaaatattttgcttt

SEQ ID NO: 1488 - DNA, 16 bp, H. sapiens
aaaaatattttggaag

SEQ ID NO: 1489 - DNA, 16 bp, H. sapiens
aaaaatatttttccaa

SEQ ID NO: 1490 - DNA, 16 bp, H. sapiens
aaaaatcaaatgtaat

SEQ ID NO: 1491 - DNA, 16 bp, H. sapiens
aaaaatcaaatgttta

SEQ ID NO: 1492 - DNA, 16 bp, H. sapiens
aaaaatcaaatttgtt

SEQ ID NO: 1493 - DNA, 16 bp, H. sapiens
aaaaatcaactgacaa

SEQ ID NO: 1494 - DNA, 16 bp, H. sapiens
aaaaatcaactttggg

SEQ ID NO: 1495 - DNA, 16 bp, H. sapiens
aaaaatcaagaagtag

SEQ ID NO: 1496 - DNA, 16 bp, H. sapiens
aaaaatcaagacattt

SEQ ID NO: 1497 - DNA, 16 bp, H. sapiens
aaaaatcaagttattt

SEQ ID NO: 1498 - DNA, 16 bp, H. sapiens
aaaaatcaatcatttt

SEQ ID NO: 1499 - DNA, 16 bp, H. sapiens
aaaaatcaatgagttt

SEQ ID NO: 1500 - DNA, 16 bp, H. sapiens
aaaaatcaattgaatt

SEQ ID NO: 1501 - DNA, 16 bp, H. sapiens
aaaaatcacaagattt

SEQ ID NO: 1502 - DNA, 16 bp, H. sapiens
aaaaatcacaagcctt

SEQ ID NO: 1503 - DNA, 16 bp, H. sapiens
aaaaatcacaagcttt

SEQ ID NO: 1504 - DNA, 16 bp, H. sapiens
aaaaatcacagaaatg

SEQ ID NO: 1505 - DNA, 16 bp, H. sapiens
aaaaatcacagatatt

SEQ ID NO: 1506 - DNA, 16 bp, H. sapiens
aaaaatcacaggcatt

SEQ ID NO: 1507 - DNA, 16 bp, H. sapiens
aaaaatcagaatttaa

SEQ ID NO: 1508 - DNA, 17 bp, H. sapiens
aaaaatcagagcttagt

SEQ ID NO: 1509 - DNA, 16 bp, H. sapiens
aaaaatcagattattt

SEQ ID NO: 1510 - DNA, 16 bp, H. sapiens
aaaaatcagatttagt

SEQ ID NO: 1511 - DNA, 16 bp, H. sapiens
aaaaatcagcaaggat

SEQ ID NO: 1512 - DNA, 16 bp, H. sapiens
aaaaatcagcagcatt

SEQ ID NO: 1513 - DNA, 16 bp, H. sapiens
aaaaatcagggctggg

SEQ ID NO: 1514 - DNA, 16 bp, H. sapiens
aaaaatcagtattatt

SEQ ID NO: 1515 - DNA, 16 bp, H. sapiens
aaaaatcagtgaaatt

SEQ ID NO: 1516 - DNA, 16 bp, H. sapiens
aaaaatcatgtgatca

SEQ ID NO: 1517 - DNA, 16 bp, H. sapiens
aaaaatcatgtttatt

SEQ ID NO: 1518 - DNA, 16 bp, H. sapiens
aaaaatcattgaaaat

SEQ ID NO: 1519 - DNA, 16 bp, H. sapiens
aaaaatcattgaaatg

SEQ ID NO: 1520 - DNA, 16 bp, H. sapiens
aaaaatcattgaaatt

SEQ ID NO: 1521 - DNA, 16 bp, H. sapiens
aaaaatcatttttctt

SEQ ID NO: 1522 - DNA, 16 bp, H. sapiens
aaaaatccacattctc

SEQ ID NO: 1523 - DNA, 16 bp, H. sapiens
aaaaatccacattctt

SEQ ID NO: 1524 - DNA, 16 bp, H. sapiens
aaaaatccatgcttca

SEQ ID NO: 1525 - DNA, 16 bp, H. sapiens
aaaaatccatgtataa

SEQ ID NO: 1526 - DNA, 16 bp, H. sapiens
aaaaatccattcatct

SEQ ID NO: 1527 - DNA, 16 bp, H. sapiens
aaaaatcctagaggaa

SEQ ID NO: 1528 - DNA, 16 bp, H. sapiens
aaaaatcctagggccc

SEQ ID NO: 1529 - DNA, 16 bp, H. sapiens
aaaaatcctcaaagaa

SEQ ID NO: 1530 - DNA, 16 bp, H. sapiens
aaaaatcctggaaaat

SEQ ID NO: 1531 - DNA, 16 bp, H. sapiens
aaaaatccttaagaaa

SEQ ID NO: 1532 - DNA, 16 bp, H. sapiens
aaaaatccttgaaaaa

SEQ ID NO: 1533 - DNA, 16 bp, H. sapiens
aaaaatccttttagaa

SEQ ID NO: 1534 - DNA, 16 bp, H. sapiens
aaaaatccttttttta

SEQ ID NO: 1535 - DNA, 16 bp, H. sapiens
aaaaatcgaggaggag

SEQ ID NO: 1536 - DNA, 16 bp, H. sapiens
aaaaatctaaaatgtg

SEQ ID NO: 1537 - DNA, 16 bp, H. sapiens
aaaaatctactcaaga

SEQ ID NO: 1538 - DNA, 16 bp, H. sapiens
aaaaatctatgttttt

SEQ ID NO: 1539 - DNA, 16 bp, H. sapiens
aaaaatctatttctaa

SEQ ID NO: 1540 - DNA, 16 bp, H. sapiens
aaaaatctatttgtaa

SEQ ID NO: 1541 - DNA, 16 bp, H. sapiens
aaaaatctcaaggaaa

SEQ ID NO: 1542 - DNA, 16 bp, H. sapiens
aaaaatctcagaactt

SEQ ID NO: 1543 - DNA, 16 bp, H. sapiens
aaaaatctcagaagaa

SEQ ID NO: 1544 - DNA, 16 bp, H. sapiens
aaaaatctctgaaaaa

SEQ ID NO: 1545 - DNA, 16 bp, H. sapiens
aaaaatctgaaaaact

SEQ ID NO: 1546 - DNA, 16 bp, H. sapiens
aaaaatctgaaatcca

SEQ ID NO: 1547 - DNA, 16 bp, H. sapiens
aaaaatctgaaattca

SEQ ID NO: 1548 - DNA, 16 bp, H. sapiens
aaaaatctgaatttct

SEQ ID NO: 1549 - DNA, 16 bp, H. sapiens
aaaaatctgatttttc

SEQ ID NO: 1550 - DNA, 16 bp, H. sapiens
aaaaatctgcaaaaat

SEQ ID NO: 1551 - DNA, 16 bp, H. sapiens
aaaaatctgcatataa

SEQ ID NO: 1552 - DNA, 16 bp, H. sapiens
aaaaatctggaaaaat

SEQ ID NO: 1553 - DNA, 16 bp, H. sapiens
aaaaatctggaaataa

SEQ ID NO: 1554 - DNA, 16 bp, H. sapiens
aaaaatctggatttct

SEQ ID NO: 1555 - DNA, 16 bp, H. sapiens
aaaaatctgtaaatat

SEQ ID NO: 1556 - DNA, 16 bp, H. sapiens
aaaaatctgtatttca

SEQ ID NO: 1557 - DNA, 16 bp, H. sapiens
aaaaatctgttaaaaa

SEQ ID NO: 1558 - DNA, 16 bp, H. sapiens
aaaaatctgttgaatg

SEQ ID NO: 1559 - DNA, 16 bp, H. sapiens
aaaaatctgttttaaa

SEQ ID NO: 1560 - DNA, 16 bp, H. sapiens
aaaaatcttaaaagat

SEQ ID NO: 1561 - DNA, 16 bp, H. sapiens
aaaaatcttaaaagtt

SEQ ID NO: 1562 - DNA, 16 bp, H. sapiens
aaaaatcttaaagaca

SEQ ID NO: 1563 - DNA, 16 bp, H. sapiens
aaaaatcttatttgtt

SEQ ID NO: 1564 - DNA, 16 bp, H. sapiens
aaaaatcttccagttt

SEQ ID NO: 1565 - DNA, 16 bp, H. sapiens
aaaaatcttccccaaa

SEQ ID NO: 1566 - DNA, 16 bp, H. sapiens
aaaaatcttgagaaaa

SEQ ID NO: 1567 - DNA, 16 bp, H. sapiens
aaaaatcttggctggg

SEQ ID NO: 1568 - DNA, 16 bp, H. sapiens
aaaaatctttctattt

SEQ ID NO: 1569 - DNA, 16 bp, H. sapiens
aaaaatctttgtcatt

SEQ ID NO: 1570 - DNA, 16 bp, H. sapiens
aaaaatcttttaaagt

SEQ ID NO: 1571 - DNA, 16 bp, H. sapiens
aaaaatcttttaactt

SEQ ID NO: 1572 - DNA, 16 bp, H. sapiens
aaaaatcttttggaaa

SEQ ID NO: 1573 - DNA, 16 bp, H. sapiens
aaaaatgaaaaattct

SEQ ID NO: 1574 - DNA, 16 bp, H. sapiens
aaaaatgaaaacactg

SEQ ID NO: 1575 - DNA, 16 bp, H. sapiens
aaaaatgaaaacattt

SEQ ID NO: 1576 - DNA, 16 bp, H. sapiens
aaaaatgaaaatgtgt

SEQ ID NO: 1577 - DNA, 16 bp, H. sapiens
aaaaatgaaacaatgt

SEQ ID NO: 1578 - DNA, 16 bp, H. sapiens
aaaaatgaaacaattt

SEQ ID NO: 1579 - DNA, 16 bp, H. sapiens
aaaaatgaaactagac

SEQ ID NO: 1580 - DNA, 16 bp, H. sapiens
aaaaatgaaagcatgt

SEQ ID NO: 1581 - DNA, 16 bp, H. sapiens
aaaaatgaaatattca

SEQ ID NO: 1582 - DNA, 16 bp, H. sapiens
aaaaatgaaatcttat

SEQ ID NO: 1583 - DNA, 16 bp, H. sapiens
aaaaatgaaatgtgtt

SEQ ID NO: 1584 - DNA, 16 bp, H. sapiens
aaaaatgaaattctta

SEQ ID NO: 1585 - DNA, 16 bp, H. sapiens
aaaaatgaacaaatgg

SEQ ID NO: 1586 - DNA, 16 bp, H. sapiens
aaaaatgaacaatttt

SEQ ID NO: 1587 - DNA, 16 bp, H. sapiens
aaaaatgaacttttaa

SEQ ID NO: 1588 - DNA, 16 bp, H. sapiens
aaaaatgaagaatgct

SEQ ID NO: 1589 - DNA, 16 bp, H. sapiens
aaaaatgaagatgaca

SEQ ID NO: 1590 - DNA, 16 bp, H. sapiens
aaaaatgaagctgaaa

SEQ ID NO: 1591 - DNA, 16 bp, H. sapiens
aaaaatgaagttggat

SEQ ID NO: 1592 - DNA, 16 bp, H. sapiens
aaaaatgaagtttctt

SEQ ID NO: 1593 - DNA, 16 bp, H. sapiens
aaaaatgaatattctg

SEQ ID NO: 1594 - DNA, 16 bp, H. sapiens
aaaaatgaattttcta

SEQ ID NO: 1595 - DNA, 16 bp, H. sapiens
aaaaatgacaaagagg

SEQ ID NO: 1596 - DNA, 16 bp, H. sapiens
aaaaatgacaaagatg

SEQ ID NO: 1597 - DNA, 16 bp, H. sapiens
aaaaatgacaagcatt

SEQ ID NO: 1598 - DNA, 16 bp, H. sapiens
aaaaatgacatttaaa

SEQ ID NO: 1599 - DNA, 16 bp, H. sapiens
aaaaatgacattttat

SEQ ID NO: 1600 - DNA, 16 bp, H. sapiens
aaaaatgactaaaatg

SEQ ID NO: 1601 - DNA, 16 bp, H. sapiens
aaaaatgagaacattt

SEQ ID NO: 1602 - DNA, 16 bp, H. sapiens
aaaaatgagaattttt

SEQ ID NO: 1603 - DNA, 16 bp, H. sapiens
aaaaatgagacaatat

SEQ ID NO: 1604 - DNA, 16 bp, H. sapiens
aaaaatgagccaaaga

SEQ ID NO: 1605 - DNA, 16 bp, H. sapiens
aaaaatgaggaaaact

SEQ ID NO: 1606 - DNA, 16 bp, H. sapiens
aaaaatgagtaaatct

SEQ ID NO: 1607 - DNA, 16 bp, H. sapiens
aaaaatgagtattttt

SEQ ID NO: 1608 - DNA, 16 bp, H. sapiens
aaaaatgataaaactg

SEQ ID NO: 1609 - DNA, 16 bp, H. sapiens
aaaaatgatcaaacat

SEQ ID NO: 1610 - DNA, 16 bp, H. sapiens
aaaaatgatgaagggg

SEQ ID NO: 1611 - DNA, 16 bp, H. sapiens
aaaaatgatgtgaaat

SEQ ID NO: 1612 - DNA, 16 bp, H. sapiens
aaaaatgattctgaaa

SEQ ID NO: 1613 - DNA, 16 bp, H. sapiens
aaaaatgattcttttt

SEQ ID NO: 1614 - DNA, 16 bp, H. sapiens
aaaaatgatttcttct

SEQ ID NO: 1615 - DNA, 16 bp, H. sapiens
aaaaatgcaaaaagtt

SEQ ID NO: 1616 - DNA, 16 bp, H. sapiens
aaaaatgcaaaatatt

SEQ ID NO: 1617 - DNA, 16 bp, H. sapiens
aaaaatgcaaaatgtg

SEQ ID NO: 1618 - DNA, 16 bp, H. sapiens
aaaaatgcaaacacat

SEQ ID NO: 1619 - DNA, 16 bp, H. sapiens
aaaaatgcaataatta

SEQ ID NO: 1620 - DNA, 16 bp, H. sapiens
aaaaatgcaattgaca

SEQ ID NO: 1621 - DNA, 16 bp, H. sapiens
aaaaatgcaatttaaa

SEQ ID NO: 1622 - DNA, 16 bp, H. sapiens
aaaaatgcacaaaagt

SEQ ID NO: 1623 - DNA, 16 bp, H. sapiens
aaaaatgcacattttt

SEQ ID NO: 1624 - DNA, 16 bp, H. sapiens
aaaaatgcagtgaaaa

SEQ ID NO: 1625 - DNA, 16 bp, H. sapiens
aaaaatgcataatttt

SEQ ID NO: 1626 - DNA, 16 bp, H. sapiens
aaaaatgcatatcaaa

SEQ ID NO: 1627 - DNA, 16 bp, H. sapiens
aaaaatgcattttaaa

SEQ ID NO: 1628 - DNA, 16 bp, H. sapiens
aaaaatgccattgaga

SEQ ID NO: 1629 - DNA, 16 bp, H. sapiens
aaaaatgctaaaatta

SEQ ID NO: 1630 - DNA, 16 bp, H. sapiens
aaaaatgctaataatt

SEQ ID NO: 1631 - DNA, 16 bp, H. sapiens
aaaaatgctcaacttc

SEQ ID NO: 1632 - DNA, 16 bp, H. sapiens
aaaaatgctcaatatc

SEQ ID NO: 1633 - DNA, 16 bp, H. sapiens
aaaaatgctcagaaaa

SEQ ID NO: 1634 - DNA, 16 bp, H. sapiens
aaaaatgctgccagtc

SEQ ID NO: 1635 - DNA, 16 bp, H. sapiens
aaaaatgcttcaataa

SEQ ID NO: 1636 - DNA, 16 bp, H. sapiens
aaaaatgcttttagaa

SEQ ID NO: 1637 - DNA, 16 bp, H. sapiens
aaaaatggaaaacatt

SEQ ID NO: 1638 - DNA, 16 bp, H. sapiens
aaaaatggaaacaacc

SEQ ID NO: 1639 - DNA, 16 bp, H. sapiens
aaaaatggaaagatgt

SEQ ID NO: 1640 - DNA, 16 bp, H. sapiens
aaaaatggaaattcat

SEQ ID NO: 1641 - DNA, 16 bp, H. sapiens
aaaaatggaactatca

SEQ ID NO: 1642 - DNA, 16 bp, H. sapiens
aaaaatggaatttctt

SEQ ID NO: 1643 - DNA, 16 bp, H. sapiens
aaaaatggaattttta

SEQ ID NO: 1644 - DNA, 16 bp, H. sapiens
aaaaatggacaaaatg

SEQ ID NO: 1645 - DNA, 16 bp, H. sapiens
aaaaatggacagaaga

SEQ ID NO: 1646 - DNA, 16 bp, H. sapiens
aaaaatggacatttct

SEQ ID NO: 1647 - DNA, 16 bp, H. sapiens
aaaaatggagaaattt

SEQ ID NO: 1648 - DNA, 16 bp, H. sapiens
aaaaatggagctacca

SEQ ID NO: 1649 - DNA, 16 bp, H. sapiens
aaaaatggagctgaaa

SEQ ID NO: 1650 - DNA, 16 bp, H. sapiens
aaaaatggattttttt

SEQ ID NO: 1651 - DNA, 16 bp, H. sapiens
aaaaatggcaaagaat

SEQ ID NO: 1652 - DNA, 16 bp, H. sapiens
aaaaatggcaatatat

SEQ ID NO: 1653 - DNA, 16 bp, H. sapiens
aaaaatggccaaatat

SEQ ID NO: 1654 - DNA, 16 bp, H. sapiens
aaaaatgggcaaagga

SEQ ID NO: 1655 - DNA, 16 bp, H. sapiens
aaaaatgggcaaataa

SEQ ID NO: 1656 - DNA, 16 bp, H. sapiens
aaaaatgggcaagaga

SEQ ID NO: 1657 - DNA, 16 bp, H. sapiens
aaaaatgggccaggcg

SEQ ID NO: 1658 - DNA, 16 bp, H. sapiens
aaaaatggggaaaaca

SEQ ID NO: 1659 - DNA, 16 bp, H. sapiens
aaaaatgggtgaagga

SEQ ID NO: 1660 - DNA, 16 bp, H. sapiens
aaaaatggtcaaagaa

SEQ ID NO: 1661 - DNA, 16 bp, H. sapiens
aaaaatggtgctaata

SEQ ID NO: 1662 - DNA, 16 bp, H. sapiens
aaaaatggtgctgata

SEQ ID NO: 1663 - DNA, 16 bp, H. sapiens
aaaaatggttaaaaca

SEQ ID NO: 1664 - DNA, 16 bp, H. sapiens
aaaaatggtttcatgg

SEQ ID NO: 1665 - DNA, 16 bp, H. sapiens
aaaaatggtttgaaaa

SEQ ID NO: 1666 - DNA, 16 bp, H. sapiens
aaaaatggttttgtta

SEQ ID NO: 1667 - DNA, 16 bp, H. sapiens
aaaaatgtaaaaagtc

SEQ ID NO: 1668 - DNA, 16 bp, H. sapiens
aaaaatgtaaaactta

SEQ ID NO: 1669 - DNA, 16 bp, H. sapiens
aaaaatgtaaaagcat

SEQ ID NO: 1670 - DNA, 16 bp, H. sapiens
aaaaatgtaaactttt

SEQ ID NO: 1671 - DNA, 16 bp, H. sapiens
aaaaatgtaaatttca

SEQ ID NO: 1672 - DNA, 16 bp, H. sapiens
aaaaatgtaactgcta

SEQ ID NO: 1673 - DNA, 16 bp, H. sapiens
aaaaatgtaattcttt

SEQ ID NO: 1674 - DNA, 16 bp, H. sapiens
aaaaatgtacacattt

SEQ ID NO: 1675 - DNA, 16 bp, H. sapiens
aaaaatgtacagtttt

SEQ ID NO: 1676 - DNA, 16 bp, H. sapiens
aaaaatgtacattgta

SEQ ID NO: 1677 - DNA, 16 bp, H. sapiens
aaaaatgtaggccagg

SEQ ID NO: 1678 - DNA, 16 bp, H. sapiens
aaaaatgtatacattt

SEQ ID NO: 1679 - DNA, 16 bp, H. sapiens
aaaaatgtatattctg

SEQ ID NO: 1680 - DNA, 16 bp, H. sapiens
aaaaatgtatgcaaat

SEQ ID NO: 1681 - DNA, 16 bp, H. sapiens
aaaaatgtattacatt

SEQ ID NO: 1682 - DNA, 16 bp, H. sapiens
aaaaatgtattatctt

SEQ ID NO: 1683 - DNA, 16 bp, H. sapiens
aaaaatgtattcagtg

SEQ ID NO: 1684 - DNA, 16 bp, H. sapiens
aaaaatgtattctata

SEQ ID NO: 1685 - DNA, 16 bp, H. sapiens
aaaaatgtcagagaaa

SEQ ID NO: 1686 - DNA, 16 bp, H. sapiens
aaaaatgtcagataat

SEQ ID NO: 1687 - DNA, 16 bp, H. sapiens
aaaaatgtcaggaaaa

SEQ ID NO: 1688 - DNA, 16 bp, H. sapiens
aaaaatgtcattagta

SEQ ID NO: 1689 - DNA, 16 bp, H. sapiens
aaaaatgtcattttaa

SEQ ID NO: 1690 - DNA, 16 bp, H. sapiens
aaaaatgtctaaaaag

SEQ ID NO: 1691 - DNA, 16 bp, H. sapiens
aaaaatgtctctagac

SEQ ID NO: 1692 - DNA, 16 bp, H. sapiens
aaaaatgtctctctct

SEQ ID NO: 1693 - DNA, 16 bp, H. sapiens
aaaaatgtcttcattt

SEQ ID NO: 1694 - DNA, 16 bp, H. sapiens
aaaaatgtctttaaaa

SEQ ID NO: 1695 - DNA, 16 bp, H. sapiens
aaaaatgtcttttcat

SEQ ID NO: 1696 - DNA, 16 bp, H. sapiens
aaaaatgtcttttgaa

SEQ ID NO: 1697 - DNA, 16 bp, H. sapiens
aaaaatgtgaaaagac

SEQ ID NO: 1698 - DNA, 16 bp, H. sapiens
aaaaatgtgaagatat

SEQ ID NO: 1699 - DNA, 16 bp, H. sapiens
aaaaatgtgattttta

SEQ ID NO: 1700 - DNA, 16 bp, H. sapiens
aaaaatgtgatttttt

SEQ ID NO: 1701 - DNA, 16 bp, H. sapiens
aaaaatgtgcaaaaca

SEQ ID NO: 1702 - DNA, 16 bp, H. sapiens
aaaaatgtgcaaaaga

SEQ ID NO: 1703 - DNA, 16 bp, H. sapiens
aaaaatgtgcaaagga

SEQ ID NO: 1704 - DNA, 16 bp, H. sapiens
aaaaatgtgcatttta

SEQ ID NO: 1705 - DNA, 16 bp, H. sapiens
aaaaatgtggaaatga

SEQ ID NO: 1706 - DNA, 16 bp, H. sapiens
aaaaatgtggaaccaa

SEQ ID NO: 1707 - DNA, 16 bp, H. sapiens
aaaaatgtggcatata

SEQ ID NO: 1708 - DNA, 16 bp, H. sapiens
aaaaatgtgtaatttt

SEQ ID NO: 1709 - DNA, 16 bp, H. sapiens
aaaaatgtgtacatga

SEQ ID NO: 1710 - DNA, 16 bp, H. sapiens
aaaaatgtgtgtgtgt

SEQ ID NO: 1711 - DNA, 16 bp, H. sapiens
aaaaatgtgttttcag

SEQ ID NO: 1712 - DNA, 16 bp, H. sapiens
aaaaatgttaaaacag

SEQ ID NO: 1713 - DNA, 16 bp, H. sapiens
aaaaatgttaaaatct

SEQ ID NO: 1714 - DNA, 16 bp, H. sapiens
aaaaatgttaaacata

SEQ ID NO: 1715 - DNA, 16 bp, H. sapiens
aaaaatgttaaatgga

SEQ ID NO: 1716 - DNA, 16 bp, H. sapiens
aaaaatgttaacatta

SEQ ID NO: 1717 - DNA, 16 bp, H. sapiens
aaaaatgttaggaaat

SEQ ID NO: 1718 - DNA, 16 bp, H. sapiens
aaaaatgttatcattt

SEQ ID NO: 1719 - DNA, 16 bp, H. sapiens
aaaaatgttatcttgt

SEQ ID NO: 1720 - DNA, 16 bp, H. sapiens
aaaaatgttatgtttt

SEQ ID NO: 1721 - DNA, 16 bp, H. sapiens
aaaaatgttcaaataa

SEQ ID NO: 1722 - DNA, 16 bp, H. sapiens
aaaaatgttcataaca

SEQ ID NO: 1723 - DNA, 16 bp, H. sapiens
aaaaatgttcatttct

SEQ ID NO: 1724 - DNA, 16 bp, H. sapiens
aaaaatgttctaatat

SEQ ID NO: 1725 - DNA, 16 bp, H. sapiens
aaaaatgttctatatt

SEQ ID NO: 1726 - DNA, 16 bp, H. sapiens
aaaaatgttctttaaa

SEQ ID NO: 1727 - DNA, 16 bp, H. sapiens
aaaaatgttgaatttt

SEQ ID NO: 1728 - DNA, 16 bp, H. sapiens
aaaaatgttgtataat

SEQ ID NO: 1729 - DNA, 16 bp, H. sapiens
aaaaatgtttaacata

SEQ ID NO: 1730 - DNA, 16 bp, H. sapiens
aaaaatgtttactaaa

SEQ ID NO: 1731 - DNA, 16 bp, H. sapiens
aaaaatgtttccagat

SEQ ID NO: 1732 - DNA, 16 bp, H. sapiens
aaaaatgtttcctttt

SEQ ID NO: 1733 - DNA, 16 bp, H. sapiens
aaaaatgtttctaata

SEQ ID NO: 1734 - DNA, 16 bp, H. sapiens
aaaaatgttttaaatg

SEQ ID NO: 1735 - DNA, 16 bp, H. sapiens
aaaaatgttttcaaga

SEQ ID NO: 1736 - DNA, 16 bp, H. sapiens
aaaaatgttttcactg

SEQ ID NO: 1737 - DNA, 16 bp, H. sapiens
aaaaatgttttcagat

SEQ ID NO: 1738 - DNA, 16 bp, H. sapiens
aaaaatgttttctatt

SEQ ID NO: 1739 - DNA, 16 bp, H. sapiens
aaaaatgttttctcca

SEQ ID NO: 1740 - DNA, 16 bp, H. sapiens
aaaaatgttttctttc

SEQ ID NO: 1741 - DNA, 16 bp, H. sapiens
aaaaatgttttctttt

SEQ ID NO: 1742 - DNA, 16 bp, H. sapiens
aaaaatgttttgaaag

SEQ ID NO: 1743 - DNA, 16 bp, H. sapiens
aaaaatgtttttcaga

SEQ ID NO: 1744 - DNA, 16 bp, H. sapiens
aaaaatgtttttccaa

SEQ ID NO: 1745 - DNA, 16 bp, H. sapiens
aaaaatgtttttctaa

SEQ ID NO: 1746 - DNA, 16 bp, H. sapiens
aaaaatgttttttgaa

SEQ ID NO: 1747 - DNA, 16 bp, H. sapiens
aaaaatgttttttgag

SEQ ID NO: 1748 - DNA, 16 bp, H. sapiens
aaaaattaaaaagcct

SEQ ID NO: 1749 - DNA, 16 bp, H. sapiens
aaaaattaaaagcttg

SEQ ID NO: 1750 - DNA, 16 bp, H. sapiens
aaaaattaaacatgca

SEQ ID NO: 1751 - DNA, 16 bp, H. sapiens
aaaaattaaactcttt

SEQ ID NO: 1752 - DNA, 16 bp, H. sapiens
aaaaattaaagacatg

SEQ ID NO: 1753 - DNA, 16 bp, H. sapiens
aaaaattaaagaccta

SEQ ID NO: 1754 - DNA, 16 bp, H. sapiens
aaaaattaaagcaatt

SEQ ID NO: 1755 - DNA, 16 bp, H. sapiens
aaaaattaacattgat

SEQ ID NO: 1756 - DNA, 16 bp, H. sapiens
aaaaattaacattttc

SEQ ID NO: 1757 - DNA, 16 bp, H. sapiens
aaaaattaaccagatg

SEQ ID NO: 1758 - DNA, 16 bp, H. sapiens
aaaaattaaccaggta

SEQ ID NO: 1759 - DNA, 16 bp, H. sapiens
aaaaattaactcatga

SEQ ID NO: 1760 - DNA, 16 bp, H. sapiens
aaaaattaagtgagat

SEQ ID NO: 1761 - DNA, 16 bp, H. sapiens
aaaaattaatagcaat

SEQ ID NO: 1762 - DNA, 16 bp, H. sapiens
aaaaattaatcaagtt

SEQ ID NO: 1763 - DNA, 16 bp, H. sapiens
aaaaattaatcaggtg

SEQ ID NO: 1764 - DNA, 16 bp, H. sapiens
aaaaattaatccaaga

SEQ ID NO: 1765 - DNA, 16 bp, H. sapiens
aaaaattaatgtcaaa

SEQ ID NO: 1766 - DNA, 16 bp, H. sapiens
aaaaattacaagcatt

SEQ ID NO: 1767 - DNA, 16 bp, H. sapiens
aaaaattacagaatat

SEQ ID NO: 1768 - DNA, 16 bp, H. sapiens
aaaaattacatgtaat

SEQ ID NO: 1769 - DNA, 16 bp, H. sapiens
aaaaattactggaaaa

SEQ ID NO: 1770 - DNA, 16 bp, H. sapiens
aaaaattacttcaaga

SEQ ID NO: 1771 - DNA, 16 bp, H. sapiens
aaaaattacttgaaaa

SEQ ID NO: 1772 - DNA, 16 bp, H. sapiens
aaaaattagagcagaa

SEQ ID NO: 1773 - DNA, 16 bp, H. sapiens
aaaaattagataactt

SEQ ID NO: 1774 - DNA, 16 bp, H. sapiens
aaaaattagccaagtt

SEQ ID NO: 1775 - DNA, 19 bp, H. sapiens
aaaaattagccaggtgtgt

SEQ ID NO: 1776 - DNA, 16 bp, H. sapiens
aaaaattagccagtat

SEQ ID NO: 1777 - DNA, 16 bp, H. sapiens
aaaaattagccggtca

SEQ ID NO: 1778 - DNA, 17 bp, H. sapiens
aaaaattagcctggcgc

SEQ ID NO: 1779 - DNA, 16 bp, H. sapiens
aaaaattagctaatca

SEQ ID NO: 1780 - DNA, 16 bp, H. sapiens
aaaaattaggcatggt

SEQ ID NO: 1781 - DNA, 16 bp, H. sapiens
aaaaattaggctgggc

SEQ ID NO: 1782 - DNA, 16 bp, H. sapiens
aaaaattagtattttc

SEQ ID NO: 1783 - DNA, 16 bp, H. sapiens
aaaaattatatgggca

SEQ ID NO: 1784 - DNA, 16 bp, H. sapiens
aaaaattatcccagca

SEQ ID NO: 1785 - DNA, 16 bp, H. sapiens
aaaaattatctgaaac

SEQ ID NO: 1786 - DNA, 16 bp, H. sapiens
aaaaattatgaaatac

SEQ ID NO: 1787 - DNA, 16 bp, H. sapiens
aaaaattatgaaatca

SEQ ID NO: 1788 - DNA, 16 bp, H. sapiens
aaaaattatgtgaatg

SEQ ID NO: 1789 - DNA, 16 bp, H. sapiens
aaaaattatgttcaaa

SEQ ID NO: 1790 - DNA, 16 bp, H. sapiens
aaaaattatgtttcag

SEQ ID NO: 1791 - DNA, 16 bp, H. sapiens
aaaaattatgttttct

SEQ ID NO: 1792 - DNA, 16 bp, H. sapiens
aaaaattattatctca

SEQ ID NO: 1793 - DNA, 16 bp, H. sapiens
aaaaattattcactgt

SEQ ID NO: 1794 - DNA, 16 bp, H. sapiens
aaaaattattctgaca

SEQ ID NO: 1795 - DNA, 16 bp, H. sapiens
aaaaattattggccag

SEQ ID NO: 1796 - DNA, 16 bp, H. sapiens
aaaaattattgtccct

SEQ ID NO: 1797 - DNA, 16 bp, H. sapiens
aaaaattatttcacat

SEQ ID NO: 1798 - DNA, 16 bp, H. sapiens
aaaaattatttcagaa

SEQ ID NO: 1799 - DNA, 16 bp, H. sapiens
aaaaattatttcagat

SEQ ID NO: 1800 - DNA, 16 bp, H. sapiens
aaaaattatttccaga

SEQ ID NO: 1801 - DNA, 16 bp, H. sapiens
aaaaattatttcttgt

SEQ ID NO: 1802 - DNA, 16 bp, H. sapiens
aaaaattatttgtaga

SEQ ID NO: 1803 - DNA, 16 bp, H. sapiens
aaaaattatttgttgt

SEQ ID NO: 1804 - DNA, 16 bp, H. sapiens
aaaaattattttccat

SEQ ID NO: 1805 - DNA, 16 bp, H. sapiens
aaaaattattttctca

SEQ ID NO: 1806 - DNA, 16 bp, H. sapiens
aaaaattattttctgt

SEQ ID NO: 1807 - DNA, 16 bp, H. sapiens
aaaaattcaaaaagtg

SEQ ID NO: 1808 - DNA, 16 bp, H. sapiens
aaaaattcaaaatgtt

SEQ ID NO: 1809 - DNA, 16 bp, H. sapiens
aaaaattcaaagcata

SEQ ID NO: 1810 - DNA, 16 bp, H. sapiens
aaaaattcaaatgtaa

SEQ ID NO: 1811 - DNA, 16 bp, H. sapiens
aaaaattcaagaaact

SEQ ID NO: 1812 - DNA, 16 bp, H. sapiens
aaaaattcaagaatta

SEQ ID NO: 1813 - DNA, 16 bp, H. sapiens
aaaaattcaatagagg

SEQ ID NO: 1814 - DNA, 16 bp, H. sapiens
aaaaattcacttattt

SEQ ID NO: 1815 - DNA, 16 bp, H. sapiens
aaaaattcacttttat

SEQ ID NO: 1816 - DNA, 16 bp, H. sapiens
aaaaattcagattaaa

SEQ ID NO: 1817 - DNA, 16 bp, H. sapiens
aaaaattcaggaaact

SEQ ID NO: 1818 - DNA, 16 bp, H. sapiens
aaaaattcaggaaatt

SEQ ID NO: 1819 - DNA, 16 bp, H. sapiens
aaaaattcagtattat

SEQ ID NO: 1820 - DNA, 16 bp, H. sapiens
aaaaattcatatgaaa

SEQ ID NO: 1821 - DNA, 16 bp, H. sapiens
aaaaattcatgatgaa

SEQ ID NO: 1822 - DNA, 16 bp, H. sapiens
aaaaattcatttttct

SEQ ID NO: 1823 - DNA, 16 bp, H. sapiens
aaaaattccaaatgaa

SEQ ID NO: 1824 - DNA, 16 bp, H. sapiens
aaaaattccagaagaa

SEQ ID NO: 1825 - DNA, 16 bp, H. sapiens
aaaaattccagaggaa

SEQ ID NO: 1826 - DNA, 16 bp, H. sapiens
aaaaattccatgttca

SEQ ID NO: 1827 - DNA, 16 bp, H. sapiens
aaaaattcctactgcc

SEQ ID NO: 1828 - DNA, 16 bp, H. sapiens
aaaaattcctgtcacc

SEQ ID NO: 1829 - DNA, 16 bp, H. sapiens
aaaaattctaaacttt

SEQ ID NO: 1830 - DNA, 16 bp, H. sapiens
aaaaattctacaagat

SEQ ID NO: 1831 - DNA, 16 bp, H. sapiens
aaaaattctacacttt

SEQ ID NO: 1832 - DNA, 16 bp, H. sapiens
aaaaattctgaaagaa

SEQ ID NO: 1833 - DNA, 16 bp, H. sapiens
aaaaattcttatcctg

SEQ ID NO: 1834 - DNA, 16 bp, H. sapiens
aaaaattcttcaaact

SEQ ID NO: 1835 - DNA, 16 bp, H. sapiens
aaaaattcttcagtga

SEQ ID NO: 1836 - DNA, 16 bp, H. sapiens
aaaaattcttgaaaca

SEQ ID NO: 1837 - DNA, 16 bp, H. sapiens
aaaaattgaaaaactg

SEQ ID NO: 1838 - DNA, 16 bp, H. sapiens
aaaaattgaaacattt

SEQ ID NO: 1839 - DNA, 16 bp, H. sapiens
aaaaattgaaagcaag

SEQ ID NO: 1840 - DNA, 16 bp, H. sapiens
aaaaattgaaatcata

SEQ ID NO: 1841 - DNA, 16 bp, H. sapiens
aaaaattgacaaaact

SEQ ID NO: 1842 - DNA, 16 bp, H. sapiens
aaaaattgacaaattg

SEQ ID NO: 1843 - DNA, 16 bp, H. sapiens
aaaaattgattcaaga

SEQ ID NO: 1844 - DNA, 16 bp, H. sapiens
aaaaattgcatcttta

SEQ ID NO: 1845 - DNA, 16 bp, H. sapiens
aaaaattgccaaaaat

SEQ ID NO: 1846 - DNA, 16 bp, H. sapiens
aaaaattgccaacaaa

SEQ ID NO: 1847 - DNA, 16 bp, H. sapiens
aaaaattgctgaaaat

SEQ ID NO: 1848 - DNA, 16 bp, H. sapiens
aaaaattgcttgaacc

SEQ ID NO: 1849 - DNA, 16 bp, H. sapiens
aaaaattgcttttttg

SEQ ID NO: 1850 - DNA, 16 bp, H. sapiens
aaaaattggaaacaac

SEQ ID NO: 1851 - DNA, 16 bp, H. sapiens
aaaaattggaaacaat

SEQ ID NO: 1852 - DNA, 16 bp, H. sapiens
aaaaattggaatattt

SEQ ID NO: 1853 - DNA, 16 bp, H. sapiens
aaaaattggaattatt

SEQ ID NO: 1854 - DNA, 16 bp, H. sapiens
aaaaattggccgggca

SEQ ID NO: 1855 - DNA, 16 bp, H. sapiens
aaaaattggctaggtg

SEQ ID NO: 1856 - DNA, 16 bp, H. sapiens
aaaaattgtaagttga

SEQ ID NO: 1857 - DNA, 16 bp, H. sapiens
aaaaattgtcaaatta

SEQ ID NO: 1858 - DNA, 16 bp, H. sapiens
aaaaattgtctaaaat

SEQ ID NO: 1859 - DNA, 16 bp, H. sapiens
aaaaattgtgtgactt

SEQ ID NO: 1860 - DNA, 16 bp, H. sapiens
aaaaattgttagtttt

SEQ ID NO: 1861 - DNA, 16 bp, H. sapiens
aaaaattgttcatttt

SEQ ID NO: 1862 - DNA, 16 bp, H. sapiens
aaaaattgtttacttt

SEQ ID NO: 1863 - DNA, 16 bp, H. sapiens
aaaaattgtttccaaa

SEQ ID NO: 1864 - DNA, 16 bp, H. sapiens
aaaaattgtttctaaa

SEQ ID NO: 1865 - DNA, 16 bp, H. sapiens
aaaaattgttttaaac

SEQ ID NO: 1866 - DNA, 16 bp, H. sapiens
aaaaattgttttctgt

SEQ ID NO: 1867 - DNA, 16 bp, H. sapiens
aaaaattgttttgaaa

SEQ ID NO: 1868 - DNA, 16 bp, H. sapiens
aaaaattgttttttct

SEQ ID NO: 1869 - DNA, 16 bp, H. sapiens
aaaaatttaaactgaa

SEQ ID NO: 1870 - DNA, 16 bp, H. sapiens
aaaaatttaaactttc

SEQ ID NO: 1871 - DNA, 16 bp, H. sapiens
aaaaatttactgtaaa

SEQ ID NO: 1872 - DNA, 16 bp, H. sapiens
aaaaatttagccaggc

SEQ ID NO: 1873 - DNA, 16 bp, H. sapiens
aaaaatttatatgttg

SEQ ID NO: 1874 - DNA, 16 bp, H. sapiens
aaaaatttattcaaga

SEQ ID NO: 1875 - DNA, 16 bp, H. sapiens
aaaaatttattgaatg

SEQ ID NO: 1876 - DNA, 16 bp, H. sapiens
aaaaatttcaaatgtt

SEQ ID NO: 1877 - DNA, 16 bp, H. sapiens
aaaaatttcagaaaga

SEQ ID NO: 1878 - DNA, 16 bp, H. sapiens
aaaaatttcagatttt

SEQ ID NO: 1879 - DNA, 16 bp, H. sapiens
aaaaatttcaggccaa

SEQ ID NO: 1880 - DNA, 16 bp, H. sapiens
aaaaatttccaggaaa

SEQ ID NO: 1881 - DNA, 16 bp, H. sapiens
aaaaatttcttccaaa

SEQ ID NO: 1882 - DNA, 16 bp, H. sapiens
aaaaatttcttttgta

SEQ ID NO: 1883 - DNA, 16 bp, H. sapiens
aaaaatttgaaaacat

SEQ ID NO: 1884 - DNA, 16 bp, H. sapiens
aaaaatttgaaatgtt

SEQ ID NO: 1885 - DNA, 16 bp, H. sapiens
aaaaatttgaagagga

SEQ ID NO: 1886 - DNA, 16 bp, H. sapiens
aaaaatttgagaagga

SEQ ID NO: 1887 - DNA, 16 bp, H. sapiens
aaaaatttgcaaaaca

SEQ ID NO: 1888 - DNA, 16 bp, H. sapiens
aaaaatttgcaaacta

SEQ ID NO: 1889 - DNA, 16 bp, H. sapiens
aaaaatttgcatctgt

SEQ ID NO: 1890 - DNA, 16 bp, H. sapiens
aaaaatttgcctttac

SEQ ID NO: 1891 - DNA, 16 bp, H. sapiens
aaaaatttgttaaagt

SEQ ID NO: 1892 - DNA, 16 bp, H. sapiens
aaaaatttgttttctt

SEQ ID NO: 1893 - DNA, 16 bp, H. sapiens
aaaaatttgtttttca

SEQ ID NO: 1894 - DNA, 16 bp, H. sapiens
aaaaattttaatcact

SEQ ID NO: 1895 - DNA, 16 bp, H. sapiens
aaaaattttactttct

SEQ ID NO: 1896 - DNA, 16 bp, H. sapiens
aaaaattttcctttta

SEQ ID NO: 1897 - DNA, 16 bp, H. sapiens
aaaaattttgcaaact

SEQ ID NO: 1898 - DNA, 16 bp, H. sapiens
aaaaattttgtagaga

SEQ ID NO: 1899 - DNA, 16 bp, H. sapiens
aaaaatttttaagtga

SEQ ID NO: 1900 - DNA, 16 bp, H. sapiens
aaaaatttttcagaaa

SEQ ID NO: 1901 - DNA, 16 bp, H. sapiens
aaaaatttttctgaaa

SEQ ID NO: 1902 - DNA, 16 bp, H. sapiens
aaaaatttttggagat

SEQ ID NO: 1903 - DNA, 16 bp, H. sapiens
aaaaatttttttagtg

SEQ ID NO: 1904 - DNA, 16 bp, H. sapiens
aaaaatttttttgcca

SEQ ID NO: 1905 - DNA, 16 bp, H. sapiens
aaaacaaaaaacctgt

SEQ ID NO: 1906 - DNA, 16 bp, H. sapiens
aaaacaaaaaactgcc

SEQ ID NO: 1907 - DNA, 16 bp, H. sapiens
aaaacaaaaaacttgg

SEQ ID NO: 1908 - DNA, 16 bp, H. sapiens
aaaacaaaaacctatg

SEQ ID NO: 1909 - DNA, 16 bp, H. sapiens
aaaacaaaaacctgga

SEQ ID NO: 1910 - DNA, 16 bp, H. sapiens
aaaacaaaaagatctt

SEQ ID NO: 1911 - DNA, 16 bp, H. sapiens
aaaacaaaaagcactt

SEQ ID NO: 1912 - DNA, 16 bp, H. sapiens
aaaacaaaaagttgtt

SEQ ID NO: 1913 - DNA, 16 bp, H. sapiens
aaaacaaaaatattgt

SEQ ID NO: 1914 - DNA, 16 bp, H. sapiens
aaaacaaaaatgcttt

SEQ ID NO: 1915 - DNA, 16 bp, H. sapiens
aaaacaaaaatgttca

SEQ ID NO: 1916 - DNA, 16 bp, H. sapiens
aaaacaaaacagtttt

SEQ ID NO: 1917 - DNA, 16 bp, H. sapiens
aaaacaaaacatgatt

SEQ ID NO: 1918 - DNA, 16 bp, H. sapiens
aaaacaaaaccacttt

SEQ ID NO: 1919 - DNA, 16 bp, H. sapiens
aaaacaaaacctgttt

SEQ ID NO: 1920 - DNA, 16 bp, H. sapiens
aaaacaaaactggaat

SEQ ID NO: 1921 - DNA, 16 bp, H. sapiens
aaaacaaaacttttca

SEQ ID NO: 1922 - DNA, 16 bp, H. sapiens
aaaacaaaagatattt

SEQ ID NO: 1923 - DNA, 16 bp, H. sapiens
aaaacaaaagctattt

SEQ ID NO: 1924 - DNA, 16 bp, H. sapiens
aaaacaaaagtttaat

SEQ ID NO: 1925 - DNA, 16 bp, H. sapiens
aaaacaaaatatctga

SEQ ID NO: 1926 - DNA, 16 bp, H. sapiens
aaaacaaaatgaactt

SEQ ID NO: 1927 - DNA, 16 bp, H. sapiens
aaaacaaaatgcacag

SEQ ID NO: 1928 - DNA, 16 bp, H. sapiens
aaaacaaaatgcattt

SEQ ID NO: 1929 - DNA, 16 bp, H. sapiens
aaaacaaaatgttaca

SEQ ID NO: 1930 - DNA, 16 bp, H. sapiens
aaaacaaaattctgaa

SEQ ID NO: 1931 - DNA, 16 bp, H. sapiens
aaaacaaaattctgca

SEQ ID NO: 1932 - DNA, 16 bp, H. sapiens
aaaacaaacacatttt

SEQ ID NO: 1933 - DNA, 16 bp, H. sapiens
aaaacaaacactgcat

SEQ ID NO: 1934 - DNA, 16 bp, H. sapiens
aaaacaaagacattct

SEQ ID NO: 1935 - DNA, 16 bp, H. sapiens
aaaacaaagacatttt

SEQ ID NO: 1936 - DNA, 16 bp, H. sapiens
aaaacaaagctgaagg

SEQ ID NO: 1937 - DNA, 16 bp, H. sapiens
aaaacaaaggttaatg

SEQ ID NO: 1938 - DNA, 16 bp, H. sapiens
aaaacaaagtaaattt

SEQ ID NO: 1939 - DNA, 16 bp, H. sapiens
aaaacaaagtttgttt

SEQ ID NO: 1940 - DNA, 16 bp, H. sapiens
aaaacaaatactgaat

SEQ ID NO: 1941 - DNA, 16 bp, H. sapiens
aaaacaaatgaaattt

SEQ ID NO: 1942 - DNA, 16 bp, H. sapiens
aaaacaaatgaatttt

SEQ ID NO: 1943 - DNA, 16 bp, H. sapiens
aaaacaaatgatggca

SEQ ID NO: 1944 - DNA, 16 bp, H. sapiens
aaaacaaatgattttc

SEQ ID NO: 1945 - DNA, 16 bp, H. sapiens
aaaacaaatgattttt

SEQ ID NO: 1946 - DNA, 16 bp, H. sapiens
aaaacaaatgccacat

SEQ ID NO: 1947 - DNA, 16 bp, H. sapiens
aaaacaaatgttaaat

SEQ ID NO: 1948 - DNA, 16 bp, H. sapiens
aaaacaaatgttgaaa

SEQ ID NO: 1949 - DNA, 16 bp, H. sapiens
aaaacaaatgtttatt

SEQ ID NO: 1950 - DNA, 16 bp, H. sapiens
aaaacaaatgttttat

SEQ ID NO: 1951 - DNA, 16 bp, H. sapiens
aaaacaaattgtttaa

SEQ ID NO: 1952 - DNA, 16 bp, H. sapiens
aaaacaaatttaagat

SEQ ID NO: 1953 - DNA, 16 bp, H. sapiens
aaaacaaatttaattg

SEQ ID NO: 1954 - DNA, 16 bp, H. sapiens
aaaacaaatttccaca

SEQ ID NO: 1955 - DNA, 16 bp, H. sapiens
aaaacaaatttgtttt

SEQ ID NO: 1956 - DNA, 16 bp, H. sapiens
aaaacaacaatgagat

SEQ ID NO: 1957 - DNA, 16 bp, H. sapiens
aaaacaacagaaatgt

SEQ ID NO: 1958 - DNA, 16 bp, H. sapiens
aaaacaacagaaattt

SEQ ID NO: 1959 - DNA, 16 bp, H. sapiens
aaaacaacagatgtta

SEQ ID NO: 1960 - DNA, 16 bp, H. sapiens
aaaacaacatttatct

SEQ ID NO: 1961 - DNA, 16 bp, H. sapiens
aaaacaacattttttt

SEQ ID NO: 1962 - DNA, 16 bp, H. sapiens
aaaacaacccaaatgt

SEQ ID NO: 1963 - DNA, 16 bp, H. sapiens
aaaacaactatatttt

SEQ ID NO: 1964 - DNA, 16 bp, H. sapiens
aaaacaactttgtaaa

SEQ ID NO: 1965 - DNA, 16 bp, H. sapiens
aaaacaactttttttt

SEQ ID NO: 1966 - DNA, 16 bp, H. sapiens
aaaacaagaaaatgct

SEQ ID NO: 1967 - DNA, 16 bp, H. sapiens
aaaacaagacccagct

SEQ ID NO: 1968 - DNA, 16 bp, H. sapiens
aaaacaagataatttt

SEQ ID NO: 1969 - DNA, 16 bp, H. sapiens
aaaacaagattatttt

SEQ ID NO: 1970 - DNA, 16 bp, H. sapiens
aaaacaagcaatgtgg

SEQ ID NO: 1971 - DNA, 16 bp, H. sapiens
aaaacaagcattgggg

SEQ ID NO: 1972 - DNA, 17 bp, H. sapiens
aaaacaagctcagggct

SEQ ID NO: 1973 - DNA, 16 bp, H. sapiens
aaaacaagcttttaaa

SEQ ID NO: 1974 - DNA, 16 bp, H. sapiens
aaaacaaggacatttt

SEQ ID NO: 1975 - DNA, 16 bp, H. sapiens
aaaacaaggagaatga

SEQ ID NO: 1976 - DNA, 16 bp, H. sapiens
aaaacaaggtttttaa

SEQ ID NO: 1977 - DNA, 16 bp, H. sapiens
aaaacaagttctgaaa

SEQ ID NO: 1978 - DNA, 16 bp, H. sapiens
aaaacaagtttattaa

SEQ ID NO: 1979 - DNA, 16 bp, H. sapiens
aaaacaagttttaaca

SEQ ID NO: 1980 - DNA, 16 bp, H. sapiens
aaaacaagttttataa

SEQ ID NO: 1981 - DNA, 16 bp, H. sapiens
aaaacaagtttttttt

SEQ ID NO: 1982 - DNA, 16 bp, H. sapiens
aaaacaataatgatga

SEQ ID NO: 1983 - DNA, 16 bp, H. sapiens
aaaacaatacagattt

SEQ ID NO: 1984 - DNA, 16 bp, H. sapiens
aaaacaatactttttt

SEQ ID NO: 1985 - DNA, 16 bp, H. sapiens
aaaacaatatgaagat

SEQ ID NO: 1986 - DNA, 16 bp, H. sapiens
aaaacaatatgaatat

SEQ ID NO: 1987 - DNA, 16 bp, H. sapiens
aaaacaatatggaagt

SEQ ID NO: 1988 - DNA, 16 bp, H. sapiens
aaaacaatatttgaaa

SEQ ID NO: 1989 - DNA, 16 bp, H. sapiens
aaaacaatcttgaaca

SEQ ID NO: 1990 - DNA, 16 bp, H. sapiens
aaaacaatgagaatga

SEQ ID NO: 1991 - DNA, 16 bp, H. sapiens
aaaacaatgatttaaa

SEQ ID NO: 1992 - DNA, 16 bp, H. sapiens
aaaacaatgattttaa

SEQ ID NO: 1993 - DNA, 16 bp, H. sapiens
aaaacaatgcaaatat

SEQ ID NO: 1994 - DNA, 16 bp, H. sapiens
aaaacaatgcatattt

SEQ ID NO: 1995 - DNA, 16 bp, H. sapiens
aaaacaatggcaacaa

SEQ ID NO: 1996 - DNA, 16 bp, H. sapiens
aaaacaatgtttaaaa

SEQ ID NO: 1997 - DNA, 16 bp, H. sapiens
aaaacaatgtttctaa

SEQ ID NO: 1998 - DNA, 16 bp, H. sapiens
aaaacaatgttttaaa

SEQ ID NO: 1999 - DNA, 16 bp, H. sapiens
aaaacaattatgtaat

SEQ ID NO: 2000 - DNA, 16 bp, H. sapiens
aaaacaattatgtttt

SEQ ID NO: 2001 - DNA, 16 bp, H. sapiens
aaaacaattcagaaat

SEQ ID NO: 2002 - DNA, 16 bp, H. sapiens
aaaacaattcagaata

SEQ ID NO: 2003 - DNA, 16 bp, H. sapiens
aaaacaattccttttt

SEQ ID NO: 2004 - DNA, 16 bp, H. sapiens
aaaacaattgaactca

SEQ ID NO: 2005 - DNA, 16 bp, H. sapiens
aaaacaattgagctca

SEQ ID NO: 2006 - DNA, 16 bp, H. sapiens
aaaacaattgtaaaat

SEQ ID NO: 2007 - DNA, 16 bp, H. sapiens
aaaacaattgtttaaa

SEQ ID NO: 2008 - DNA, 16 bp, H. sapiens
aaaacaatttaaatgt

SEQ ID NO: 2009 - DNA, 16 bp, H. sapiens
aaaacaatttgaatga

SEQ ID NO: 2010 - DNA, 16 bp, H. sapiens
aaaacaatttgatttt

SEQ ID NO: 2011 - DNA, 16 bp, H. sapiens
aaaacaatttgcattt

SEQ ID NO: 2012 - DNA, 16 bp, H. sapiens
aaaacaattttaagaa

SEQ ID NO: 2013 - DNA, 16 bp, H. sapiens
aaaacaattttacttt

SEQ ID NO: 2014 - DNA, 16 bp, H. sapiens
aaaacaattttagaat

SEQ ID NO: 2015 - DNA, 16 bp, H. sapiens
aaaacaattttgataa

SEQ ID NO: 2016 - DNA, 16 bp, H. sapiens
aaaacaattttggaaa

SEQ ID NO: 2017 - DNA, 16 bp, H. sapiens
aaaacaatttttgttt

SEQ ID NO: 2018 - DNA, 16 bp, H. sapiens
aaaacacaaacatttt

SEQ ID NO: 2019 - DNA, 16 bp, H. sapiens
aaaacacaaagacatt

SEQ ID NO: 2020 - DNA, 16 bp, H. sapiens
aaaacacaaagctttt

SEQ ID NO: 2021 - DNA, 16 bp, H. sapiens
aaaacacaaatttgat

SEQ ID NO: 2022 - DNA, 16 bp, H. sapiens
aaaacacaatattttt

SEQ ID NO: 2023 - DNA, 16 bp, H. sapiens
aaaacacaatttattt

SEQ ID NO: 2024 - DNA, 16 bp, H. sapiens
aaaacacagaatattt

SEQ ID NO: 2025 - DNA, 16 bp, H. sapiens
aaaacacagattcctg

SEQ ID NO: 2026 - DNA, 16 bp, H. sapiens
aaaacacagtatctgc

SEQ ID NO: 2027 - DNA, 16 bp, H. sapiens
aaaacacataacattt

SEQ ID NO: 2028 - DNA, 16 bp, H. sapiens
aaaacacatggaagaa

SEQ ID NO: 2029 - DNA, 16 bp, H. sapiens
aaaacacatgtatttt

SEQ ID NO: 2030 - DNA, 16 bp, H. sapiens
aaaacacattgaagta

SEQ ID NO: 2031 - DNA, 16 bp, H. sapiens
aaaacacatttaattt

SEQ ID NO: 2032 - DNA, 16 bp, H. sapiens
aaaacacatttgtttt

SEQ ID NO: 2033 - DNA, 16 bp, H. sapiens
aaaacacattttaatg

SEQ ID NO: 2034 - DNA, 16 bp, H. sapiens
aaaacacattttcaga

SEQ ID NO: 2035 - DNA, 16 bp, H. sapiens
aaaacacattttcttc

SEQ ID NO: 2036 - DNA, 16 bp, H. sapiens
aaaacacatttttctt

SEQ ID NO: 2037 - DNA, 16 bp, H. sapiens
aaaacacatttttttt

SEQ ID NO: 2038 - DNA, 16 bp, H. sapiens
aaaacaccacacatct

SEQ ID NO: 2039 - DNA, 16 bp, H. sapiens
aaaacaccagacaaat

SEQ ID NO: 2040 - DNA, 16 bp, H. sapiens
aaaacaccctcacaga

SEQ ID NO: 2041 - DNA, 16 bp, H. sapiens
aaaacaccgtctctac

SEQ ID NO: 2042 - DNA, 16 bp, H. sapiens
aaaacacgaaaattag

SEQ ID NO: 2043 - DNA, 16 bp, H. sapiens
aaaacactactgaaaa

SEQ ID NO: 2044 - DNA, 16 bp, H. sapiens
aaaacactattatttt

SEQ ID NO: 2045 - DNA, 16 bp, H. sapiens
aaaacactgaaaaact

SEQ ID NO: 2046 - DNA, 16 bp, H. sapiens
aaaacactgcagaaag

SEQ ID NO: 2047 - DNA, 16 bp, H. sapiens
aaaacactgctcagag

SEQ ID NO: 2048 - DNA, 16 bp, H. sapiens
aaaacactgctgaaaa

SEQ ID NO: 2049 - DNA, 16 bp, H. sapiens
aaaacactgggaaaaa

SEQ ID NO: 2050 - DNA, 16 bp, H. sapiens
aaaacacttaggaaga

SEQ ID NO: 2051 - DNA, 16 bp, H. sapiens
aaaacacttctaaaat

SEQ ID NO: 2052 - DNA, 16 bp, H. sapiens
aaaacacttctttaaa

SEQ ID NO: 2053 - DNA, 16 bp, H. sapiens
aaaacacttgagaaaa

SEQ ID NO: 2054 - DNA, 16 bp, H. sapiens
aaaacactttgttttt

SEQ ID NO: 2055 - DNA, 16 bp, H. sapiens
aaaacacttttcaaaa

SEQ ID NO: 2056 - DNA, 16 bp, H. sapiens
aaaacactttttgaaa

SEQ ID NO: 2057 - DNA, 16 bp, H. sapiens
aaaacagaaaacctga

SEQ ID NO: 2058 - DNA, 16 bp, H. sapiens
aaaacagaaaatgttt

SEQ ID NO: 2059 - DNA, 16 bp, H. sapiens
aaaacagaaaatttca

SEQ ID NO: 2060 - DNA, 16 bp, H. sapiens
aaaacagaaactggac

SEQ ID NO: 2061 - DNA, 16 bp, H. sapiens
aaaacagaaagatatt

SEQ ID NO: 2062 - DNA, 16 bp, H. sapiens
aaaacagaaaggacat

SEQ ID NO: 2063 - DNA, 16 bp, H. sapiens
aaaacagaaatatgca

SEQ ID NO: 2064 - DNA, 16 bp, H. sapiens
aaaacagaaatgcctg

SEQ ID NO: 2065 - DNA, 16 bp, H. sapiens
aaaacagaacaattat

SEQ ID NO: 2066 - DNA, 16 bp, H. sapiens
aaaacagaactaccat

SEQ ID NO: 2067 - DNA, 16 bp, H. sapiens
aaaacagaactcttga

SEQ ID NO: 2068 - DNA, 16 bp, H. sapiens
aaaacagaactgccat

SEQ ID NO: 2069 - DNA, 16 bp, H. sapiens
aaaacagaaggaaatt

SEQ ID NO: 2070 - DNA, 16 bp, H. sapiens
aaaacagaataccaca

SEQ ID NO: 2071 - DNA, 16 bp, H. sapiens
aaaacagaatatttaa

SEQ ID NO: 2072 - DNA, 16 bp, H. sapiens
aaaacagaatctcttt

SEQ ID NO: 2073 - DNA, 16 bp, H. sapiens
aaaacagaattttcaa

SEQ ID NO: 2074 - DNA, 16 bp, H. sapiens
aaaacagacaaaattc

SEQ ID NO: 2075 - DNA, 16 bp, H. sapiens
aaaacagacaaaattt

SEQ ID NO: 2076 - DNA, 16 bp, H. sapiens
aaaacagacaaatcca

SEQ ID NO: 2077 - DNA, 16 bp, H. sapiens
aaaacagacacataga

SEQ ID NO: 2078 - DNA, 16 bp, H. sapiens
aaaacagacattaaac

SEQ ID NO: 2079 - DNA, 16 bp, H. sapiens
aaaacagaccttaaac

SEQ ID NO: 2080 - DNA, 16 bp, H. sapiens
aaaacagactcaagaa

SEQ ID NO: 2081 - DNA, 16 bp, H. sapiens
aaaacagacttgaaac

SEQ ID NO: 2082 - DNA, 16 bp, H. sapiens
aaaacagactttaaag

SEQ ID NO: 2083 - DNA, 16 bp, H. sapiens
aaaacagagatatgtg

SEQ ID NO: 2084 - DNA, 16 bp, H. sapiens
aaaacagagatcttaa

SEQ ID NO: 2085 - DNA, 16 bp, H. sapiens
aaaacagagcattaaa

SEQ ID NO: 2086 - DNA, 16 bp, H. sapiens
aaaacagagtgcctct

SEQ ID NO: 2087 - DNA, 16 bp, H. sapiens
aaaacagatatataga

SEQ ID NO: 2088 - DNA, 16 bp, H. sapiens
aaaacagatatatata

SEQ ID NO: 2089 - DNA, 16 bp, H. sapiens
aaaacagatcaaagac

SEQ ID NO: 2090 - DNA, 16 bp, H. sapiens
aaaacagatggaaaat

SEQ ID NO: 2091 - DNA, 16 bp, H. sapiens
aaaacagatgtataga

SEQ ID NO: 2092 - DNA, 16 bp, H. sapiens
aaaacagattaagaca

SEQ ID NO: 2093 - DNA, 16 bp, H. sapiens
aaaacagattattaaa

SEQ ID NO: 2094 - DNA, 16 bp, H. sapiens
aaaacagatttggaaa

SEQ ID NO: 2095 - DNA, 16 bp, H. sapiens
aaaacagattttggaa

SEQ ID NO: 2096 - DNA, 16 bp, H. sapiens
aaaacagcagcagcaa

SEQ ID NO: 2097 - DNA, 16 bp, H. sapiens
aaaacagcagcagcag

SEQ ID NO: 2098 - DNA, 16 bp, H. sapiens
aaaacagcatagtact

SEQ ID NO: 2099 - DNA, 16 bp, H. sapiens
aaaacagcatgatatt

SEQ ID NO: 2100 - DNA, 16 bp, H. sapiens
aaaacagcatggtact

SEQ ID NO: 2101 - DNA, 27 bp, H. sapiens
aaaacagcatggtactggtaccaaaat

SEQ ID NO: 2102 - DNA, 18 bp, H. sapiens
aaaacagcatggtactgt

SEQ ID NO: 2103 - DNA, 16 bp, H. sapiens
aaaacagcatgttgct

SEQ ID NO: 2104 - DNA, 16 bp, H. sapiens
aaaacagcatgttgta

SEQ ID NO: 2105 - DNA, 16 bp, H. sapiens
aaaacagcattaatct

SEQ ID NO: 2106 - DNA, 16 bp, H. sapiens
aaaacagccaggtgtg

SEQ ID NO: 2107 - DNA, 16 bp, H. sapiens
aaaacagccatttaaa

SEQ ID NO: 2108 - DNA, 16 bp, H. sapiens
aaaacagcctgcattg

SEQ ID NO: 2109 - DNA, 16 bp, H. sapiens
aaaacagctagaagag

SEQ ID NO: 2110 - DNA, 16 bp, H. sapiens
aaaacagctttcaaaa

SEQ ID NO: 2111 - DNA, 16 bp, H. sapiens
aaaacagctttgaaaa

SEQ ID NO: 2112 - DNA, 16 bp, H. sapiens
aaaacaggaaatcaat

SEQ ID NO: 2113 - DNA, 16 bp, H. sapiens
aaaacaggaactcaaa

SEQ ID NO: 2114 - DNA, 16 bp, H. sapiens
aaaacaggcaaaacta

SEQ ID NO: 2115 - DNA, 16 bp, H. sapiens
aaaacaggcaaatcca

SEQ ID NO: 2116 - DNA, 16 bp, H. sapiens
aaaacaggcatatgaa

SEQ ID NO: 2117 - DNA, 16 bp, H. sapiens
aaaacaggccctggtg

SEQ ID NO: 2118 - DNA, 16 bp, H. sapiens
aaaacaggctctgaaa

SEQ ID NO: 2119 - DNA, 16 bp, H. sapiens
aaaacagtaaaatatt

SEQ ID NO: 2120 - DNA, 16 bp, H. sapiens
aaaacagtaaaatgtg

SEQ ID NO: 2121 - DNA, 16 bp, H. sapiens
aaaacagtaacagcaa

SEQ ID NO: 2122 - DNA, 16 bp, H. sapiens
aaaacagtattagaaa

SEQ ID NO: 2123 - DNA, 16 bp, H. sapiens
aaaacagtcagaaaac

SEQ ID NO: 2124 - DNA, 16 bp, H. sapiens
aaaacagtcttgaatt

SEQ ID NO: 2125 - DNA, 16 bp, H. sapiens
aaaacagtgctgaaag

SEQ ID NO: 2126 - DNA, 16 bp, H. sapiens
aaaacagtgtggtaat

SEQ ID NO: 2127 - DNA, 16 bp, H. sapiens
aaaacagtgtggtggt

SEQ ID NO: 2128 - DNA, 16 bp, H. sapiens
aaaacagtgtgtagag

SEQ ID NO: 2129 - DNA, 16 bp, H. sapiens
aaaacagtgttaccaa

SEQ ID NO: 2130 - DNA, 16 bp, H. sapiens
aaaacagtgtttagag

SEQ ID NO: 2131 - DNA, 16 bp, H. sapiens
aaaacagtgtttcaaa

SEQ ID NO: 2132 - DNA, 16 bp, H. sapiens
aaaacagtgtttccag

SEQ ID NO: 2133 - DNA, 16 bp, H. sapiens
aaaacagtgtttgcaa

SEQ ID NO: 2134 - DNA, 16 bp, H. sapiens
aaaacagtgttttaaa

SEQ ID NO: 2135 - DNA, 16 bp, H. sapiens
aaaacagttatataga

SEQ ID NO: 2136 - DNA, 16 bp, H. sapiens
aaaacagttatttttc

SEQ ID NO: 2137 - DNA, 16 bp, H. sapiens
aaaacagtttaaaatt

SEQ ID NO: 2138 - DNA, 16 bp, H. sapiens
aaaacagtttcaaaaa

SEQ ID NO: 2139 - DNA, 16 bp, H. sapiens
aaaacagtttcatttt

SEQ ID NO: 2140 - DNA, 16 bp, H. sapiens
aaaacagtttgcagta

SEQ ID NO: 2141 - DNA, 16 bp, H. sapiens
aaaacagttttaaaaa

SEQ ID NO: 2142 - DNA, 16 bp, H. sapiens
aaaacagttttaaaag

SEQ ID NO: 2143 - DNA, 16 bp, H. sapiens
aaaacagttttgtttt

SEQ ID NO: 2144 - DNA, 16 bp, H. sapiens
aaaacagtttttgaaa

SEQ ID NO: 2145 - DNA, 16 bp, H. sapiens
aaaacagttttttcta

SEQ ID NO: 2146 - DNA, 16 bp, H. sapiens
aaaacataaatgttaa

SEQ ID NO: 2147 - DNA, 16 bp, H. sapiens
aaaacataattttcat

SEQ ID NO: 2148 - DNA, 16 bp, H. sapiens
aaaacatacaaatgga

SEQ ID NO: 2149 - DNA, 16 bp, H. sapiens
aaaacatagatttttt

SEQ ID NO: 2150 - DNA, 16 bp, H. sapiens
aaaacataggggaaaa

SEQ ID NO: 2151 - DNA, 16 bp, H. sapiens
aaaacatagtatacat

SEQ ID NO: 2152 - DNA, 16 bp, H. sapiens
aaaacatatatatgtt

SEQ ID NO: 2153 - DNA, 16 bp, H. sapiens
aaaacatatgtttaca

SEQ ID NO: 2154 - DNA, 16 bp, H. sapiens
aaaacatattcagaat

SEQ ID NO: 2155 - DNA, 16 bp, H. sapiens
aaaacatatttatctt

SEQ ID NO: 2156 - DNA, 16 bp, H. sapiens
aaaacatatttctttg

SEQ ID NO: 2157 - DNA, 16 bp, H. sapiens
aaaacatattttacat

SEQ ID NO: 2158 - DNA, 16 bp, H. sapiens
aaaacatcaaaaagtg

SEQ ID NO: 2159 - DNA, 16 bp, H. sapiens
aaaacatcaaacattt

SEQ ID NO: 2160 - DNA, 16 bp, H. sapiens
aaaacatcatattgta

SEQ ID NO: 2161 - DNA, 16 bp, H. sapiens
aaaacatcatgttgta

SEQ ID NO: 2162 - DNA, 16 bp, H. sapiens
aaaacatccagaaaag

SEQ ID NO: 2163 - DNA, 16 bp, H. sapiens
aaaacatccagaaaat

SEQ ID NO: 2164 - DNA, 16 bp, H. sapiens
aaaacatctgataaaa

SEQ ID NO: 2165 - DNA, 16 bp, H. sapiens
aaaacatctttatatt

SEQ ID NO: 2166 - DNA, 16 bp, H. sapiens
aaaacatctttcaaaa

SEQ ID NO: 2167 - DNA, 16 bp, H. sapiens
aaaacatgaaaattat

SEQ ID NO: 2168 - DNA, 16 bp, H. sapiens
aaaacatgaaatactt

SEQ ID NO: 2169 - DNA, 16 bp, H. sapiens
aaaacatgaaatattt

SEQ ID NO: 2170 - DNA, 16 bp, H. sapiens
aaaacatgaatttata

SEQ ID NO: 2171 - DNA, 16 bp, H. sapiens
aaaacatgacaaattg

SEQ ID NO: 2172 - DNA, 16 bp, H. sapiens
aaaacatgatccaact

SEQ ID NO: 2173 - DNA, 16 bp, H. sapiens
aaaacatgatgaaaat

SEQ ID NO: 2174 - DNA, 16 bp, H. sapiens
aaaacatgattttaaa

SEQ ID NO: 2175 - DNA, 16 bp, H. sapiens
aaaacatgcaaaatat

SEQ ID NO: 2176 - DNA, 16 bp, H. sapiens
aaaacatgctattttt

SEQ ID NO: 2177 - DNA, 23 bp, H. sapiens
aaaacatggagttgttcctttgg

SEQ ID NO: 2178 - DNA, 16 bp, H. sapiens
aaaacatggatgaacc

SEQ ID NO: 2179 - DNA, 16 bp, H. sapiens
aaaacatggccagact

SEQ ID NO: 2180 - DNA, 16 bp, H. sapiens
aaaacatggccgggcg

SEQ ID NO: 2181 - DNA, 16 bp, H. sapiens
aaaacatgggggaaaa

SEQ ID NO: 2182 - DNA, 16 bp, H. sapiens
aaaacatgtaaaaatt

SEQ ID NO: 2183 - DNA, 16 bp, H. sapiens
aaaacatgtaatattt

SEQ ID NO: 2184 - DNA, 16 bp, H. sapiens
aaaacatgtatttctt

SEQ ID NO: 2185 - DNA, 16 bp, H. sapiens
aaaacatgtcttcttt

SEQ ID NO: 2186 - DNA, 16 bp, H. sapiens
aaaacatgttaaaatt

SEQ ID NO: 2187 - DNA, 16 bp, H. sapiens
aaaacatgttatttta

SEQ ID NO: 2188 - DNA, 16 bp, H. sapiens
aaaacatgttgaattt

SEQ ID NO: 2189 - DNA, 16 bp, H. sapiens
aaaacatgtttaaata

SEQ ID NO: 2190 - DNA, 16 bp, H. sapiens
aaaacatgtttataaa

SEQ ID NO: 2191 - DNA, 16 bp, H. sapiens
aaaacatgtttattct

SEQ ID NO: 2192 - DNA, 16 bp, H. sapiens
aaaacatgtttgaaaa

SEQ ID NO: 2193 - DNA, 16 bp, H. sapiens
aaaacatgttttattt

SEQ ID NO: 2194 - DNA, 16 bp, H. sapiens
aaaacattaattttgt

SEQ ID NO: 2195 - DNA, 16 bp, H. sapiens
aaaacattacaggagc

SEQ ID NO: 2196 - DNA, 16 bp, H. sapiens
aaaacattacatgctc

SEQ ID NO: 2197 - DNA, 16 bp, H. sapiens
aaaacattactgagag

SEQ ID NO: 2198 - DNA, 16 bp, H. sapiens
aaaacattatgaaaat

SEQ ID NO: 2199 - DNA, 16 bp, H. sapiens
aaaacattatggaaat

SEQ ID NO: 2200 - DNA, 16 bp, H. sapiens
aaaacattatttacat

SEQ ID NO: 2201 - DNA, 16 bp, H. sapiens
aaaacattatttcatt

SEQ ID NO: 2202 - DNA, 16 bp, H. sapiens
aaaacattcatttatt

SEQ ID NO: 2203 - DNA, 21 bp, H. sapiens
aaaacattccatgctcatgga

SEQ ID NO: 2204 - DNA, 16 bp, H. sapiens
aaaacattctattata

SEQ ID NO: 2205 - DNA, 16 bp, H. sapiens
aaaacattcttctttt

SEQ ID NO: 2206 - DNA, 16 bp, H. sapiens
aaaacattcttgaaaa

SEQ ID NO: 2207 - DNA, 16 bp, H. sapiens
aaaacattcttttctt

SEQ ID NO: 2208 - DNA, 16 bp, H. sapiens
aaaacattgaattgta

SEQ ID NO: 2209 - DNA, 16 bp, H. sapiens
aaaacattgattttta

SEQ ID NO: 2210 - DNA, 16 bp, H. sapiens
aaaacattgcattaaa

SEQ ID NO: 2211 - DNA, 16 bp, H. sapiens
aaaacattgctgaaaa

SEQ ID NO: 2212 - DNA, 16 bp, H. sapiens
aaaacattgggaaaaa

SEQ ID NO: 2213 - DNA, 16 bp, H. sapiens
aaaacattgttaagaa

SEQ ID NO: 2214 - DNA, 16 bp, H. sapiens
aaaacatttacatatt

SEQ ID NO: 2215 - DNA, 16 bp, H. sapiens
aaaacatttatttttg

SEQ ID NO: 2216 - DNA, 16 bp, H. sapiens
aaaacatttcatccaa

SEQ ID NO: 2217 - DNA, 16 bp, H. sapiens
aaaacatttctatttt

SEQ ID NO: 2218 - DNA, 16 bp, H. sapiens
aaaacatttctgaaaa

SEQ ID NO: 2219 - DNA, 16 bp, H. sapiens
aaaacatttgaagaaa

SEQ ID NO: 2220 - DNA, 16 bp, H. sapiens
aaaacatttgacaaaa

SEQ ID NO: 2221 - DNA, 16 bp, H. sapiens
aaaacatttgattttt

SEQ ID NO: 2222 - DNA, 16 bp, H. sapiens
aaaacatttggaaaaa

SEQ ID NO: 2223 - DNA, 16 bp, H. sapiens
aaaacatttgtaatat

SEQ ID NO: 2224 - DNA, 16 bp, H. sapiens
aaaacatttgtttgaa

SEQ ID NO: 2225 - DNA, 16 bp, H. sapiens
aaaacatttgttttat

SEQ ID NO: 2226 - DNA, 16 bp, H. sapiens
aaaacattttaaagaa

SEQ ID NO: 2227 - DNA, 16 bp, H. sapiens
aaaacattttaacttt

SEQ ID NO: 2228 - DNA, 16 bp, H. sapiens
aaaacattttagaaat

SEQ ID NO: 2229 - DNA, 16 bp, H. sapiens
aaaacattttatgtat

SEQ ID NO: 2230 - DNA, 16 bp, H. sapiens
aaaacattttcaatat

SEQ ID NO: 2231 - DNA, 16 bp, H. sapiens
aaaacattttcatata

SEQ ID NO: 2232 - DNA, 16 bp, H. sapiens
aaaacattttcatctt

SEQ ID NO: 2233 - DNA, 16 bp, H. sapiens
aaaacattttcatttt

SEQ ID NO: 2234 - DNA, 16 bp, H. sapiens
aaaacattttctaatt

SEQ ID NO: 2235 - DNA, 16 bp, H. sapiens
aaaacattttctattt

SEQ ID NO: 2236 - DNA, 16 bp, H. sapiens
aaaacattttctcatt

SEQ ID NO: 2237 - DNA, 16 bp, H. sapiens
aaaacattttgaaaaa

SEQ ID NO: 2238 - DNA, 16 bp, H. sapiens
aaaacattttgaaaag

SEQ ID NO: 2239 - DNA, 16 bp, H. sapiens
aaaacattttgaattt

SEQ ID NO: 2240 - DNA, 16 bp, H. sapiens
aaaacattttgagaaa

SEQ ID NO: 2241 - DNA, 16 bp, H. sapiens
aaaacattttgatttt

SEQ ID NO: 2242 - DNA, 16 bp, H. sapiens
aaaacattttgtaatt

SEQ ID NO: 2243 - DNA, 16 bp, H. sapiens
aaaacattttgtagag

SEQ ID NO: 2244 - DNA, 16 bp, H. sapiens
aaaacattttgtgttt

SEQ ID NO: 2245 - DNA, 16 bp, H. sapiens
aaaacattttgttaaa

SEQ ID NO: 2246 - DNA, 16 bp, H. sapiens
aaaacatttttcaaag

SEQ ID NO: 2247 - DNA, 16 bp, H. sapiens
aaaacatttttctcaa

SEQ ID NO: 2248 - DNA, 16 bp, H. sapiens
aaaacatttttctgaa

SEQ ID NO: 2249 - DNA, 16 bp, H. sapiens
aaaacatttttcttct

SEQ ID NO: 2250 - DNA, 16 bp, H. sapiens
aaaacatttttgaaaa

SEQ ID NO: 2251 - DNA, 16 bp, H. sapiens
aaaacatttttgtcac

SEQ ID NO: 2252 - DNA, 16 bp, H. sapiens
aaaacatttttgtttt

SEQ ID NO: 2253 - DNA, 16 bp, H. sapiens
aaaacattttttcaaa

SEQ ID NO: 2254 - DNA, 16 bp, H. sapiens
aaaacatttttttcaa

SEQ ID NO: 2255 - DNA, 16 bp, H. sapiens
aaaaccaaaaatgtat

SEQ ID NO: 2256 - DNA, 16 bp, H. sapiens
aaaaccaaaagccttt

SEQ ID NO: 2257 - DNA, 26 bp, H. sapiens
aaaaccaaacactgcatattctcact

SEQ ID NO: 2258 - DNA, 16 bp, H. sapiens
aaaaccaaataccatg

SEQ ID NO: 2259 - DNA, 16 bp, H. sapiens
aaaaccaaatattcca

SEQ ID NO: 2260 - DNA, 16 bp, H. sapiens
aaaaccaaatattgca

SEQ ID NO: 2261 - DNA, 16 bp, H. sapiens
aaaaccaaattctgca

SEQ ID NO: 2262 - DNA, 16 bp, H. sapiens
aaaaccaagactcaga

SEQ ID NO: 2263 - DNA, 16 bp, H. sapiens
aaaaccaagatgatga

SEQ ID NO: 2264 - DNA, 16 bp, H. sapiens
aaaaccaagatggcta

SEQ ID NO: 2265 - DNA, 16 bp, H. sapiens
aaaaccaagtatcaca

SEQ ID NO: 2266 - DNA, 16 bp, H. sapiens
aaaaccaattgtattt

SEQ ID NO: 2267 - DNA, 16 bp, H. sapiens
aaaaccacaaatgaga

SEQ ID NO: 2268 - DNA, 16 bp, H. sapiens
aaaaccacaagagata

SEQ ID NO: 2269 - DNA, 16 bp, H. sapiens
aaaaccacaatgccat

SEQ ID NO: 2270 - DNA, 16 bp, H. sapiens
aaaaccacaatggcat

SEQ ID NO: 2271 - DNA, 16 bp, H. sapiens
aaaaccacagtgatat

SEQ ID NO: 2272 - DNA, 16 bp, H. sapiens
aaaaccacatgtttat

SEQ ID NO: 2273 - DNA, 16 bp, H. sapiens
aaaaccacattgagat

SEQ ID NO: 2274 - DNA, 16 bp, H. sapiens
aaaaccacattttaaa

SEQ ID NO: 2275 - DNA, 16 bp, H. sapiens
aaaaccaccattgtca

SEQ ID NO: 2276 - DNA, 16 bp, H. sapiens
aaaaccaccgaggcct

SEQ ID NO: 2277 - DNA, 16 bp, H. sapiens
aaaaccacctttgcaa

SEQ ID NO: 2278 - DNA, 16 bp, H. sapiens
aaaaccactttaaatt

SEQ ID NO: 2279 - DNA, 16 bp, H. sapiens
aaaaccagaaaattta

SEQ ID NO: 2280 - DNA, 16 bp, H. sapiens
aaaaccagaaatacca

SEQ ID NO: 2281 - DNA, 16 bp, H. sapiens
aaaaccagagatgaaa

SEQ ID NO: 2282 - DNA, 16 bp, H. sapiens
aaaaccagagtgcccc

SEQ ID NO: 2283 - DNA, 16 bp, H. sapiens
aaaaccagataccaca

SEQ ID NO: 2284 - DNA, 21 bp, H. sapiens
aaaaccagcaagtttttatta

SEQ ID NO: 2285 - DNA, 16 bp, H. sapiens
aaaaccagcaggtttt

SEQ ID NO: 2286 - DNA, 16 bp, H. sapiens
aaaaccagctgggcat

SEQ ID NO: 2287 - DNA, 16 bp, H. sapiens
aaaaccaggaaattgg

SEQ ID NO: 2288 - DNA, 16 bp, H. sapiens
aaaaccaggccaggtg

SEQ ID NO: 2289 - DNA, 16 bp, H. sapiens
aaaaccagggaagcca

SEQ ID NO: 2290 - DNA, 16 bp, H. sapiens
aaaaccaggtcctgga

SEQ ID NO: 2291 - DNA, 16 bp, H. sapiens
aaaaccatctatgaca

SEQ ID NO: 2292 - DNA, 16 bp, H. sapiens
aaaaccatctctacaa

SEQ ID NO: 2293 - DNA, 16 bp, H. sapiens
aaaaccatcttttaaa

SEQ ID NO: 2294 - DNA, 16 bp, H. sapiens
aaaaccatgaaaatga

SEQ ID NO: 2295 - DNA, 16 bp, H. sapiens
aaaaccatgagaaata

SEQ ID NO: 2296 - DNA, 16 bp, H. sapiens
aaaaccatgagatatc

SEQ ID NO: 2297 - DNA, 16 bp, H. sapiens
aaaaccatgggaaaag

SEQ ID NO: 2298 - DNA, 16 bp, H. sapiens
aaaaccattctaaaat

SEQ ID NO: 2299 - DNA, 16 bp, H. sapiens
aaaaccattgaattgt

SEQ ID NO: 2300 - DNA, 16 bp, H. sapiens
aaaaccatttcttttt

SEQ ID NO: 2301 - DNA, 16 bp, H. sapiens
aaaaccatttggcagt

SEQ ID NO: 2302 - DNA, 16 bp, H. sapiens
aaaaccatttgttgaa

SEQ ID NO: 2303 - DNA, 16 bp, H. sapiens
aaaaccattttatttt

SEQ ID NO: 2304 - DNA, 16 bp, H. sapiens
aaaaccattttttcct

SEQ ID NO: 2305 - DNA, 16 bp, H. sapiens
aaaacccaaaaacttt

SEQ ID NO: 2306 - DNA, 16 bp, H. sapiens
aaaacccaaaactatg

SEQ ID NO: 2307 - DNA, 16 bp, H. sapiens
aaaacccagcagagca

SEQ ID NO: 2308 - DNA, 16 bp, H. sapiens
aaaacccaggaggtgg

SEQ ID NO: 2309 - DNA, 16 bp, H. sapiens
aaaacccatctataca

SEQ ID NO: 2310 - DNA, 16 bp, H. sapiens
aaaacccatctgtaca

SEQ ID NO: 2311 - DNA, 16 bp, H. sapiens
aaaacccatgcagaca

SEQ ID NO: 2312 - DNA, 16 bp, H. sapiens
aaaacccattttcttg

SEQ ID NO: 2313 - DNA, 16 bp, H. sapiens
aaaaccccacagctcc

SEQ ID NO: 2314 - DNA, 16 bp, H. sapiens
aaaaccccactgtctc

SEQ ID NO: 2315 - DNA, 22 bp, H. sapiens
aaaaccccatctctactaaaac

SEQ ID NO: 2316 - DNA, 16 bp, H. sapiens
aaaaccccatctttac

SEQ ID NO: 2317 - DNA, 16 bp, H. sapiens
aaaaccccgtctctat

SEQ ID NO: 2318 - DNA, 16 bp, H. sapiens
aaaaccccgttgtctc

SEQ ID NO: 2319 - DNA, 16 bp, H. sapiens
aaaaccctaaaaattc

SEQ ID NO: 2320 - DNA, 16 bp, H. sapiens
aaaaccctatccaaag

SEQ ID NO: 2321 - DNA, 16 bp, H. sapiens
aaaaccctatttccaa

SEQ ID NO: 2322 - DNA, 16 bp, H. sapiens
aaaaccctcagcaaaa

SEQ ID NO: 2323 - DNA, 16 bp, H. sapiens
aaaaccctgaagactc

SEQ ID NO: 2324 - DNA, 16 bp, H. sapiens
aaaaccctgtctccaa

SEQ ID NO: 2325 - DNA, 19 bp, H. sapiens
aaaaccctgtctctactga

SEQ ID NO: 2326 - DNA, 16 bp, H. sapiens
aaaaccctgtctctat

SEQ ID NO: 2327 - DNA, 16 bp, H. sapiens
aaaacccttctagaca

SEQ ID NO: 2328 - DNA, 16 bp, H. sapiens
aaaacctaccaagcaa

SEQ ID NO: 2329 - DNA, 16 bp, H. sapiens
aaaacctagaaatgat

SEQ ID NO: 2330 - DNA, 16 bp, H. sapiens
aaaacctagaagaaat

SEQ ID NO: 2331 - DNA, 16 bp, H. sapiens
aaaacctagaggaaaa

SEQ ID NO: 2332 - DNA, 16 bp, H. sapiens
aaaacctagcagaaga

SEQ ID NO: 2333 - DNA, 16 bp, H. sapiens
aaaacctagtatttga

SEQ ID NO: 2334 - DNA, 17 bp, H. sapiens
aaaacctatcagattaa

SEQ ID NO: 2335 - DNA, 16 bp, H. sapiens
aaaacctattgaaata

SEQ ID NO: 2336 - DNA, 16 bp, H. sapiens
aaaacctcatctctac

SEQ ID NO: 2337 - DNA, 16 bp, H. sapiens
aaaacctcatctctat

SEQ ID NO: 2338 - DNA, 16 bp, H. sapiens
aaaacctcatttctac

SEQ ID NO: 2339 - DNA, 16 bp, H. sapiens
aaaacctctgagaact

SEQ ID NO: 2340 - DNA, 16 bp, H. sapiens
aaaacctctttaaaaa

SEQ ID NO: 2341 - DNA, 16 bp, H. sapiens
aaaacctctttccttt

SEQ ID NO: 2342 - DNA, 16 bp, H. sapiens
aaaacctgaaaacata

SEQ ID NO: 2343 - DNA, 16 bp, H. sapiens
aaaacctggaagacaa

SEQ ID NO: 2344 - DNA, 16 bp, H. sapiens
aaaacctggcagagat

SEQ ID NO: 2345 - DNA, 16 bp, H. sapiens
aaaacctgttagaact

SEQ ID NO: 2346 - DNA, 16 bp, H. sapiens
aaaacctgttcaggca

SEQ ID NO: 2347 - DNA, 16 bp, H. sapiens
aaaaccttaaaactga

SEQ ID NO: 2348 - DNA, 16 bp, H. sapiens
aaaaccttactgagga

SEQ ID NO: 2349 - DNA, 16 bp, H. sapiens
aaaaccttatttacaa

SEQ ID NO: 2350 - DNA, 16 bp, H. sapiens
aaaaccttatttttat

SEQ ID NO: 2351 - DNA, 16 bp, H. sapiens
aaaaccttcccactcc

SEQ ID NO: 2352 - DNA, 16 bp, H. sapiens
aaaaccttgaaaaaag

SEQ ID NO: 2353 - DNA, 16 bp, H. sapiens
aaaaccttgaaaaata

SEQ ID NO: 2354 - DNA, 16 bp, H. sapiens
aaaaccttgaagaaat

SEQ ID NO: 2355 - DNA, 16 bp, H. sapiens
aaaacctttaaatttt

SEQ ID NO: 2356 - DNA, 16 bp, H. sapiens
aaaacctttattcttt

SEQ ID NO: 2357 - DNA, 16 bp, H. sapiens
aaaacctttgaagagg

SEQ ID NO: 2358 - DNA, 16 bp, H. sapiens
aaaaccttttaaaatt

SEQ ID NO: 2359 - DNA, 16 bp, H. sapiens
aaaaccttttcagaaa

SEQ ID NO: 2360 - DNA, 16 bp, H. sapiens
aaaacgtggccagact

SEQ ID NO: 2361 - DNA, 16 bp, H. sapiens
aaaactaaaagttggt

SEQ ID NO: 2362 - DNA, 16 bp, H. sapiens
aaaactaaaatgcaga

SEQ ID NO: 2363 - DNA, 16 bp, H. sapiens
aaaactaaacatgcaa

SEQ ID NO: 2364 - DNA, 16 bp, H. sapiens
aaaactaaactatttt

SEQ ID NO: 2365 - DNA, 16 bp, H. sapiens
aaaactaaagaaattt

SEQ ID NO: 2366 - DNA, 16 bp, H. sapiens
aaaactaaagtttaaa

SEQ ID NO: 2367 - DNA, 16 bp, H. sapiens
aaaactaacaattttt

SEQ ID NO: 2368 - DNA, 16 bp, H. sapiens
aaaactaactcaagaa

SEQ ID NO: 2369 - DNA, 16 bp, H. sapiens
aaaactaagctgtgct

SEQ ID NO: 2370 - DNA, 16 bp, H. sapiens
aaaactaataaaagct

SEQ ID NO: 2371 - DNA, 16 bp, H. sapiens
aaaactaatcatgcct

SEQ ID NO: 2372 - DNA, 16 bp, H. sapiens
aaaactacaaaacttc

SEQ ID NO: 2373 - DNA, 16 bp, H. sapiens
aaaactacaagaatta

SEQ ID NO: 2374 - DNA, 16 bp, H. sapiens
aaaactacaatgtgat

SEQ ID NO: 2375 - DNA, 16 bp, H. sapiens
aaaactacagaaacag

SEQ ID NO: 2376 - DNA, 16 bp, H. sapiens
aaaactacagactgat

SEQ ID NO: 2377 - DNA, 16 bp, H. sapiens
aaaactacagatcaat

SEQ ID NO: 2378 - DNA, 16 bp, H. sapiens
aaaactacatattgga

SEQ ID NO: 2379 - DNA, 16 bp, H. sapiens
aaaactaccatcagag

SEQ ID NO: 2380 - DNA, 16 bp, H. sapiens
aaaactactttaaatg

SEQ ID NO: 2381 - DNA, 16 bp, H. sapiens
aaaactacttttattt

SEQ ID NO: 2382 - DNA, 16 bp, H. sapiens
aaaactagaaaaagct

SEQ ID NO: 2383 - DNA, 16 bp, H. sapiens
aaaactagaaaacttt

SEQ ID NO: 2384 - DNA, 16 bp, H. sapiens
aaaactagaaagaagg

SEQ ID NO: 2385 - DNA, 16 bp, H. sapiens
aaaactagaaataatc

SEQ ID NO: 2386 - DNA, 16 bp, H. sapiens
aaaactagaagaaatg

SEQ ID NO: 2387 - DNA, 16 bp, H. sapiens
aaaactagacagaaac

SEQ ID NO: 2388 - DNA, 16 bp, H. sapiens
aaaactagacagagaa

SEQ ID NO: 2389 - DNA, 16 bp, H. sapiens
aaaactagatttaaaa

SEQ ID NO: 2390 - DNA, 16 bp, H. sapiens
aaaactaggaagaagc

SEQ ID NO: 2391 - DNA, 16 bp, H. sapiens
aaaactataaagcatt

SEQ ID NO: 2392 - DNA, 16 bp, H. sapiens
aaaactatagtgacag

SEQ ID NO: 2393 - DNA, 16 bp, H. sapiens
aaaactatcattattt

SEQ ID NO: 2394 - DNA, 16 bp, H. sapiens
aaaactatctattggg

SEQ ID NO: 2395 - DNA, 16 bp, H. sapiens
aaaactatgaaaatta

SEQ ID NO: 2396 - DNA, 16 bp, H. sapiens
aaaactatggaaataa

SEQ ID NO: 2397 - DNA, 16 bp, H. sapiens
aaaactatgttaaaat

SEQ ID NO: 2398 - DNA, 16 bp, H. sapiens
aaaactattataactg

SEQ ID NO: 2399 - DNA, 16 bp, H. sapiens
aaaactatttgacaaa

SEQ ID NO: 2400 - DNA, 16 bp, H. sapiens
aaaactattttaagaa

SEQ ID NO: 2401 - DNA, 16 bp, H. sapiens
aaaactatttttcatt

SEQ ID NO: 2402 - DNA, 16 bp, H. sapiens
aaaactcaaaaagcca

SEQ ID NO: 2403 - DNA, 16 bp, H. sapiens
aaaactcaacagcaaa

SEQ ID NO: 2404 - DNA, 16 bp, H. sapiens
aaaactcaatagcaaa

SEQ ID NO: 2405 - DNA, 16 bp, H. sapiens
aaaactcacaatgttt

SEQ ID NO: 2406 - DNA, 16 bp, H. sapiens
aaaactcacagatgaa

SEQ ID NO: 2407 - DNA, 16 bp, H. sapiens
aaaactcactcactgt

SEQ ID NO: 2408 - DNA, 16 bp, H. sapiens
aaaactcagaaatgaa

SEQ ID NO: 2409 - DNA, 16 bp, H. sapiens
aaaactcaggcaaagg

SEQ ID NO: 2410 - DNA, 16 bp, H. sapiens
aaaactcaggctcaga

SEQ ID NO: 2411 - DNA, 16 bp, H. sapiens
aaaactcagttgtatg

SEQ ID NO: 2412 - DNA, 16 bp, H. sapiens
aaaactcatcaaaatg

SEQ ID NO: 2413 - DNA, 16 bp, H. sapiens
aaaactcatgttgaaa

SEQ ID NO: 2414 - DNA, 16 bp, H. sapiens
aaaactcattaaaaag

SEQ ID NO: 2415 - DNA, 16 bp, H. sapiens
aaaactcattttgttt

SEQ ID NO: 2416 - DNA, 16 bp, H. sapiens
aaaactccaaaaattg

SEQ ID NO: 2417 - DNA, 16 bp, H. sapiens
aaaactccatactgtt

SEQ ID NO: 2418 - DNA, 16 bp, H. sapiens
aaaactccatctctac

SEQ ID NO: 2419 - DNA, 16 bp, H. sapiens
aaaactcctacaactc

SEQ ID NO: 2420 - DNA, 16 bp, H. sapiens
aaaactcctcaatcaa

SEQ ID NO: 2421 - DNA, 16 bp, H. sapiens
aaaactccttaaaaat

SEQ ID NO: 2422 - DNA, 16 bp, H. sapiens
aaaactccttatctga

SEQ ID NO: 2423 - DNA, 16 bp, H. sapiens
aaaactctatttttat

SEQ ID NO: 2424 - DNA, 16 bp, H. sapiens
aaaactctcagaaaac

SEQ ID NO: 2425 - DNA, 16 bp, H. sapiens
aaaactctcttcctcc

SEQ ID NO: 2426 - DNA, 16 bp, H. sapiens
aaaactctgaaataaa

SEQ ID NO: 2427 - DNA, 16 bp, H. sapiens
aaaactctgtcaaaaa

SEQ ID NO: 2428 - DNA, 16 bp, H. sapiens
aaaactcttagaagaa

SEQ ID NO: 2429 - DNA, 16 bp, H. sapiens
aaaactctttcctttg

SEQ ID NO: 2430 - DNA, 16 bp, H. sapiens
aaaactctttcttttg

SEQ ID NO: 2431 - DNA, 16 bp, H. sapiens
aaaactgaaaacaacc

SEQ ID NO: 2432 - DNA, 16 bp, H. sapiens
aaaactgaaaaccttt

SEQ ID NO: 2433 - DNA, 16 bp, H. sapiens
aaaactgaaaactcta

SEQ ID NO: 2434 - DNA, 16 bp, H. sapiens
aaaactgaaaatcaat

SEQ ID NO: 2435 - DNA, 16 bp, H. sapiens
aaaactgaaactgaaa

SEQ ID NO: 2436 - DNA, 16 bp, H. sapiens
aaaactgaaactggaa

SEQ ID NO: 2437 - DNA, 16 bp, H. sapiens
aaaactgaaagaaacc

SEQ ID NO: 2438 - DNA, 16 bp, H. sapiens
aaaactgaaagcagaa

SEQ ID NO: 2439 - DNA, 16 bp, H. sapiens
aaaactgaaatatgaa

SEQ ID NO: 2440 - DNA, 16 bp, H. sapiens
aaaactgaaatgaaat

SEQ ID NO: 2441 - DNA, 16 bp, H. sapiens
aaaactgaaattgttt

SEQ ID NO: 2442 - DNA, 16 bp, H. sapiens
aaaactgaagaaaagt

SEQ ID NO: 2443 - DNA, 16 bp, H. sapiens
aaaactgaagaaattg

SEQ ID NO: 2444 - DNA, 16 bp, H. sapiens
aaaactgaagaatttt

SEQ ID NO: 2445 - DNA, 16 bp, H. sapiens
aaaactgaagacaaag

SEQ ID NO: 2446 - DNA, 16 bp, H. sapiens
aaaactgaagacattt

SEQ ID NO: 2447 - DNA, 16 bp, H. sapiens
aaaactgaagatagaa

SEQ ID NO: 2448 - DNA, 16 bp, H. sapiens
aaaactgaagcaagaa

SEQ ID NO: 2449 - DNA, 16 bp, H. sapiens
aaaactgaagctggac

SEQ ID NO: 2450 - DNA, 16 bp, H. sapiens
aaaactgaagtatttt

SEQ ID NO: 2451 - DNA, 16 bp, H. sapiens
aaaactgaagttcaga

SEQ ID NO: 2452 - DNA, 16 bp, H. sapiens
aaaactgaatattata

SEQ ID NO: 2453 - DNA, 16 bp, H. sapiens
aaaactgaatcaagaa

SEQ ID NO: 2454 - DNA, 16 bp, H. sapiens
aaaactgaattttaca

SEQ ID NO: 2455 - DNA, 16 bp, H. sapiens
aaaactgacatcttaa

SEQ ID NO: 2456 - DNA, 16 bp, H. sapiens
aaaactgacattttta

SEQ ID NO: 2457 - DNA, 16 bp, H. sapiens
aaaactgacttttttt

SEQ ID NO: 2458 - DNA, 16 bp, H. sapiens
aaaactgagaaacact

SEQ ID NO: 2459 - DNA, 16 bp, H. sapiens
aaaactgagaaattta

SEQ ID NO: 2460 - DNA, 16 bp, H. sapiens
aaaactgagacacaaa

SEQ ID NO: 2461 - DNA, 16 bp, H. sapiens
aaaactgagactcaga

SEQ ID NO: 2462 - DNA, 16 bp, H. sapiens
aaaactgagactgaga

SEQ ID NO: 2463 - DNA, 16 bp, H. sapiens
aaaactgagataattt

SEQ ID NO: 2464 - DNA, 16 bp, H. sapiens
aaaactgagatttgaa

SEQ ID NO: 2465 - DNA, 16 bp, H. sapiens
aaaactgaggcccaag

SEQ ID NO: 2466 - DNA, 16 bp, H. sapiens
aaaactgaggcccaga

SEQ ID NO: 2467 - DNA, 16 bp, H. sapiens
aaaactgaggctcaga

SEQ ID NO: 2468 - DNA, 16 bp, H. sapiens
aaaactgatagaacta

SEQ ID NO: 2469 - DNA, 16 bp, H. sapiens
aaaactgattatttta

SEQ ID NO: 2470 - DNA, 16 bp, H. sapiens
aaaactgatttaagaa

SEQ ID NO: 2471 - DNA, 16 bp, H. sapiens
aaaactgattttaaaa

SEQ ID NO: 2472 - DNA, 16 bp, H. sapiens
aaaactgcaaaaagag

SEQ ID NO: 2473 - DNA, 16 bp, H. sapiens
aaaactgcaaaatatt

SEQ ID NO: 2474 - DNA, 16 bp, H. sapiens
aaaactgcaaatattt

SEQ ID NO: 2475 - DNA, 20 bp, H. sapiens
aaaactgcaatgcctgcagc

SEQ ID NO: 2476 - DNA, 16 bp, H. sapiens
aaaactgcaattactt

SEQ ID NO: 2477 - DNA, 16 bp, H. sapiens
aaaactgcagagaaaa

SEQ ID NO: 2478 - DNA, 16 bp, H. sapiens
aaaactgcatcttttt

SEQ ID NO: 2479 - DNA, 16 bp, H. sapiens
aaaactgccttccaca

SEQ ID NO: 2480 - DNA, 16 bp, H. sapiens
aaaactgctattttga

SEQ ID NO: 2481 - DNA, 16 bp, H. sapiens
aaaactgctgaatcaa

SEQ ID NO: 2482 - DNA, 16 bp, H. sapiens
aaaactgctgggatta

SEQ ID NO: 2483 - DNA, 16 bp, H. sapiens
aaaactgcttttgctg

SEQ ID NO: 2484 - DNA, 16 bp, H. sapiens
aaaactggaaaacaac

SEQ ID NO: 2485 - DNA, 16 bp, H. sapiens
aaaactggaaaatgta

SEQ ID NO: 2486 - DNA, 16 bp, H. sapiens
aaaactggaaaccatc

SEQ ID NO: 2487 - DNA, 16 bp, H. sapiens
aaaactggaaatgacc

SEQ ID NO: 2488 - DNA, 16 bp, H. sapiens
aaaactggaaattaat

SEQ ID NO: 2489 - DNA, 16 bp, H. sapiens
aaaactggaagaagca

SEQ ID NO: 2490 - DNA, 16 bp, H. sapiens
aaaactggaagctttc

SEQ ID NO: 2491 - DNA, 16 bp, H. sapiens
aaaactggaattaaaa

SEQ ID NO: 2492 - DNA, 16 bp, H. sapiens
aaaactggacaaaaga

SEQ ID NO: 2493 - DNA, 16 bp, H. sapiens
aaaactggacaaaata

SEQ ID NO: 2494 - DNA, 16 bp, H. sapiens
aaaactggacaaagac

SEQ ID NO: 2495 - DNA, 16 bp, H. sapiens
aaaactggacagaagc

SEQ ID NO: 2496 - DNA, 16 bp, H. sapiens
aaaactggagaaaata

SEQ ID NO: 2497 - DNA, 16 bp, H. sapiens
aaaactggaggaaaaa

SEQ ID NO: 2498 - DNA, 16 bp, H. sapiens
aaaactggctagacat

SEQ ID NO: 2499 - DNA, 16 bp, H. sapiens
aaaactggctatccat

SEQ ID NO: 2500 - DNA, 16 bp, H. sapiens
aaaactgggcaaagga

SEQ ID NO: 2501 - DNA, 16 bp, H. sapiens
aaaactggggctcaga

SEQ ID NO: 2502 - DNA, 16 bp, H. sapiens
aaaactgggtgaagga

SEQ ID NO: 2503 - DNA, 16 bp, H. sapiens
aaaactggtaataaaa

SEQ ID NO: 2504 - DNA, 16 bp, H. sapiens
aaaactggttatttta

SEQ ID NO: 2505 - DNA, 16 bp, H. sapiens
aaaactggttttaaaa

SEQ ID NO: 2506 - DNA, 16 bp, H. sapiens
aaaactgtaaaataat

SEQ ID NO: 2507 - DNA, 16 bp, H. sapiens
aaaactgtaagataat

SEQ ID NO: 2508 - DNA, 16 bp, H. sapiens
aaaactgtaatttttt

SEQ ID NO: 2509 - DNA, 16 bp, H. sapiens
aaaactgtacagcatg

SEQ ID NO: 2510 - DNA, 16 bp, H. sapiens
aaaactgtataaaata

SEQ ID NO: 2511 - DNA, 16 bp, H. sapiens
aaaactgtatattttt

SEQ ID NO: 2512 - DNA, 16 bp, H. sapiens
aaaactgtattaaaat

SEQ ID NO: 2513 - DNA, 16 bp, H. sapiens
aaaactgtattttatt

SEQ ID NO: 2514 - DNA, 16 bp, H. sapiens
aaaactgtcaaaatca

SEQ ID NO: 2515 - DNA, 16 bp, H. sapiens
aaaactgtcaacaaat

SEQ ID NO: 2516 - DNA, 16 bp, H. sapiens
aaaactgtcacagcca

SEQ ID NO: 2517 - DNA, 16 bp, H. sapiens
aaaactgtcagaatca

SEQ ID NO: 2518 - DNA, 16 bp, H. sapiens
aaaactgtcatatttt

SEQ ID NO: 2519 - DNA, 16 bp, H. sapiens
aaaactgtctattttt

SEQ ID NO: 2520 - DNA, 16 bp, H. sapiens
aaaactgtcttaaaaa

SEQ ID NO: 2521 - DNA, 16 bp, H. sapiens
aaaactgtgaaaatat

SEQ ID NO: 2522 - DNA, 16 bp, H. sapiens
aaaactgtgaagaaaa

SEQ ID NO: 2523 - DNA, 16 bp, H. sapiens
aaaactgttaaaaata

SEQ ID NO: 2524 - DNA, 16 bp, H. sapiens
aaaactgttaaaatat

SEQ ID NO: 2525 - DNA, 16 bp, H. sapiens
aaaactgttataaaca

SEQ ID NO: 2526 - DNA, 16 bp, H. sapiens
aaaactgttgggtact

SEQ ID NO: 2527 - DNA, 16 bp, H. sapiens
aaaactgttttctttc

SEQ ID NO: 2528 - DNA, 16 bp, H. sapiens
aaaacttaaaaagtat

SEQ ID NO: 2529 - DNA, 16 bp, H. sapiens
aaaacttaaaatgtaa

SEQ ID NO: 2530 - DNA, 16 bp, H. sapiens
aaaacttaagtataat

SEQ ID NO: 2531 - DNA, 16 bp, H. sapiens
aaaacttacaacaaag

SEQ ID NO: 2532 - DNA, 16 bp, H. sapiens
aaaacttacatccaca

SEQ ID NO: 2533 - DNA, 16 bp, H. sapiens
aaaacttactacaaag

SEQ ID NO: 2534 - DNA, 16 bp, H. sapiens
aaaacttactgcaaag

SEQ ID NO: 2535 - DNA, 16 bp, H. sapiens
aaaacttacttttcat

SEQ ID NO: 2536 - DNA, 16 bp, H. sapiens
aaaacttactttttaa

SEQ ID NO: 2537 - DNA, 16 bp, H. sapiens
aaaacttagccaagtg

SEQ ID NO: 2538 - DNA, 16 bp, H. sapiens
aaaacttatttaaaga

SEQ ID NO: 2539 - DNA, 16 bp, H. sapiens
aaaacttatttttaca

SEQ ID NO: 2540 - DNA, 16 bp, H. sapiens
aaaacttatttttcat

SEQ ID NO: 2541 - DNA, 16 bp, H. sapiens
aaaacttcaatttttt

SEQ ID NO: 2542 - DNA, 16 bp, H. sapiens
aaaacttcacattaaa

SEQ ID NO: 2543 - DNA, 16 bp, H. sapiens
aaaacttcagaaaatt

SEQ ID NO: 2544 - DNA, 16 bp, H. sapiens
aaaacttcagagaaat

SEQ ID NO: 2545 - DNA, 16 bp, H. sapiens
aaaacttcagtttaaa

SEQ ID NO: 2546 - DNA, 16 bp, H. sapiens
aaaacttcattttcaa

SEQ ID NO: 2547 - DNA, 16 bp, H. sapiens
aaaacttccagcaaag

SEQ ID NO: 2548 - DNA, 16 bp, H. sapiens
aaaacttcccaagttt

SEQ ID NO: 2549 - DNA, 16 bp, H. sapiens
aaaacttcctaaattt

SEQ ID NO: 2550 - DNA, 16 bp, H. sapiens
aaaacttccttttaaa

SEQ ID NO: 2551 - DNA, 16 bp, H. sapiens
aaaacttctagaaata

SEQ ID NO: 2552 - DNA, 16 bp, H. sapiens
aaaacttctgattttt

SEQ ID NO: 2553 - DNA, 16 bp, H. sapiens
aaaacttctttcaaaa

SEQ ID NO: 2554 - DNA, 16 bp, H. sapiens
aaaacttctttttaat

SEQ ID NO: 2555 - DNA, 16 bp, H. sapiens
aaaacttgaaattatt

SEQ ID NO: 2556 - DNA, 16 bp, H. sapiens
aaaacttgaagaaaat

SEQ ID NO: 2557 - DNA, 16 bp, H. sapiens
aaaacttgctacaaag

SEQ ID NO: 2558 - DNA, 16 bp, H. sapiens
aaaacttgtttataaa

SEQ ID NO: 2559 - DNA, 16 bp, H. sapiens
aaaactttaaaaattg

SEQ ID NO: 2560 - DNA, 16 bp, H. sapiens
aaaactttaaaatgtt

SEQ ID NO: 2561 - DNA, 16 bp, H. sapiens
aaaactttactgaatt

SEQ ID NO: 2562 - DNA, 16 bp, H. sapiens
aaaactttatgaaata

SEQ ID NO: 2563 - DNA, 16 bp, H. sapiens
aaaactttatgacatt

SEQ ID NO: 2564 - DNA, 16 bp, H. sapiens
aaaactttatttgaaa

SEQ ID NO: 2565 - DNA, 16 bp, H. sapiens
aaaactttcaaaagtt

SEQ ID NO: 2566 - DNA, 16 bp, H. sapiens
aaaactttcaaaatct

SEQ ID NO: 2567 - DNA, 16 bp, H. sapiens
aaaactttcagaaaaa

SEQ ID NO: 2568 - DNA, 16 bp, H. sapiens
aaaactttctaaattt

SEQ ID NO: 2569 - DNA, 16 bp, H. sapiens
aaaactttctggaaag

SEQ ID NO: 2570 - DNA, 16 bp, H. sapiens
aaaactttgaaataat

SEQ ID NO: 2571 - DNA, 16 bp, H. sapiens
aaaactttgataaaat

SEQ ID NO: 2572 - DNA, 16 bp, H. sapiens
aaaactttgattaaat

SEQ ID NO: 2573 - DNA, 16 bp, H. sapiens
aaaactttgcagagaa

SEQ ID NO: 2574 - DNA, 16 bp, H. sapiens
aaaactttgctgaatt

SEQ ID NO: 2575 - DNA, 16 bp, H. sapiens
aaaactttgtaaaata

SEQ ID NO: 2576 - DNA, 16 bp, H. sapiens
aaaactttgttttcat

SEQ ID NO: 2577 - DNA, 16 bp, H. sapiens
aaaactttgttttctt

SEQ ID NO: 2578 - DNA, 16 bp, H. sapiens
aaaactttgtttttat

SEQ ID NO: 2579 - DNA, 16 bp, H. sapiens
aaaactttgtttttct

SEQ ID NO: 2580 - DNA, 16 bp, H. sapiens
aaaacttttaaaagaa

SEQ ID NO: 2581 - DNA, 16 bp, H. sapiens
aaaacttttaaatctt

SEQ ID NO: 2582 - DNA, 16 bp, H. sapiens
aaaacttttaaattca

SEQ ID NO: 2583 - DNA, 16 bp, H. sapiens
aaaacttttacctttt

SEQ ID NO: 2584 - DNA, 16 bp, H. sapiens
aaaacttttagaaaaa

SEQ ID NO: 2585 - DNA, 16 bp, H. sapiens
aaaacttttagaaatt

SEQ ID NO: 2586 - DNA, 16 bp, H. sapiens
aaaacttttattttga

SEQ ID NO: 2587 - DNA, 16 bp, H. sapiens
aaaacttttctcaaaa

SEQ ID NO: 2588 - DNA, 16 bp, H. sapiens
aaaacttttctgaaaa

SEQ ID NO: 2589 - DNA, 16 bp, H. sapiens
aaaacttttcttttga

SEQ ID NO: 2590 - DNA, 16 bp, H. sapiens
aaaacttttctttttc

SEQ ID NO: 2591 - DNA, 16 bp, H. sapiens
aaaacttttgaaattt

SEQ ID NO: 2592 - DNA, 16 bp, H. sapiens
aaaacttttgaatttt

SEQ ID NO: 2593 - DNA, 16 bp, H. sapiens
aaaacttttgcaatct

SEQ ID NO: 2594 - DNA, 16 bp, H. sapiens
aaaacttttgtttttt

SEQ ID NO: 2595 - DNA, 16 bp, H. sapiens
aaaactttttgaaaga

SEQ ID NO: 2596 - DNA, 16 bp, H. sapiens
aaaactttttgaagaa

SEQ ID NO: 2597 - DNA, 16 bp, H. sapiens
aaaactttttgtaaaa

SEQ ID NO: 2598 - DNA, 16 bp, H. sapiens
aaaacttttttaaaga

SEQ ID NO: 2599 - DNA, 16 bp, H. sapiens
aaaacttttttggaaa

SEQ ID NO: 2600 - DNA, 16 bp, H. sapiens
aaaacttttttgtaaa

SEQ ID NO: 2601 - DNA, 16 bp, H. sapiens
aaaacttttttgtttt

SEQ ID NO: 2602 - DNA, 16 bp, H. sapiens
aaaagaaaaaactttt

SEQ ID NO: 2603 - DNA, 16 bp, H. sapiens
aaaagaaaaaatgctt

SEQ ID NO: 2604 - DNA, 16 bp, H. sapiens
aaaagaaaaacattct

SEQ ID NO: 2605 - DNA, 16 bp, H. sapiens
aaaagaaaaaccttag

SEQ ID NO: 2606 - DNA, 16 bp, H. sapiens
aaaagaaaaactgttt

SEQ ID NO: 2607 - DNA, 16 bp, H. sapiens
aaaagaaaaacttcag

SEQ ID NO: 2608 - DNA, 16 bp, H. sapiens
aaaagaaaaagagtct

SEQ ID NO: 2609 - DNA, 16 bp, H. sapiens
aaaagaaaaagctgag

SEQ ID NO: 2610 - DNA, 16 bp, H. sapiens
aaaagaaaaagctgga

SEQ ID NO: 2611 - DNA, 16 bp, H. sapiens
aaaagaaaaaggcatt

SEQ ID NO: 2612 - DNA, 16 bp, H. sapiens
aaaagaaaaagttggt

SEQ ID NO: 2613 - DNA, 16 bp, H. sapiens
aaaagaaaaagtttgg

SEQ ID NO: 2614 - DNA, 16 bp, H. sapiens
aaaagaaaaatatctt

SEQ ID NO: 2615 - DNA, 16 bp, H. sapiens
aaaagaaaaatcattt

SEQ ID NO: 2616 - DNA, 16 bp, H. sapiens
aaaagaaaaatccatt

SEQ ID NO: 2617 - DNA, 16 bp, H. sapiens
aaaagaaaaatctgtt

SEQ ID NO: 2618 - DNA, 16 bp, H. sapiens
aaaagaaaaatctttt

SEQ ID NO: 2619 - DNA, 16 bp, H. sapiens
aaaagaaaaatgtctg

SEQ ID NO: 2620 - DNA, 16 bp, H. sapiens
aaaagaaaaatgttct

SEQ ID NO: 2621 - DNA, 16 bp, H. sapiens
aaaagaaaaattacct

SEQ ID NO: 2622 - DNA, 16 bp, H. sapiens
aaaagaaaaattcagc

SEQ ID NO: 2623 - DNA, 16 bp, H. sapiens
aaaagaaaaatttcca

SEQ ID NO: 2624 - DNA, 16 bp, H. sapiens
aaaagaaaacacagct

SEQ ID NO: 2625 - DNA, 16 bp, H. sapiens
aaaagaaaacataggt

SEQ ID NO: 2626 - DNA, 16 bp, H. sapiens
aaaagaaaacatcatt

SEQ ID NO: 2627 - DNA, 16 bp, H. sapiens
aaaagaaaacatcttt

SEQ ID NO: 2628 - DNA, 16 bp, H. sapiens
aaaagaaaacatgact

SEQ ID NO: 2629 - DNA, 16 bp, H. sapiens
aaaagaaaacatttat

SEQ ID NO: 2630 - DNA, 16 bp, H. sapiens
aaaagaaaacatttta

SEQ ID NO: 2631 - DNA, 16 bp, H. sapiens
aaaagaaaaccatttt

SEQ ID NO: 2632 - DNA, 16 bp, H. sapiens
aaaagaaaaccccatc

SEQ ID NO: 2633 - DNA, 16 bp, H. sapiens
aaaagaaaaccctgaa

SEQ ID NO: 2634 - DNA, 16 bp, H. sapiens
aaaagaaaacctacag

SEQ ID NO: 2635 - DNA, 16 bp, H. sapiens
aaaagaaaactccatt

SEQ ID NO: 2636 - DNA, 16 bp, H. sapiens
aaaagaaaactgaatt

SEQ ID NO: 2637 - DNA, 16 bp, H. sapiens
aaaagaaaactgctga

SEQ ID NO: 2638 - DNA, 16 bp, H. sapiens
aaaagaaaactgtgta

SEQ ID NO: 2639 - DNA, 16 bp, H. sapiens
aaaagaaaacttcaga

SEQ ID NO: 2640 - DNA, 16 bp, H. sapiens
aaaagaaaagaaggct

SEQ ID NO: 2641 - DNA, 16 bp, H. sapiens
aaaagaaaagatgctg

SEQ ID NO: 2642 - DNA, 16 bp, H. sapiens
aaaagaaaagatttca

SEQ ID NO: 2643 - DNA, 16 bp, H. sapiens
aaaagaaaagcatatt

SEQ ID NO: 2644 - DNA, 16 bp, H. sapiens
aaaagaaaagcatcca

SEQ ID NO: 2645 - DNA, 16 bp, H. sapiens
aaaagaaaaggtattt

SEQ ID NO: 2646 - DNA, 16 bp, H. sapiens
aaaagaaaaggtttta

SEQ ID NO: 2647 - DNA, 16 bp, H. sapiens
aaaagaaaagtcatat

SEQ ID NO: 2648 - DNA, 16 bp, H. sapiens
aaaagaaaagtctcaa

SEQ ID NO: 2649 - DNA, 16 bp, H. sapiens
aaaagaaaagtttcct

SEQ ID NO: 2650 - DNA, 16 bp, H. sapiens
aaaagaaaatactgca

SEQ ID NO: 2651 - DNA, 16 bp, H. sapiens
aaaagaaaatatcagt

SEQ ID NO: 2652 - DNA, 16 bp, H. sapiens
aaaagaaaatattctt

SEQ ID NO: 2653 - DNA, 16 bp, H. sapiens
aaaagaaaatcagttg

SEQ ID NO: 2654 - DNA, 16 bp, H. sapiens
aaaagaaaatctatta

SEQ ID NO: 2655 - DNA, 16 bp, H. sapiens
aaaagaaaatcttgaa

SEQ ID NO: 2656 - DNA, 16 bp, H. sapiens
aaaagaaaatctttga

SEQ ID NO: 2657 - DNA, 16 bp, H. sapiens
aaaagaaaatctttta

SEQ ID NO: 2658 - DNA, 16 bp, H. sapiens
aaaagaaaatgagtct

SEQ ID NO: 2659 - DNA, 16 bp, H. sapiens
aaaagaaaatggtttg

SEQ ID NO: 2660 - DNA, 16 bp, H. sapiens
aaaagaaaatgtacat

SEQ ID NO: 2661 - DNA, 16 bp, H. sapiens
aaaagaaaatgtcttt

SEQ ID NO: 2662 - DNA, 16 bp, H. sapiens
aaaagaaaattaatgc

SEQ ID NO: 2663 - DNA, 16 bp, H. sapiens
aaaagaaaattacagg

SEQ ID NO: 2664 - DNA, 16 bp, H. sapiens
aaaagaaaattatctt

SEQ ID NO: 2665 - DNA, 16 bp, H. sapiens
aaaagaaaattattct

SEQ ID NO: 2666 - DNA, 16 bp, H. sapiens
aaaagaaaattcagga

SEQ ID NO: 2667 - DNA, 16 bp, H. sapiens
aaaagaaaattgcatt

SEQ ID NO: 2668 - DNA, 16 bp, H. sapiens
aaaagaaaattttcca

SEQ ID NO: 2669 - DNA, 16 bp, H. sapiens
aaaagaaacaaacttt

SEQ ID NO: 2670 - DNA, 16 bp, H. sapiens
aaaagaaacaagtttt

SEQ ID NO: 2671 - DNA, 16 bp, H. sapiens
aaaagaaacaatcatc

SEQ ID NO: 2672 - DNA, 16 bp, H. sapiens
aaaagaaacagatgga

SEQ ID NO: 2673 - DNA, 16 bp, H. sapiens
aaaagaaacagcattt

SEQ ID NO: 2674 - DNA, 16 bp, H. sapiens
aaaagaaacagggttt

SEQ ID NO: 2675 - DNA, 16 bp, H. sapiens
aaaagaaacaggtgaa

SEQ ID NO: 2676 - DNA, 16 bp, H. sapiens
aaaagaaacatatttt

SEQ ID NO: 2677 - DNA, 16 bp, H. sapiens
aaaagaaaccccatac

SEQ ID NO: 2678 - DNA, 16 bp, H. sapiens
aaaagaaacctggaaa

SEQ ID NO: 2679 - DNA, 16 bp, H. sapiens
aaaagaaactatcaat

SEQ ID NO: 2680 - DNA, 16 bp, H. sapiens
aaaagaaactgaagag

SEQ ID NO: 2681 - DNA, 16 bp, H. sapiens
aaaagaaactgttaaa

SEQ ID NO: 2682 - DNA, 16 bp, H. sapiens
aaaagaaacttttaat

SEQ ID NO: 2683 - DNA, 16 bp, H. sapiens
aaaagaaagaagattc

SEQ ID NO: 2684 - DNA, 16 bp, H. sapiens
aaaagaaagaatgtgt

SEQ ID NO: 2685 - DNA, 16 bp, H. sapiens
aaaagaaagaattcta

SEQ ID NO: 2686 - DNA, 16 bp, H. sapiens
aaaagaaagagagatc

SEQ ID NO: 2687 - DNA, 16 bp, H. sapiens
aaaagaaagagatttt

SEQ ID NO: 2688 - DNA, 16 bp, H. sapiens
aaaagaaagagctgaa

SEQ ID NO: 2689 - DNA, 16 bp, H. sapiens
aaaagaaagatgattt

SEQ ID NO: 2690 - DNA, 16 bp, H. sapiens
aaaagaaagcagagtg

SEQ ID NO: 2691 - DNA, 16 bp, H. sapiens
aaaagaaagctacaga

SEQ ID NO: 2692 - DNA, 16 bp, H. sapiens
aaaagaaagctgcatt

SEQ ID NO: 2693 - DNA, 16 bp, H. sapiens
aaaagaaagctgtaag

SEQ ID NO: 2694 - DNA, 17 bp, H. sapiens
aaaagaaagtaccatca

SEQ ID NO: 2695 - DNA, 16 bp, H. sapiens
aaaagaaagtcttaaa

SEQ ID NO: 2696 - DNA, 16 bp, H. sapiens
aaaagaaagttcaact

SEQ ID NO: 2697 - DNA, 16 bp, H. sapiens
aaaagaaagtttcacc

SEQ ID NO: 2698 - DNA, 16 bp, H. sapiens
aaaagaaagtttcaga

SEQ ID NO: 2699 - DNA, 16 bp, H. sapiens
aaaagaaagttttttt

SEQ ID NO: 2700 - DNA, 16 bp, H. sapiens
aaaagaaatacatatt

SEQ ID NO: 2701 - DNA, 16 bp, H. sapiens
aaaagaaatacattgg

SEQ ID NO: 2702 - DNA, 16 bp, H. sapiens
aaaagaaatactttct

SEQ ID NO: 2703 - DNA, 16 bp, H. sapiens
aaaagaaatatctgtt

SEQ ID NO: 2704 - DNA, 16 bp, H. sapiens
aaaagaaatatcttca

SEQ ID NO: 2705 - DNA, 16 bp, H. sapiens
aaaagaaatatgtcaa

SEQ ID NO: 2706 - DNA, 16 bp, H. sapiens
aaaagaaatattacag

SEQ ID NO: 2707 - DNA, 16 bp, H. sapiens
aaaagaaatcagaatt

SEQ ID NO: 2708 - DNA, 16 bp, H. sapiens
aaaagaaatcagacat

SEQ ID NO: 2709 - DNA, 16 bp, H. sapiens
aaaagaaatctcaagt

SEQ ID NO: 2710 - DNA, 16 bp, H. sapiens
aaaagaaatctctgga

SEQ ID NO: 2711 - DNA, 16 bp, H. sapiens
aaaagaaatctgaaat

SEQ ID NO: 2712 - DNA, 16 bp, H. sapiens
aaaagaaatctttaaa

SEQ ID NO: 2713 - DNA, 16 bp, H. sapiens
aaaagaaatgagatca

SEQ ID NO: 2714 - DNA, 16 bp, H. sapiens
aaaagaaatgagccat

SEQ ID NO: 2715 - DNA, 16 bp, H. sapiens
aaaagaaatgcaagtt

SEQ ID NO: 2716 - DNA, 16 bp, H. sapiens
aaaagaaatgcagatt

SEQ ID NO: 2717 - DNA, 16 bp, H. sapiens
aaaagaaatgctgaaa

SEQ ID NO: 2718 - DNA, 16 bp, H. sapiens
aaaagaaatgcttaaa

SEQ ID NO: 2719 - DNA, 16 bp, H. sapiens
aaaagaaatggaacat

SEQ ID NO: 2720 - DNA, 16 bp, H. sapiens
aaaagaaatgttcaaa

SEQ ID NO: 2721 - DNA, 16 bp, H. sapiens
aaaagaaatgttcatt

SEQ ID NO: 2722 - DNA, 16 bp, H. sapiens
aaaagaaatgttttta

SEQ ID NO: 2723 - DNA, 16 bp, H. sapiens
aaaagaaatgtttttt

SEQ ID NO: 2724 - DNA, 16 bp, H. sapiens
aaaagaaattatatca

SEQ ID NO: 2725 - DNA, 16 bp, H. sapiens
aaaagaaattatccaa

SEQ ID NO: 2726 - DNA, 16 bp, H. sapiens
aaaagaaattatgtca

SEQ ID NO: 2727 - DNA, 16 bp, H. sapiens
aaaagaaattattctg

SEQ ID NO: 2728 - DNA, 16 bp, H. sapiens
aaaagaaattcagttt

SEQ ID NO: 2729 - DNA, 16 bp, H. sapiens
aaaagaaattccaact

SEQ ID NO: 2730 - DNA, 16 bp, H. sapiens
aaaagaaattctcaaa

SEQ ID NO: 2731 - DNA, 16 bp, H. sapiens
aaaagaaattctggaa

SEQ ID NO: 2732 - DNA, 16 bp, H. sapiens
aaaagaaattgcattt

SEQ ID NO: 2733 - DNA, 16 bp, H. sapiens
aaaagaaatttcagaa

SEQ ID NO: 2734 - DNA, 16 bp, H. sapiens
aaaagaaatttcattt

SEQ ID NO: 2735 - DNA, 16 bp, H. sapiens
aaaagaaatttctaag

SEQ ID NO: 2736 - DNA, 16 bp, H. sapiens
aaaagaaatttcttca

SEQ ID NO: 2737 - DNA, 16 bp, H. sapiens
aaaagaaatttgtgct

SEQ ID NO: 2738 - DNA, 16 bp, H. sapiens
aaaagaacaaaattgg

SEQ ID NO: 2739 - DNA, 24 bp, H. sapiens
aaaagaacaaagctggaggcatca

SEQ ID NO: 2740 - DNA, 16 bp, H. sapiens
aaaagaacaaagctgt

SEQ ID NO: 2741 - DNA, 16 bp, H. sapiens
aaaagaacaaagttgg

SEQ ID NO: 2742 - DNA, 16 bp, H. sapiens
aaaagaacacacattt

SEQ ID NO: 2743 - DNA, 16 bp, H. sapiens
aaaagaacagaatttt

SEQ ID NO: 2744 - DNA, 16 bp, H. sapiens
aaaagaacagcaggtg

SEQ ID NO: 2745 - DNA, 16 bp, H. sapiens
aaaagaacatttagaa

SEQ ID NO: 2746 - DNA, 16 bp, H. sapiens
aaaagaacatttgttt

SEQ ID NO: 2747 - DNA, 16 bp, H. sapiens
aaaagaacattttaaa

SEQ ID NO: 2748 - DNA, 16 bp, H. sapiens
aaaagaacattttcct

SEQ ID NO: 2749 - DNA, 16 bp, H. sapiens
aaaagaactacagaag

SEQ ID NO: 2750 - DNA, 16 bp, H. sapiens
aaaagaactatttaaa

SEQ ID NO: 2751 - DNA, 16 bp, H. sapiens
aaaagaactctgaaaa

SEQ ID NO: 2752 - DNA, 16 bp, H. sapiens
aaaagaactgaaaatg

SEQ ID NO: 2753 - DNA, 16 bp, H. sapiens
aaaagaactggaaaag

SEQ ID NO: 2754 - DNA, 16 bp, H. sapiens
aaaagaactggagaaa

SEQ ID NO: 2755 - DNA, 16 bp, H. sapiens
aaaagaacttattttt

SEQ ID NO: 2756 - DNA, 16 bp, H. sapiens
aaaagaactttcaaaa

SEQ ID NO: 2757 - DNA, 16 bp, H. sapiens
aaaagaacttttatct

SEQ ID NO: 2758 - DNA, 16 bp, H. sapiens
aaaagaagaaaatcct

SEQ ID NO: 2759 - DNA, 16 bp, H. sapiens
aaaagaagaaaatctt

SEQ ID NO: 2760 - DNA, 16 bp, H. sapiens
aaaagaagaaaatttc

SEQ ID NO: 2761 - DNA, 16 bp, H. sapiens
aaaagaagaaactgag

SEQ ID NO: 2762 - DNA, 16 bp, H. sapiens
aaaagaagaaagttct

SEQ ID NO: 2763 - DNA, 16 bp, H. sapiens
aaaagaagaaatatct

SEQ ID NO: 2764 - DNA, 16 bp, H. sapiens
aaaagaagaagaagct

SEQ ID NO: 2765 - DNA, 16 bp, H. sapiens
aaaagaagacaattat

SEQ ID NO: 2766 - DNA, 16 bp, H. sapiens
aaaagaagacatatat

SEQ ID NO: 2767 - DNA, 16 bp, H. sapiens
aaaagaagacattcaa

SEQ ID NO: 2768 - DNA, 16 bp, H. sapiens
aaaagaagagacattt

SEQ ID NO: 2769 - DNA, 16 bp, H. sapiens
aaaagaagatttcaaa

SEQ ID NO: 2770 - DNA, 16 bp, H. sapiens
aaaagaagcaatgatt

SEQ ID NO: 2771 - DNA, 16 bp, H. sapiens
aaaagaagcagaaatt

SEQ ID NO: 2772 - DNA, 16 bp, H. sapiens
aaaagaagccagacag

SEQ ID NO: 2773 - DNA, 16 bp, H. sapiens
aaaagaagctgaaaat

SEQ ID NO: 2774 - DNA, 16 bp, H. sapiens
aaaagaagctgagaaa

SEQ ID NO: 2775 - DNA, 16 bp, H. sapiens
aaaagaagctttaaaa

SEQ ID NO: 2776 - DNA, 16 bp, H. sapiens
aaaagaagctttctga

SEQ ID NO: 2777 - DNA, 16 bp, H. sapiens
aaaagaaggaaacttt

SEQ ID NO: 2778 - DNA, 16 bp, H. sapiens
aaaagaaggcagaaat

SEQ ID NO: 2779 - DNA, 16 bp, H. sapiens
aaaagaaggcattttt

SEQ ID NO: 2780 - DNA, 16 bp, H. sapiens
aaaagaaggtatacaa

SEQ ID NO: 2781 - DNA, 16 bp, H. sapiens
aaaagaaggtattttt

SEQ ID NO: 2782 - DNA, 16 bp, H. sapiens
aaaagaagtaaaaggc

SEQ ID NO: 2783 - DNA, 16 bp, H. sapiens
aaaagaagtatttttt

SEQ ID NO: 2784 - DNA, 16 bp, H. sapiens
aaaagaagtcattaca

SEQ ID NO: 2785 - DNA, 16 bp, H. sapiens
aaaagaagtcattatt

SEQ ID NO: 2786 - DNA, 16 bp, H. sapiens
aaaagaagttcttcaa

SEQ ID NO: 2787 - DNA, 16 bp, H. sapiens
aaaagaataaaactct

SEQ ID NO: 2788 - DNA, 16 bp, H. sapiens
aaaagaataaaactgg

SEQ ID NO: 2789 - DNA, 16 bp, H. sapiens
aaaagaataaatgctt

SEQ ID NO: 2790 - DNA, 16 bp, H. sapiens
aaaagaataaatgtgt

SEQ ID NO: 2791 - DNA, 16 bp, H. sapiens
aaaagaataatgtttt

SEQ ID NO: 2792 - DNA, 16 bp, H. sapiens
aaaagaatacaattct

SEQ ID NO: 2793 - DNA, 16 bp, H. sapiens
aaaagaatacattatt

SEQ ID NO: 2794 - DNA, 16 bp, H. sapiens
aaaagaatagatgttg

SEQ ID NO: 2795 - DNA, 16 bp, H. sapiens
aaaagaatagtctttt

SEQ ID NO: 2796 - DNA, 16 bp, H. sapiens
aaaagaatagtttttt

SEQ ID NO: 2797 - DNA, 16 bp, H. sapiens
aaaagaatatctgaga

SEQ ID NO: 2798 - DNA, 16 bp, H. sapiens
aaaagaatattctttc

SEQ ID NO: 2799 - DNA, 16 bp, H. sapiens
aaaagaatattttctt

SEQ ID NO: 2800 - DNA, 16 bp, H. sapiens
aaaagaatcaaactct

SEQ ID NO: 2801 - DNA, 16 bp, H. sapiens
aaaagaatcacttgaa

SEQ ID NO: 2802 - DNA, 16 bp, H. sapiens
aaaagaatcacttgag

SEQ ID NO: 2803 - DNA, 16 bp, H. sapiens
aaaagaatcatttgaa

SEQ ID NO: 2804 - DNA, 16 bp, H. sapiens
aaaagaatctatatca

SEQ ID NO: 2805 - DNA, 16 bp, H. sapiens
aaaagaatctgaacag

SEQ ID NO: 2806 - DNA, 16 bp, H. sapiens
aaaagaatctgaagaa

SEQ ID NO: 2807 - DNA, 16 bp, H. sapiens
aaaagaatctgaagag

SEQ ID NO: 2808 - DNA, 16 bp, H. sapiens
aaaagaatgaaatcag

SEQ ID NO: 2809 - DNA, 16 bp, H. sapiens
aaaagaatgaaattct

SEQ ID NO: 2810 - DNA, 16 bp, H. sapiens
aaaagaatgaagagca

SEQ ID NO: 2811 - DNA, 16 bp, H. sapiens
aaaagaatgaagttgg

SEQ ID NO: 2812 - DNA, 16 bp, H. sapiens
aaaagaatgaatgctt

SEQ ID NO: 2813 - DNA, 16 bp, H. sapiens
aaaagaatgaatggat

SEQ ID NO: 2814 - DNA, 16 bp, H. sapiens
aaaagaatgaattaac

SEQ ID NO: 2815 - DNA, 16 bp, H. sapiens
aaaagaatgacaagga

SEQ ID NO: 2816 - DNA, 16 bp, H. sapiens
aaaagaatggaaagca

SEQ ID NO: 2817 - DNA, 16 bp, H. sapiens
aaaagaatggaattgg

SEQ ID NO: 2818 - DNA, 16 bp, H. sapiens
aaaagaatgtatttct

SEQ ID NO: 2819 - DNA, 16 bp, H. sapiens
aaaagaatgtgtattt

SEQ ID NO: 2820 - DNA, 16 bp, H. sapiens
aaaagaatgtgtgtgt

SEQ ID NO: 2821 - DNA, 16 bp, H. sapiens
aaaagaatgtgtgttt

SEQ ID NO: 2822 - DNA, 16 bp, H. sapiens
aaaagaattcagaagg

SEQ ID NO: 2823 - DNA, 16 bp, H. sapiens
aaaagaattcagtaaa

SEQ ID NO: 2824 - DNA, 16 bp, H. sapiens
aaaagaattctggaga

SEQ ID NO: 2825 - DNA, 16 bp, H. sapiens
aaaagaattcttagaa

SEQ ID NO: 2826 - DNA, 16 bp, H. sapiens
aaaagaattgaaatca

SEQ ID NO: 2827 - DNA, 16 bp, H. sapiens
aaaagaatttaaagca

SEQ ID NO: 2828 - DNA, 16 bp, H. sapiens
aaaagaatttaaggat

SEQ ID NO: 2829 - DNA, 16 bp, H. sapiens
aaaagaatttcatttt

SEQ ID NO: 2830 - DNA, 16 bp, H. sapiens
aaaagaatttcttaaa

SEQ ID NO: 2831 - DNA, 16 bp, H. sapiens
aaaagaatttgttttt

SEQ ID NO: 2832 - DNA, 16 bp, H. sapiens
aaaagacaaaaattgt

SEQ ID NO: 2833 - DNA, 16 bp, H. sapiens
aaaagacaaaatattt

SEQ ID NO: 2834 - DNA, 16 bp, H. sapiens
aaaagacaaattatgg

SEQ ID NO: 2835 - DNA, 16 bp, H. sapiens
aaaagacaacctgcag

SEQ ID NO: 2836 - DNA, 16 bp, H. sapiens
aaaagacaactttaaa

SEQ ID NO: 2837 - DNA, 16 bp, H. sapiens
aaaagacaaggatgcc

SEQ ID NO: 2838 - DNA, 16 bp, H. sapiens
aaaagacaatgaaatg

SEQ ID NO: 2839 - DNA, 16 bp, H. sapiens
aaaagacaattatttt

SEQ ID NO: 2840 - DNA, 16 bp, H. sapiens
aaaagacacaaaattt

SEQ ID NO: 2841 - DNA, 16 bp, H. sapiens
aaaagacacaatccca

SEQ ID NO: 2842 - DNA, 16 bp, H. sapiens
aaaagacacatgaaga

SEQ ID NO: 2843 - DNA, 16 bp, H. sapiens
aaaagacacatttttt

SEQ ID NO: 2844 - DNA, 16 bp, H. sapiens
aaaagacacctcaaaa

SEQ ID NO: 2845 - DNA, 16 bp, H. sapiens
aaaagacagaagaatc

SEQ ID NO: 2846 - DNA, 16 bp, H. sapiens
aaaagacagagatgga

SEQ ID NO: 2847 - DNA, 16 bp, H. sapiens
aaaagacagaggttta

SEQ ID NO: 2848 - DNA, 16 bp, H. sapiens
aaaagacagcttttca

SEQ ID NO: 2849 - DNA, 16 bp, H. sapiens
aaaagacagtttaaaa

SEQ ID NO: 2850 - DNA, 16 bp, H. sapiens
aaaagacataatttta

SEQ ID NO: 2851 - DNA, 16 bp, H. sapiens
aaaagacatacatgca

SEQ ID NO: 2852 - DNA, 16 bp, H. sapiens
aaaagacatatttgat

SEQ ID NO: 2853 - DNA, 16 bp, H. sapiens
aaaagacatgaacaga

SEQ ID NO: 2854 - DNA, 16 bp, H. sapiens
aaaagacatgagcaga

SEQ ID NO: 2855 - DNA, 16 bp, H. sapiens
aaaagacatggaagaa

SEQ ID NO: 2856 - DNA, 16 bp, H. sapiens
aaaagacatggagaaa

SEQ ID NO: 2857 - DNA, 16 bp, H. sapiens
aaaagacatggatgaa

SEQ ID NO: 2858 - DNA, 16 bp, H. sapiens
aaaagacattaaattt

SEQ ID NO: 2859 - DNA, 16 bp, H. sapiens
aaaagacatttcagtt

SEQ ID NO: 2860 - DNA, 16 bp, H. sapiens
aaaagacattttaaaa

SEQ ID NO: 2861 - DNA, 16 bp, H. sapiens
aaaagacattttaaat

SEQ ID NO: 2862 - DNA, 16 bp, H. sapiens
aaaagacattttaata

SEQ ID NO: 2863 - DNA, 16 bp, H. sapiens
aaaagacattttgaaa

SEQ ID NO: 2864 - DNA, 16 bp, H. sapiens
aaaagaccaaatattt

SEQ ID NO: 2865 - DNA, 16 bp, H. sapiens
aaaagactacatattg

SEQ ID NO: 2866 - DNA, 16 bp, H. sapiens
aaaagactattttttt

SEQ ID NO: 2867 - DNA, 16 bp, H. sapiens
aaaagactcctttcaa

SEQ ID NO: 2868 - DNA, 16 bp, H. sapiens
aaaagactctgcaaaa

SEQ ID NO: 2869 - DNA, 16 bp, H. sapiens
aaaagactgataaatt

SEQ ID NO: 2870 - DNA, 16 bp, H. sapiens
aaaagactgttctttc

SEQ ID NO: 2871 - DNA, 16 bp, H. sapiens
aaaagactgtttcttt

SEQ ID NO: 2872 - DNA, 16 bp, H. sapiens
aaaagacttcaaataa

SEQ ID NO: 2873 - DNA, 16 bp, H. sapiens
aaaagacttgaagaaa

SEQ ID NO: 2874 - DNA, 16 bp, H. sapiens
aaaagactttcctttt

SEQ ID NO: 2875 - DNA, 16 bp, H. sapiens
aaaagacttttaaata

SEQ ID NO: 2876 - DNA, 16 bp, H. sapiens
aaaagagaaaactcag

SEQ ID NO: 2877 - DNA, 16 bp, H. sapiens
aaaagagaaaactgca

SEQ ID NO: 2878 - DNA, 16 bp, H. sapiens
aaaagagaaaagccat

SEQ ID NO: 2879 - DNA, 16 bp, H. sapiens
aaaagagaaaagtctt

SEQ ID NO: 2880 - DNA, 16 bp, H. sapiens
aaaagagaaagctgaa

SEQ ID NO: 2881 - DNA, 16 bp, H. sapiens
aaaagagaaatgattt

SEQ ID NO: 2882 - DNA, 16 bp, H. sapiens
aaaagagaaatgtttg

SEQ ID NO: 2883 - DNA, 16 bp, H. sapiens
aaaagagaacatttat

SEQ ID NO: 2884 - DNA, 16 bp, H. sapiens
aaaagagaacccttgt

SEQ ID NO: 2885 - DNA, 16 bp, H. sapiens
aaaagagaagattttt

SEQ ID NO: 2886 - DNA, 16 bp, H. sapiens
aaaagagaaggaaatc

SEQ ID NO: 2887 - DNA, 16 bp, H. sapiens
aaaagagaatttcaaa

SEQ ID NO: 2888 - DNA, 18 bp, H. sapiens
aaaagagaattttagaca

SEQ ID NO: 2889 - DNA, 16 bp, H. sapiens
aaaagagaattttagg

SEQ ID NO: 2890 - DNA, 16 bp, H. sapiens
aaaagagaattttgaa

SEQ ID NO: 2891 - DNA, 16 bp, H. sapiens
aaaagagagaaaactc

SEQ ID NO: 2892 - DNA, 23 bp, H. sapiens
aaaagagagaagaatcaaataga

SEQ ID NO: 2893 - DNA, 23 bp, H. sapiens
aaaagagagaagaatccaataga

SEQ ID NO: 2894 - DNA, 16 bp, H. sapiens
aaaagagagaagagtc

SEQ ID NO: 2895 - DNA, 16 bp, H. sapiens
aaaagagagaatttct

SEQ ID NO: 2896 - DNA, 16 bp, H. sapiens
aaaagagagattcaaa

SEQ ID NO: 2897 - DNA, 18 bp, H. sapiens
aaaagagagtcagcaaag

SEQ ID NO: 2898 - DNA, 16 bp, H. sapiens
aaaagagatattttta

SEQ ID NO: 2899 - DNA, 16 bp, H. sapiens
aaaagagatttcaaga

SEQ ID NO: 2900 - DNA, 16 bp, H. sapiens
aaaagagatttttttt

SEQ ID NO: 2901 - DNA, 16 bp, H. sapiens
aaaagagcaaaactct

SEQ ID NO: 2902 - DNA, 16 bp, H. sapiens
aaaagagcactcataa

SEQ ID NO: 2903 - DNA, 16 bp, H. sapiens
aaaagagcaggagtaa

SEQ ID NO: 2904 - DNA, 16 bp, H. sapiens
aaaagagcagtggttc

SEQ ID NO: 2905 - DNA, 16 bp, H. sapiens
aaaagagctctgatta

SEQ ID NO: 2906 - DNA, 16 bp, H. sapiens
aaaagaggaaaattgt

SEQ ID NO: 2907 - DNA, 16 bp, H. sapiens
aaaagaggaaacattt

SEQ ID NO: 2908 - DNA, 16 bp, H. sapiens
aaaagaggaaatttag

SEQ ID NO: 2909 - DNA, 16 bp, H. sapiens
aaaagaggaagttgct

SEQ ID NO: 2910 - DNA, 16 bp, H. sapiens
aaaagaggatgatatt

SEQ ID NO: 2911 - DNA, 16 bp, H. sapiens
aaaagaggcagtcaaa

SEQ ID NO: 2912 - DNA, 16 bp, H. sapiens
aaaagaggccaggtgc

SEQ ID NO: 2913 - DNA, 16 bp, H. sapiens
aaaagaggttacaaac

SEQ ID NO: 2914 - DNA, 16 bp, H. sapiens
aaaagaggtttgattg

SEQ ID NO: 2915 - DNA, 16 bp, H. sapiens
aaaagagtaggagtag

SEQ ID NO: 2916 - DNA, 16 bp, H. sapiens
aaaagagtgatttttt

SEQ ID NO: 2917 - DNA, 16 bp, H. sapiens
aaaagagttaatattt

SEQ ID NO: 2918 - DNA, 16 bp, H. sapiens
aaaagagtttcttttt

SEQ ID NO: 2919 - DNA, 16 bp, H. sapiens
aaaagagtttttcaaa

SEQ ID NO: 2920 - DNA, 16 bp, H. sapiens
aaaagataattcacca

SEQ ID NO: 2921 - DNA, 16 bp, H. sapiens
aaaagataatttaaca

SEQ ID NO: 2922 - DNA, 16 bp, H. sapiens
aaaagataattttcaa

SEQ ID NO: 2923 - DNA, 16 bp, H. sapiens
aaaagatacattttat

SEQ ID NO: 2924 - DNA, 16 bp, H. sapiens
aaaagatacattttta

SEQ ID NO: 2925 - DNA, 16 bp, H. sapiens
aaaagatagaaaatct

SEQ ID NO: 2926 - DNA, 16 bp, H. sapiens
aaaagatatgatttca

SEQ ID NO: 2927 - DNA, 16 bp, H. sapiens
aaaagatatgttaaag

SEQ ID NO: 2928 - DNA, 16 bp, H. sapiens
aaaagatatgttgaag

SEQ ID NO: 2929 - DNA, 16 bp, H. sapiens
aaaagatattctaaaa

SEQ ID NO: 2930 - DNA, 16 bp, H. sapiens
aaaagatatttctttt

SEQ ID NO: 2931 - DNA, 16 bp, H. sapiens
aaaagatatttgatat

SEQ ID NO: 2932 - DNA, 16 bp, H. sapiens
aaaagatattttcaaa

SEQ ID NO: 2933 - DNA, 16 bp, H. sapiens
aaaagatattttggag

SEQ ID NO: 2934 - DNA, 16 bp, H. sapiens
aaaagatcaacaaatt

SEQ ID NO: 2935 - DNA, 16 bp, H. sapiens
aaaagatcaacaacat

SEQ ID NO: 2936 - DNA, 16 bp, H. sapiens
aaaagatcactctggt

SEQ ID NO: 2937 - DNA, 16 bp, H. sapiens
aaaagatcattagaga

SEQ ID NO: 2938 - DNA, 16 bp, H. sapiens
aaaagatcatttacca

SEQ ID NO: 2939 - DNA, 16 bp, H. sapiens
aaaagatgaaaatctt

SEQ ID NO: 2940 - DNA, 16 bp, H. sapiens
aaaagatgaaaatgtt

SEQ ID NO: 2941 - DNA, 16 bp, H. sapiens
aaaagatgaatttaga

SEQ ID NO: 2942 - DNA, 16 bp, H. sapiens
aaaagatgcccaacat

SEQ ID NO: 2943 - DNA, 16 bp, H. sapiens
aaaagatggccaggca

SEQ ID NO: 2944 - DNA, 16 bp, H. sapiens
aaaagatgtattttta

SEQ ID NO: 2945 - DNA, 16 bp, H. sapiens
aaaagatgttggcatg

SEQ ID NO: 2946 - DNA, 16 bp, H. sapiens
aaaagatgtttaatat

SEQ ID NO: 2947 - DNA, 16 bp, H. sapiens
aaaagatgtttatttt

SEQ ID NO: 2948 - DNA, 16 bp, H. sapiens
aaaagatgtttgtttt

SEQ ID NO: 2949 - DNA, 16 bp, H. sapiens
aaaagattaaaatcat

SEQ ID NO: 2950 - DNA, 16 bp, H. sapiens
aaaagattaaacagat

SEQ ID NO: 2951 - DNA, 16 bp, H. sapiens
aaaagattataatgga

SEQ ID NO: 2952 - DNA, 16 bp, H. sapiens
aaaagattatattttc

SEQ ID NO: 2953 - DNA, 16 bp, H. sapiens
aaaagattattcaaaa

SEQ ID NO: 2954 - DNA, 16 bp, H. sapiens
aaaagattcattattt

SEQ ID NO: 2955 - DNA, 16 bp, H. sapiens
aaaagattcattttta

SEQ ID NO: 2956 - DNA, 16 bp, H. sapiens
aaaagattctaaaatt

SEQ ID NO: 2957 - DNA, 16 bp, H. sapiens
aaaagattcttgcaca

SEQ ID NO: 2958 - DNA, 16 bp, H. sapiens
aaaagattgacaaatt

SEQ ID NO: 2959 - DNA, 16 bp, H. sapiens
aaaagattggacacct

SEQ ID NO: 2960 - DNA, 16 bp, H. sapiens
aaaagattggggacca

SEQ ID NO: 2961 - DNA, 16 bp, H. sapiens
aaaagattgtcttttc

SEQ ID NO: 2962 - DNA, 16 bp, H. sapiens
aaaagattgttttaaa

SEQ ID NO: 2963 - DNA, 16 bp, H. sapiens
aaaagatttatctgta

SEQ ID NO: 2964 - DNA, 16 bp, H. sapiens
aaaagatttattcaca

SEQ ID NO: 2965 - DNA, 16 bp, H. sapiens
aaaagatttcttattt

SEQ ID NO: 2966 - DNA, 16 bp, H. sapiens
aaaagatttctttcaa

SEQ ID NO: 2967 - DNA, 16 bp, H. sapiens
aaaagatttgaacaga

SEQ ID NO: 2968 - DNA, 16 bp, H. sapiens
aaaagatttgaagaga

SEQ ID NO: 2969 - DNA, 16 bp, H. sapiens
aaaagatttgcaaact

SEQ ID NO: 2970 - DNA, 16 bp, H. sapiens
aaaagatttgggaaaa

SEQ ID NO: 2971 - DNA, 16 bp, H. sapiens
aaaagattttaaggaa

SEQ ID NO: 2972 - DNA, 16 bp, H. sapiens
aaaagattttacattt

SEQ ID NO: 2973 - DNA, 16 bp, H. sapiens
aaaagattttctgatt

SEQ ID NO: 2974 - DNA, 16 bp, H. sapiens
aaaagattttgaattt

SEQ ID NO: 2975 - DNA, 16 bp, H. sapiens
aaaagattttggaaat

SEQ ID NO: 2976 - DNA, 16 bp, H. sapiens
aaaagatttttaaaca

SEQ ID NO: 2977 - DNA, 16 bp, H. sapiens
aaaagcaaaaattatc

SEQ ID NO: 2978 - DNA, 16 bp, H. sapiens
aaaagcaaaactatag

SEQ ID NO: 2979 - DNA, 16 bp, H. sapiens
aaaagcaaaacttcat

SEQ ID NO: 2980 - DNA, 16 bp, H. sapiens
aaaagcaaaacttgaa

SEQ ID NO: 2981 - DNA, 16 bp, H. sapiens
aaaagcaaaagctttt

SEQ ID NO: 2982 - DNA, 16 bp, H. sapiens
aaaagcaaaagttgac

SEQ ID NO: 2983 - DNA, 16 bp, H. sapiens
aaaagcaaaagttttt

SEQ ID NO: 2984 - DNA, 16 bp, H. sapiens
aaaagcaaaatgtttt

SEQ ID NO: 2985 - DNA, 16 bp, H. sapiens
aaaagcaaaatttaga

SEQ ID NO: 2986 - DNA, 16 bp, H. sapiens
aaaagcaaacaacttt

SEQ ID NO: 2987 - DNA, 16 bp, H. sapiens
aaaagcaaatatttca

SEQ ID NO: 2988 - DNA, 16 bp, H. sapiens
aaaagcaaatatttct

SEQ ID NO: 2989 - DNA, 16 bp, H. sapiens
aaaagcaaatgcagca

SEQ ID NO: 2990 - DNA, 16 bp, H. sapiens
aaaagcaaatgctttt

SEQ ID NO: 2991 - DNA, 16 bp, H. sapiens
aaaagcaaatggaaat

SEQ ID NO: 2992 - DNA, 16 bp, H. sapiens
aaaagcaaatgggaga

SEQ ID NO: 2993 - DNA, 16 bp, H. sapiens
aaaagcaaattcaagc

SEQ ID NO: 2994 - DNA, 16 bp, H. sapiens
aaaagcaaatttttaa

SEQ ID NO: 2995 - DNA, 16 bp, H. sapiens
aaaagcaaatttttta

SEQ ID NO: 2996 - DNA, 16 bp, H. sapiens
aaaagcaacagaaatt

SEQ ID NO: 2997 - DNA, 16 bp, H. sapiens
aaaagcaacagatgtt

SEQ ID NO: 2998 - DNA, 16 bp, H. sapiens
aaaagcaagaaaatgg

SEQ ID NO: 2999 - DNA, 16 bp, H. sapiens
aaaagcaagcaggaat

SEQ ID NO: 3000 - DNA, 16 bp, H. sapiens
aaaagcaagttgcaaa

SEQ ID NO: 3001 - DNA, 16 bp, H. sapiens
aaaagcaatagagaag

SEQ ID NO: 3002 - DNA, 16 bp, H. sapiens
aaaagcaatgcaacaa

SEQ ID NO: 3003 - DNA, 16 bp, H. sapiens
aaaagcaatgctaaga

SEQ ID NO: 3004 - DNA, 16 bp, H. sapiens
aaaagcaatgggaaaa

SEQ ID NO: 3005 - DNA, 16 bp, H. sapiens
aaaagcaatgtttaaa

SEQ ID NO: 3006 - DNA, 16 bp, H. sapiens
aaaagcaattacattt

SEQ ID NO: 3007 - DNA, 16 bp, H. sapiens
aaaagcaattcagaaa

SEQ ID NO: 3008 - DNA, 16 bp, H. sapiens
aaaagcaatttaaatt

SEQ ID NO: 3009 - DNA, 16 bp, H. sapiens
aaaagcaatttataga

SEQ ID NO: 3010 - DNA, 16 bp, H. sapiens
aaaagcaatttattta

SEQ ID NO: 3011 - DNA, 16 bp, H. sapiens
aaaagcaatttgaaaa

SEQ ID NO: 3012 - DNA, 16 bp, H. sapiens
aaaagcaattttcaaa

SEQ ID NO: 3013 - DNA, 16 bp, H. sapiens
aaaagcacaattcata

SEQ ID NO: 3014 - DNA, 16 bp, H. sapiens
aaaagcacagacaact

SEQ ID NO: 3015 - DNA, 16 bp, H. sapiens
aaaagcacagaggcag

SEQ ID NO: 3016 - DNA, 16 bp, H. sapiens
aaaagcacaggcagca

SEQ ID NO: 3017 - DNA, 16 bp, H. sapiens
aaaagcacagttttaa

SEQ ID NO: 3018 - DNA, 16 bp, H. sapiens
aaaagcacatacagaa

SEQ ID NO: 3019 - DNA, 16 bp, H. sapiens
aaaagcacatttttaa

SEQ ID NO: 3020 - DNA, 16 bp, H. sapiens
aaaagcacttgacaaa

SEQ ID NO: 3021 - DNA, 16 bp, H. sapiens
aaaagcacttgataaa

SEQ ID NO: 3022 - DNA, 16 bp, H. sapiens
aaaagcagaaactcct

SEQ ID NO: 3023 - DNA, 16 bp, H. sapiens
aaaagcagaaagtaga

SEQ ID NO: 3024 - DNA, 16 bp, H. sapiens
aaaagcagaaatgaga

SEQ ID NO: 3025 - DNA, 16 bp, H. sapiens
aaaagcagaagttgca

SEQ ID NO: 3026 - DNA, 16 bp, H. sapiens
aaaagcagaatttaaa

SEQ ID NO: 3027 - DNA, 16 bp, H. sapiens
aaaagcagaattttaa

SEQ ID NO: 3028 - DNA, 16 bp, H. sapiens
aaaagcagagtgcctc

SEQ ID NO: 3029 - DNA, 16 bp, H. sapiens
aaaagcagatattttt

SEQ ID NO: 3030 - DNA, 16 bp, H. sapiens
aaaagcagattataaa

SEQ ID NO: 3031 - DNA, 16 bp, H. sapiens
aaaagcagattttatt

SEQ ID NO: 3032 - DNA, 16 bp, H. sapiens
aaaagcagcagcaaca

SEQ ID NO: 3033 - DNA, 16 bp, H. sapiens
aaaagcagcagcagaa

SEQ ID NO: 3034 - DNA, 16 bp, H. sapiens
aaaagcagcagcagcc

SEQ ID NO: 3035 - DNA, 16 bp, H. sapiens
aaaagcagccatggac

SEQ ID NO: 3036 - DNA, 16 bp, H. sapiens
aaaagcaggaggtaaa

SEQ ID NO: 3037 - DNA, 16 bp, H. sapiens
aaaagcaggcaaaatt

SEQ ID NO: 3038 - DNA, 16 bp, H. sapiens
aaaagcaggcagtggg

SEQ ID NO: 3039 - DNA, 16 bp, H. sapiens
aaaagcagggtggggt

SEQ ID NO: 3040 - DNA, 16 bp, H. sapiens
aaaagcaggttacaaa

SEQ ID NO: 3041 - DNA, 16 bp, H. sapiens
aaaagcagtatttcaa

SEQ ID NO: 3042 - DNA, 16 bp, H. sapiens
aaaagcagtattttaa

SEQ ID NO: 3043 - DNA, 16 bp, H. sapiens
aaaagcagtgctaaaa

SEQ ID NO: 3044 - DNA, 16 bp, H. sapiens
aaaagcagttattttt

SEQ ID NO: 3045 - DNA, 16 bp, H. sapiens
aaaagcagttgacaaa

SEQ ID NO: 3046 - DNA, 16 bp, H. sapiens
aaaagcagttgagttt

SEQ ID NO: 3047 - DNA, 16 bp, H. sapiens
aaaagcagtttagaga

SEQ ID NO: 3048 - DNA, 16 bp, H. sapiens
aaaagcataaaatact

SEQ ID NO: 3049 - DNA, 16 bp, H. sapiens
aaaagcataaatatta

SEQ ID NO: 3050 - DNA, 16 bp, H. sapiens
aaaagcatagaaaatt

SEQ ID NO: 3051 - DNA, 16 bp, H. sapiens
aaaagcatatatttaa

SEQ ID NO: 3052 - DNA, 16 bp, H. sapiens
aaaagcatatgataaa

SEQ ID NO: 3053 - DNA, 16 bp, H. sapiens
aaaagcatatttttat

SEQ ID NO: 3054 - DNA, 16 bp, H. sapiens
aaaagcatcagatctt

SEQ ID NO: 3055 - DNA, 16 bp, H. sapiens
aaaagcatccaaataa

SEQ ID NO: 3056 - DNA, 16 bp, H. sapiens
aaaagcatccagattg

SEQ ID NO: 3057 - DNA, 16 bp, H. sapiens
aaaagcatgaacaaca

SEQ ID NO: 3058 - DNA, 16 bp, H. sapiens
aaaagcatggattctg

SEQ ID NO: 3059 - DNA, 16 bp, H. sapiens
aaaagcatgtgaaaag

SEQ ID NO: 3060 - DNA, 16 bp, H. sapiens
aaaagcattattaaaa

SEQ ID NO: 3061 - DNA, 16 bp, H. sapiens
aaaagcattctgagaa

SEQ ID NO: 3062 - DNA, 16 bp, H. sapiens
aaaagcatttcaaaaa

SEQ ID NO: 3063 - DNA, 16 bp, H. sapiens
aaaagcatttccattt

SEQ ID NO: 3064 - DNA, 16 bp, H. sapiens
aaaagcatttcttttt

SEQ ID NO: 3065 - DNA, 16 bp, H. sapiens
aaaagcatttgacaaa

SEQ ID NO: 3066 - DNA, 16 bp, H. sapiens
aaaagcatttgacaca

SEQ ID NO: 3067 - DNA, 16 bp, H. sapiens
aaaagcatttgatgaa

SEQ ID NO: 3068 - DNA, 16 bp, H. sapiens
aaaagcattttaaaga

SEQ ID NO: 3069 - DNA, 16 bp, H. sapiens
aaaagcattttcacag

SEQ ID NO: 3070 - DNA, 16 bp, H. sapiens
aaaagcattttccaaa

SEQ ID NO: 3071 - DNA, 16 bp, H. sapiens
aaaagccaaaaggtgg

SEQ ID NO: 3072 - DNA, 16 bp, H. sapiens
aaaagccaaaatagat

SEQ ID NO: 3073 - DNA, 16 bp, H. sapiens
aaaagccaaagtcttt

SEQ ID NO: 3074 - DNA, 16 bp, H. sapiens
aaaagccaactttttg

SEQ ID NO: 3075 - DNA, 16 bp, H. sapiens
aaaagccaagacttca

SEQ ID NO: 3076 - DNA, 16 bp, H. sapiens
aaaagccaagtgaaaa

SEQ ID NO: 3077 - DNA, 19 bp, H. sapiens
aaaagccacagacactcag

SEQ ID NO: 3078 - DNA, 16 bp, H. sapiens
aaaagccagagtgcct

SEQ ID NO: 3079 - DNA, 16 bp, H. sapiens
aaaagccaggtgtggt

SEQ ID NO: 3080 - DNA, 16 bp, H. sapiens
aaaagccagtgccctt

SEQ ID NO: 3081 - DNA, 16 bp, H. sapiens
aaaagccatctgtgac

SEQ ID NO: 3082 - DNA, 16 bp, H. sapiens
aaaagccattctaaca

SEQ ID NO: 3083 - DNA, 16 bp, H. sapiens
aaaagccatttaaaaa

SEQ ID NO: 3084 - DNA, 16 bp, H. sapiens
aaaagccattttatct

SEQ ID NO: 3085 - DNA, 16 bp, H. sapiens
aaaagccattttttaa

SEQ ID NO: 3086 - DNA, 16 bp, H. sapiens
aaaagcccaggaactg

SEQ ID NO: 3087 - DNA, 20 bp, H. sapiens
aaaagcccatgaattattca

SEQ ID NO: 3088 - DNA, 16 bp, H. sapiens
aaaagccttatttttt

SEQ ID NO: 3089 - DNA, 16 bp, H. sapiens
aaaagccttctggaaa

SEQ ID NO: 3090 - DNA, 16 bp, H. sapiens
aaaagccttttatttt

SEQ ID NO: 3091 - DNA, 16 bp, H. sapiens
aaaagctaacatttat

SEQ ID NO: 3092 - DNA, 16 bp, H. sapiens
aaaagctagaaataat

SEQ ID NO: 3093 - DNA, 16 bp, H. sapiens
aaaagctcaacaaaat

SEQ ID NO: 3094 - DNA, 16 bp, H. sapiens
aaaagctcagaaaatt

SEQ ID NO: 3095 - DNA, 16 bp, H. sapiens
aaaagctccctgaagc

SEQ ID NO: 3096 - DNA, 16 bp, H. sapiens
aaaagctcctgaaaaa

SEQ ID NO: 3097 - DNA, 16 bp, H. sapiens
aaaagctgaaaacatt

SEQ ID NO: 3098 - DNA, 16 bp, H. sapiens
aaaagctgaaatttaa

SEQ ID NO: 3099 - DNA, 16 bp, H. sapiens
aaaagctgaaatttta

SEQ ID NO: 3100 - DNA, 16 bp, H. sapiens
aaaagctgaaggaaaa

SEQ ID NO: 3101 - DNA, 16 bp, H. sapiens
aaaagctgaaggattt

SEQ ID NO: 3102 - DNA, 16 bp, H. sapiens
aaaagctgaataaaat

SEQ ID NO: 3103 - DNA, 16 bp, H. sapiens
aaaagctgaatttaaa

SEQ ID NO: 3104 - DNA, 16 bp, H. sapiens
aaaagctgacagaatt

SEQ ID NO: 3105 - DNA, 16 bp, H. sapiens
aaaagctgaggaaatt

SEQ ID NO: 3106 - DNA, 16 bp, H. sapiens
aaaagctgagtgttgg

SEQ ID NO: 3107 - DNA, 16 bp, H. sapiens
aaaagctgcaggcatt

SEQ ID NO: 3108 - DNA, 16 bp, H. sapiens
aaaagctggaaatatt

SEQ ID NO: 3109 - DNA, 16 bp, H. sapiens
aaaagctggaagcatt

SEQ ID NO: 3110 - DNA, 16 bp, H. sapiens
aaaagctggaagcctt

SEQ ID NO: 3111 - DNA, 16 bp, H. sapiens
aaaagctggaaggatt

SEQ ID NO: 3112 - DNA, 17 bp, H. sapiens
aaaagctggaggcatca

SEQ ID NO: 3113 - DNA, 17 bp, H. sapiens
aaaagcttatccaccac

SEQ ID NO: 3114 - DNA, 16 bp, H. sapiens
aaaagcttatttaaag

SEQ ID NO: 3115 - DNA, 16 bp, H. sapiens
aaaagcttatttattt

SEQ ID NO: 3116 - DNA, 16 bp, H. sapiens
aaaagcttctgcaaag

SEQ ID NO: 3117 - DNA, 16 bp, H. sapiens
aaaagcttctgcacag

SEQ ID NO: 3118 - DNA, 16 bp, H. sapiens
aaaagcttcttcacag

SEQ ID NO: 3119 - DNA, 16 bp, H. sapiens
aaaagctttaaaaaat

SEQ ID NO: 3120 - DNA, 16 bp, H. sapiens
aaaagctttaaaaaca

SEQ ID NO: 3121 - DNA, 16 bp, H. sapiens
aaaagctttaaaattt

SEQ ID NO: 3122 - DNA, 16 bp, H. sapiens
aaaagctttaagaaaa

SEQ ID NO: 3123 - DNA, 16 bp, H. sapiens
aaaagctttaattttt

SEQ ID NO: 3124 - DNA, 16 bp, H. sapiens
aaaagctttcctattt

SEQ ID NO: 3125 - DNA, 16 bp, H. sapiens
aaaagctttctaaaaa

SEQ ID NO: 3126 - DNA, 16 bp, H. sapiens
aaaagctttgaaaaaa

SEQ ID NO: 3127 - DNA, 16 bp, H. sapiens
aaaagcttttaaaaaa

SEQ ID NO: 3128 - DNA, 16 bp, H. sapiens
aaaagcttttcaaaat

SEQ ID NO: 3129 - DNA, 16 bp, H. sapiens
aaaagcttttgataaa

SEQ ID NO: 3130 - DNA, 16 bp, H. sapiens
aaaagcttttgctttt

SEQ ID NO: 3131 - DNA, 16 bp, H. sapiens
aaaagcttttgtgctt

SEQ ID NO: 3132 - DNA, 16 bp, H. sapiens
aaaagctttttaaaaa

SEQ ID NO: 3133 - DNA, 16 bp, H. sapiens
aaaagctttttaactt

SEQ ID NO: 3134 - DNA, 16 bp, H. sapiens
aaaagctttttatttt

SEQ ID NO: 3135 - DNA, 16 bp, H. sapiens
aaaagctttttttttt

SEQ ID NO: 3136 - DNA, 16 bp, H. sapiens
aaaaggaaaaagttct

SEQ ID NO: 3137 - DNA, 16 bp, H. sapiens
aaaaggaaaacatgtt

SEQ ID NO: 3138 - DNA, 16 bp, H. sapiens
aaaaggaaaacatttt

SEQ ID NO: 3139 - DNA, 16 bp, H. sapiens
aaaaggaaaacccatt

SEQ ID NO: 3140 - DNA, 16 bp, H. sapiens
aaaaggaaaacctcaa

SEQ ID NO: 3141 - DNA, 16 bp, H. sapiens
aaaaggaaaagaagtc

SEQ ID NO: 3142 - DNA, 16 bp, H. sapiens
aaaaggaaaagctttt

SEQ ID NO: 3143 - DNA, 16 bp, H. sapiens
aaaaggaaaaggattt

SEQ ID NO: 3144 - DNA, 16 bp, H. sapiens
aaaaggaaaatacttt

SEQ ID NO: 3145 - DNA, 16 bp, H. sapiens
aaaaggaaacacaagt

SEQ ID NO: 3146 - DNA, 16 bp, H. sapiens
aaaaggaaacacttat

SEQ ID NO: 3147 - DNA, 16 bp, H. sapiens
aaaaggaaaccctgta

SEQ ID NO: 3148 - DNA, 16 bp, H. sapiens
aaaaggaaacctccag

SEQ ID NO: 3149 - DNA, 16 bp, H. sapiens
aaaaggaaactgattt

SEQ ID NO: 3150 - DNA, 16 bp, H. sapiens
aaaaggaaactggaaa

SEQ ID NO: 3151 - DNA, 16 bp, H. sapiens
aaaaggaaactgttga

SEQ ID NO: 3152 - DNA, 16 bp, H. sapiens
aaaaggaaacttgaaa

SEQ ID NO: 3153 - DNA, 16 bp, H. sapiens
aaaaggaaagactgaa

SEQ ID NO: 3154 - DNA, 16 bp, H. sapiens
aaaaggaaagcagaat

SEQ ID NO: 3155 - DNA, 16 bp, H. sapiens
aaaaggaaagtgacat

SEQ ID NO: 3156 - DNA, 16 bp, H. sapiens
aaaaggaaataacttt

SEQ ID NO: 3157 - DNA, 16 bp, H. sapiens
aaaaggaaataccttc

SEQ ID NO: 3158 - DNA, 16 bp, H. sapiens
aaaaggaaatattttc

SEQ ID NO: 3159 - DNA, 16 bp, H. sapiens
aaaaggaaatctatga

SEQ ID NO: 3160 - DNA, 16 bp, H. sapiens
aaaaggaaatctgaaa

SEQ ID NO: 3161 - DNA, 16 bp, H. sapiens
aaaaggaaatgagcaa

SEQ ID NO: 3162 - DNA, 16 bp, H. sapiens
aaaaggaaatgcttac

SEQ ID NO: 3163 - DNA, 16 bp, H. sapiens
aaaaggaaatgtattt

SEQ ID NO: 3164 - DNA, 16 bp, H. sapiens
aaaaggaaatgtttat

SEQ ID NO: 3165 - DNA, 16 bp, H. sapiens
aaaaggaaatttattg

SEQ ID NO: 3166 - DNA, 16 bp, H. sapiens
aaaaggaacaaaattg

SEQ ID NO: 3167 - DNA, 16 bp, H. sapiens
aaaaggaactgaggta

SEQ ID NO: 3168 - DNA, 16 bp, H. sapiens
aaaaggaagaaaactg

SEQ ID NO: 3169 - DNA, 16 bp, H. sapiens
aaaaggaagaaactgt

SEQ ID NO: 3170 - DNA, 16 bp, H. sapiens
aaaaggaagaaattct

SEQ ID NO: 3171 - DNA, 16 bp, H. sapiens
aaaaggaagaggctga

SEQ ID NO: 3172 - DNA, 16 bp, H. sapiens
aaaaggaaggaaactc

SEQ ID NO: 3173 - DNA, 16 bp, H. sapiens
aaaaggaagtttcaac

SEQ ID NO: 3174 - DNA, 16 bp, H. sapiens
aaaaggaagttttaaa

SEQ ID NO: 3175 - DNA, 16 bp, H. sapiens
aaaaggaatacttata

SEQ ID NO: 3176 - DNA, 16 bp, H. sapiens
aaaaggaatatcttca

SEQ ID NO: 3177 - DNA, 16 bp, H. sapiens
aaaaggaatccaaatt

SEQ ID NO: 3178 - DNA, 16 bp, H. sapiens
aaaaggaatgaactat

SEQ ID NO: 3179 - DNA, 18 bp, H. sapiens
aaaaggaatgcttataca

SEQ ID NO: 3180 - DNA, 16 bp, H. sapiens
aaaaggaattagatca

SEQ ID NO: 3181 - DNA, 16 bp, H. sapiens
aaaaggaattatttta

SEQ ID NO: 3182 - DNA, 16 bp, H. sapiens
aaaaggaattctaaaa

SEQ ID NO: 3183 - DNA, 16 bp, H. sapiens
aaaaggaatttctttt

SEQ ID NO: 3184 - DNA, 16 bp, H. sapiens
aaaaggaatttgagga

SEQ ID NO: 3185 - DNA, 16 bp, H. sapiens
aaaaggaatttggagg

SEQ ID NO: 3186 - DNA, 16 bp, H. sapiens
aaaaggacatttaaaa

SEQ ID NO: 3187 - DNA, 16 bp, H. sapiens
aaaaggactttaaaaa

SEQ ID NO: 3188 - DNA, 16 bp, H. sapiens
aaaaggacttttaaaa

SEQ ID NO: 3189 - DNA, 16 bp, H. sapiens
aaaaggagaaaatcat

SEQ ID NO: 3190 - DNA, 16 bp, H. sapiens
aaaaggagaaactgag

SEQ ID NO: 3191 - DNA, 16 bp, H. sapiens
aaaaggagaaagattt

SEQ ID NO: 3192 - DNA, 16 bp, H. sapiens
aaaaggagaaatttgg

SEQ ID NO: 3193 - DNA, 16 bp, H. sapiens
aaaaggagaacctggt

SEQ ID NO: 3194 - DNA, 16 bp, H. sapiens
aaaaggagagatgggc

SEQ ID NO: 3195 - DNA, 16 bp, H. sapiens
aaaaggagatattaca

SEQ ID NO: 3196 - DNA, 16 bp, H. sapiens
aaaaggagattatttt

SEQ ID NO: 3197 - DNA, 16 bp, H. sapiens
aaaaggaggaactcct

SEQ ID NO: 3198 - DNA, 16 bp, H. sapiens
aaaaggaggcagtgac

SEQ ID NO: 3199 - DNA, 16 bp, H. sapiens
aaaaggagttcccctg

SEQ ID NO: 3200 - DNA, 16 bp, H. sapiens
aaaaggatagtctctt

SEQ ID NO: 3201 - DNA, 16 bp, H. sapiens
aaaaggatatccagga

SEQ ID NO: 3202 - DNA, 16 bp, H. sapiens
aaaaggatgagctcag

SEQ ID NO: 3203 - DNA, 18 bp, H. sapiens
aaaaggatgagttcatat

SEQ ID NO: 3204 - DNA, 16 bp, H. sapiens
aaaaggatgctggatt

SEQ ID NO: 3205 - DNA, 16 bp, H. sapiens
aaaaggatgtgtttgc

SEQ ID NO: 3206 - DNA, 16 bp, H. sapiens
aaaaggattataaagg

SEQ ID NO: 3207 - DNA, 16 bp, H. sapiens
aaaaggattccctatt

SEQ ID NO: 3208 - DNA, 16 bp, H. sapiens
aaaaggattttagaaa

SEQ ID NO: 3209 - DNA, 16 bp, H. sapiens
aaaaggattttcttaa

SEQ ID NO: 3210 - DNA, 16 bp, H. sapiens
aaaaggattttgaaaa

SEQ ID NO: 3211 - DNA, 16 bp, H. sapiens
aaaaggcaaaactgta

SEQ ID NO: 3212 - DNA, 16 bp, H. sapiens
aaaaggcaaaagtaat

SEQ ID NO: 3213 - DNA, 16 bp, H. sapiens
aaaaggcaaaatgaag

SEQ ID NO: 3214 - DNA, 16 bp, H. sapiens
aaaaggcaaaatggca

SEQ ID NO: 3215 - DNA, 16 bp, H. sapiens
aaaaggcaaatgacaa

SEQ ID NO: 3216 - DNA, 16 bp, H. sapiens
aaaaggcaagccacag

SEQ ID NO: 3217 - DNA, 16 bp, H. sapiens
aaaaggcacatgaaaa

SEQ ID NO: 3218 - DNA, 16 bp, H. sapiens
aaaaggcactgttgct

SEQ ID NO: 3219 - DNA, 16 bp, H. sapiens
aaaaggcagcaatgag

SEQ ID NO: 3220 - DNA, 16 bp, H. sapiens
aaaaggcagcagacaa

SEQ ID NO: 3221 - DNA, 16 bp, H. sapiens
aaaaggcagcttacaa

SEQ ID NO: 3222 - DNA, 16 bp, H. sapiens
aaaaggcaggaaaatg

SEQ ID NO: 3223 - DNA, 16 bp, H. sapiens
aaaaggcaggagttgc

SEQ ID NO: 3224 - DNA, 16 bp, H. sapiens
aaaaggcagttcccct

SEQ ID NO: 3225 - DNA, 16 bp, H. sapiens
aaaaggcataaatatt

SEQ ID NO: 3226 - DNA, 16 bp, H. sapiens
aaaaggcattattcag

SEQ ID NO: 3227 - DNA, 16 bp, H. sapiens
aaaaggcatttctttt

SEQ ID NO: 3228 - DNA, 16 bp, H. sapiens
aaaaggcatttgataa

SEQ ID NO: 3229 - DNA, 16 bp, H. sapiens
aaaaggcatttgccaa

SEQ ID NO: 3230 - DNA, 16 bp, H. sapiens
aaaaggcattttaaaa

SEQ ID NO: 3231 - DNA, 16 bp, H. sapiens
aaaaggcattttaaat

SEQ ID NO: 3232 - DNA, 16 bp, H. sapiens
aaaaggcattttataa

SEQ ID NO: 3233 - DNA, 16 bp, H. sapiens
aaaaggcatttttaaa

SEQ ID NO: 3234 - DNA, 16 bp, H. sapiens
aaaaggccaggagcag

SEQ ID NO: 3235 - DNA, 19 bp, H. sapiens
aaaaggccatactgcccaa

SEQ ID NO: 3236 - DNA, 16 bp, H. sapiens
aaaaggcctttgacac

SEQ ID NO: 3237 - DNA, 16 bp, H. sapiens
aaaaggctatttttaa

SEQ ID NO: 3238 - DNA, 16 bp, H. sapiens
aaaaggctcaacatca

SEQ ID NO: 3239 - DNA, 16 bp, H. sapiens
aaaaggctgaccctcc

SEQ ID NO: 3240 - DNA, 16 bp, H. sapiens
aaaaggctgggattac

SEQ ID NO: 3241 - DNA, 16 bp, H. sapiens
aaaaggctgtcaccct

SEQ ID NO: 3242 - DNA, 16 bp, H. sapiens
aaaaggctttgataaa

SEQ ID NO: 3243 - DNA, 16 bp, H. sapiens
aaaaggcttttaaaaa

SEQ ID NO: 3244 - DNA, 16 bp, H. sapiens
aaaagggaaaactttt

SEQ ID NO: 3245 - DNA, 16 bp, H. sapiens
aaaagggaaacatttt

SEQ ID NO: 3246 - DNA, 16 bp, H. sapiens
aaaagggaaagaattt

SEQ ID NO: 3247 - DNA, 16 bp, H. sapiens
aaaagggaaagtttat

SEQ ID NO: 3248 - DNA, 16 bp, H. sapiens
aaaagggaaattacaa

SEQ ID NO: 3249 - DNA, 16 bp, H. sapiens
aaaagggaaattgagg

SEQ ID NO: 3250 - DNA, 16 bp, H. sapiens
aaaagggaacacttct

SEQ ID NO: 3251 - DNA, 16 bp, H. sapiens
aaaagggaaccctcac

SEQ ID NO: 3252 - DNA, 16 bp, H. sapiens
aaaagggaattttaaa

SEQ ID NO: 3253 - DNA, 16 bp, H. sapiens
aaaagggaattttaga

SEQ ID NO: 3254 - DNA, 16 bp, H. sapiens
aaaagggactttgtag

SEQ ID NO: 3255 - DNA, 16 bp, H. sapiens
aaaagggagaaatttg

SEQ ID NO: 3256 - DNA, 16 bp, H. sapiens
aaaagggatttttaaa

SEQ ID NO: 3257 - DNA, 16 bp, H. sapiens
aaaagggcagcaatga

SEQ ID NO: 3258 - DNA, 16 bp, H. sapiens
aaaagggcattttttt

SEQ ID NO: 3259 - DNA, 16 bp, H. sapiens
aaaagggccaggtgcg

SEQ ID NO: 3260 - DNA, 16 bp, H. sapiens
aaaaggggaaaatgtg

SEQ ID NO: 3261 - DNA, 16 bp, H. sapiens
aaaaggggctgggcac

SEQ ID NO: 3262 - DNA, 16 bp, H. sapiens
aaaagggggaaattgt

SEQ ID NO: 3263 - DNA, 16 bp, H. sapiens
aaaaggtaaaattcac

SEQ ID NO: 3264 - DNA, 16 bp, H. sapiens
aaaaggtacaaaattt

SEQ ID NO: 3265 - DNA, 16 bp, H. sapiens
aaaaggtacaaagttt

SEQ ID NO: 3266 - DNA, 16 bp, H. sapiens
aaaaggtacagtaaaa

SEQ ID NO: 3267 - DNA, 16 bp, H. sapiens
aaaaggtatttgaaaa

SEQ ID NO: 3268 - DNA, 16 bp, H. sapiens
aaaaggtcaagaaaca

SEQ ID NO: 3269 - DNA, 16 bp, H. sapiens
aaaaggtcagtggttg

SEQ ID NO: 3270 - DNA, 16 bp, H. sapiens
aaaaggtcttatctga

SEQ ID NO: 3271 - DNA, 16 bp, H. sapiens
aaaaggtgaaaatatt

SEQ ID NO: 3272 - DNA, 16 bp, H. sapiens
aaaaggtgaagcagag

SEQ ID NO: 3273 - DNA, 16 bp, H. sapiens
aaaaggtgctgtgctt

SEQ ID NO: 3274 - DNA, 16 bp, H. sapiens
aaaaggtgtgtgtgtg

SEQ ID NO: 3275 - DNA, 16 bp, H. sapiens
aaaaggtgttttaaat

SEQ ID NO: 3276 - DNA, 16 bp, H. sapiens
aaaaggttagaagaat

SEQ ID NO: 3277 - DNA, 16 bp, H. sapiens
aaaaggttagacaaat

SEQ ID NO: 3278 - DNA, 16 bp, H. sapiens
aaaaggttagaggaat

SEQ ID NO: 3279 - DNA, 16 bp, H. sapiens
aaaaggttagatgaat

SEQ ID NO: 3280 - DNA, 16 bp, H. sapiens
aaaaggttattaagaa

SEQ ID NO: 3281 - DNA, 16 bp, H. sapiens
aaaaggtttataagaa

SEQ ID NO: 3282 - DNA, 16 bp, H. sapiens
aaaaggtttatgaaaa

SEQ ID NO: 3283 - DNA, 16 bp, H. sapiens
aaaaggttttcatttt

SEQ ID NO: 3284 - DNA, 16 bp, H. sapiens
aaaaggtttttgcttt

SEQ ID NO: 3285 - DNA, 16 bp, H. sapiens
aaaaggttttttaaaa

SEQ ID NO: 3286 - DNA, 16 bp, H. sapiens
aaaaggttttttcttt

SEQ ID NO: 3287 - DNA, 16 bp, H. sapiens
aaaaggttttttttct

SEQ ID NO: 3288 - DNA, 16 bp, H. sapiens
aaaaggttttttttgt

SEQ ID NO: 3289 - DNA, 16 bp, H. sapiens
aaaagtaaaaacttta

SEQ ID NO: 3290 - DNA, 16 bp, H. sapiens
aaaagtaaaaatcatt

SEQ ID NO: 3291 - DNA, 16 bp, H. sapiens
aaaagtaaaacttgaa

SEQ ID NO: 3292 - DNA, 16 bp, H. sapiens
aaaagtaaaagttgct

SEQ ID NO: 3293 - DNA, 16 bp, H. sapiens
aaaagtaaaatgatct

SEQ ID NO: 3294 - DNA, 16 bp, H. sapiens
aaaagtaaacatgtaa

SEQ ID NO: 3295 - DNA, 16 bp, H. sapiens
aaaagtaaacttattt

SEQ ID NO: 3296 - DNA, 16 bp, H. sapiens
aaaagtaaactttctt

SEQ ID NO: 3297 - DNA, 16 bp, H. sapiens
aaaagtaaatataact

SEQ ID NO: 3298 - DNA, 16 bp, H. sapiens
aaaagtaaatgtttta

SEQ ID NO: 3299 - DNA, 16 bp, H. sapiens
aaaagtaaatgttttt

SEQ ID NO: 3300 - DNA, 16 bp, H. sapiens
aaaagtaaattgcctt

SEQ ID NO: 3301 - DNA, 16 bp, H. sapiens
aaaagtaaatttcaaa

SEQ ID NO: 3302 - DNA, 16 bp, H. sapiens
aaaagtaaatttcctt

SEQ ID NO: 3303 - DNA, 16 bp, H. sapiens
aaaagtaaattttact

SEQ ID NO: 3304 - DNA, 16 bp, H. sapiens
aaaagtaactgtggtt

SEQ ID NO: 3305 - DNA, 16 bp, H. sapiens
aaaagtaacttaaaat

SEQ ID NO: 3306 - DNA, 16 bp, H. sapiens
aaaagtaacttttttt

SEQ ID NO: 3307 - DNA, 16 bp, H. sapiens
aaaagtaagacctgaa

SEQ ID NO: 3308 - DNA, 16 bp, H. sapiens
aaaagtaagatatttt

SEQ ID NO: 3309 - DNA, 16 bp, H. sapiens
aaaagtaatcatttta

SEQ ID NO: 3310 - DNA, 16 bp, H. sapiens
aaaagtaatgcatgtt

SEQ ID NO: 3311 - DNA, 16 bp, H. sapiens
aaaagtaattttgact

SEQ ID NO: 3312 - DNA, 16 bp, H. sapiens
aaaagtacaaaacatt

SEQ ID NO: 3313 - DNA, 16 bp, H. sapiens
aaaagtacaaaatatt

SEQ ID NO: 3314 - DNA, 16 bp, H. sapiens
aaaagtacaaacatta

SEQ ID NO: 3315 - DNA, 16 bp, H. sapiens
aaaagtacagaaaatt

SEQ ID NO: 3316 - DNA, 16 bp, H. sapiens
aaaagtacatatattt

SEQ ID NO: 3317 - DNA, 16 bp, H. sapiens
aaaagtactttgtaaa

SEQ ID NO: 3318 - DNA, 16 bp, H. sapiens
aaaagtagaaaatatc

SEQ ID NO: 3319 - DNA, 16 bp, H. sapiens
aaaagtagaaatacca

SEQ ID NO: 3320 - DNA, 16 bp, H. sapiens
aaaagtagaagaagca

SEQ ID NO: 3321 - DNA, 16 bp, H. sapiens
aaaagtagagaagctg

SEQ ID NO: 3322 - DNA, 16 bp, H. sapiens
aaaagtagccaagcat

SEQ ID NO: 3323 - DNA, 16 bp, H. sapiens
aaaagtagctgagcat

SEQ ID NO: 3324 - DNA, 16 bp, H. sapiens
aaaagtaggtataaat

SEQ ID NO: 3325 - DNA, 16 bp, H. sapiens
aaaagtataaattcaa

SEQ ID NO: 3326 - DNA, 16 bp, H. sapiens
aaaagtatatatatac

SEQ ID NO: 3327 - DNA, 16 bp, H. sapiens
aaaagtatctgagaca

SEQ ID NO: 3328 - DNA, 16 bp, H. sapiens
aaaagtatctgtttat

SEQ ID NO: 3329 - DNA, 16 bp, H. sapiens
aaaagtatgcattttt

SEQ ID NO: 3330 - DNA, 16 bp, H. sapiens
aaaagtattcattgtt

SEQ ID NO: 3331 - DNA, 16 bp, H. sapiens
aaaagtatttcattta

SEQ ID NO: 3332 - DNA, 16 bp, H. sapiens
aaaagtattttcataa

SEQ ID NO: 3333 - DNA, 16 bp, H. sapiens
aaaagtcaaaagaatt

SEQ ID NO: 3334 - DNA, 16 bp, H. sapiens
aaaagtcaaagaagca

SEQ ID NO: 3335 - DNA, 16 bp, H. sapiens
aaaagtcaagccctgt

SEQ ID NO: 3336 - DNA, 16 bp, H. sapiens
aaaagtcaagctggga

SEQ ID NO: 3337 - DNA, 16 bp, H. sapiens
aaaagtcaaggaaata

SEQ ID NO: 3338 - DNA, 16 bp, H. sapiens
aaaagtcacatttttt

SEQ ID NO: 3339 - DNA, 16 bp, H. sapiens
aaaagtcactgaaaat

SEQ ID NO: 3340 - DNA, 16 bp, H. sapiens
aaaagtcattaaaata

SEQ ID NO: 3341 - DNA, 16 bp, H. sapiens
aaaagtcattaaaatt

SEQ ID NO: 3342 - DNA, 16 bp, H. sapiens
aaaagtcattattttt

SEQ ID NO: 3343 - DNA, 16 bp, H. sapiens
aaaagtcattcaagag

SEQ ID NO: 3344 - DNA, 16 bp, H. sapiens
aaaagtcattcagaaa

SEQ ID NO: 3345 - DNA, 16 bp, H. sapiens
aaaagtcattcaggag

SEQ ID NO: 3346 - DNA, 16 bp, H. sapiens
aaaagtcatttctttt

SEQ ID NO: 3347 - DNA, 16 bp, H. sapiens
aaaagtcattttattt

SEQ ID NO: 3348 - DNA, 16 bp, H. sapiens
aaaagtccaagatcaa

SEQ ID NO: 3349 - DNA, 16 bp, H. sapiens
aaaagtccattttaaa

SEQ ID NO: 3350 - DNA, 16 bp, H. sapiens
aaaagtcctttgaaaa

SEQ ID NO: 3351 - DNA, 16 bp, H. sapiens
aaaagtctaattttta

SEQ ID NO: 3352 - DNA, 16 bp, H. sapiens
aaaagtctatttaaaa

SEQ ID NO: 3353 - DNA, 16 bp, H. sapiens
aaaagtctattttatt

SEQ ID NO: 3354 - DNA, 16 bp, H. sapiens
aaaagtctcaaaaata

SEQ ID NO: 3355 - DNA, 16 bp, H. sapiens
aaaagtctcacttttg

SEQ ID NO: 3356 - DNA, 21 bp, H. sapiens
aaaagtctcaggatacaaaat

SEQ ID NO: 3357 - DNA, 16 bp, H. sapiens
aaaagtctccagagaa

SEQ ID NO: 3358 - DNA, 16 bp, H. sapiens
aaaagtctcccattat

SEQ ID NO: 3359 - DNA, 16 bp, H. sapiens
aaaagtctgagaaaca

SEQ ID NO: 3360 - DNA, 16 bp, H. sapiens
aaaagtctgctaccag

SEQ ID NO: 3361 - DNA, 16 bp, H. sapiens
aaaagtctgtgtgtgt

SEQ ID NO: 3362 - DNA, 16 bp, H. sapiens
aaaagtctgttgccag

SEQ ID NO: 3363 - DNA, 16 bp, H. sapiens
aaaagtcttcaaaaaa

SEQ ID NO: 3364 - DNA, 16 bp, H. sapiens
aaaagtcttcaaaatt

SEQ ID NO: 3365 - DNA, 16 bp, H. sapiens
aaaagtctttaagtat

SEQ ID NO: 3366 - DNA, 16 bp, H. sapiens
aaaagtctttgaaatg

SEQ ID NO: 3367 - DNA, 16 bp, H. sapiens
aaaagtcttttaaaaa

SEQ ID NO: 3368 - DNA, 16 bp, H. sapiens
aaaagtctttttcttt

SEQ ID NO: 3369 - DNA, 16 bp, H. sapiens
aaaagtgaaaatgtta

SEQ ID NO: 3370 - DNA, 16 bp, H. sapiens
aaaagtgaaagtattt

SEQ ID NO: 3371 - DNA, 16 bp, H. sapiens
aaaagtgaaatatttg

SEQ ID NO: 3372 - DNA, 16 bp, H. sapiens
aaaagtgaaatcatat

SEQ ID NO: 3373 - DNA, 16 bp, H. sapiens
aaaagtgaacaggagt

SEQ ID NO: 3374 - DNA, 16 bp, H. sapiens
aaaagtgaatatattt

SEQ ID NO: 3375 - DNA, 16 bp, H. sapiens
aaaagtgaatatcaca

SEQ ID NO: 3376 - DNA, 16 bp, H. sapiens
aaaagtgagaacatgt

SEQ ID NO: 3377 - DNA, 16 bp, H. sapiens
aaaagtgagtttggcc

SEQ ID NO: 3378 - DNA, 16 bp, H. sapiens
aaaagtgataaagggg

SEQ ID NO: 3379 - DNA, 16 bp, H. sapiens
aaaagtgattttgttt

SEQ ID NO: 3380 - DNA, 16 bp, H. sapiens
aaaagtgcatttaaaa

SEQ ID NO: 3381 - DNA, 16 bp, H. sapiens
aaaagtgctctaaaaa

SEQ ID NO: 3382 - DNA, 16 bp, H. sapiens
aaaagtgctggaatta

SEQ ID NO: 3383 - DNA, 16 bp, H. sapiens
aaaagtgctgggacta

SEQ ID NO: 3384 - DNA, 16 bp, H. sapiens
aaaagtgctgggatta

SEQ ID NO: 3385 - DNA, 16 bp, H. sapiens
aaaagtgctttgtaaa

SEQ ID NO: 3386 - DNA, 16 bp, H. sapiens
aaaagtgcttttaaaa

SEQ ID NO: 3387 - DNA, 16 bp, H. sapiens
aaaagtggaaacaaac

SEQ ID NO: 3388 - DNA, 16 bp, H. sapiens
aaaagtggaattactg

SEQ ID NO: 3389 - DNA, 16 bp, H. sapiens
aaaagtggaccagtca

SEQ ID NO: 3390 - DNA, 16 bp, H. sapiens
aaaagtggattttata

SEQ ID NO: 3391 - DNA, 16 bp, H. sapiens
aaaagtggctcatgcc

SEQ ID NO: 3392 - DNA, 16 bp, H. sapiens
aaaagtggcttttttt

SEQ ID NO: 3393 - DNA, 16 bp, H. sapiens
aaaagtgggccaggtg

SEQ ID NO: 3394 - DNA, 16 bp, H. sapiens
aaaagtgggctaagaa

SEQ ID NO: 3395 - DNA, 16 bp, H. sapiens
aaaagtgggtaaagga

SEQ ID NO: 3396 - DNA, 16 bp, H. sapiens
aaaagtgggtgaaaga

SEQ ID NO: 3397 - DNA, 16 bp, H. sapiens
aaaagtggtttaattg

SEQ ID NO: 3398 - DNA, 16 bp, H. sapiens
aaaagtggtttttttt

SEQ ID NO: 3399 - DNA, 16 bp, H. sapiens
aaaagtgtatatattt

SEQ ID NO: 3400 - DNA, 16 bp, H. sapiens
aaaagtgtctttaaaa

SEQ ID NO: 3401 - DNA, 16 bp, H. sapiens
aaaagtgtgtttcaaa

SEQ ID NO: 3402 - DNA, 16 bp, H. sapiens
aaaagtgtgtttggaa

SEQ ID NO: 3403 - DNA, 16 bp, H. sapiens
aaaagtgttattattt

SEQ ID NO: 3404 - DNA, 16 bp, H. sapiens
aaaagtgttccaattt

SEQ ID NO: 3405 - DNA, 16 bp, H. sapiens
aaaagtgtttgaaaaa

SEQ ID NO: 3406 - DNA, 16 bp, H. sapiens
aaaagtgttttataaa

SEQ ID NO: 3407 - DNA, 16 bp, H. sapiens
aaaagtgttttcattt

SEQ ID NO: 3408 - DNA, 16 bp, H. sapiens
aaaagtgttttttaaa

SEQ ID NO: 3409 - DNA, 16 bp, H. sapiens
aaaagttaaaacaatt

SEQ ID NO: 3410 - DNA, 16 bp, H. sapiens
aaaagttaaacaaagt

SEQ ID NO: 3411 - DNA, 16 bp, H. sapiens
aaaagttaacattttt

SEQ ID NO: 3412 - DNA, 16 bp, H. sapiens
aaaagttaagtgactt

SEQ ID NO: 3413 - DNA, 16 bp, H. sapiens
aaaagttaatactttt

SEQ ID NO: 3414 - DNA, 16 bp, H. sapiens
aaaagttaatcacttt

SEQ ID NO: 3415 - DNA, 16 bp, H. sapiens
aaaagttaattttctt

SEQ ID NO: 3416 - DNA, 16 bp, H. sapiens
aaaagttacagtaaaa

SEQ ID NO: 3417 - DNA, 16 bp, H. sapiens
aaaagttacttaaaaa

SEQ ID NO: 3418 - DNA, 16 bp, H. sapiens
aaaagttactttaaaa

SEQ ID NO: 3419 - DNA, 16 bp, H. sapiens
aaaagttagccaggtg

SEQ ID NO: 3420 - DNA, 16 bp, H. sapiens
aaaagttatatataca

SEQ ID NO: 3421 - DNA, 16 bp, H. sapiens
aaaagttatatttcta

SEQ ID NO: 3422 - DNA, 16 bp, H. sapiens
aaaagttatttacaaa

SEQ ID NO: 3423 - DNA, 16 bp, H. sapiens
aaaagttattttaact

SEQ ID NO: 3424 - DNA, 16 bp, H. sapiens
aaaagttattttatgt

SEQ ID NO: 3425 - DNA, 16 bp, H. sapiens
aaaagttattttccat

SEQ ID NO: 3426 - DNA, 16 bp, H. sapiens
aaaagttattttcctt

SEQ ID NO: 3427 - DNA, 16 bp, H. sapiens
aaaagttattttgaaa

SEQ ID NO: 3428 - DNA, 16 bp, H. sapiens
aaaagttatttttcaa

SEQ ID NO: 3429 - DNA, 16 bp, H. sapiens
aaaagttatttttcta

SEQ ID NO: 3430 - DNA, 16 bp, H. sapiens
aaaagttcagaaaata

SEQ ID NO: 3431 - DNA, 16 bp, H. sapiens
aaaagttcatggaaaa

SEQ ID NO: 3432 - DNA, 16 bp, H. sapiens
aaaagttcattgatat

SEQ ID NO: 3433 - DNA, 16 bp, H. sapiens
aaaagttcatttataa

SEQ ID NO: 3434 - DNA, 16 bp, H. sapiens
aaaagttcccttttct

SEQ ID NO: 3435 - DNA, 16 bp, H. sapiens
aaaagttctcaataaa

SEQ ID NO: 3436 - DNA, 16 bp, H. sapiens
aaaagttctcaatttt

SEQ ID NO: 3437 - DNA, 16 bp, H. sapiens
aaaagttctgaaattg

SEQ ID NO: 3438 - DNA, 16 bp, H. sapiens
aaaagttctgaagatg

SEQ ID NO: 3439 - DNA, 16 bp, H. sapiens
aaaagttctgggatta

SEQ ID NO: 3440 - DNA, 16 bp, H. sapiens
aaaagttgaaaaatgt

SEQ ID NO: 3441 - DNA, 16 bp, H. sapiens
aaaagttgaaagcatt

SEQ ID NO: 3442 - DNA, 16 bp, H. sapiens
aaaagttgaaagtttt

SEQ ID NO: 3443 - DNA, 16 bp, H. sapiens
aaaagttgaaatattt

SEQ ID NO: 3444 - DNA, 16 bp, H. sapiens
aaaagttgaaattatg

SEQ ID NO: 3445 - DNA, 16 bp, H. sapiens
aaaagttgaaatttat

SEQ ID NO: 3446 - DNA, 16 bp, H. sapiens
aaaagttgaagcaaaa

SEQ ID NO: 3447 - DNA, 16 bp, H. sapiens
aaaagttgaagttttt

SEQ ID NO: 3448 - DNA, 16 bp, H. sapiens
aaaagttgaatgaatt

SEQ ID NO: 3449 - DNA, 16 bp, H. sapiens
aaaagttgacaaaaat

SEQ ID NO: 3450 - DNA, 16 bp, H. sapiens
aaaagttgactttttt

SEQ ID NO: 3451 - DNA, 16 bp, H. sapiens
aaaagttgagaaaatt

SEQ ID NO: 3452 - DNA, 16 bp, H. sapiens
aaaagttgcaaaaata

SEQ ID NO: 3453 - DNA, 16 bp, H. sapiens
aaaagttgctttaaaa

SEQ ID NO: 3454 - DNA, 16 bp, H. sapiens
aaaagttggccctcca

SEQ ID NO: 3455 - DNA, 16 bp, H. sapiens
aaaagttgtatttctt

SEQ ID NO: 3456 - DNA, 16 bp, H. sapiens
aaaagttgttaaacaa

SEQ ID NO: 3457 - DNA, 16 bp, H. sapiens
aaaagttgttttaaaa

SEQ ID NO: 3458 - DNA, 16 bp, H. sapiens
aaaagttgtttttaaa

SEQ ID NO: 3459 - DNA, 16 bp, H. sapiens
aaaagtttaaaacaca

SEQ ID NO: 3460 - DNA, 16 bp, H. sapiens
aaaagtttaaaacttt

SEQ ID NO: 3461 - DNA, 16 bp, H. sapiens
aaaagtttatggaaaa

SEQ ID NO: 3462 - DNA, 16 bp, H. sapiens
aaaagtttattcaaga

SEQ ID NO: 3463 - DNA, 16 bp, H. sapiens
aaaagtttatttggct

SEQ ID NO: 3464 - DNA, 16 bp, H. sapiens
aaaagtttcttctttt

SEQ ID NO: 3465 - DNA, 16 bp, H. sapiens
aaaagtttcttttaaa

SEQ ID NO: 3466 - DNA, 16 bp, H. sapiens
aaaagtttgaaaaaca

SEQ ID NO: 3467 - DNA, 16 bp, H. sapiens
aaaagtttgaaaaatg

SEQ ID NO: 3468 - DNA, 16 bp, H. sapiens
aaaagtttgaaacatt

SEQ ID NO: 3469 - DNA, 16 bp, H. sapiens
aaaagtttgagaactg

SEQ ID NO: 3470 - DNA, 16 bp, H. sapiens
aaaagtttgagaagaa

SEQ ID NO: 3471 - DNA, 16 bp, H. sapiens
aaaagtttgctgccag

SEQ ID NO: 3472 - DNA, 16 bp, H. sapiens
aaaagtttggaaaata

SEQ ID NO: 3473 - DNA, 16 bp, H. sapiens
aaaagttttaaaaatc

SEQ ID NO: 3474 - DNA, 16 bp, H. sapiens
aaaagttttaaaacaa

SEQ ID NO: 3475 - DNA, 16 bp, H. sapiens
aaaagttttacaatct

SEQ ID NO: 3476 - DNA, 16 bp, H. sapiens
aaaagttttagaagaa

SEQ ID NO: 3477 - DNA, 16 bp, H. sapiens
aaaagttttattttct

SEQ ID NO: 3478 - DNA, 16 bp, H. sapiens
aaaagttttcagaaaa

SEQ ID NO: 3479 - DNA, 16 bp, H. sapiens
aaaagttttccaaaat

SEQ ID NO: 3480 - DNA, 16 bp, H. sapiens
aaaagttttccaaagt

SEQ ID NO: 3481 - DNA, 16 bp, H. sapiens
aaaagttttcttattt

SEQ ID NO: 3482 - DNA, 16 bp, H. sapiens
aaaagttttcttgtgc

SEQ ID NO: 3483 - DNA, 16 bp, H. sapiens
aaaagttttgaaaaca

SEQ ID NO: 3484 - DNA, 16 bp, H. sapiens
aaaagttttgaaattt

SEQ ID NO: 3485 - DNA, 16 bp, H. sapiens
aaaagttttgccacat

SEQ ID NO: 3486 - DNA, 16 bp, H. sapiens
aaaagttttggaaaat

SEQ ID NO: 3487 - DNA, 16 bp, H. sapiens
aaaagttttgtgtttt

SEQ ID NO: 3488 - DNA, 16 bp, H. sapiens
aaaagtttttaaaact

SEQ ID NO: 3489 - DNA, 16 bp, H. sapiens
aaaagtttttaaaagt

SEQ ID NO: 3490 - DNA, 16 bp, H. sapiens
aaaagtttttaaatca

SEQ ID NO: 3491 - DNA, 16 bp, H. sapiens
aaaagttttttctttc

SEQ ID NO: 3492 - DNA, 16 bp, H. sapiens
aaaagttttttgtttg

SEQ ID NO: 3493 - DNA, 16 bp, H. sapiens
aaaagtttttttaaag

SEQ ID NO: 3494 - DNA, 16 bp, H. sapiens
aaaataaaaaagctgg

SEQ ID NO: 3495 - DNA, 16 bp, H. sapiens
aaaataaaaacccttt

SEQ ID NO: 3496 - DNA, 16 bp, H. sapiens
aaaataaaaactggag

SEQ ID NO: 3497 - DNA, 16 bp, H. sapiens
aaaataaaaagcatct

SEQ ID NO: 3498 - DNA, 16 bp, H. sapiens
aaaataaaaagcctga

SEQ ID NO: 3499 - DNA, 16 bp, H. sapiens
aaaataaaaagctttt

SEQ ID NO: 3500 - DNA, 16 bp, H. sapiens
aaaataaaaagtcact

SEQ ID NO: 3501 - DNA, 16 bp, H. sapiens
aaaataaaaagtcttt

SEQ ID NO: 3502 - DNA, 16 bp, H. sapiens
aaaataaaaatcttcc

SEQ ID NO: 3503 - DNA, 16 bp, H. sapiens
aaaataaaaatggcag

SEQ ID NO: 3504 - DNA, 16 bp, H. sapiens
aaaataaaaatgttca

SEQ ID NO: 3505 - DNA, 16 bp, H. sapiens
aaaataaaaattggct

SEQ ID NO: 3506 - DNA, 16 bp, H. sapiens
aaaataaaacagatgt

SEQ ID NO: 3507 - DNA, 16 bp, H. sapiens
aaaataaaactccaga

SEQ ID NO: 3508 - DNA, 16 bp, H. sapiens
aaaataaaactctttt

SEQ ID NO: 3509 - DNA, 16 bp, H. sapiens
aaaataaaactgattt

SEQ ID NO: 3510 - DNA, 16 bp, H. sapiens
aaaataaaactgcaat

SEQ ID NO: 3511 - DNA, 16 bp, H. sapiens
aaaataaaacttcttt

SEQ ID NO: 3512 - DNA, 16 bp, H. sapiens
aaaataaaacttgaag

SEQ ID NO: 3513 - DNA, 16 bp, H. sapiens
aaaataaaacttgttt

SEQ ID NO: 3514 - DNA, 16 bp, H. sapiens
aaaataaaagaagctt

SEQ ID NO: 3515 - DNA, 16 bp, H. sapiens
aaaataaaagcaatct

SEQ ID NO: 3516 - DNA, 16 bp, H. sapiens
aaaataaaagcaatgt

SEQ ID NO: 3517 - DNA, 16 bp, H. sapiens
aaaataaaagctttct

SEQ ID NO: 3518 - DNA, 16 bp, H. sapiens
aaaataaaagctttgt

SEQ ID NO: 3519 - DNA, 16 bp, H. sapiens
aaaataaaagtgacat

SEQ ID NO: 3520 - DNA, 16 bp, H. sapiens
aaaataaaataacttg

SEQ ID NO: 3521 - DNA, 16 bp, H. sapiens
aaaataaaatactatg

SEQ ID NO: 3522 - DNA, 16 bp, H. sapiens
aaaataaaatattgct

SEQ ID NO: 3523 - DNA, 16 bp, H. sapiens
aaaataaaatcctttt

SEQ ID NO: 3524 - DNA, 16 bp, H. sapiens
aaaataaaatctcaag

SEQ ID NO: 3525 - DNA, 16 bp, H. sapiens
aaaataaaatctgctt

SEQ ID NO: 3526 - DNA, 16 bp, H. sapiens
aaaataaaatctttct

SEQ ID NO: 3527 - DNA, 16 bp, H. sapiens
aaaataaaatgacagg

SEQ ID NO: 3528 - DNA, 16 bp, H. sapiens
aaaataaaatgacatg

SEQ ID NO: 3529 - DNA, 16 bp, H. sapiens
aaaataaaatgcattt

SEQ ID NO: 3530 - DNA, 16 bp, H. sapiens
aaaataaaatgggatt

SEQ ID NO: 3531 - DNA, 16 bp, H. sapiens
aaaataaaatgttctg

SEQ ID NO: 3532 - DNA, 16 bp, H. sapiens
aaaataaaatgtttct

SEQ ID NO: 3533 - DNA, 16 bp, H. sapiens
aaaataaaattatcag

SEQ ID NO: 3534 - DNA, 16 bp, H. sapiens
aaaataaaattctgaa

SEQ ID NO: 3535 - DNA, 16 bp, H. sapiens
aaaataaaattctgtg

SEQ ID NO: 3536 - DNA, 16 bp, H. sapiens
aaaataaaattggctg

SEQ ID NO: 3537 - DNA, 16 bp, H. sapiens
aaaataaaattgtttc

SEQ ID NO: 3538 - DNA, 16 bp, H. sapiens
aaaataaaattttcct

SEQ ID NO: 3539 - DNA, 16 bp, H. sapiens
aaaataaacagtattt

SEQ ID NO: 3540 - DNA, 16 bp, H. sapiens
aaaataaacatgtatt

SEQ ID NO: 3541 - DNA, 16 bp, H. sapiens
aaaataaacattcttt

SEQ ID NO: 3542 - DNA, 16 bp, H. sapiens
aaaataaacattgttt

SEQ ID NO: 3543 - DNA, 16 bp, H. sapiens
aaaataaacatttcag

SEQ ID NO: 3544 - DNA, 16 bp, H. sapiens
aaaataaacatttgga

SEQ ID NO: 3545 - DNA, 16 bp, H. sapiens
aaaataaacctttttt

SEQ ID NO: 3546 - DNA, 16 bp, H. sapiens
aaaataaactcagaat

SEQ ID NO: 3547 - DNA, 16 bp, H. sapiens
aaaataaactgaactt

SEQ ID NO: 3548 - DNA, 16 bp, H. sapiens
aaaataaacttcattt

SEQ ID NO: 3549 - DNA, 16 bp, H. sapiens
aaaataaacttggaaa

SEQ ID NO: 3550 - DNA, 16 bp, H. sapiens
aaaataaactttattc

SEQ ID NO: 3551 - DNA, 16 bp, H. sapiens
aaaataaactttgaaa

SEQ ID NO: 3552 - DNA, 16 bp, H. sapiens
aaaataaactttgatt

SEQ ID NO: 3553 - DNA, 16 bp, H. sapiens
aaaataaagacacttt

SEQ ID NO: 3554 - DNA, 16 bp, H. sapiens
aaaataaagacatttt

SEQ ID NO: 3555 - DNA, 16 bp, H. sapiens
aaaataaagatacttt

SEQ ID NO: 3556 - DNA, 16 bp, H. sapiens
aaaataaagatatctt

SEQ ID NO: 3557 - DNA, 16 bp, H. sapiens
aaaataaagatgttct

SEQ ID NO: 3558 - DNA, 16 bp, H. sapiens
aaaataaagcaaattt

SEQ ID NO: 3559 - DNA, 16 bp, H. sapiens
aaaataaagcaatgag

SEQ ID NO: 3560 - DNA, 16 bp, H. sapiens
aaaataaagcagtgaa

SEQ ID NO: 3561 - DNA, 16 bp, H. sapiens
aaaataaagcattcta

SEQ ID NO: 3562 - DNA, 16 bp, H. sapiens
aaaataaagccaggaa

SEQ ID NO: 3563 - DNA, 16 bp, H. sapiens
aaaataaagcctattt

SEQ ID NO: 3564 - DNA, 16 bp, H. sapiens
aaaataaagctaaatt

SEQ ID NO: 3565 - DNA, 16 bp, H. sapiens
aaaataaagctgttat

SEQ ID NO: 3566 - DNA, 16 bp, H. sapiens
aaaataaaggcatatt

SEQ ID NO: 3567 - DNA, 16 bp, H. sapiens
aaaataaagggttgga

SEQ ID NO: 3568 - DNA, 16 bp, H. sapiens
aaaataaagtactttt

SEQ ID NO: 3569 - DNA, 16 bp, H. sapiens
aaaataaagtcctttt

SEQ ID NO: 3570 - DNA, 16 bp, H. sapiens
aaaataaagtctgtta

SEQ ID NO: 3571 - DNA, 16 bp, H. sapiens
aaaataaagtgatgga

SEQ ID NO: 3572 - DNA, 16 bp, H. sapiens
aaaataaagtgtattc

SEQ ID NO: 3573 - DNA, 16 bp, H. sapiens
aaaataaagttctaaa

SEQ ID NO: 3574 - DNA, 16 bp, H. sapiens
aaaataaagttcttca

SEQ ID NO: 3575 - DNA, 16 bp, H. sapiens
aaaataaagtttacaa

SEQ ID NO: 3576 - DNA, 16 bp, H. sapiens
aaaataaagtttcaaa

SEQ ID NO: 3577 - DNA, 16 bp, H. sapiens
aaaataaagtttcttt

SEQ ID NO: 3578 - DNA, 16 bp, H. sapiens
aaaataaagttttgtt

SEQ ID NO: 3579 - DNA, 16 bp, H. sapiens
aaaataaatacagtga

SEQ ID NO: 3580 - DNA, 16 bp, H. sapiens
aaaataaatactgcat

SEQ ID NO: 3581 - DNA, 16 bp, H. sapiens
aaaataaatactttgt

SEQ ID NO: 3582 - DNA, 16 bp, H. sapiens
aaaataaatatagcca

SEQ ID NO: 3583 - DNA, 16 bp, H. sapiens
aaaataaatatcagtt

SEQ ID NO: 3584 - DNA, 16 bp, H. sapiens
aaaataaatattgtct

SEQ ID NO: 3585 - DNA, 16 bp, H. sapiens
aaaataaatcatcttt

SEQ ID NO: 3586 - DNA, 16 bp, H. sapiens
aaaataaatcattctt

SEQ ID NO: 3587 - DNA, 16 bp, H. sapiens
aaaataaatcattgtt

SEQ ID NO: 3588 - DNA, 16 bp, H. sapiens
aaaataaatctgtctt

SEQ ID NO: 3589 - DNA, 16 bp, H. sapiens
aaaataaatgagctat

SEQ ID NO: 3590 - DNA, 16 bp, H. sapiens
aaaataaatgcaattt

SEQ ID NO: 3591 - DNA, 16 bp, H. sapiens
aaaataaatgcatttg

SEQ ID NO: 3592 - DNA, 16 bp, H. sapiens
aaaataaatgccattt

SEQ ID NO: 3593 - DNA, 16 bp, H. sapiens
aaaataaatgctttaa

SEQ ID NO: 3594 - DNA, 16 bp, H. sapiens
aaaataaatgcttttt

SEQ ID NO: 3595 - DNA, 16 bp, H. sapiens
aaaataaatggatttt

SEQ ID NO: 3596 - DNA, 16 bp, H. sapiens
aaaataaatgggaatt

SEQ ID NO: 3597 - DNA, 16 bp, H. sapiens
aaaataaatgtttact

SEQ ID NO: 3598 - DNA, 16 bp, H. sapiens
aaaataaattacccag

SEQ ID NO: 3599 - DNA, 16 bp, H. sapiens
aaaataaattagctgg

SEQ ID NO: 3600 - DNA, 16 bp, H. sapiens
aaaataaattatctga

SEQ ID NO: 3601 - DNA, 16 bp, H. sapiens
aaaataaattatggtt

SEQ ID NO: 3602 - DNA, 16 bp, H. sapiens
aaaataaattcatgat

SEQ ID NO: 3603 - DNA, 16 bp, H. sapiens
aaaataaatttctgaa

SEQ ID NO: 3604 - DNA, 16 bp, H. sapiens
aaaataaatttgccaa

SEQ ID NO: 3605 - DNA, 16 bp, H. sapiens
aaaataaattttgttg

SEQ ID NO: 3606 - DNA, 16 bp, H. sapiens
aaaataacaaatctgg

SEQ ID NO: 3607 - DNA, 16 bp, H. sapiens
aaaataacaaatgtta

SEQ ID NO: 3608 - DNA, 16 bp, H. sapiens
aaaataacacaaatgg

SEQ ID NO: 3609 - DNA, 16 bp, H. sapiens
aaaataacagatgctg

SEQ ID NO: 3610 - DNA, 16 bp, H. sapiens
aaaataacagtaaatt

SEQ ID NO: 3611 - DNA, 16 bp, H. sapiens
aaaataacagtttttt

SEQ ID NO: 3612 - DNA, 16 bp, H. sapiens
aaaataacatttcaga

SEQ ID NO: 3613 - DNA, 16 bp, H. sapiens
aaaataacatttcttt

SEQ ID NO: 3614 - DNA, 16 bp, H. sapiens
aaaataaccagttaac

SEQ ID NO: 3615 - DNA, 16 bp, H. sapiens
aaaataaccattttct

SEQ ID NO: 3616 - DNA, 16 bp, H. sapiens
aaaataactagtgttg

SEQ ID NO: 3617 - DNA, 16 bp, H. sapiens
aaaataactcaatttt

SEQ ID NO: 3618 - DNA, 16 bp, H. sapiens
aaaataactgattaat

SEQ ID NO: 3619 - DNA, 16 bp, H. sapiens
aaaataactgttttaa

SEQ ID NO: 3620 - DNA, 16 bp, H. sapiens
aaaataacttgttttt

SEQ ID NO: 3621 - DNA, 16 bp, H. sapiens
aaaataactttaaatg

SEQ ID NO: 3622 - DNA, 16 bp, H. sapiens
aaaataactttgaaaa

SEQ ID NO: 3623 - DNA, 16 bp, H. sapiens
aaaataactttggaaa

SEQ ID NO: 3624 - DNA, 16 bp, H. sapiens
aaaataagaaattagc

SEQ ID NO: 3625 - DNA, 16 bp, H. sapiens
aaaataagaatttcaa

SEQ ID NO: 3626 - DNA, 16 bp, H. sapiens
aaaataagacccaacc

SEQ ID NO: 3627 - DNA, 16 bp, H. sapiens
aaaataagacccaact

SEQ ID NO: 3628 - DNA, 16 bp, H. sapiens
aaaataagactttttt

SEQ ID NO: 3629 - DNA, 16 bp, H. sapiens
aaaataagagaggaca

SEQ ID NO: 3630 - DNA, 16 bp, H. sapiens
aaaataagagcaaatt

SEQ ID NO: 3631 - DNA, 16 bp, H. sapiens
aaaataagattttcat

SEQ ID NO: 3632 - DNA, 16 bp, H. sapiens
aaaataagcaaatgtt

SEQ ID NO: 3633 - DNA, 16 bp, H. sapiens
aaaataagctcagaaa

SEQ ID NO: 3634 - DNA, 16 bp, H. sapiens
aaaataagctttagtc

SEQ ID NO: 3635 - DNA, 16 bp, H. sapiens
aaaataagctttataa

SEQ ID NO: 3636 - DNA, 16 bp, H. sapiens
aaaataaggaaattct

SEQ ID NO: 3637 - DNA, 16 bp, H. sapiens
aaaataaggaattttt

SEQ ID NO: 3638 - DNA, 16 bp, H. sapiens
aaaataagggttattt

SEQ ID NO: 3639 - DNA, 16 bp, H. sapiens
aaaataaggttttata

SEQ ID NO: 3640 - DNA, 16 bp, H. sapiens
aaaataagtacatata

SEQ ID NO: 3641 - DNA, 16 bp, H. sapiens
aaaataagtatttcca

SEQ ID NO: 3642 - DNA, 16 bp, H. sapiens
aaaataagtatttgtt

SEQ ID NO: 3643 - DNA, 16 bp, H. sapiens
aaaataagtctatttt

SEQ ID NO: 3644 - DNA, 16 bp, H. sapiens
aaaataagtctcaaca

SEQ ID NO: 3645 - DNA, 16 bp, H. sapiens
aaaataagtcttaaaa

SEQ ID NO: 3646 - DNA, 16 bp, H. sapiens
aaaataagtgcaaaat

SEQ ID NO: 3647 - DNA, 16 bp, H. sapiens
aaaataagtgcatttt

SEQ ID NO: 3648 - DNA, 16 bp, H. sapiens
aaaataagtgtgtgtg

SEQ ID NO: 3649 - DNA, 16 bp, H. sapiens
aaaataagtgttttat

SEQ ID NO: 3650 - DNA, 16 bp, H. sapiens
aaaataagttgcagaa

SEQ ID NO: 3651 - DNA, 16 bp, H. sapiens
aaaataagtttctgtt

SEQ ID NO: 3652 - DNA, 16 bp, H. sapiens
aaaataataaagcatt

SEQ ID NO: 3653 - DNA, 16 bp, H. sapiens
aaaataataaatgctt

SEQ ID NO: 3654 - DNA, 16 bp, H. sapiens
aaaataataattgcaa

SEQ ID NO: 3655 - DNA, 16 bp, H. sapiens
aaaataatacagatat

SEQ ID NO: 3656 - DNA, 16 bp, H. sapiens
aaaataatacatgatt

SEQ ID NO: 3657 - DNA, 16 bp, H. sapiens
aaaataatagacattt

SEQ ID NO: 3658 - DNA, 16 bp, H. sapiens
aaaataatagctataa

SEQ ID NO: 3659 - DNA, 16 bp, H. sapiens
aaaataatagtttctt

SEQ ID NO: 3660 - DNA, 16 bp, H. sapiens
aaaataatcaaatgga

SEQ ID NO: 3661 - DNA, 16 bp, H. sapiens
aaaataatcacatttt

SEQ ID NO: 3662 - DNA, 16 bp, H. sapiens
aaaataatcattgaaa

SEQ ID NO: 3663 - DNA, 16 bp, H. sapiens
aaaataatcattttct

SEQ ID NO: 3664 - DNA, 16 bp, H. sapiens
aaaataatctcctttg

SEQ ID NO: 3665 - DNA, 16 bp, H. sapiens
aaaataatctgaaaat

SEQ ID NO: 3666 - DNA, 16 bp, H. sapiens
aaaataatcttagaaa

SEQ ID NO: 3667 - DNA, 16 bp, H. sapiens
aaaataatgaaacatt

SEQ ID NO: 3668 - DNA, 16 bp, H. sapiens
aaaataatgaaatact

SEQ ID NO: 3669 - DNA, 16 bp, H. sapiens
aaaataatgaaatcca

SEQ ID NO: 3670 - DNA, 16 bp, H. sapiens
aaaataatgaatacat

SEQ ID NO: 3671 - DNA, 16 bp, H. sapiens
aaaataatgacataat

SEQ ID NO: 3672 - DNA, 16 bp, H. sapiens
aaaataatgacttttt

SEQ ID NO: 3673 - DNA, 16 bp, H. sapiens
aaaataatgagtcatc

SEQ ID NO: 3674 - DNA, 16 bp, H. sapiens
aaaataatgatagcaa

SEQ ID NO: 3675 - DNA, 16 bp, H. sapiens
aaaataatgcaaatgt

SEQ ID NO: 3676 - DNA, 16 bp, H. sapiens
aaaataatgctgctat

SEQ ID NO: 3677 - DNA, 16 bp, H. sapiens
aaaataatgctgtatt

SEQ ID NO: 3678 - DNA, 16 bp, H. sapiens
aaaataatggcaataa

SEQ ID NO: 3679 - DNA, 16 bp, H. sapiens
aaaataatggcataaa

SEQ ID NO: 3680 - DNA, 16 bp, H. sapiens
aaaataatgtaattgt

SEQ ID NO: 3681 - DNA, 16 bp, H. sapiens
aaaataatgtactttt

SEQ ID NO: 3682 - DNA, 16 bp, H. sapiens
aaaataatgtattatg

SEQ ID NO: 3683 - DNA, 16 bp, H. sapiens
aaaataatgtggtttt

SEQ ID NO: 3684 - DNA, 16 bp, H. sapiens
aaaataatgttattct

SEQ ID NO: 3685 - DNA, 16 bp, H. sapiens
aaaataatgtttcaga

SEQ ID NO: 3686 - DNA, 16 bp, H. sapiens
aaaataattatagcta

SEQ ID NO: 3687 - DNA, 16 bp, H. sapiens
aaaataattcagaaat

SEQ ID NO: 3688 - DNA, 16 bp, H. sapiens
aaaataattcatgtga

SEQ ID NO: 3689 - DNA, 16 bp, H. sapiens
aaaataattcattgtt

SEQ ID NO: 3690 - DNA, 16 bp, H. sapiens
aaaataattccactta

SEQ ID NO: 3691 - DNA, 16 bp, H. sapiens
aaaataattccattta

SEQ ID NO: 3692 - DNA, 16 bp, H. sapiens
aaaataattctgtaaa

SEQ ID NO: 3693 - DNA, 16 bp, H. sapiens
aaaataattcttgttt

SEQ ID NO: 3694 - DNA, 16 bp, H. sapiens
aaaataattgaaagca

SEQ ID NO: 3695 - DNA, 16 bp, H. sapiens
aaaataattgatgaag

SEQ ID NO: 3696 - DNA, 16 bp, H. sapiens
aaaataattgtgtttt

SEQ ID NO: 3697 - DNA, 16 bp, H. sapiens
aaaataatttacattc

SEQ ID NO: 3698 - DNA, 16 bp, H. sapiens
aaaataatttcacatt

SEQ ID NO: 3699 - DNA, 16 bp, H. sapiens
aaaataatttcacttt

SEQ ID NO: 3700 - DNA, 16 bp, H. sapiens
aaaataatttcccttt

SEQ ID NO: 3701 - DNA, 16 bp, H. sapiens
aaaataatttctgcat

SEQ ID NO: 3702 - DNA, 16 bp, H. sapiens
aaaataatttctggaa

SEQ ID NO: 3703 - DNA, 16 bp, H. sapiens
aaaataatttgccaaa

SEQ ID NO: 3704 - DNA, 16 bp, H. sapiens
aaaataattttcagat

SEQ ID NO: 3705 - DNA, 16 bp, H. sapiens
aaaataattttcctaa

SEQ ID NO: 3706 - DNA, 16 bp, H. sapiens
aaaataattttctgtt

SEQ ID NO: 3707 - DNA, 16 bp, H. sapiens
aaaataattttgagtt

SEQ ID NO: 3708 - DNA, 16 bp, H. sapiens
aaaataattttgtgat

SEQ ID NO: 3709 - DNA, 16 bp, H. sapiens
aaaataatttttagag

SEQ ID NO: 3710 - DNA, 16 bp, H. sapiens
aaaataatttttgtgt

SEQ ID NO: 3711 - DNA, 16 bp, H. sapiens
aaaataattttttcct

SEQ ID NO: 3712 - DNA, 18 bp, H. sapiens
aaaatacaaaaattggcc

SEQ ID NO: 3713 - DNA, 16 bp, H. sapiens
aaaatacaaaagcatt

SEQ ID NO: 3714 - DNA, 16 bp, H. sapiens
aaaatacaaaagttag

SEQ ID NO: 3715 - DNA, 16 bp, H. sapiens
aaaatacaaaagttca

SEQ ID NO: 3716 - DNA, 16 bp, H. sapiens
aaaatacaaaatgtct

SEQ ID NO: 3717 - DNA, 21 bp, H. sapiens
aaaatacaaaattagcagggc

SEQ ID NO: 3718 - DNA, 16 bp, H. sapiens
aaaatacaaagtattt

SEQ ID NO: 3719 - DNA, 16 bp, H. sapiens
aaaatacaaatgcata

SEQ ID NO: 3720 - DNA, 16 bp, H. sapiens
aaaatacaaatgtctt

SEQ ID NO: 3721 - DNA, 16 bp, H. sapiens
aaaatacaaatttgaa

SEQ ID NO: 3722 - DNA, 16 bp, H. sapiens
aaaatacaagaattac

SEQ ID NO: 3723 - DNA, 18 bp, H. sapiens
aaaatacaagaattagcc

SEQ ID NO: 3724 - DNA, 16 bp, H. sapiens
aaaatacaagataatt

SEQ ID NO: 3725 - DNA, 16 bp, H. sapiens
aaaatacaagttagct

SEQ ID NO: 3726 - DNA, 16 bp, H. sapiens
aaaatacaagttttta

SEQ ID NO: 3727 - DNA, 16 bp, H. sapiens
aaaatacaatgatggg

SEQ ID NO: 3728 - DNA, 16 bp, H. sapiens
aaaatacaatgttttt

SEQ ID NO: 3729 - DNA, 16 bp, H. sapiens
aaaatacacattgaaa

SEQ ID NO: 3730 - DNA, 16 bp, H. sapiens
aaaatacacatttttt

SEQ ID NO: 3731 - DNA, 16 bp, H. sapiens
aaaatacactgtttta

SEQ ID NO: 3732 - DNA, 16 bp, H. sapiens
aaaatacactttgaaa

SEQ ID NO: 3733 - DNA, 16 bp, H. sapiens
aaaatacactttttaa

SEQ ID NO: 3734 - DNA, 16 bp, H. sapiens
aaaatacagaaattta

SEQ ID NO: 3735 - DNA, 16 bp, H. sapiens
aaaatacagaacattt

SEQ ID NO: 3736 - DNA, 16 bp, H. sapiens
aaaatacagaagaatt

SEQ ID NO: 3737 - DNA, 16 bp, H. sapiens
aaaatacagaatttag

SEQ ID NO: 3738 - DNA, 16 bp, H. sapiens
aaaatacagacatttt

SEQ ID NO: 3739 - DNA, 16 bp, H. sapiens
aaaatacagatgcctg

SEQ ID NO: 3740 - DNA, 16 bp, H. sapiens
aaaatacagattctga

SEQ ID NO: 3741 - DNA, 16 bp, H. sapiens
aaaatacagatttctg

SEQ ID NO: 3742 - DNA, 16 bp, H. sapiens
aaaatacagatttttt

SEQ ID NO: 3743 - DNA, 16 bp, H. sapiens
aaaatacagtcagagg

SEQ ID NO: 3744 - DNA, 16 bp, H. sapiens
aaaatacagttaaaat

SEQ ID NO: 3745 - DNA, 16 bp, H. sapiens
aaaatacagttacata

SEQ ID NO: 3746 - DNA, 16 bp, H. sapiens
aaaatacatactttta

SEQ ID NO: 3747 - DNA, 16 bp, H. sapiens
aaaatacatagaaatt

SEQ ID NO: 3748 - DNA, 16 bp, H. sapiens
aaaatacatgaacaga

SEQ ID NO: 3749 - DNA, 16 bp, H. sapiens
aaaatacatggaaatt

SEQ ID NO: 3750 - DNA, 16 bp, H. sapiens
aaaatacatgtaaaat

SEQ ID NO: 3751 - DNA, 16 bp, H. sapiens
aaaatacatgtattat

SEQ ID NO: 3752 - DNA, 16 bp, H. sapiens
aaaatacatgtgacaa

SEQ ID NO: 3753 - DNA, 16 bp, H. sapiens
aaaatacatgtttttg

SEQ ID NO: 3754 - DNA, 16 bp, H. sapiens
aaaatacattatgaaa

SEQ ID NO: 3755 - DNA, 16 bp, H. sapiens
aaaatacattcatttc

SEQ ID NO: 3756 - DNA, 16 bp, H. sapiens
aaaatacattcttttt

SEQ ID NO: 3757 - DNA, 16 bp, H. sapiens
aaaatacattgttatt

SEQ ID NO: 3758 - DNA, 16 bp, H. sapiens
aaaatacatttaaaga

SEQ ID NO: 3759 - DNA, 16 bp, H. sapiens
aaaatacatttagaaa

SEQ ID NO: 3760 - DNA, 16 bp, H. sapiens
aaaatacatttctatt

SEQ ID NO: 3761 - DNA, 16 bp, H. sapiens
aaaatacatttctttg

SEQ ID NO: 3762 - DNA, 16 bp, H. sapiens
aaaatacattttcttt

SEQ ID NO: 3763 - DNA, 16 bp, H. sapiens
aaaatacattttgaaa

SEQ ID NO: 3764 - DNA, 16 bp, H. sapiens
aaaatacattttttgt

SEQ ID NO: 3765 - DNA, 16 bp, H. sapiens
aaaatacatttttttc

SEQ ID NO: 3766 - DNA, 16 bp, H. sapiens
aaaataccaaggaatc

SEQ ID NO: 3767 - DNA, 16 bp, H. sapiens
aaaataccacagattg

SEQ ID NO: 3768 - DNA, 16 bp, H. sapiens
aaaataccatcattat

SEQ ID NO: 3769 - DNA, 16 bp, H. sapiens
aaaataccatttacaa

SEQ ID NO: 3770 - DNA, 16 bp, H. sapiens
aaaataccatttttaa

SEQ ID NO: 3771 - DNA, 16 bp, H. sapiens
aaaatacccagaaaat

SEQ ID NO: 3772 - DNA, 16 bp, H. sapiens
aaaatacctaagaata

SEQ ID NO: 3773 - DNA, 16 bp, H. sapiens
aaaatacctaggaata

SEQ ID NO: 3774 - DNA, 16 bp, H. sapiens
aaaatacctctttatt

SEQ ID NO: 3775 - DNA, 16 bp, H. sapiens
aaaataccttcacaag

SEQ ID NO: 3776 - DNA, 16 bp, H. sapiens
aaaatacctttatttc

SEQ ID NO: 3777 - DNA, 16 bp, H. sapiens
aaaatactactgctca

SEQ ID NO: 3778 - DNA, 16 bp, H. sapiens
aaaatactaggaaact

SEQ ID NO: 3779 - DNA, 16 bp, H. sapiens
aaaatactcaggaata

SEQ ID NO: 3780 - DNA, 16 bp, H. sapiens
aaaatactcatttcta

SEQ ID NO: 3781 - DNA, 16 bp, H. sapiens
aaaatactgaaagaga

SEQ ID NO: 3782 - DNA, 16 bp, H. sapiens
aaaatactgaaggaaa

SEQ ID NO: 3783 - DNA, 16 bp, H. sapiens
aaaatactgaatatat

SEQ ID NO: 3784 - DNA, 16 bp, H. sapiens
aaaatactggataaaa

SEQ ID NO: 3785 - DNA, 16 bp, H. sapiens
aaaatactggcaaatc

SEQ ID NO: 3786 - DNA, 16 bp, H. sapiens
aaaatactgggtagaa

SEQ ID NO: 3787 - DNA, 16 bp, H. sapiens
aaaatactgtttttca

SEQ ID NO: 3788 - DNA, 16 bp, H. sapiens
aaaatacttagagaaa

SEQ ID NO: 3789 - DNA, 16 bp, H. sapiens
aaaatacttaggaaca

SEQ ID NO: 3790 - DNA, 16 bp, H. sapiens
aaaatacttgaagaaa

SEQ ID NO: 3791 - DNA, 16 bp, H. sapiens
aaaatacttgagaaat

SEQ ID NO: 3792 - DNA, 16 bp, H. sapiens
aaaatacttgcaaata

SEQ ID NO: 3793 - DNA, 16 bp, H. sapiens
aaaatacttggaaata

SEQ ID NO: 3794 - DNA, 16 bp, H. sapiens
aaaatacttggaaatc

SEQ ID NO: 3795 - DNA, 16 bp, H. sapiens
aaaatacttgtaaatt

SEQ ID NO: 3796 - DNA, 16 bp, H. sapiens
aaaatactttatttct

SEQ ID NO: 3797 - DNA, 16 bp, H. sapiens
aaaatactttgaaaaa

SEQ ID NO: 3798 - DNA, 16 bp, H. sapiens
aaaatactttgtaaaa

SEQ ID NO: 3799 - DNA, 16 bp, H. sapiens
aaaatacttttagaaa

SEQ ID NO: 3800 - DNA, 16 bp, H. sapiens
aaaatacttttatttc

SEQ ID NO: 3801 - DNA, 16 bp, H. sapiens
aaaatacttttcttct

SEQ ID NO: 3802 - DNA, 16 bp, H. sapiens
aaaatacttttgaatt

SEQ ID NO: 3803 - DNA, 16 bp, H. sapiens
aaaatacttttgtaca

SEQ ID NO: 3804 - DNA, 16 bp, H. sapiens
aaaatacttttgtttt

SEQ ID NO: 3805 - DNA, 16 bp, H. sapiens
aaaatactttttctaa

SEQ ID NO: 3806 - DNA, 16 bp, H. sapiens
aaaatactttttgtat

SEQ ID NO: 3807 - DNA, 16 bp, H. sapiens
aaaatagaaaactttt

SEQ ID NO: 3808 - DNA, 16 bp, H. sapiens
aaaatagaaaaggacc

SEQ ID NO: 3809 - DNA, 16 bp, H. sapiens
aaaatagaaaatctag

SEQ ID NO: 3810 - DNA, 16 bp, H. sapiens
aaaatagaaaatctga

SEQ ID NO: 3811 - DNA, 16 bp, H. sapiens
aaaatagaaactttaa

SEQ ID NO: 3812 - DNA, 16 bp, H. sapiens
aaaatagaaatgtgta

SEQ ID NO: 3813 - DNA, 16 bp, H. sapiens
aaaatagaaatgtttt

SEQ ID NO: 3814 - DNA, 16 bp, H. sapiens
aaaatagaaattctga

SEQ ID NO: 3815 - DNA, 16 bp, H. sapiens
aaaatagaacaatttt

SEQ ID NO: 3816 - DNA, 16 bp, H. sapiens
aaaatagaacatttca

SEQ ID NO: 3817 - DNA, 16 bp, H. sapiens
aaaatagaactaccat

SEQ ID NO: 3818 - DNA, 16 bp, H. sapiens
aaaatagaagaaagct

SEQ ID NO: 3819 - DNA, 16 bp, H. sapiens
aaaatagacaaatatg

SEQ ID NO: 3820 - DNA, 16 bp, H. sapiens
aaaatagacacatttt

SEQ ID NO: 3821 - DNA, 16 bp, H. sapiens
aaaatagacattttaa

SEQ ID NO: 3822 - DNA, 29 bp, H. sapiens
aaaatagacctaggtaaattctcagataa

SEQ ID NO: 3823 - DNA, 16 bp, H. sapiens
aaaatagactaataca

SEQ ID NO: 3824 - DNA, 16 bp, H. sapiens
aaaatagacttatttt

SEQ ID NO: 3825 - DNA, 16 bp, H. sapiens
aaaatagactttattt

SEQ ID NO: 3826 - DNA, 16 bp, H. sapiens
aaaatagatgtatttt

SEQ ID NO: 3827 - DNA, 16 bp, H. sapiens
aaaatagattcttatt

SEQ ID NO: 3828 - DNA, 16 bp, H. sapiens
aaaatagcaaactgaa

SEQ ID NO: 3829 - DNA, 16 bp, H. sapiens
aaaatagcaaatgttg

SEQ ID NO: 3830 - DNA, 16 bp, H. sapiens
aaaatagcacaaccac

SEQ ID NO: 3831 - DNA, 16 bp, H. sapiens
aaaatagcatatttta

SEQ ID NO: 3832 - DNA, 16 bp, H. sapiens
aaaatagcatttaaaa

SEQ ID NO: 3833 - DNA, 16 bp, H. sapiens
aaaatagcatttatta

SEQ ID NO: 3834 - DNA, 16 bp, H. sapiens
aaaatagcatttgttt

SEQ ID NO: 3835 - DNA, 16 bp, H. sapiens
aaaatagccaaaaagt

SEQ ID NO: 3836 - DNA, 16 bp, H. sapiens
aaaatagccagatgtg

SEQ ID NO: 3837 - DNA, 16 bp, H. sapiens
aaaatagccttattgc

SEQ ID NO: 3838 - DNA, 16 bp, H. sapiens
aaaatagctgttttga

SEQ ID NO: 3839 - DNA, 16 bp, H. sapiens
aaaatagcttggcatg

SEQ ID NO: 3840 - DNA, 16 bp, H. sapiens
aaaatagctttgaaaa

SEQ ID NO: 3841 - DNA, 16 bp, H. sapiens
aaaataggcaaaagac

SEQ ID NO: 3842 - DNA, 16 bp, H. sapiens
aaaataggcaaatcta

SEQ ID NO: 3843 - DNA, 16 bp, H. sapiens
aaaataggcatataga

SEQ ID NO: 3844 - DNA, 16 bp, H. sapiens
aaaataggctgaaaaa

SEQ ID NO: 3845 - DNA, 16 bp, H. sapiens
aaaataggtttttatt

SEQ ID NO: 3846 - DNA, 16 bp, H. sapiens
aaaatagtaaatactt

SEQ ID NO: 3847 - DNA, 16 bp, H. sapiens
aaaatagtaaatttca

SEQ ID NO: 3848 - DNA, 16 bp, H. sapiens
aaaatagtacatttta

SEQ ID NO: 3849 - DNA, 16 bp, H. sapiens
aaaatagtagatttta

SEQ ID NO: 3850 - DNA, 16 bp, H. sapiens
aaaatagtattttcaa

SEQ ID NO: 3851 - DNA, 16 bp, H. sapiens
aaaatagtattttcta

SEQ ID NO: 3852 - DNA, 16 bp, H. sapiens
aaaatagtcatatttt

SEQ ID NO: 3853 - DNA, 16 bp, H. sapiens
aaaatagtcattaaaa

SEQ ID NO: 3854 - DNA, 16 bp, H. sapiens
aaaatagtcatttcaa

SEQ ID NO: 3855 - DNA, 16 bp, H. sapiens
aaaatagtcattttta

SEQ ID NO: 3856 - DNA, 16 bp, H. sapiens
aaaatagtgtggtatt

SEQ ID NO: 3857 - DNA, 16 bp, H. sapiens
aaaatagtgtttttaa

SEQ ID NO: 3858 - DNA, 16 bp, H. sapiens
aaaatagttcttaaaa

SEQ ID NO: 3859 - DNA, 16 bp, H. sapiens
aaaatagtttaaatgt

SEQ ID NO: 3860 - DNA, 16 bp, H. sapiens
aaaatagtttattcta

SEQ ID NO: 3861 - DNA, 16 bp, H. sapiens
aaaatagtttgagtag

SEQ ID NO: 3862 - DNA, 16 bp, H. sapiens
aaaatagttttcttta

SEQ ID NO: 3863 - DNA, 16 bp, H. sapiens
aaaatagttttgcttt

SEQ ID NO: 3864 - DNA, 16 bp, H. sapiens
aaaatagtttttttct

SEQ ID NO: 3865 - DNA, 16 bp, H. sapiens
aaaatataaagtacat

SEQ ID NO: 3866 - DNA, 16 bp, H. sapiens
aaaatataaatgtgtt

SEQ ID NO: 3867 - DNA, 16 bp, H. sapiens
aaaatataacagaatt

SEQ ID NO: 3868 - DNA, 16 bp, H. sapiens
aaaatataagcatatt

SEQ ID NO: 3869 - DNA, 16 bp, H. sapiens
aaaatataatgcatat

SEQ ID NO: 3870 - DNA, 16 bp, H. sapiens
aaaatatacaaacagc

SEQ ID NO: 3871 - DNA, 16 bp, H. sapiens
aaaatatacaatgtaa

SEQ ID NO: 3872 - DNA, 16 bp, H. sapiens
aaaatatacatacatg

SEQ ID NO: 3873 - DNA, 16 bp, H. sapiens
aaaatatacatgttaa

SEQ ID NO: 3874 - DNA, 16 bp, H. sapiens
aaaatatactgtattt

SEQ ID NO: 3875 - DNA, 16 bp, H. sapiens
aaaatatagcattaaa

SEQ ID NO: 3876 - DNA, 16 bp, H. sapiens
aaaatatagtaattct

SEQ ID NO: 3877 - DNA, 16 bp, H. sapiens
aaaatatagtttcaaa

SEQ ID NO: 3878 - DNA, 16 bp, H. sapiens
aaaatatatacagttt

SEQ ID NO: 3879 - DNA, 16 bp, H. sapiens
aaaatatatagtatgt

SEQ ID NO: 3880 - DNA, 16 bp, H. sapiens
aaaatatatatcagat

SEQ ID NO: 3881 - DNA, 16 bp, H. sapiens
aaaatatatatcctta

SEQ ID NO: 3882 - DNA, 16 bp, H. sapiens
aaaatatatatgacat

SEQ ID NO: 3883 - DNA, 16 bp, H. sapiens
aaaatatatcaatatg

SEQ ID NO: 3884 - DNA, 16 bp, H. sapiens
aaaatatatcactttt

SEQ ID NO: 3885 - DNA, 16 bp, H. sapiens
aaaatatatctttcct

SEQ ID NO: 3886 - DNA, 16 bp, H. sapiens
aaaatatatgaagaac

SEQ ID NO: 3887 - DNA, 16 bp, H. sapiens
aaaatatatgtatatg

SEQ ID NO: 3888 - DNA, 16 bp, H. sapiens
aaaatatatgttttct

SEQ ID NO: 3889 - DNA, 16 bp, H. sapiens
aaaatatattcaactt

SEQ ID NO: 3890 - DNA, 16 bp, H. sapiens
aaaatatattccatat

SEQ ID NO: 3891 - DNA, 16 bp, H. sapiens
aaaatatatttcctat

SEQ ID NO: 3892 - DNA, 16 bp, H. sapiens
aaaatatatttgtact

SEQ ID NO: 3893 - DNA, 16 bp, H. sapiens
aaaatatattttctgt

SEQ ID NO: 3894 - DNA, 16 bp, H. sapiens
aaaatatattttggga

SEQ ID NO: 3895 - DNA, 16 bp, H. sapiens
aaaatatcacatatac

SEQ ID NO: 3896 - DNA, 16 bp, H. sapiens
aaaatatcactttgta

SEQ ID NO: 3897 - DNA, 16 bp, H. sapiens
aaaatatcagaaatca

SEQ ID NO: 3898 - DNA, 16 bp, H. sapiens
aaaatatcagaaatta

SEQ ID NO: 3899 - DNA, 16 bp, H. sapiens
aaaatatcagagaaat

SEQ ID NO: 3900 - DNA, 16 bp, H. sapiens
aaaatatcagatattt

SEQ ID NO: 3901 - DNA, 16 bp, H. sapiens
aaaatatcagtaaaat

SEQ ID NO: 3902 - DNA, 16 bp, H. sapiens
aaaatatcagtattaa

SEQ ID NO: 3903 - DNA, 16 bp, H. sapiens
aaaatatcataaattg

SEQ ID NO: 3904 - DNA, 16 bp, H. sapiens
aaaatatcatttgaaa

SEQ ID NO: 3905 - DNA, 16 bp, H. sapiens
aaaatatcattttgta

SEQ ID NO: 3906 - DNA, 16 bp, H. sapiens
aaaatatccaggcatg

SEQ ID NO: 3907 - DNA, 16 bp, H. sapiens
aaaatatctacagaaa

SEQ ID NO: 3908 - DNA, 16 bp, H. sapiens
aaaatatctagtaata

SEQ ID NO: 3909 - DNA, 16 bp, H. sapiens
aaaatatctcatgcac

SEQ ID NO: 3910 - DNA, 16 bp, H. sapiens
aaaatatctcatgtaa

SEQ ID NO: 3911 - DNA, 16 bp, H. sapiens
aaaatatctctggaag

SEQ ID NO: 3912 - DNA, 16 bp, H. sapiens
aaaatatctctttgca

SEQ ID NO: 3913 - DNA, 16 bp, H. sapiens
aaaatatctgaaaaat

SEQ ID NO: 3914 - DNA, 16 bp, H. sapiens
aaaatatctgaacaga

SEQ ID NO: 3915 - DNA, 16 bp, H. sapiens
aaaatatctgaagcaa

SEQ ID NO: 3916 - DNA, 16 bp, H. sapiens
aaaatatctgagacaa

SEQ ID NO: 3917 - DNA, 16 bp, H. sapiens
aaaatatcttgaaaat

SEQ ID NO: 3918 - DNA, 16 bp, H. sapiens
aaaatatctttcttct

SEQ ID NO: 3919 - DNA, 16 bp, H. sapiens
aaaatatctttgtttt

SEQ ID NO: 3920 - DNA, 16 bp, H. sapiens
aaaatatcttttgaaa

SEQ ID NO: 3921 - DNA, 16 bp, H. sapiens
aaaatatgaaaactta

SEQ ID NO: 3922 - DNA, 16 bp, H. sapiens
aaaatatgaacattaa

SEQ ID NO: 3923 - DNA, 16 bp, H. sapiens
aaaatatgactttttt

SEQ ID NO: 3924 - DNA, 16 bp, H. sapiens
aaaatatgagactcaa

SEQ ID NO: 3925 - DNA, 16 bp, H. sapiens
aaaatatgaggccagt

SEQ ID NO: 3926 - DNA, 16 bp, H. sapiens
aaaatatgatacatat

SEQ ID NO: 3927 - DNA, 16 bp, H. sapiens
aaaatatgcaaaatga

SEQ ID NO: 3928 - DNA, 16 bp, H. sapiens
aaaatatgcaaagcaa

SEQ ID NO: 3929 - DNA, 16 bp, H. sapiens
aaaatatgcagagaaa

SEQ ID NO: 3930 - DNA, 16 bp, H. sapiens
aaaatatgcatataaa

SEQ ID NO: 3931 - DNA, 16 bp, H. sapiens
aaaatatgcatgtata

SEQ ID NO: 3932 - DNA, 16 bp, H. sapiens
aaaatatgcattcttc

SEQ ID NO: 3933 - DNA, 16 bp, H. sapiens
aaaatatgcattttaa

SEQ ID NO: 3934 - DNA, 16 bp, H. sapiens
aaaatatgccaaagaa

SEQ ID NO: 3935 - DNA, 16 bp, H. sapiens
aaaatatgccattttg

SEQ ID NO: 3936 - DNA, 16 bp, H. sapiens
aaaatatgctatatat

SEQ ID NO: 3937 - DNA, 16 bp, H. sapiens
aaaatatgctattaaa

SEQ ID NO: 3938 - DNA, 16 bp, H. sapiens
aaaatatgctgctttg

SEQ ID NO: 3939 - DNA, 16 bp, H. sapiens
aaaatatggaatattt

SEQ ID NO: 3940 - DNA, 31 bp, H. sapiens
aaaatatgggacaataagttgtggaaagcca

SEQ ID NO: 3941 - DNA, 16 bp, H. sapiens
aaaatatggtattata

SEQ ID NO: 3942 - DNA, 16 bp, H. sapiens
aaaatatggttatttt

SEQ ID NO: 3943 - DNA, 16 bp, H. sapiens
aaaatatgtaaattgt

SEQ ID NO: 3944 - DNA, 16 bp, H. sapiens
aaaatatgtaagtttt

SEQ ID NO: 3945 - DNA, 16 bp, H. sapiens
aaaatatgtacacaaa

SEQ ID NO: 3946 - DNA, 16 bp, H. sapiens
aaaatatgtacagtat

SEQ ID NO: 3947 - DNA, 16 bp, H. sapiens
aaaatatgtagaaaca

SEQ ID NO: 3948 - DNA, 16 bp, H. sapiens
aaaatatgtatgtata

SEQ ID NO: 3949 - DNA, 16 bp, H. sapiens
aaaatatgtattaatc

SEQ ID NO: 3950 - DNA, 16 bp, H. sapiens
aaaatatgtcttttaa

SEQ ID NO: 3951 - DNA, 16 bp, H. sapiens
aaaatatgtgaaaaca

SEQ ID NO: 3952 - DNA, 16 bp, H. sapiens
aaaatatgtgaaacaa

SEQ ID NO: 3953 - DNA, 16 bp, H. sapiens
aaaatatgtgcaacta

SEQ ID NO: 3954 - DNA, 16 bp, H. sapiens
aaaatatgtgcatttt

SEQ ID NO: 3955 - DNA, 16 bp, H. sapiens
aaaatatgtgttttta

SEQ ID NO: 3956 - DNA, 16 bp, H. sapiens
aaaatatgttaatgta

SEQ ID NO: 3957 - DNA, 16 bp, H. sapiens
aaaatatgttcaaaat

SEQ ID NO: 3958 - DNA, 16 bp, H. sapiens
aaaatatgttcacata

SEQ ID NO: 3959 - DNA, 16 bp, H. sapiens
aaaatatgttcatata

SEQ ID NO: 3960 - DNA, 16 bp, H. sapiens
aaaatatgttcatttc

SEQ ID NO: 3961 - DNA, 16 bp, H. sapiens
aaaatatgttctaaaa

SEQ ID NO: 3962 - DNA, 16 bp, H. sapiens
aaaatatgttcttttt

SEQ ID NO: 3963 - DNA, 16 bp, H. sapiens
aaaatatgttgaattt

SEQ ID NO: 3964 - DNA, 16 bp, H. sapiens
aaaatatgttgagaaa

SEQ ID NO: 3965 - DNA, 16 bp, H. sapiens
aaaatatgtttacatt

SEQ ID NO: 3966 - DNA, 16 bp, H. sapiens
aaaatattaacatttg

SEQ ID NO: 3967 - DNA, 16 bp, H. sapiens
aaaatattacacattt

SEQ ID NO: 3968 - DNA, 16 bp, H. sapiens
aaaatattactaaaag

SEQ ID NO: 3969 - DNA, 16 bp, H. sapiens
aaaatattagcaaaat

SEQ ID NO: 3970 - DNA, 16 bp, H. sapiens
aaaatattatctgttt

SEQ ID NO: 3971 - DNA, 16 bp, H. sapiens
aaaatattcaaagaga

SEQ ID NO: 3972 - DNA, 16 bp, H. sapiens
aaaatattcaaatgga

SEQ ID NO: 3973 - DNA, 16 bp, H. sapiens
aaaatattcagggaaa

SEQ ID NO: 3974 - DNA, 16 bp, H. sapiens
aaaatattcagttaat

SEQ ID NO: 3975 - DNA, 16 bp, H. sapiens
aaaatattcagttttc

SEQ ID NO: 3976 - DNA, 16 bp, H. sapiens
aaaatattccagaaaa

SEQ ID NO: 3977 - DNA, 16 bp, H. sapiens
aaaatattccaggaaa

SEQ ID NO: 3978 - DNA, 16 bp, H. sapiens
aaaatattccatttta

SEQ ID NO: 3979 - DNA, 16 bp, H. sapiens
aaaatattctaaaaga

SEQ ID NO: 3980 - DNA, 16 bp, H. sapiens
aaaatattctaaagat

SEQ ID NO: 3981 - DNA, 16 bp, H. sapiens
aaaatattctatgttt

SEQ ID NO: 3982 - DNA, 16 bp, H. sapiens
aaaatattctgaaatt

SEQ ID NO: 3983 - DNA, 16 bp, H. sapiens
aaaatattctgcaaaa

SEQ ID NO: 3984 - DNA, 16 bp, H. sapiens
aaaatattctggaaaa

SEQ ID NO: 3985 - DNA, 16 bp, H. sapiens
aaaatattcttattct

SEQ ID NO: 3986 - DNA, 16 bp, H. sapiens
aaaatattcttgaaaa

SEQ ID NO: 3987 - DNA, 16 bp, H. sapiens
aaaatattgaatggaa

SEQ ID NO: 3988 - DNA, 16 bp, H. sapiens
aaaatattgaattttg

SEQ ID NO: 3989 - DNA, 16 bp, H. sapiens
aaaatattgagatttt

SEQ ID NO: 3990 - DNA, 16 bp, H. sapiens
aaaatattgattttct

SEQ ID NO: 3991 - DNA, 16 bp, H. sapiens
aaaatattgcaataaa

SEQ ID NO: 3992 - DNA, 16 bp, H. sapiens
aaaatattgctaaaat

SEQ ID NO: 3993 - DNA, 16 bp, H. sapiens
aaaatattgctgagag

SEQ ID NO: 3994 - DNA, 16 bp, H. sapiens
aaaatattggccaggc

SEQ ID NO: 3995 - DNA, 16 bp, H. sapiens
aaaatattgggaaata

SEQ ID NO: 3996 - DNA, 16 bp, H. sapiens
aaaatattgtatgatt

SEQ ID NO: 3997 - DNA, 16 bp, H. sapiens
aaaatattgtttcaaa

SEQ ID NO: 3998 - DNA, 16 bp, H. sapiens
aaaatattgttttgaa

SEQ ID NO: 3999 - DNA, 16 bp, H. sapiens
aaaatatttaatgctt

SEQ ID NO: 4000 - DNA, 16 bp, H. sapiens
aaaatatttaatggta

SEQ ID NO: 4001 - DNA, 16 bp, H. sapiens
aaaatatttaccttct

SEQ ID NO: 4002 - DNA, 16 bp, H. sapiens
aaaatatttactgttt

SEQ ID NO: 4003 - DNA, 16 bp, H. sapiens
aaaatatttatgtcaa

SEQ ID NO: 4004 - DNA, 16 bp, H. sapiens
aaaatatttattgtct

SEQ ID NO: 4005 - DNA, 16 bp, H. sapiens
aaaatatttatttccc

SEQ ID NO: 4006 - DNA, 16 bp, H. sapiens
aaaatatttatttctg

SEQ ID NO: 4007 - DNA, 16 bp, H. sapiens
aaaatatttcaatatg

SEQ ID NO: 4008 - DNA, 16 bp, H. sapiens
aaaatatttcagaaaa

SEQ ID NO: 4009 - DNA, 16 bp, H. sapiens
aaaatatttcagcaaa

SEQ ID NO: 4010 - DNA, 16 bp, H. sapiens
aaaatatttcagtgaa

SEQ ID NO: 4011 - DNA, 16 bp, H. sapiens
aaaatatttcagtttt

SEQ ID NO: 4012 - DNA, 16 bp, H. sapiens
aaaatatttcatcata

SEQ ID NO: 4013 - DNA, 16 bp, H. sapiens
aaaatatttcatgctc

SEQ ID NO: 4014 - DNA, 16 bp, H. sapiens
aaaatatttcattaac

SEQ ID NO: 4015 - DNA, 16 bp, H. sapiens
aaaatatttccaaact

SEQ ID NO: 4016 - DNA, 16 bp, H. sapiens
aaaatatttcccattt

SEQ ID NO: 4017 - DNA, 16 bp, H. sapiens
aaaatatttcctgtct

SEQ ID NO: 4018 - DNA, 16 bp, H. sapiens
aaaatatttctatttg

SEQ ID NO: 4019 - DNA, 16 bp, H. sapiens
aaaatatttctcatct

SEQ ID NO: 4020 - DNA, 16 bp, H. sapiens
aaaatatttctcattt

SEQ ID NO: 4021 - DNA, 16 bp, H. sapiens
aaaatatttctgtgaa

SEQ ID NO: 4022 - DNA, 16 bp, H. sapiens
aaaatatttcttccta

SEQ ID NO: 4023 - DNA, 16 bp, H. sapiens
aaaatatttcttttgt

SEQ ID NO: 4024 - DNA, 16 bp, H. sapiens
aaaatatttgaaagca

SEQ ID NO: 4025 - DNA, 16 bp, H. sapiens
aaaatatttgaagaga

SEQ ID NO: 4026 - DNA, 16 bp, H. sapiens
aaaatatttgaatgtt

SEQ ID NO: 4027 - DNA, 16 bp, H. sapiens
aaaatatttgcaaaat

SEQ ID NO: 4028 - DNA, 16 bp, H. sapiens
aaaatatttgcaaata

SEQ ID NO: 4029 - DNA, 16 bp, H. sapiens
aaaatatttgcaatct

SEQ ID NO: 4030 - DNA, 16 bp, H. sapiens
aaaatatttgcagact

SEQ ID NO: 4031 - DNA, 16 bp, H. sapiens
aaaatatttgccatct

SEQ ID NO: 4032 - DNA, 16 bp, H. sapiens
aaaatatttgctatat

SEQ ID NO: 4033 - DNA, 16 bp, H. sapiens
aaaatatttgcttttt

SEQ ID NO: 4034 - DNA, 16 bp, H. sapiens
aaaatatttggaatga

SEQ ID NO: 4035 - DNA, 16 bp, H. sapiens
aaaatatttgggaaaa

SEQ ID NO: 4036 - DNA, 16 bp, H. sapiens
aaaatatttgtaaatc

SEQ ID NO: 4037 - DNA, 16 bp, H. sapiens
aaaatatttgtaatgt

SEQ ID NO: 4038 - DNA, 16 bp, H. sapiens
aaaatatttgtcaaaa

SEQ ID NO: 4039 - DNA, 16 bp, H. sapiens
aaaatatttgtgaaag

SEQ ID NO: 4040 - DNA, 16 bp, H. sapiens
aaaatatttgtggaat

SEQ ID NO: 4041 - DNA, 16 bp, H. sapiens
aaaatatttgtgtaat

SEQ ID NO: 4042 - DNA, 16 bp, H. sapiens
aaaatattttaaaagc

SEQ ID NO: 4043 - DNA, 16 bp, H. sapiens
aaaatattttaaaggt

SEQ ID NO: 4044 - DNA, 16 bp, H. sapiens
aaaatattttatgtga

SEQ ID NO: 4045 - DNA, 16 bp, H. sapiens
aaaatattttattcac

SEQ ID NO: 4046 - DNA, 16 bp, H. sapiens
aaaatattttattctg

SEQ ID NO: 4047 - DNA, 16 bp, H. sapiens
aaaatattttcagaaa

SEQ ID NO: 4048 - DNA, 16 bp, H. sapiens
aaaatattttcagata

SEQ ID NO: 4049 - DNA, 16 bp, H. sapiens
aaaatattttcagcaa

SEQ ID NO: 4050 - DNA, 16 bp, H. sapiens
aaaatattttcagctt

SEQ ID NO: 4051 - DNA, 16 bp, H. sapiens
aaaatattttctcaaa

SEQ ID NO: 4052 - DNA, 16 bp, H. sapiens
aaaatattttctttga

SEQ ID NO: 4053 - DNA, 16 bp, H. sapiens
aaaatattttgaagat

SEQ ID NO: 4054 - DNA, 16 bp, H. sapiens
aaaatattttgaatca

SEQ ID NO: 4055 - DNA, 16 bp, H. sapiens
aaaatattttgattct

SEQ ID NO: 4056 - DNA, 16 bp, H. sapiens
aaaatattttggaaag

SEQ ID NO: 4057 - DNA, 16 bp, H. sapiens
aaaatattttgtgaaa

SEQ ID NO: 4058 - DNA, 16 bp, H. sapiens
aaaatattttgtgttc

SEQ ID NO: 4059 - DNA, 16 bp, H. sapiens
aaaatattttgttgaa

SEQ ID NO: 4060 - DNA, 16 bp, H. sapiens
aaaatattttgtttct

SEQ ID NO: 4061 - DNA, 16 bp, H. sapiens
aaaatatttttccaag

SEQ ID NO: 4062 - DNA, 16 bp, H. sapiens
aaaatatttttcttcc

SEQ ID NO: 4063 - DNA, 16 bp, H. sapiens
aaaatatttttgagga

SEQ ID NO: 4064 - DNA, 16 bp, H. sapiens
aaaatattttttccaa

SEQ ID NO: 4065 - DNA, 16 bp, H. sapiens
aaaatcaaaacaatgt

SEQ ID NO: 4066 - DNA, 16 bp, H. sapiens
aaaatcaaaagcaggt

SEQ ID NO: 4067 - DNA, 16 bp, H. sapiens
aaaatcaaaagcattt

SEQ ID NO: 4068 - DNA, 16 bp, H. sapiens
aaaatcaaaagctttt

SEQ ID NO: 4069 - DNA, 16 bp, H. sapiens
aaaatcaaaagtattt

SEQ ID NO: 4070 - DNA, 16 bp, H. sapiens
aaaatcaaaatgtatt

SEQ ID NO: 4071 - DNA, 16 bp, H. sapiens
aaaatcaaacctgaat

SEQ ID NO: 4072 - DNA, 16 bp, H. sapiens
aaaatcaaactgtttt

SEQ ID NO: 4073 - DNA, 16 bp, H. sapiens
aaaatcaaacttcagt

SEQ ID NO: 4074 - DNA, 16 bp, H. sapiens
aaaatcaaagccacaa

SEQ ID NO: 4075 - DNA, 16 bp, H. sapiens
aaaatcaaataatgca

SEQ ID NO: 4076 - DNA, 16 bp, H. sapiens
aaaatcaaatatttct

SEQ ID NO: 4077 - DNA, 16 bp, H. sapiens
aaaatcaaatcaagat

SEQ ID NO: 4078 - DNA, 16 bp, H. sapiens
aaaatcaaatgagatt

SEQ ID NO: 4079 - DNA, 16 bp, H. sapiens
aaaatcaaatggaaat

SEQ ID NO: 4080 - DNA, 16 bp, H. sapiens
aaaatcaacaaaatgt

SEQ ID NO: 4081 - DNA, 16 bp, H. sapiens
aaaatcaacaaagtga

SEQ ID NO: 4082 - DNA, 16 bp, H. sapiens
aaaatcaacaaggata

SEQ ID NO: 4083 - DNA, 16 bp, H. sapiens
aaaatcaacacaagat

SEQ ID NO: 4084 - DNA, 16 bp, H. sapiens
aaaatcaacacatttt

SEQ ID NO: 4085 - DNA, 16 bp, H. sapiens
aaaatcaacactctaa

SEQ ID NO: 4086 - DNA, 16 bp, H. sapiens
aaaatcaacagcattt

SEQ ID NO: 4087 - DNA, 16 bp, H. sapiens
aaaatcaacatttgaa

SEQ ID NO: 4088 - DNA, 16 bp, H. sapiens
aaaatcaactctaaat

SEQ ID NO: 4089 - DNA, 16 bp, H. sapiens
aaaatcaactgataaa

SEQ ID NO: 4090 - DNA, 16 bp, H. sapiens
aaaatcaagatgcaaa

SEQ ID NO: 4091 - DNA, 16 bp, H. sapiens
aaaatcaagcttttaa

SEQ ID NO: 4092 - DNA, 16 bp, H. sapiens
aaaatcaagtaaaatg

SEQ ID NO: 4093 - DNA, 16 bp, H. sapiens
aaaatcaataaaagtt

SEQ ID NO: 4094 - DNA, 16 bp, H. sapiens
aaaatcaatgaaacca

SEQ ID NO: 4095 - DNA, 16 bp, H. sapiens
aaaatcaatgaaatta

SEQ ID NO: 4096 - DNA, 16 bp, H. sapiens
aaaatcaatgtgaaaa

SEQ ID NO: 4097 - DNA, 16 bp, H. sapiens
aaaatcaattaaccat

SEQ ID NO: 4098 - DNA, 16 bp, H. sapiens
aaaatcaattatgttt

SEQ ID NO: 4099 - DNA, 16 bp, H. sapiens
aaaatcaattccagat

SEQ ID NO: 4100 - DNA, 16 bp, H. sapiens
aaaatcaattgactat

SEQ ID NO: 4101 - DNA, 16 bp, H. sapiens
aaaatcaattgcattt

SEQ ID NO: 4102 - DNA, 16 bp, H. sapiens
aaaatcaattgtattt

SEQ ID NO: 4103 - DNA, 16 bp, H. sapiens
aaaatcaattgttttt

SEQ ID NO: 4104 - DNA, 16 bp, H. sapiens
aaaatcaatttctttc

SEQ ID NO: 4105 - DNA, 34 bp, H. sapiens
aaaatcacaaactatgctcaactcactctctaca

SEQ ID NO: 4106 - DNA, 16 bp, H. sapiens
aaaatcacaaggaaga

SEQ ID NO: 4107 - DNA, 16 bp, H. sapiens
aaaatcacagaaaatt

SEQ ID NO: 4108 - DNA, 16 bp, H. sapiens
aaaatcacagaaattt

SEQ ID NO: 4109 - DNA, 16 bp, H. sapiens
aaaatcacagtgaaat

SEQ ID NO: 4110 - DNA, 16 bp, H. sapiens
aaaatcacatgataat

SEQ ID NO: 4111 - DNA, 16 bp, H. sapiens
aaaatcacattgaaaa

SEQ ID NO: 4112 - DNA, 16 bp, H. sapiens
aaaatcacatttttga

SEQ ID NO: 4113 - DNA, 16 bp, H. sapiens
aaaatcactatttttc

SEQ ID NO: 4114 - DNA, 16 bp, H. sapiens
aaaatcactgaagaaa

SEQ ID NO: 4115 - DNA, 16 bp, H. sapiens
aaaatcactggaaccc

SEQ ID NO: 4116 - DNA, 16 bp, H. sapiens
aaaatcacttatttta

SEQ ID NO: 4117 - DNA, 16 bp, H. sapiens
aaaatcagaaaattta

SEQ ID NO: 4118 - DNA, 16 bp, H. sapiens
aaaatcagaaatgcaa

SEQ ID NO: 4119 - DNA, 16 bp, H. sapiens
aaaatcagaatattaa

SEQ ID NO: 4120 - DNA, 16 bp, H. sapiens
aaaatcagaattattt

SEQ ID NO: 4121 - DNA, 16 bp, H. sapiens
aaaatcagaatttatt

SEQ ID NO: 4122 - DNA, 16 bp, H. sapiens
aaaatcagaatttgaa

SEQ ID NO: 4123 - DNA, 16 bp, H. sapiens
aaaatcagacaaagat

SEQ ID NO: 4124 - DNA, 16 bp, H. sapiens
aaaatcagaccttggc

SEQ ID NO: 4125 - DNA, 16 bp, H. sapiens
aaaatcagattattta

SEQ ID NO: 4126 - DNA, 16 bp, H. sapiens
aaaatcagattgtttt

SEQ ID NO: 4127 - DNA, 16 bp, H. sapiens
aaaatcagcaaaatat

SEQ ID NO: 4128 - DNA, 16 bp, H. sapiens
aaaatcagcacacaaa

SEQ ID NO: 4129 - DNA, 16 bp, H. sapiens
aaaatcagcatttcta

SEQ ID NO: 4130 - DNA, 20 bp, H. sapiens
aaaatcagccgggcgtggtg

SEQ ID NO: 4131 - DNA, 16 bp, H. sapiens
aaaatcagcctggcca

SEQ ID NO: 4132 - DNA, 16 bp, H. sapiens
aaaatcagctttgaaa

SEQ ID NO: 4133 - DNA, 16 bp, H. sapiens
aaaatcagctttttaa

SEQ ID NO: 4134 - DNA, 16 bp, H. sapiens
aaaatcaggaaattta

SEQ ID NO: 4135 - DNA, 16 bp, H. sapiens
aaaatcagggaaaatg

SEQ ID NO: 4136 - DNA, 16 bp, H. sapiens
aaaatcagtaaagata

SEQ ID NO: 4137 - DNA, 16 bp, H. sapiens
aaaatcagtaaagttg

SEQ ID NO: 4138 - DNA, 16 bp, H. sapiens
aaaatcagtagcattt

SEQ ID NO: 4139 - DNA, 16 bp, H. sapiens
aaaatcagtagccttt

SEQ ID NO: 4140 - DNA, 16 bp, H. sapiens
aaaatcagtattatta

SEQ ID NO: 4141 - DNA, 16 bp, H. sapiens
aaaatcagtcagattt

SEQ ID NO: 4142 - DNA, 16 bp, H. sapiens
aaaatcagtgaaacca

SEQ ID NO: 4143 - DNA, 16 bp, H. sapiens
aaaatcagtgagaaaa

SEQ ID NO: 4144 - DNA, 16 bp, H. sapiens
aaaatcagttagctgt

SEQ ID NO: 4145 - DNA, 16 bp, H. sapiens
aaaatcagttatttaa

SEQ ID NO: 4146 - DNA, 16 bp, H. sapiens
aaaatcagttgatcat

SEQ ID NO: 4147 - DNA, 16 bp, H. sapiens
aaaatcagttggctat

SEQ ID NO: 4148 - DNA, 16 bp, H. sapiens
aaaatcagttggctgt

SEQ ID NO: 4149 - DNA, 16 bp, H. sapiens
aaaatcagttgtccat

SEQ ID NO: 4150 - DNA, 16 bp, H. sapiens
aaaatcagtttaattt

SEQ ID NO: 4151 - DNA, 16 bp, H. sapiens
aaaatcagtttatcaa

SEQ ID NO: 4152 - DNA, 16 bp, H. sapiens
aaaatcagttttatta

SEQ ID NO: 4153 - DNA, 16 bp, H. sapiens
aaaatcataaaaatgt

SEQ ID NO: 4154 - DNA, 16 bp, H. sapiens
aaaatcataacagtct

SEQ ID NO: 4155 - DNA, 16 bp, H. sapiens
aaaatcataatgacag

SEQ ID NO: 4156 - DNA, 16 bp, H. sapiens
aaaatcatacagaaag

SEQ ID NO: 4157 - DNA, 16 bp, H. sapiens
aaaatcatatatctga

SEQ ID NO: 4158 - DNA, 16 bp, H. sapiens
aaaatcatatgttgaa

SEQ ID NO: 4159 - DNA, 16 bp, H. sapiens
aaaatcatattctttt

SEQ ID NO: 4160 - DNA, 16 bp, H. sapiens
aaaatcatcacctcct

SEQ ID NO: 4161 - DNA, 16 bp, H. sapiens
aaaatcatcatcattt

SEQ ID NO: 4162 - DNA, 16 bp, H. sapiens
aaaatcatcttcagag

SEQ ID NO: 4163 - DNA, 16 bp, H. sapiens
aaaatcatctttttaa

SEQ ID NO: 4164 - DNA, 16 bp, H. sapiens
aaaatcatgaagagaa

SEQ ID NO: 4165 - DNA, 16 bp, H. sapiens
aaaatcatgaatgaac

SEQ ID NO: 4166 - DNA, 16 bp, H. sapiens
aaaatcatgagaaaat

SEQ ID NO: 4167 - DNA, 16 bp, H. sapiens
aaaatcatgagcaaaa

SEQ ID NO: 4168 - DNA, 16 bp, H. sapiens
aaaatcatggaatcaa

SEQ ID NO: 4169 - DNA, 16 bp, H. sapiens
aaaatcattagcattt

SEQ ID NO: 4170 - DNA, 16 bp, H. sapiens
aaaatcattatttttg

SEQ ID NO: 4171 - DNA, 16 bp, H. sapiens
aaaatcattcattcat

SEQ ID NO: 4172 - DNA, 16 bp, H. sapiens
aaaatcattgactgga

SEQ ID NO: 4173 - DNA, 16 bp, H. sapiens
aaaatcattgtccaga

SEQ ID NO: 4174 - DNA, 16 bp, H. sapiens
aaaatcatttaacaca

SEQ ID NO: 4175 - DNA, 16 bp, H. sapiens
aaaatcatttgataaa

SEQ ID NO: 4176 - DNA, 16 bp, H. sapiens
aaaatcatttggaaaa

SEQ ID NO: 4177 - DNA, 16 bp, H. sapiens
aaaatcatttgtattt

SEQ ID NO: 4178 - DNA, 16 bp, H. sapiens
aaaatcattttccctt

SEQ ID NO: 4179 - DNA, 16 bp, H. sapiens
aaaatcatttttgaaa

SEQ ID NO: 4180 - DNA, 16 bp, H. sapiens
aaaatccaaaagttag

SEQ ID NO: 4181 - DNA, 16 bp, H. sapiens
aaaatccaaaattttt

SEQ ID NO: 4182 - DNA, 16 bp, H. sapiens
aaaatccaaataacct

SEQ ID NO: 4183 - DNA, 16 bp, H. sapiens
aaaatccaaataatct

SEQ ID NO: 4184 - DNA, 16 bp, H. sapiens
aaaatccaaattcttt

SEQ ID NO: 4185 - DNA, 16 bp, H. sapiens
aaaatccaaatttctt

SEQ ID NO: 4186 - DNA, 16 bp, H. sapiens
aaaatccacagagaca

SEQ ID NO: 4187 - DNA, 16 bp, H. sapiens
aaaatccagatcatgg

SEQ ID NO: 4188 - DNA, 16 bp, H. sapiens
aaaatccattatttta

SEQ ID NO: 4189 - DNA, 16 bp, H. sapiens
aaaatccattttattt

SEQ ID NO: 4190 - DNA, 16 bp, H. sapiens
aaaatcccaagtcaaa

SEQ ID NO: 4191 - DNA, 16 bp, H. sapiens
aaaatcccacagctaa

SEQ ID NO: 4192 - DNA, 16 bp, H. sapiens
aaaatcccagaaatca

SEQ ID NO: 4193 - DNA, 16 bp, H. sapiens
aaaatcccagcaagtt

SEQ ID NO: 4194 - DNA, 16 bp, H. sapiens
aaaatcccagctactt

SEQ ID NO: 4195 - DNA, 16 bp, H. sapiens
aaaatcccccacattt

SEQ ID NO: 4196 - DNA, 16 bp, H. sapiens
aaaatcccgtctctac

SEQ ID NO: 4197 - DNA, 16 bp, H. sapiens
aaaatccctgccctca

SEQ ID NO: 4198 - DNA, 16 bp, H. sapiens
aaaatcctaaagaatt

SEQ ID NO: 4199 - DNA, 16 bp, H. sapiens
aaaatcctaaggaaat

SEQ ID NO: 4200 - DNA, 16 bp, H. sapiens
aaaatcctaggagaaa

SEQ ID NO: 4201 - DNA, 16 bp, H. sapiens
aaaatcctcaagaaaa

SEQ ID NO: 4202 - DNA, 16 bp, H. sapiens
aaaatcctcagcaaaa

SEQ ID NO: 4203 - DNA, 26 bp, H. sapiens
aaaatcctcagtaaaatactggcaaa

SEQ ID NO: 4204 - DNA, 16 bp, H. sapiens
aaaatcctcctctgct

SEQ ID NO: 4205 - DNA, 16 bp, H. sapiens
aaaatcctgaaagaca

SEQ ID NO: 4206 - DNA, 16 bp, H. sapiens
aaaatcctggaagaaa

SEQ ID NO: 4207 - DNA, 16 bp, H. sapiens
aaaatcctgtcacttg

SEQ ID NO: 4208 - DNA, 16 bp, H. sapiens
aaaatccttaaccaaa

SEQ ID NO: 4209 - DNA, 16 bp, H. sapiens
aaaatcctttccagaa

SEQ ID NO: 4210 - DNA, 16 bp, H. sapiens
aaaatccttttaaaat

SEQ ID NO: 4211 - DNA, 16 bp, H. sapiens
aaaatctaaaatgttt

SEQ ID NO: 4212 - DNA, 16 bp, H. sapiens
aaaatctaaatgaaat

SEQ ID NO: 4213 - DNA, 16 bp, H. sapiens
aaaatctaacatttat

SEQ ID NO: 4214 - DNA, 16 bp, H. sapiens
aaaatctaagctgttg

SEQ ID NO: 4215 - DNA, 16 bp, H. sapiens
aaaatctaagttaaaa

SEQ ID NO: 4216 - DNA, 16 bp, H. sapiens
aaaatctactaaaact

SEQ ID NO: 4217 - DNA, 16 bp, H. sapiens
aaaatctacttattta

SEQ ID NO: 4218 - DNA, 16 bp, H. sapiens
aaaatctagaaatgga

SEQ ID NO: 4219 - DNA, 16 bp, H. sapiens
aaaatctagaagataa

SEQ ID NO: 4220 - DNA, 16 bp, H. sapiens
aaaatctagagaaggc

SEQ ID NO: 4221 - DNA, 16 bp, H. sapiens
aaaatctagattaaaa

SEQ ID NO: 4222 - DNA, 16 bp, H. sapiens
aaaatctatctatcta

SEQ ID NO: 4223 - DNA, 16 bp, H. sapiens
aaaatctcaaaagcag

SEQ ID NO: 4224 - DNA, 16 bp, H. sapiens
aaaatctcaagagaaa

SEQ ID NO: 4225 - DNA, 16 bp, H. sapiens
aaaatctcaagcattc

SEQ ID NO: 4226 - DNA, 16 bp, H. sapiens
aaaatctcaatgaaat

SEQ ID NO: 4227 - DNA, 16 bp, H. sapiens
aaaatctcagaaacca

SEQ ID NO: 4228 - DNA, 16 bp, H. sapiens
aaaatctcagaaatga

SEQ ID NO: 4229 - DNA, 16 bp, H. sapiens
aaaatctcagaataca

SEQ ID NO: 4230 - DNA, 16 bp, H. sapiens
aaaatctcagcaagtt

SEQ ID NO: 4231 - DNA, 16 bp, H. sapiens
aaaatctcattcattt

SEQ ID NO: 4232 - DNA, 16 bp, H. sapiens
aaaatctcattttaaa

SEQ ID NO: 4233 - DNA, 16 bp, H. sapiens
aaaatctccaatcaaa

SEQ ID NO: 4234 - DNA, 16 bp, H. sapiens
aaaatctccagagaaa

SEQ ID NO: 4235 - DNA, 16 bp, H. sapiens
aaaatctccagtgaaa

SEQ ID NO: 4236 - DNA, 16 bp, H. sapiens
aaaatctcctgaaaaa

SEQ ID NO: 4237 - DNA, 16 bp, H. sapiens
aaaatctctcagtgtt

SEQ ID NO: 4238 - DNA, 16 bp, H. sapiens
aaaatctcttaaaatt

SEQ ID NO: 4239 - DNA, 16 bp, H. sapiens
aaaatctgaaaaaatt

SEQ ID NO: 4240 - DNA, 16 bp, H. sapiens
aaaatctgaaaaatat

SEQ ID NO: 4241 - DNA, 16 bp, H. sapiens
aaaatctgaaaatgtt

SEQ ID NO: 4242 - DNA, 16 bp, H. sapiens
aaaatctgaaacattt

SEQ ID NO: 4243 - DNA, 16 bp, H. sapiens
aaaatctgaaatactt

SEQ ID NO: 4244 - DNA, 16 bp, H. sapiens
aaaatctgaaatgaaa

SEQ ID NO: 4245 - DNA, 16 bp, H. sapiens
aaaatctgaacaaatt

SEQ ID NO: 4246 - DNA, 16 bp, H. sapiens
aaaatctgaagaaatt

SEQ ID NO: 4247 - DNA, 16 bp, H. sapiens
aaaatctgaatatatt

SEQ ID NO: 4248 - DNA, 16 bp, H. sapiens
aaaatctgacatttta

SEQ ID NO: 4249 - DNA, 16 bp, H. sapiens
aaaatctgagaaatca

SEQ ID NO: 4250 - DNA, 16 bp, H. sapiens
aaaatctgagaagaaa

SEQ ID NO: 4251 - DNA, 16 bp, H. sapiens
aaaatctgattaaaaa

SEQ ID NO: 4252 - DNA, 16 bp, H. sapiens
aaaatctgcagatgct

SEQ ID NO: 4253 - DNA, 16 bp, H. sapiens
aaaatctgcatttaaa

SEQ ID NO: 4254 - DNA, 16 bp, H. sapiens
aaaatctgcatttata

SEQ ID NO: 4255 - DNA, 16 bp, H. sapiens
aaaatctgctttttaa

SEQ ID NO: 4256 - DNA, 16 bp, H. sapiens
aaaatctggaaaaata

SEQ ID NO: 4257 - DNA, 16 bp, H. sapiens
aaaatctggaacaaga

SEQ ID NO: 4258 - DNA, 16 bp, H. sapiens
aaaatctggattttta

SEQ ID NO: 4259 - DNA, 16 bp, H. sapiens
aaaatctgtaagatga

SEQ ID NO: 4260 - DNA, 16 bp, H. sapiens
aaaatctgtatatttt

SEQ ID NO: 4261 - DNA, 16 bp, H. sapiens
aaaatctgtgggaaaa

SEQ ID NO: 4262 - DNA, 16 bp, H. sapiens
aaaatctgttttaaaa

SEQ ID NO: 4263 - DNA, 16 bp, H. sapiens
aaaatctgttttcttc

SEQ ID NO: 4264 - DNA, 16 bp, H. sapiens
aaaatctgttttgttt

SEQ ID NO: 4265 - DNA, 16 bp, H. sapiens
aaaatctgtttttctc

SEQ ID NO: 4266 - DNA, 16 bp, H. sapiens
aaaatcttaaaagcag

SEQ ID NO: 4267 - DNA, 16 bp, H. sapiens
aaaatcttaaaatgtg

SEQ ID NO: 4268 - DNA, 16 bp, H. sapiens
aaaatcttaattcatt

SEQ ID NO: 4269 - DNA, 16 bp, H. sapiens
aaaatcttcaacaaag

SEQ ID NO: 4270 - DNA, 16 bp, H. sapiens
aaaatcttcaagaaaa

SEQ ID NO: 4271 - DNA, 16 bp, H. sapiens
aaaatcttcatttaaa

SEQ ID NO: 4272 - DNA, 16 bp, H. sapiens
aaaatcttccttttct

SEQ ID NO: 4273 - DNA, 16 bp, H. sapiens
aaaatcttgaaagtag

SEQ ID NO: 4274 - DNA, 16 bp, H. sapiens
aaaatcttgaacaaaa

SEQ ID NO: 4275 - DNA, 16 bp, H. sapiens
aaaatcttggaagaaa

SEQ ID NO: 4276 - DNA, 16 bp, H. sapiens
aaaatcttggctattg

SEQ ID NO: 4277 - DNA, 16 bp, H. sapiens
aaaatcttgtaacact

SEQ ID NO: 4278 - DNA, 16 bp, H. sapiens
aaaatcttgttttttt

SEQ ID NO: 4279 - DNA, 16 bp, H. sapiens
aaaatctttagaagaa

SEQ ID NO: 4280 - DNA, 16 bp, H. sapiens
aaaatctttcagtttt

SEQ ID NO: 4281 - DNA, 16 bp, H. sapiens
aaaatctttctttctt

SEQ ID NO: 4282 - DNA, 16 bp, H. sapiens
aaaatctttgtaaaaa

SEQ ID NO: 4283 - DNA, 16 bp, H. sapiens
aaaatctttgttcttt

SEQ ID NO: 4284 - DNA, 16 bp, H. sapiens
aaaatcttttcaattt

SEQ ID NO: 4285 - DNA, 16 bp, H. sapiens
aaaatcttttcccaga

SEQ ID NO: 4286 - DNA, 16 bp, H. sapiens
aaaatgaaaaacttct

SEQ ID NO: 4287 - DNA, 16 bp, H. sapiens
aaaatgaaaacacatt

SEQ ID NO: 4288 - DNA, 16 bp, H. sapiens
aaaatgaaaacactgg

SEQ ID NO: 4289 - DNA, 16 bp, H. sapiens
aaaatgaaaacagctt

SEQ ID NO: 4290 - DNA, 16 bp, H. sapiens
aaaatgaaaacattta

SEQ ID NO: 4291 - DNA, 16 bp, H. sapiens
aaaatgaaaacatttt

SEQ ID NO: 4292 - DNA, 16 bp, H. sapiens
aaaatgaaaactcaga

SEQ ID NO: 4293 - DNA, 16 bp, H. sapiens
aaaatgaaaactgatt

SEQ ID NO: 4294 - DNA, 16 bp, H. sapiens
aaaatgaaaagcaagc

SEQ ID NO: 4295 - DNA, 16 bp, H. sapiens
aaaatgaaaagcaagt

SEQ ID NO: 4296 - DNA, 16 bp, H. sapiens
aaaatgaaaaggcaac

SEQ ID NO: 4297 - DNA, 16 bp, H. sapiens
aaaatgaaaaggtttt

SEQ ID NO: 4298 - DNA, 16 bp, H. sapiens
aaaatgaaaatcctaa

SEQ ID NO: 4299 - DNA, 16 bp, H. sapiens
aaaatgaaaatctgac

SEQ ID NO: 4300 - DNA, 16 bp, H. sapiens
aaaatgaaaatgtgga

SEQ ID NO: 4301 - DNA, 16 bp, H. sapiens
aaaatgaaaattcagt

SEQ ID NO: 4302 - DNA, 16 bp, H. sapiens
aaaatgaaaattctat

SEQ ID NO: 4303 - DNA, 16 bp, H. sapiens
aaaatgaaacaaactg

SEQ ID NO: 4304 - DNA, 16 bp, H. sapiens
aaaatgaaacaatttt

SEQ ID NO: 4305 - DNA, 16 bp, H. sapiens
aaaatgaaacactgaa

SEQ ID NO: 4306 - DNA, 16 bp, H. sapiens
aaaatgaaacactgca

SEQ ID NO: 4307 - DNA, 16 bp, H. sapiens
aaaatgaaacatttta

SEQ ID NO: 4308 - DNA, 16 bp, H. sapiens
aaaatgaaacattttc

SEQ ID NO: 4309 - DNA, 16 bp, H. sapiens
aaaatgaaacattttt

SEQ ID NO: 4310 - DNA, 16 bp, H. sapiens
aaaatgaaaccatttt

SEQ ID NO: 4311 - DNA, 16 bp, H. sapiens
aaaatgaaactatttt

SEQ ID NO: 4312 - DNA, 16 bp, H. sapiens
aaaatgaaactgtttc

SEQ ID NO: 4313 - DNA, 16 bp, H. sapiens
aaaatgaaactttttt

SEQ ID NO: 4314 - DNA, 16 bp, H. sapiens
aaaatgaaagattttt

SEQ ID NO: 4315 - DNA, 16 bp, H. sapiens
aaaatgaaagctgtaa

SEQ ID NO: 4316 - DNA, 16 bp, H. sapiens
aaaatgaaaggacaga

SEQ ID NO: 4317 - DNA, 16 bp, H. sapiens
aaaatgaaagtaacag

SEQ ID NO: 4318 - DNA, 16 bp, H. sapiens
aaaatgaaagtatact

SEQ ID NO: 4319 - DNA, 16 bp, H. sapiens
aaaatgaaagttgaag

SEQ ID NO: 4320 - DNA, 16 bp, H. sapiens
aaaatgaaagtttttt

SEQ ID NO: 4321 - DNA, 16 bp, H. sapiens
aaaatgaaataatttc

SEQ ID NO: 4322 - DNA, 16 bp, H. sapiens
aaaatgaaatgtattt

SEQ ID NO: 4323 - DNA, 16 bp, H. sapiens
aaaatgaaattctaaa

SEQ ID NO: 4324 - DNA, 16 bp, H. sapiens
aaaatgaaatttcaag

SEQ ID NO: 4325 - DNA, 16 bp, H. sapiens
aaaatgaaatttggaa

SEQ ID NO: 4326 - DNA, 16 bp, H. sapiens
aaaatgaacaaattga

SEQ ID NO: 4327 - DNA, 16 bp, H. sapiens
aaaatgaacagagcct

SEQ ID NO: 4328 - DNA, 16 bp, H. sapiens
aaaatgaacatatttc

SEQ ID NO: 4329 - DNA, 16 bp, H. sapiens
aaaatgaacattttgt

SEQ ID NO: 4330 - DNA, 16 bp, H. sapiens
aaaatgaactaaagac

SEQ ID NO: 4331 - DNA, 16 bp, H. sapiens
aaaatgaactaagaca

SEQ ID NO: 4332 - DNA, 16 bp, H. sapiens
aaaatgaactttaaaa

SEQ ID NO: 4333 - DNA, 16 bp, H. sapiens
aaaatgaagaaagcca

SEQ ID NO: 4334 - DNA, 16 bp, H. sapiens
aaaatgaagaaattca

SEQ ID NO: 4335 - DNA, 16 bp, H. sapiens
aaaatgaagaatttca

SEQ ID NO: 4336 - DNA, 16 bp, H. sapiens
aaaatgaagacaattt

SEQ ID NO: 4337 - DNA, 16 bp, H. sapiens
aaaatgaagacatttc

SEQ ID NO: 4338 - DNA, 16 bp, H. sapiens
aaaatgaagactcaaa

SEQ ID NO: 4339 - DNA, 16 bp, H. sapiens
aaaatgaagagtttgt

SEQ ID NO: 4340 - DNA, 16 bp, H. sapiens
aaaatgaagatggcat

SEQ ID NO: 4341 - DNA, 16 bp, H. sapiens
aaaatgaagatgtttt

SEQ ID NO: 4342 - DNA, 16 bp, H. sapiens
aaaatgaagatttttt

SEQ ID NO: 4343 - DNA, 16 bp, H. sapiens
aaaatgaagctaaaat

SEQ ID NO: 4344 - DNA, 16 bp, H. sapiens
aaaatgaaggcatttt

SEQ ID NO: 4345 - DNA, 16 bp, H. sapiens
aaaatgaaggcctcag

SEQ ID NO: 4346 - DNA, 16 bp, H. sapiens
aaaatgaagtacagag

SEQ ID NO: 4347 - DNA, 16 bp, H. sapiens
aaaatgaagtcagaaa

SEQ ID NO: 4348 - DNA, 16 bp, H. sapiens
aaaatgaagttgattt

SEQ ID NO: 4349 - DNA, 16 bp, H. sapiens
aaaatgaagttggacc

SEQ ID NO: 4350 - DNA, 16 bp, H. sapiens
aaaatgaagtttcatt

SEQ ID NO: 4351 - DNA, 16 bp, H. sapiens
aaaatgaagtttctga

SEQ ID NO: 4352 - DNA, 16 bp, H. sapiens
aaaatgaataatacat

SEQ ID NO: 4353 - DNA, 16 bp, H. sapiens
aaaatgaatacatttt

SEQ ID NO: 4354 - DNA, 16 bp, H. sapiens
aaaatgaatattttga

SEQ ID NO: 4355 - DNA, 16 bp, H. sapiens
aaaatgaatcattcta

SEQ ID NO: 4356 - DNA, 16 bp, H. sapiens
aaaatgaatgtgaaca

SEQ ID NO: 4357 - DNA, 16 bp, H. sapiens
aaaatgaattaacatt

SEQ ID NO: 4358 - DNA, 16 bp, H. sapiens
aaaatgaattgaagac

SEQ ID NO: 4359 - DNA, 16 bp, H. sapiens
aaaatgaattttatct

SEQ ID NO: 4360 - DNA, 16 bp, H. sapiens
aaaatgaattttgaat

SEQ ID NO: 4361 - DNA, 16 bp, H. sapiens
aaaatgaatttttctt

SEQ ID NO: 4362 - DNA, 16 bp, H. sapiens
aaaatgaatttttgaa

SEQ ID NO: 4363 - DNA, 16 bp, H. sapiens
aaaatgacaaaaccct

SEQ ID NO: 4364 - DNA, 16 bp, H. sapiens
aaaatgacaaatactg

SEQ ID NO: 4365 - DNA, 16 bp, H. sapiens
aaaatgacaaatttta

SEQ ID NO: 4366 - DNA, 16 bp, H. sapiens
aaaatgacaacatttt

SEQ ID NO: 4367 - DNA, 16 bp, H. sapiens
aaaatgacaataatga

SEQ ID NO: 4368 - DNA, 16 bp, H. sapiens
aaaatgacaatatcaa

SEQ ID NO: 4369 - DNA, 16 bp, H. sapiens
aaaatgacaatgaaat

SEQ ID NO: 4370 - DNA, 16 bp, H. sapiens
aaaatgacacatttta

SEQ ID NO: 4371 - DNA, 16 bp, H. sapiens
aaaatgacagaaatga

SEQ ID NO: 4372 - DNA, 16 bp, H. sapiens
aaaatgacagtatttt

SEQ ID NO: 4373 - DNA, 16 bp, H. sapiens
aaaatgacataaaatt

SEQ ID NO: 4374 - DNA, 16 bp, H. sapiens
aaaatgacataaatat

SEQ ID NO: 4375 - DNA, 16 bp, H. sapiens
aaaatgacataaattt

SEQ ID NO: 4376 - DNA, 16 bp, H. sapiens
aaaatgacatagtatt

SEQ ID NO: 4377 - DNA, 16 bp, H. sapiens
aaaatgaccataaaat

SEQ ID NO: 4378 - DNA, 16 bp, H. sapiens
aaaatgaccatactgc

SEQ ID NO: 4379 - DNA, 16 bp, H. sapiens
aaaatgaccattttta

SEQ ID NO: 4380 - DNA, 16 bp, H. sapiens
aaaatgacctttaaaa

SEQ ID NO: 4381 - DNA, 16 bp, H. sapiens
aaaatgaccttttaaa

SEQ ID NO: 4382 - DNA, 16 bp, H. sapiens
aaaatgaccttttttt

SEQ ID NO: 4383 - DNA, 16 bp, H. sapiens
aaaatgactgaaaata

SEQ ID NO: 4384 - DNA, 16 bp, H. sapiens
aaaatgactgcatttt

SEQ ID NO: 4385 - DNA, 16 bp, H. sapiens
aaaatgacttaaaatt

SEQ ID NO: 4386 - DNA, 16 bp, H. sapiens
aaaatgactttatttt

SEQ ID NO: 4387 - DNA, 16 bp, H. sapiens
aaaatgactttgaaaa

SEQ ID NO: 4388 - DNA, 16 bp, H. sapiens
aaaatgagaaaactga

SEQ ID NO: 4389 - DNA, 16 bp, H. sapiens
aaaatgagaaaatact

SEQ ID NO: 4390 - DNA, 16 bp, H. sapiens
aaaatgagaaagattt

SEQ ID NO: 4391 - DNA, 16 bp, H. sapiens
aaaatgagaaatttga

SEQ ID NO: 4392 - DNA, 16 bp, H. sapiens
aaaatgagagaaaact

SEQ ID NO: 4393 - DNA, 16 bp, H. sapiens
aaaatgagagtgaaat

SEQ ID NO: 4394 - DNA, 16 bp, H. sapiens
aaaatgagatttgaaa

SEQ ID NO: 4395 - DNA, 16 bp, H. sapiens
aaaatgagcaaaagtt

SEQ ID NO: 4396 - DNA, 16 bp, H. sapiens
aaaatgagcaaaatac

SEQ ID NO: 4397 - DNA, 16 bp, H. sapiens
aaaatgagctttccta

SEQ ID NO: 4398 - DNA, 17 bp, H. sapiens
aaaatgaggaagaagca

SEQ ID NO: 4399 - DNA, 16 bp, H. sapiens
aaaatgaggaagatgt

SEQ ID NO: 4400 - DNA, 16 bp, H. sapiens
aaaatgaggataatga

SEQ ID NO: 4401 - DNA, 16 bp, H. sapiens
aaaatgaggcaataat

SEQ ID NO: 4402 - DNA, 16 bp, H. sapiens
aaaatgaggccattga

SEQ ID NO: 4403 - DNA, 16 bp, H. sapiens
aaaatgaggctggaga

SEQ ID NO: 4404 - DNA, 16 bp, H. sapiens
aaaatgaggttttttt

SEQ ID NO: 4405 - DNA, 16 bp, H. sapiens
aaaatgagtgtttcca

SEQ ID NO: 4406 - DNA, 16 bp, H. sapiens
aaaatgagttggaaaa

SEQ ID NO: 4407 - DNA, 16 bp, H. sapiens
aaaatgagtttagaaa

SEQ ID NO: 4408 - DNA, 16 bp, H. sapiens
aaaatgataatagcaa

SEQ ID NO: 4409 - DNA, 16 bp, H. sapiens
aaaatgataattttgt

SEQ ID NO: 4410 - DNA, 16 bp, H. sapiens
aaaatgatacttaaaa

SEQ ID NO: 4411 - DNA, 16 bp, H. sapiens
aaaatgatatacaaat

SEQ ID NO: 4412 - DNA, 16 bp, H. sapiens
aaaatgatcaaaatat

SEQ ID NO: 4413 - DNA, 16 bp, H. sapiens
aaaatgatcatttaaa

SEQ ID NO: 4414 - DNA, 16 bp, H. sapiens
aaaatgatcttaaaaa

SEQ ID NO: 4415 - DNA, 16 bp, H. sapiens
aaaatgatgcatattt

SEQ ID NO: 4416 - DNA, 16 bp, H. sapiens
aaaatgatggtaaatg

SEQ ID NO: 4417 - DNA, 16 bp, H. sapiens
aaaatgatgtaaattt

SEQ ID NO: 4418 - DNA, 16 bp, H. sapiens
aaaatgatgtattttt

SEQ ID NO: 4419 - DNA, 16 bp, H. sapiens
aaaatgatgttaatga

SEQ ID NO: 4420 - DNA, 16 bp, H. sapiens
aaaatgatgttgaatt

SEQ ID NO: 4421 - DNA, 16 bp, H. sapiens
aaaatgatgttgatat

SEQ ID NO: 4422 - DNA, 16 bp, H. sapiens
aaaatgatgtttattt

SEQ ID NO: 4423 - DNA, 16 bp, H. sapiens
aaaatgattacaaatt

SEQ ID NO: 4424 - DNA, 16 bp, H. sapiens
aaaatgattcaaaaat

SEQ ID NO: 4425 - DNA, 16 bp, H. sapiens
aaaatgattcaagaaa

SEQ ID NO: 4426 - DNA, 16 bp, H. sapiens
aaaatgattgtttaaa

SEQ ID NO: 4427 - DNA, 16 bp, H. sapiens
aaaatgatttatagat

SEQ ID NO: 4428 - DNA, 16 bp, H. sapiens
aaaatgatttcaaata

SEQ ID NO: 4429 - DNA, 16 bp, H. sapiens
aaaatgatttcaaatt

SEQ ID NO: 4430 - DNA, 16 bp, H. sapiens
aaaatgatttctttct

SEQ ID NO: 4431 - DNA, 16 bp, H. sapiens
aaaatgatttgtttta

SEQ ID NO: 4432 - DNA, 16 bp, H. sapiens
aaaatgattttgaaga

SEQ ID NO: 4433 - DNA, 16 bp, H. sapiens
aaaatgatttttcttt

SEQ ID NO: 4434 - DNA, 16 bp, H. sapiens
aaaatgcaaaatgaga

SEQ ID NO: 4435 - DNA, 16 bp, H. sapiens
aaaatgcaaaatgttt

SEQ ID NO: 4436 - DNA, 16 bp, H. sapiens
aaaatgcaaaattaca

SEQ ID NO: 4437 - DNA, 18 bp, H. sapiens
aaaatgcaaacttgggga

SEQ ID NO: 4438 - DNA, 16 bp, H. sapiens
aaaatgcaaaggagaa

SEQ ID NO: 4439 - DNA, 16 bp, H. sapiens
aaaatgcaaagggaaa

SEQ ID NO: 4440 - DNA, 16 bp, H. sapiens
aaaatgcaaatgagaa

SEQ ID NO: 4441 - DNA, 16 bp, H. sapiens
aaaatgcaaatggaaa

SEQ ID NO: 4442 - DNA, 16 bp, H. sapiens
aaaatgcaaattacaa

SEQ ID NO: 4443 - DNA, 16 bp, H. sapiens
aaaatgcaaattttat

SEQ ID NO: 4444 - DNA, 16 bp, H. sapiens
aaaatgcaacatacca

SEQ ID NO: 4445 - DNA, 16 bp, H. sapiens
aaaatgcaataaaatt

SEQ ID NO: 4446 - DNA, 16 bp, H. sapiens
aaaatgcaataaatat

SEQ ID NO: 4447 - DNA, 16 bp, H. sapiens
aaaatgcaataataat

SEQ ID NO: 4448 - DNA, 16 bp, H. sapiens
aaaatgcaatatttca

SEQ ID NO: 4449 - DNA, 16 bp, H. sapiens
aaaatgcaatatttgt

SEQ ID NO: 4450 - DNA, 16 bp, H. sapiens
aaaatgcaattacttt

SEQ ID NO: 4451 - DNA, 16 bp, H. sapiens
aaaatgcaattcaaaa

SEQ ID NO: 4452 - DNA, 16 bp, H. sapiens
aaaatgcaattggcat

SEQ ID NO: 4453 - DNA, 16 bp, H. sapiens
aaaatgcacaaatcat

SEQ ID NO: 4454 - DNA, 16 bp, H. sapiens
aaaatgcacatttaaa

SEQ ID NO: 4455 - DNA, 16 bp, H. sapiens
aaaatgcacttaatac

SEQ ID NO: 4456 - DNA, 16 bp, H. sapiens
aaaatgcacttttttt

SEQ ID NO: 4457 - DNA, 16 bp, H. sapiens
aaaatgcagaaaatca

SEQ ID NO: 4458 - DNA, 16 bp, H. sapiens
aaaatgcagaaattta

SEQ ID NO: 4459 - DNA, 16 bp, H. sapiens
aaaatgcagaatattt

SEQ ID NO: 4460 - DNA, 16 bp, H. sapiens
aaaatgcagacatttt

SEQ ID NO: 4461 - DNA, 16 bp, H. sapiens
aaaatgcagattcaaa

SEQ ID NO: 4462 - DNA, 16 bp, H. sapiens
aaaatgcagattcact

SEQ ID NO: 4463 - DNA, 16 bp, H. sapiens
aaaatgcagattcccc

SEQ ID NO: 4464 - DNA, 16 bp, H. sapiens
aaaatgcagattcctg

SEQ ID NO: 4465 - DNA, 16 bp, H. sapiens
aaaatgcagattttca

SEQ ID NO: 4466 - DNA, 16 bp, H. sapiens
aaaatgcagcaagaca

SEQ ID NO: 4467 - DNA, 16 bp, H. sapiens
aaaatgcagcagaaac

SEQ ID NO: 4468 - DNA, 16 bp, H. sapiens
aaaatgcagttttaaa

SEQ ID NO: 4469 - DNA, 16 bp, H. sapiens
aaaatgcagttttatt

SEQ ID NO: 4470 - DNA, 16 bp, H. sapiens
aaaatgcataaaatat

SEQ ID NO: 4471 - DNA, 16 bp, H. sapiens
aaaatgcatatatata

SEQ ID NO: 4472 - DNA, 16 bp, H. sapiens
aaaatgcatatatgta

SEQ ID NO: 4473 - DNA, 16 bp, H. sapiens
aaaatgcattaaagat

SEQ ID NO: 4474 - DNA, 16 bp, H. sapiens
aaaatgcattattttt

SEQ ID NO: 4475 - DNA, 16 bp, H. sapiens
aaaatgcatttaaata

SEQ ID NO: 4476 - DNA, 16 bp, H. sapiens
aaaatgcatttagaaa

SEQ ID NO: 4477 - DNA, 16 bp, H. sapiens
aaaatgcatttataaa

SEQ ID NO: 4478 - DNA, 16 bp, H. sapiens
aaaatgcatttggaaa

SEQ ID NO: 4479 - DNA, 16 bp, H. sapiens
aaaatgcattttataa

SEQ ID NO: 4480 - DNA, 16 bp, H. sapiens
aaaatgcattttatga

SEQ ID NO: 4481 - DNA, 16 bp, H. sapiens
aaaatgcattttattt

SEQ ID NO: 4482 - DNA, 16 bp, H. sapiens
aaaatgcattttcaaa

SEQ ID NO: 4483 - DNA, 16 bp, H. sapiens
aaaatgcattttcctt

SEQ ID NO: 4484 - DNA, 16 bp, H. sapiens
aaaatgcatttttcat

SEQ ID NO: 4485 - DNA, 16 bp, H. sapiens
aaaatgccaatagtgc

SEQ ID NO: 4486 - DNA, 16 bp, H. sapiens
aaaatgccacagaaaa

SEQ ID NO: 4487 - DNA, 16 bp, H. sapiens
aaaatgccatcagtct

SEQ ID NO: 4488 - DNA, 16 bp, H. sapiens
aaaatgccattttatt

SEQ ID NO: 4489 - DNA, 16 bp, H. sapiens
aaaatgccattttttt

SEQ ID NO: 4490 - DNA, 16 bp, H. sapiens
aaaatgcccacccagt

SEQ ID NO: 4491 - DNA, 16 bp, H. sapiens
aaaatgcctgcagctt

SEQ ID NO: 4492 - DNA, 16 bp, H. sapiens
aaaatgccttcaataa

SEQ ID NO: 4493 - DNA, 16 bp, H. sapiens
aaaatgcctttaaaaa

SEQ ID NO: 4494 - DNA, 16 bp, H. sapiens
aaaatgctaaaattta

SEQ ID NO: 4495 - DNA, 16 bp, H. sapiens
aaaatgctaaagactc

SEQ ID NO: 4496 - DNA, 16 bp, H. sapiens
aaaatgctaataatca

SEQ ID NO: 4497 - DNA, 16 bp, H. sapiens
aaaatgctactaattt

SEQ ID NO: 4498 - DNA, 16 bp, H. sapiens
aaaatgctacttaaaa

SEQ ID NO: 4499 - DNA, 16 bp, H. sapiens
aaaatgctatcaaaca

SEQ ID NO: 4500 - DNA, 16 bp, H. sapiens
aaaatgctatcaaata

SEQ ID NO: 4501 - DNA, 16 bp, H. sapiens
aaaatgctatgaagaa

SEQ ID NO: 4502 - DNA, 16 bp, H. sapiens
aaaatgctatgtaaat

SEQ ID NO: 4503 - DNA, 16 bp, H. sapiens
aaaatgctattaatat

SEQ ID NO: 4504 - DNA, 16 bp, H. sapiens
aaaatgctattattaa

SEQ ID NO: 4505 - DNA, 16 bp, H. sapiens
aaaatgctatttatat

SEQ ID NO: 4506 - DNA, 16 bp, H. sapiens
aaaatgctattttttt

SEQ ID NO: 4507 - DNA, 16 bp, H. sapiens
aaaatgctctgaaaaa

SEQ ID NO: 4508 - DNA, 16 bp, H. sapiens
aaaatgctgaaaacaa

SEQ ID NO: 4509 - DNA, 16 bp, H. sapiens
aaaatgctgaaaataa

SEQ ID NO: 4510 - DNA, 16 bp, H. sapiens
aaaatgctgaaaatca

SEQ ID NO: 4511 - DNA, 16 bp, H. sapiens
aaaatgctgaaaggaa

SEQ ID NO: 4512 - DNA, 16 bp, H. sapiens
aaaatgctgaaataaa

SEQ ID NO: 4513 - DNA, 16 bp, H. sapiens
aaaatgctgacacaga

SEQ ID NO: 4514 - DNA, 16 bp, H. sapiens
aaaatgctgagatgac

SEQ ID NO: 4515 - DNA, 16 bp, H. sapiens
aaaatgctgatgaaat

SEQ ID NO: 4516 - DNA, 16 bp, H. sapiens
aaaatgctgatggaaa

SEQ ID NO: 4517 - DNA, 16 bp, H. sapiens
aaaatgctgatttaaa

SEQ ID NO: 4518 - DNA, 16 bp, H. sapiens
aaaatgctgatttttt

SEQ ID NO: 4519 - DNA, 16 bp, H. sapiens
aaaatgctgctagtct

SEQ ID NO: 4520 - DNA, 16 bp, H. sapiens
aaaatgctgctgtgaa

SEQ ID NO: 4521 - DNA, 16 bp, H. sapiens
aaaatgctgtgtgatg

SEQ ID NO: 4522 - DNA, 16 bp, H. sapiens
aaaatgcttaaagaaa

SEQ ID NO: 4523 - DNA, 16 bp, H. sapiens
aaaatgcttaacaaaa

SEQ ID NO: 4524 - DNA, 16 bp, H. sapiens
aaaatgcttaataaaa

SEQ ID NO: 4525 - DNA, 16 bp, H. sapiens
aaaatgcttatttaaa

SEQ ID NO: 4526 - DNA, 16 bp, H. sapiens
aaaatgcttctaaaat

SEQ ID NO: 4527 - DNA, 16 bp, H. sapiens
aaaatgcttctgcaca

SEQ ID NO: 4528 - DNA, 16 bp, H. sapiens
aaaatgcttgggaaca

SEQ ID NO: 4529 - DNA, 16 bp, H. sapiens
aaaatgcttgggacaa

SEQ ID NO: 4530 - DNA, 16 bp, H. sapiens
aaaatgctttagaaaa

SEQ ID NO: 4531 - DNA, 16 bp, H. sapiens
aaaatgctttattttt

SEQ ID NO: 4532 - DNA, 16 bp, H. sapiens
aaaatgctttcagttt

SEQ ID NO: 4533 - DNA, 16 bp, H. sapiens
aaaatgctttctaaaa

SEQ ID NO: 4534 - DNA, 16 bp, H. sapiens
aaaatgctttctaaat

SEQ ID NO: 4535 - DNA, 16 bp, H. sapiens
aaaatgctttgaaaaa

SEQ ID NO: 4536 - DNA, 16 bp, H. sapiens
aaaatgctttgaaaag

SEQ ID NO: 4537 - DNA, 16 bp, H. sapiens
aaaatgctttgaaaat

SEQ ID NO: 4538 - DNA, 16 bp, H. sapiens
aaaatgctttgtaaac

SEQ ID NO: 4539 - DNA, 16 bp, H. sapiens
aaaatgctttgtgatg

SEQ ID NO: 4540 - DNA, 16 bp, H. sapiens
aaaatgcttttacttt

SEQ ID NO: 4541 - DNA, 16 bp, H. sapiens
aaaatgcttttataaa

SEQ ID NO: 4542 - DNA, 16 bp, H. sapiens
aaaatgcttttataat

SEQ ID NO: 4543 - DNA, 16 bp, H. sapiens
aaaatgcttttatttt

SEQ ID NO: 4544 - DNA, 16 bp, H. sapiens
aaaatgcttttcataa

SEQ ID NO: 4545 - DNA, 16 bp, H. sapiens
aaaatgctttttcctt

SEQ ID NO: 4546 - DNA, 16 bp, H. sapiens
aaaatggaaaaatact

SEQ ID NO: 4547 - DNA, 16 bp, H. sapiens
aaaatggaaaactttt

SEQ ID NO: 4548 - DNA, 16 bp, H. sapiens
aaaatggaaaagcaag

SEQ ID NO: 4549 - DNA, 16 bp, H. sapiens
aaaatggaaaagcaat

SEQ ID NO: 4550 - DNA, 16 bp, H. sapiens
aaaatggaaaatacat

SEQ ID NO: 4551 - DNA, 16 bp, H. sapiens
aaaatggaaaatgtca

SEQ ID NO: 4552 - DNA, 16 bp, H. sapiens
aaaatggaaacaatct

SEQ ID NO: 4553 - DNA, 16 bp, H. sapiens
aaaatggaaactcaga

SEQ ID NO: 4554 - DNA, 16 bp, H. sapiens
aaaatggaaactgaaa

SEQ ID NO: 4555 - DNA, 16 bp, H. sapiens
aaaatggaaagacaga

SEQ ID NO: 4556 - DNA, 16 bp, H. sapiens
aaaatggaaagtattt

SEQ ID NO: 4557 - DNA, 16 bp, H. sapiens
aaaatggaaatatcaa

SEQ ID NO: 4558 - DNA, 16 bp, H. sapiens
aaaatggaaatatttg

SEQ ID NO: 4559 - DNA, 16 bp, H. sapiens
aaaatggaacattaaa

SEQ ID NO: 4560 - DNA, 16 bp, H. sapiens
aaaatggaagcagaga

SEQ ID NO: 4561 - DNA, 16 bp, H. sapiens
aaaatggaaggaaatt

SEQ ID NO: 4562 - DNA, 16 bp, H. sapiens
aaaatggaataatttt

SEQ ID NO: 4563 - DNA, 16 bp, H. sapiens
aaaatggaatatttta

SEQ ID NO: 4564 - DNA, 16 bp, H. sapiens
aaaatggaattcagaa

SEQ ID NO: 4565 - DNA, 16 bp, H. sapiens
aaaatggaatttctta

SEQ ID NO: 4566 - DNA, 16 bp, H. sapiens
aaaatggacaaaggat

SEQ ID NO: 4567 - DNA, 16 bp, H. sapiens
aaaatggaccaatcag

SEQ ID NO: 4568 - DNA, 22 bp, H. sapiens
aaaatggaccaatcagcaggac

SEQ ID NO: 4569 - DNA, 20 bp, H. sapiens
aaaatggaccaatcagtgct

SEQ ID NO: 4570 - DNA, 16 bp, H. sapiens
aaaatggactaacaca

SEQ ID NO: 4571 - DNA, 16 bp, H. sapiens
aaaatggagaaatatt

SEQ ID NO: 4572 - DNA, 16 bp, H. sapiens
aaaatggagaaatcag

SEQ ID NO: 4573 - DNA, 16 bp, H. sapiens
aaaatggagacaaaat

SEQ ID NO: 4574 - DNA, 16 bp, H. sapiens
aaaatggagacaagaa

SEQ ID NO: 4575 - DNA, 16 bp, H. sapiens
aaaatggagagaattt

SEQ ID NO: 4576 - DNA, 16 bp, H. sapiens
aaaatggagatttttt

SEQ ID NO: 4577 - DNA, 16 bp, H. sapiens
aaaatggaggcaaaga

SEQ ID NO: 4578 - DNA, 16 bp, H. sapiens
aaaatggaggcagaaa

SEQ ID NO: 4579 - DNA, 16 bp, H. sapiens
aaaatggaggctcaga

SEQ ID NO: 4580 - DNA, 16 bp, H. sapiens
aaaatggagtcattca

SEQ ID NO: 4581 - DNA, 16 bp, H. sapiens
aaaatggatgaaaaca

SEQ ID NO: 4582 - DNA, 16 bp, H. sapiens
aaaatggatgaataca

SEQ ID NO: 4583 - DNA, 16 bp, H. sapiens
aaaatggatgagattg

SEQ ID NO: 4584 - DNA, 16 bp, H. sapiens
aaaatggattaaaaac

SEQ ID NO: 4585 - DNA, 16 bp, H. sapiens
aaaatggatttaaatt

SEQ ID NO: 4586 - DNA, 16 bp, H. sapiens
aaaatggatttcaaga

SEQ ID NO: 4587 - DNA, 16 bp, H. sapiens
aaaatggcaaaaactg

SEQ ID NO: 4588 - DNA, 16 bp, H. sapiens
aaaatggcaaaacatt

SEQ ID NO: 4589 - DNA, 16 bp, H. sapiens
aaaatggcaaatctaa

SEQ ID NO: 4590 - DNA, 16 bp, H. sapiens
aaaatggcaataataa

SEQ ID NO: 4591 - DNA, 16 bp, H. sapiens
aaaatggcaattatta

SEQ ID NO: 4592 - DNA, 16 bp, H. sapiens
aaaatggcacagaaat

SEQ ID NO: 4593 - DNA, 16 bp, H. sapiens
aaaatggcacatttta

SEQ ID NO: 4594 - DNA, 16 bp, H. sapiens
aaaatggcacttttga

SEQ ID NO: 4595 - DNA, 16 bp, H. sapiens
aaaatggcagaaaatg

SEQ ID NO: 4596 - DNA, 16 bp, H. sapiens
aaaatggcagaggaag

SEQ ID NO: 4597 - DNA, 16 bp, H. sapiens
aaaatggcatagtact

SEQ ID NO: 4598 - DNA, 16 bp, H. sapiens
aaaatggcatcctgct

SEQ ID NO: 4599 - DNA, 16 bp, H. sapiens
aaaatggcattaaaaa

SEQ ID NO: 4600 - DNA, 16 bp, H. sapiens
aaaatggcattaaaat

SEQ ID NO: 4601 - DNA, 16 bp, H. sapiens
aaaatggcattggtaa

SEQ ID NO: 4602 - DNA, 16 bp, H. sapiens
aaaatggcattttatt

SEQ ID NO: 4603 - DNA, 16 bp, H. sapiens
aaaatggcatttttct

SEQ ID NO: 4604 - DNA, 16 bp, H. sapiens
aaaatggccaggcaca

SEQ ID NO: 4605 - DNA, 20 bp, H. sapiens
aaaatggccatactgcccaa

SEQ ID NO: 4606 - DNA, 20 bp, H. sapiens
aaaatggccatactgcccat

SEQ ID NO: 4607 - DNA, 18 bp, H. sapiens
aaaatggccatactgcct

SEQ ID NO: 4608 - DNA, 16 bp, H. sapiens
aaaatgggaaacaaag

SEQ ID NO: 4609 - DNA, 16 bp, H. sapiens
aaaatgggaacaatga

SEQ ID NO: 4610 - DNA, 16 bp, H. sapiens
aaaatgggaacattaa

SEQ ID NO: 4611 - DNA, 16 bp, H. sapiens
aaaatgggaagcaaaa

SEQ ID NO: 4612 - DNA, 16 bp, H. sapiens
aaaatgggcaaaatat

SEQ ID NO: 4613 - DNA, 16 bp, H. sapiens
aaaatgggcaaagaaa

SEQ ID NO: 4614 - DNA, 16 bp, H. sapiens
aaaatgggcaaagcac

SEQ ID NO: 4615 - DNA, 16 bp, H. sapiens
aaaatgggcaaattat

SEQ ID NO: 4616 - DNA, 16 bp, H. sapiens
aaaatgggcaaccagc

SEQ ID NO: 4617 - DNA, 16 bp, H. sapiens
aaaatgggcaagagac

SEQ ID NO: 4618 - DNA, 16 bp, H. sapiens
aaaatggggaaaaaac

SEQ ID NO: 4619 - DNA, 16 bp, H. sapiens
aaaatggggaaactga

SEQ ID NO: 4620 - DNA, 16 bp, H. sapiens
aaaatggggaaataat

SEQ ID NO: 4621 - DNA, 16 bp, H. sapiens
aaaatggggataatag

SEQ ID NO: 4622 - DNA, 16 bp, H. sapiens
aaaatggggatgacaa

SEQ ID NO: 4623 - DNA, 16 bp, H. sapiens
aaaatggggatgacag

SEQ ID NO: 4624 - DNA, 16 bp, H. sapiens
aaaatggggattaaaa

SEQ ID NO: 4625 - DNA, 16 bp, H. sapiens
aaaatggggctgggca

SEQ ID NO: 4626 - DNA, 16 bp, H. sapiens
aaaatggggggaaata

SEQ ID NO: 4627 - DNA, 16 bp, H. sapiens
aaaatgggtaaatttt

SEQ ID NO: 4628 - DNA, 16 bp, H. sapiens
aaaatggtaaagggga

SEQ ID NO: 4629 - DNA, 16 bp, H. sapiens
aaaatggtaaatatgt

SEQ ID NO: 4630 - DNA, 16 bp, H. sapiens
aaaatggtacacctat

SEQ ID NO: 4631 - DNA, 16 bp, H. sapiens
aaaatggtacagacac

SEQ ID NO: 4632 - DNA, 16 bp, H. sapiens
aaaatggtacaggcag

SEQ ID NO: 4633 - DNA, 16 bp, H. sapiens
aaaatggtattagaaa

SEQ ID NO: 4634 - DNA, 16 bp, H. sapiens
aaaatggtcaaaaata

SEQ ID NO: 4635 - DNA, 16 bp, H. sapiens
aaaatggtgaacaaaa

SEQ ID NO: 4636 - DNA, 16 bp, H. sapiens
aaaatggtgagtttta

SEQ ID NO: 4637 - DNA, 16 bp, H. sapiens
aaaatggtgataaaat

SEQ ID NO: 4638 - DNA, 16 bp, H. sapiens
aaaatggtgataatga

SEQ ID NO: 4639 - DNA, 16 bp, H. sapiens
aaaatggtggagtatg

SEQ ID NO: 4640 - DNA, 16 bp, H. sapiens
aaaatggttaagatag

SEQ ID NO: 4641 - DNA, 16 bp, H. sapiens
aaaatggttaagatgg

SEQ ID NO: 4642 - DNA, 16 bp, H. sapiens
aaaatggttaattttt

SEQ ID NO: 4643 - DNA, 16 bp, H. sapiens
aaaatggttattttat

SEQ ID NO: 4644 - DNA, 16 bp, H. sapiens
aaaatggttattttta

SEQ ID NO: 4645 - DNA, 16 bp, H. sapiens
aaaatggttcatttta

SEQ ID NO: 4646 - DNA, 16 bp, H. sapiens
aaaatggtttatttta

SEQ ID NO: 4647 - DNA, 16 bp, H. sapiens
aaaatggtttttaaaa

SEQ ID NO: 4648 - DNA, 16 bp, H. sapiens
aaaatggtttttacat

SEQ ID NO: 4649 - DNA, 16 bp, H. sapiens
aaaatgtaaaaactgt

SEQ ID NO: 4650 - DNA, 16 bp, H. sapiens
aaaatgtaaaacttag

SEQ ID NO: 4651 - DNA, 16 bp, H. sapiens
aaaatgtaaaatatct

SEQ ID NO: 4652 - DNA, 16 bp, H. sapiens
aaaatgtaaaattcta

SEQ ID NO: 4653 - DNA, 16 bp, H. sapiens
aaaatgtaaacacatt

SEQ ID NO: 4654 - DNA, 16 bp, H. sapiens
aaaatgtaaacattta

SEQ ID NO: 4655 - DNA, 16 bp, H. sapiens
aaaatgtaaacatttt

SEQ ID NO: 4656 - DNA, 16 bp, H. sapiens
aaaatgtaaagactat

SEQ ID NO: 4657 - DNA, 16 bp, H. sapiens
aaaatgtaaagatttt

SEQ ID NO: 4658 - DNA, 16 bp, H. sapiens
aaaatgtaaagcattt

SEQ ID NO: 4659 - DNA, 16 bp, H. sapiens
aaaatgtaaagttttt

SEQ ID NO: 4660 - DNA, 16 bp, H. sapiens
aaaatgtaaatacata

SEQ ID NO: 4661 - DNA, 16 bp, H. sapiens
aaaatgtaaatctgat

SEQ ID NO: 4662 - DNA, 16 bp, H. sapiens
aaaatgtaaattatgt

SEQ ID NO: 4663 - DNA, 16 bp, H. sapiens
aaaatgtaacagaaat

SEQ ID NO: 4664 - DNA, 16 bp, H. sapiens
aaaatgtaacttttca

SEQ ID NO: 4665 - DNA, 16 bp, H. sapiens
aaaatgtaagaatttt

SEQ ID NO: 4666 - DNA, 16 bp, H. sapiens
aaaatgtaatgaaaac

SEQ ID NO: 4667 - DNA, 16 bp, H. sapiens
aaaatgtaatgtatat

SEQ ID NO: 4668 - DNA, 16 bp, H. sapiens
aaaatgtaatgttttt

SEQ ID NO: 4669 - DNA, 16 bp, H. sapiens
aaaatgtaatttcatt

SEQ ID NO: 4670 - DNA, 16 bp, H. sapiens
aaaatgtacaaaatat

SEQ ID NO: 4671 - DNA, 16 bp, H. sapiens
aaaatgtacaatattt

SEQ ID NO: 4672 - DNA, 16 bp, H. sapiens
aaaatgtacataaaac

SEQ ID NO: 4673 - DNA, 16 bp, H. sapiens
aaaatgtacataattt

SEQ ID NO: 4674 - DNA, 16 bp, H. sapiens
aaaatgtacattattt

SEQ ID NO: 4675 - DNA, 16 bp, H. sapiens
aaaatgtactatatat

SEQ ID NO: 4676 - DNA, 16 bp, H. sapiens
aaaatgtactctttta

SEQ ID NO: 4677 - DNA, 16 bp, H. sapiens
aaaatgtactttgaaa

SEQ ID NO: 4678 - DNA, 16 bp, H. sapiens
aaaatgtagacaaaat

SEQ ID NO: 4679 - DNA, 16 bp, H. sapiens
aaaatgtagcagaaaa

SEQ ID NO: 4680 - DNA, 16 bp, H. sapiens
aaaatgtagttttaaa

SEQ ID NO: 4681 - DNA, 16 bp, H. sapiens
aaaatgtataaagcaa

SEQ ID NO: 4682 - DNA, 16 bp, H. sapiens
aaaatgtatatacaca

SEQ ID NO: 4683 - DNA, 16 bp, H. sapiens
aaaatgtatatacttt

SEQ ID NO: 4684 - DNA, 16 bp, H. sapiens
aaaatgtatattcaca

SEQ ID NO: 4685 - DNA, 16 bp, H. sapiens
aaaatgtatattgtgt

SEQ ID NO: 4686 - DNA, 16 bp, H. sapiens
aaaatgtatattttct

SEQ ID NO: 4687 - DNA, 16 bp, H. sapiens
aaaatgtatattttga

SEQ ID NO: 4688 - DNA, 16 bp, H. sapiens
aaaatgtatcaaaaat

SEQ ID NO: 4689 - DNA, 16 bp, H. sapiens
aaaatgtatcaatttt

SEQ ID NO: 4690 - DNA, 16 bp, H. sapiens
aaaatgtatctatatt

SEQ ID NO: 4691 - DNA, 16 bp, H. sapiens
aaaatgtatcttaaaa

SEQ ID NO: 4692 - DNA, 16 bp, H. sapiens
aaaatgtatctttaaa

SEQ ID NO: 4693 - DNA, 16 bp, H. sapiens
aaaatgtatgatttta

SEQ ID NO: 4694 - DNA, 16 bp, H. sapiens
aaaatgtatgtgtttt

SEQ ID NO: 4695 - DNA, 16 bp, H. sapiens
aaaatgtatgttctgt

SEQ ID NO: 4696 - DNA, 16 bp, H. sapiens
aaaatgtattaaatgt

SEQ ID NO: 4697 - DNA, 16 bp, H. sapiens
aaaatgtattattgaa

SEQ ID NO: 4698 - DNA, 16 bp, H. sapiens
aaaatgtattcatatt

SEQ ID NO: 4699 - DNA, 16 bp, H. sapiens
aaaatgtattcctttt

SEQ ID NO: 4700 - DNA, 16 bp, H. sapiens
aaaatgtatttatcta

SEQ ID NO: 4701 - DNA, 16 bp, H. sapiens
aaaatgtatttatgaa

SEQ ID NO: 4702 - DNA, 16 bp, H. sapiens
aaaatgtatttcagaa

SEQ ID NO: 4703 - DNA, 16 bp, H. sapiens
aaaatgtatttctgta

SEQ ID NO: 4704 - DNA, 16 bp, H. sapiens
aaaatgtatttgaaag

SEQ ID NO: 4705 - DNA, 16 bp, H. sapiens
aaaatgtatttgaaat

SEQ ID NO: 4706 - DNA, 16 bp, H. sapiens
aaaatgtatttgacaa

SEQ ID NO: 4707 - DNA, 16 bp, H. sapiens
aaaatgtatttgagga

SEQ ID NO: 4708 - DNA, 16 bp, H. sapiens
aaaatgtatttgcata

SEQ ID NO: 4709 - DNA, 16 bp, H. sapiens
aaaatgtatttgctat

SEQ ID NO: 4710 - DNA, 16 bp, H. sapiens
aaaatgtatttggaaa

SEQ ID NO: 4711 - DNA, 16 bp, H. sapiens
aaaatgtattttactt

SEQ ID NO: 4712 - DNA, 16 bp, H. sapiens
aaaatgtattttatga

SEQ ID NO: 4713 - DNA, 16 bp, H. sapiens
aaaatgtattttgaaa

SEQ ID NO: 4714 - DNA, 16 bp, H. sapiens
aaaatgtatttttctt

SEQ ID NO: 4715 - DNA, 16 bp, H. sapiens
aaaatgtcaaaaatat

SEQ ID NO: 4716 - DNA, 16 bp, H. sapiens
aaaatgtcaaaatgaa

SEQ ID NO: 4717 - DNA, 16 bp, H. sapiens
aaaatgtcaaagaata

SEQ ID NO: 4718 - DNA, 16 bp, H. sapiens
aaaatgtcaacattta

SEQ ID NO: 4719 - DNA, 16 bp, H. sapiens
aaaatgtcaacttttt

SEQ ID NO: 4720 - DNA, 16 bp, H. sapiens
aaaatgtcaatatcat

SEQ ID NO: 4721 - DNA, 16 bp, H. sapiens
aaaatgtcaccaaaaa

SEQ ID NO: 4722 - DNA, 16 bp, H. sapiens
aaaatgtcagaagaaa

SEQ ID NO: 4723 - DNA, 16 bp, H. sapiens
aaaatgtcagtagtgc

SEQ ID NO: 4724 - DNA, 16 bp, H. sapiens
aaaatgtcagtatttt

SEQ ID NO: 4725 - DNA, 16 bp, H. sapiens
aaaatgtcagtgaaga

SEQ ID NO: 4726 - DNA, 16 bp, H. sapiens
aaaatgtcagttcttc

SEQ ID NO: 4727 - DNA, 16 bp, H. sapiens
aaaatgtcataaactg

SEQ ID NO: 4728 - DNA, 16 bp, H. sapiens
aaaatgtcattgaaat

SEQ ID NO: 4729 - DNA, 16 bp, H. sapiens
aaaatgtcatttttaa

SEQ ID NO: 4730 - DNA, 16 bp, H. sapiens
aaaatgtccaaaataa

SEQ ID NO: 4731 - DNA, 16 bp, H. sapiens
aaaatgtcctaaaatt

SEQ ID NO: 4732 - DNA, 16 bp, H. sapiens
aaaatgtctaaaataa

SEQ ID NO: 4733 - DNA, 16 bp, H. sapiens
aaaatgtctagaagaa

SEQ ID NO: 4734 - DNA, 16 bp, H. sapiens
aaaatgtctattcaaa

SEQ ID NO: 4735 - DNA, 16 bp, H. sapiens
aaaatgtctccaaata

SEQ ID NO: 4736 - DNA, 16 bp, H. sapiens
aaaatgtctccagaca

SEQ ID NO: 4737 - DNA, 16 bp, H. sapiens
aaaatgtctccagggc

SEQ ID NO: 4738 - DNA, 20 bp, H. sapiens
aaaatgtctccagggcatat

SEQ ID NO: 4739 - DNA, 16 bp, H. sapiens
aaaatgtcttctaaaa

SEQ ID NO: 4740 - DNA, 16 bp, H. sapiens
aaaatgtctttcattt

SEQ ID NO: 4741 - DNA, 16 bp, H. sapiens
aaaatgtctttccttt

SEQ ID NO: 4742 - DNA, 16 bp, H. sapiens
aaaatgtcttttcttt

SEQ ID NO: 4743 - DNA, 16 bp, H. sapiens
aaaatgtctttttttt

SEQ ID NO: 4744 - DNA, 16 bp, H. sapiens
aaaatgtgaaaaatgt

SEQ ID NO: 4745 - DNA, 16 bp, H. sapiens
aaaatgtgaaaacaat

SEQ ID NO: 4746 - DNA, 16 bp, H. sapiens
aaaatgtgaaaagaca

SEQ ID NO: 4747 - DNA, 16 bp, H. sapiens
aaaatgtgaaacaatt

SEQ ID NO: 4748 - DNA, 16 bp, H. sapiens
aaaatgtgaaacataa

SEQ ID NO: 4749 - DNA, 16 bp, H. sapiens
aaaatgtgaaacattt

SEQ ID NO: 4750 - DNA, 16 bp, H. sapiens
aaaatgtgaaactttt

SEQ ID NO: 4751 - DNA, 16 bp, H. sapiens
aaaatgtgaaagcaac

SEQ ID NO: 4752 - DNA, 16 bp, H. sapiens
aaaatgtgaaattatg

SEQ ID NO: 4753 - DNA, 16 bp, H. sapiens
aaaatgtgaaattcaa

SEQ ID NO: 4754 - DNA, 16 bp, H. sapiens
aaaatgtgaacaaata

SEQ ID NO: 4755 - DNA, 16 bp, H. sapiens
aaaatgtgaagaattt

SEQ ID NO: 4756 - DNA, 16 bp, H. sapiens
aaaatgtgaatgtttt

SEQ ID NO: 4757 - DNA, 16 bp, H. sapiens
aaaatgtgaattattt

SEQ ID NO: 4758 - DNA, 16 bp, H. sapiens
aaaatgtgactgaaat

SEQ ID NO: 4759 - DNA, 16 bp, H. sapiens
aaaatgtgactgtatt

SEQ ID NO: 4760 - DNA, 16 bp, H. sapiens
aaaatgtgatattttg

SEQ ID NO: 4761 - DNA, 16 bp, H. sapiens
aaaatgtgatgtttat

SEQ ID NO: 4762 - DNA, 16 bp, H. sapiens
aaaatgtgattatttt

SEQ ID NO: 4763 - DNA, 16 bp, H. sapiens
aaaatgtgatttattt

SEQ ID NO: 4764 - DNA, 16 bp, H. sapiens
aaaatgtgcagtattt

SEQ ID NO: 4765 - DNA, 16 bp, H. sapiens
aaaatgtgccagaaag

SEQ ID NO: 4766 - DNA, 16 bp, H. sapiens
aaaatgtgccaggcat

SEQ ID NO: 4767 - DNA, 16 bp, H. sapiens
aaaatgtgccatttta

SEQ ID NO: 4768 - DNA, 16 bp, H. sapiens
aaaatgtgctattttt

SEQ ID NO: 4769 - DNA, 16 bp, H. sapiens
aaaatgtgcttatttt

SEQ ID NO: 4770 - DNA, 16 bp, H. sapiens
aaaatgtgcttttaaa

SEQ ID NO: 4771 - DNA, 16 bp, H. sapiens
aaaatgtgctttttaa

SEQ ID NO: 4772 - DNA, 16 bp, H. sapiens
aaaatgtggaaaacaa

SEQ ID NO: 4773 - DNA, 16 bp, H. sapiens
aaaatgtggaaacagc

SEQ ID NO: 4774 - DNA, 16 bp, H. sapiens
aaaatgtggaacatat

SEQ ID NO: 4775 - DNA, 16 bp, H. sapiens
aaaatgtggaagaaac

SEQ ID NO: 4776 - DNA, 16 bp, H. sapiens
aaaatgtggaagcaac

SEQ ID NO: 4777 - DNA, 16 bp, H. sapiens
aaaatgtggagaaatt

SEQ ID NO: 4778 - DNA, 16 bp, H. sapiens
aaaatgtggaggtgga

SEQ ID NO: 4779 - DNA, 16 bp, H. sapiens
aaaatgtggcaaagtt

SEQ ID NO: 4780 - DNA, 16 bp, H. sapiens
aaaatgtggccaggca

SEQ ID NO: 4781 - DNA, 17 bp, H. sapiens
aaaatgtgggaaagttt

SEQ ID NO: 4782 - DNA, 16 bp, H. sapiens
aaaatgtggtacatac

SEQ ID NO: 4783 - DNA, 16 bp, H. sapiens
aaaatgtggtacatgg

SEQ ID NO: 4784 - DNA, 16 bp, H. sapiens
aaaatgtggtatttac

SEQ ID NO: 4785 - DNA, 16 bp, H. sapiens
aaaatgtggtatttgt

SEQ ID NO: 4786 - DNA, 16 bp, H. sapiens
aaaatgtgtaaagaac

SEQ ID NO: 4787 - DNA, 16 bp, H. sapiens
aaaatgtgtaaatgaa

SEQ ID NO: 4788 - DNA, 16 bp, H. sapiens
aaaatgtgtaaatttt

SEQ ID NO: 4789 - DNA, 16 bp, H. sapiens
aaaatgtgtacatatg

SEQ ID NO: 4790 - DNA, 16 bp, H. sapiens
aaaatgtgtatatatg

SEQ ID NO: 4791 - DNA, 16 bp, H. sapiens
aaaatgtgtatatttt

SEQ ID NO: 4792 - DNA, 16 bp, H. sapiens
aaaatgtgtatttctt

SEQ ID NO: 4793 - DNA, 16 bp, H. sapiens
aaaatgtgtattttat

SEQ ID NO: 4794 - DNA, 16 bp, H. sapiens
aaaatgtgtgatgggc

SEQ ID NO: 4795 - DNA, 16 bp, H. sapiens
aaaatgtgtgattttt

SEQ ID NO: 4796 - DNA, 16 bp, H. sapiens
aaaatgtgttactttt

SEQ ID NO: 4797 - DNA, 16 bp, H. sapiens
aaaatgtgtttaataa

SEQ ID NO: 4798 - DNA, 16 bp, H. sapiens
aaaatgtgtttcatat

SEQ ID NO: 4799 - DNA, 16 bp, H. sapiens
aaaatgtgtttgaaaa

SEQ ID NO: 4800 - DNA, 16 bp, H. sapiens
aaaatgtgtttgtttc

SEQ ID NO: 4801 - DNA, 16 bp, H. sapiens
aaaatgtgtttgtttt

SEQ ID NO: 4802 - DNA, 16 bp, H. sapiens
aaaatgtgttttaata

SEQ ID NO: 4803 - DNA, 16 bp, H. sapiens
aaaatgtgttttaatt

SEQ ID NO: 4804 - DNA, 16 bp, H. sapiens
aaaatgtgttttgaaa

SEQ ID NO: 4805 - DNA, 16 bp, H. sapiens
aaaatgttaaaaagtg

SEQ ID NO: 4806 - DNA, 16 bp, H. sapiens
aaaatgttaaaacatt

SEQ ID NO: 4807 - DNA, 16 bp, H. sapiens
aaaatgttaaacattt

SEQ ID NO: 4808 - DNA, 16 bp, H. sapiens
aaaatgttaaatacat

SEQ ID NO: 4809 - DNA, 16 bp, H. sapiens
aaaatgttaacagtgg

SEQ ID NO: 4810 - DNA, 16 bp, H. sapiens
aaaatgttaacatttg

SEQ ID NO: 4811 - DNA, 16 bp, H. sapiens
aaaatgttaactatgt

SEQ ID NO: 4812 - DNA, 16 bp, H. sapiens
aaaatgttaagaatga

SEQ ID NO: 4813 - DNA, 16 bp, H. sapiens
aaaatgttaatacttt

SEQ ID NO: 4814 - DNA, 16 bp, H. sapiens
aaaatgttaatagtgc

SEQ ID NO: 4815 - DNA, 16 bp, H. sapiens
aaaatgttaatggtag

SEQ ID NO: 4816 - DNA, 16 bp, H. sapiens
aaaatgttacaaaata

SEQ ID NO: 4817 - DNA, 16 bp, H. sapiens
aaaatgttactaaaat

SEQ ID NO: 4818 - DNA, 16 bp, H. sapiens
aaaatgttactgaaat

SEQ ID NO: 4819 - DNA, 16 bp, H. sapiens
aaaatgttagcaaact

SEQ ID NO: 4820 - DNA, 16 bp, H. sapiens
aaaatgttagcaaatc

SEQ ID NO: 4821 - DNA, 16 bp, H. sapiens
aaaatgttataaatgt

SEQ ID NO: 4822 - DNA, 16 bp, H. sapiens
aaaatgttataggaaa

SEQ ID NO: 4823 - DNA, 16 bp, H. sapiens
aaaatgttatttgtaa

SEQ ID NO: 4824 - DNA, 16 bp, H. sapiens
aaaatgttattttctg

SEQ ID NO: 4825 - DNA, 16 bp, H. sapiens
aaaatgttattttgaa

SEQ ID NO: 4826 - DNA, 16 bp, H. sapiens
aaaatgttcaacacca

SEQ ID NO: 4827 - DNA, 16 bp, H. sapiens
aaaatgttcacagcag

SEQ ID NO: 4828 - DNA, 16 bp, H. sapiens
aaaatgttcatgtcct

SEQ ID NO: 4829 - DNA, 16 bp, H. sapiens
aaaatgttcattaaaa

SEQ ID NO: 4830 - DNA, 16 bp, H. sapiens
aaaatgttcattttaa

SEQ ID NO: 4831 - DNA, 16 bp, H. sapiens
aaaatgttcctgtttc

SEQ ID NO: 4832 - DNA, 16 bp, H. sapiens
aaaatgttctaaaatt

SEQ ID NO: 4833 - DNA, 16 bp, H. sapiens
aaaatgttctcctttt

SEQ ID NO: 4834 - DNA, 16 bp, H. sapiens
aaaatgttctctctct

SEQ ID NO: 4835 - DNA, 16 bp, H. sapiens
aaaatgttctgtaatt

SEQ ID NO: 4836 - DNA, 16 bp, H. sapiens
aaaatgttctgtttct

SEQ ID NO: 4837 - DNA, 16 bp, H. sapiens
aaaatgttcttattaa

SEQ ID NO: 4838 - DNA, 16 bp, H. sapiens
aaaatgttcttccttt

SEQ ID NO: 4839 - DNA, 16 bp, H. sapiens
aaaatgttctttgaaa

SEQ ID NO: 4840 - DNA, 16 bp, H. sapiens
aaaatgttcttttctt

SEQ ID NO: 4841 - DNA, 16 bp, H. sapiens
aaaatgttgcaaaaaa

SEQ ID NO: 4842 - DNA, 16 bp, H. sapiens
aaaatgttgggattac

SEQ ID NO: 4843 - DNA, 16 bp, H. sapiens
aaaatgttgtaactga

SEQ ID NO: 4844 - DNA, 16 bp, H. sapiens
aaaatgttgtatttta

SEQ ID NO: 4845 - DNA, 16 bp, H. sapiens
aaaatgttgtttgttt

SEQ ID NO: 4846 - DNA, 16 bp, H. sapiens
aaaatgtttaaaatct

SEQ ID NO: 4847 - DNA, 16 bp, H. sapiens
aaaatgtttaaagaca

SEQ ID NO: 4848 - DNA, 16 bp, H. sapiens
aaaatgtttaaatact

SEQ ID NO: 4849 - DNA, 16 bp, H. sapiens
aaaatgtttaacaaaa

SEQ ID NO: 4850 - DNA, 16 bp, H. sapiens
aaaatgtttaatatca

SEQ ID NO: 4851 - DNA, 16 bp, H. sapiens
aaaatgtttaattggc

SEQ ID NO: 4852 - DNA, 16 bp, H. sapiens
aaaatgtttacaaaaa

SEQ ID NO: 4853 - DNA, 16 bp, H. sapiens
aaaatgtttacatttt

SEQ ID NO: 4854 - DNA, 16 bp, H. sapiens
aaaatgtttactgaat

SEQ ID NO: 4855 - DNA, 16 bp, H. sapiens
aaaatgtttagaaaca

SEQ ID NO: 4856 - DNA, 16 bp, H. sapiens
aaaatgtttagaattt

SEQ ID NO: 4857 - DNA, 16 bp, H. sapiens
aaaatgtttagagatt

SEQ ID NO: 4858 - DNA, 16 bp, H. sapiens
aaaatgtttatagttt

SEQ ID NO: 4859 - DNA, 16 bp, H. sapiens
aaaatgtttatcaaga

SEQ ID NO: 4860 - DNA, 16 bp, H. sapiens
aaaatgtttattcctt

SEQ ID NO: 4861 - DNA, 16 bp, H. sapiens
aaaatgtttattcttt

SEQ ID NO: 4862 - DNA, 16 bp, H. sapiens
aaaatgtttcacaaat

SEQ ID NO: 4863 - DNA, 16 bp, H. sapiens
aaaatgtttcataatt

SEQ ID NO: 4864 - DNA, 16 bp, H. sapiens
aaaatgtttcattttt

SEQ ID NO: 4865 - DNA, 16 bp, H. sapiens
aaaatgtttccaaatt

SEQ ID NO: 4866 - DNA, 16 bp, H. sapiens
aaaatgtttcctcttt

SEQ ID NO: 4867 - DNA, 16 bp, H. sapiens
aaaatgtttcctgaat

SEQ ID NO: 4868 - DNA, 16 bp, H. sapiens
aaaatgtttctgcaca

SEQ ID NO: 4869 - DNA, 16 bp, H. sapiens
aaaatgtttctgtttt

SEQ ID NO: 4870 - DNA, 16 bp, H. sapiens
aaaatgtttcttaaat

SEQ ID NO: 4871 - DNA, 16 bp, H. sapiens
aaaatgtttctttttc

SEQ ID NO: 4872 - DNA, 16 bp, H. sapiens
aaaatgtttgaaaaca

SEQ ID NO: 4873 - DNA, 16 bp, H. sapiens
aaaatgtttgaaatat

SEQ ID NO: 4874 - DNA, 16 bp, H. sapiens
aaaatgtttgaagaaa

SEQ ID NO: 4875 - DNA, 16 bp, H. sapiens
aaaatgtttgaattaa

SEQ ID NO: 4876 - DNA, 16 bp, H. sapiens
aaaatgtttgcaaatg

SEQ ID NO: 4877 - DNA, 16 bp, H. sapiens
aaaatgtttgctgacc

SEQ ID NO: 4878 - DNA, 16 bp, H. sapiens
aaaatgtttggttttt

SEQ ID NO: 4879 - DNA, 16 bp, H. sapiens
aaaatgtttgtaaatt

SEQ ID NO: 4880 - DNA, 16 bp, H. sapiens
aaaatgtttgtaattt

SEQ ID NO: 4881 - DNA, 16 bp, H. sapiens
aaaatgtttgtttaaa

SEQ ID NO: 4882 - DNA, 16 bp, H. sapiens
aaaatgtttgtttgtt

SEQ ID NO: 4883 - DNA, 16 bp, H. sapiens
aaaatgtttgtttttc

SEQ ID NO: 4884 - DNA, 16 bp, H. sapiens
aaaatgttttaaaagt

SEQ ID NO: 4885 - DNA, 16 bp, H. sapiens
aaaatgttttaacaat

SEQ ID NO: 4886 - DNA, 16 bp, H. sapiens
aaaatgttttaccttt

SEQ ID NO: 4887 - DNA, 16 bp, H. sapiens
aaaatgttttagaaca

SEQ ID NO: 4888 - DNA, 16 bp, H. sapiens
aaaatgttttagataa

SEQ ID NO: 4889 - DNA, 16 bp, H. sapiens
aaaatgttttagattt

SEQ ID NO: 4890 - DNA, 16 bp, H. sapiens
aaaatgttttataaga

SEQ ID NO: 4891 - DNA, 16 bp, H. sapiens
aaaatgttttatcttt

SEQ ID NO: 4892 - DNA, 16 bp, H. sapiens
aaaatgttttatgatg

SEQ ID NO: 4893 - DNA, 16 bp, H. sapiens
aaaatgttttattaca

SEQ ID NO: 4894 - DNA, 16 bp, H. sapiens
aaaatgttttattctt

SEQ ID NO: 4895 - DNA, 16 bp, H. sapiens
aaaatgttttcaaatt

SEQ ID NO: 4896 - DNA, 16 bp, H. sapiens
aaaatgttttcatatt

SEQ ID NO: 4897 - DNA, 16 bp, H. sapiens
aaaatgttttccaaac

SEQ ID NO: 4898 - DNA, 16 bp, H. sapiens
aaaatgttttccattt

SEQ ID NO: 4899 - DNA, 16 bp, H. sapiens
aaaatgttttctgtgt

SEQ ID NO: 4900 - DNA, 16 bp, H. sapiens
aaaatgttttctgttt

SEQ ID NO: 4901 - DNA, 16 bp, H. sapiens
aaaatgttttcttaat

SEQ ID NO: 4902 - DNA, 16 bp, H. sapiens
aaaatgttttgaaaac

SEQ ID NO: 4903 - DNA, 16 bp, H. sapiens
aaaatgttttggaaat

SEQ ID NO: 4904 - DNA, 16 bp, H. sapiens
aaaatgttttggagat

SEQ ID NO: 4905 - DNA, 16 bp, H. sapiens
aaaatgttttgtatat

SEQ ID NO: 4906 - DNA, 16 bp, H. sapiens
aaaatgttttgttttg

SEQ ID NO: 4907 - DNA, 16 bp, H. sapiens
aaaatgtttttaaagt

SEQ ID NO: 4908 - DNA, 16 bp, H. sapiens
aaaatgtttttaagaa

SEQ ID NO: 4909 - DNA, 16 bp, H. sapiens
aaaatgtttttacaat

SEQ ID NO: 4910 - DNA, 16 bp, H. sapiens
aaaatgtttttacatt

SEQ ID NO: 4911 - DNA, 16 bp, H. sapiens
aaaatgtttttcaaat

SEQ ID NO: 4912 - DNA, 16 bp, H. sapiens
aaaatgtttttcctta

SEQ ID NO: 4913 - DNA, 16 bp, H. sapiens
aaaatgtttttctatt

SEQ ID NO: 4914 - DNA, 16 bp, H. sapiens
aaaatgtttttcttcc

SEQ ID NO: 4915 - DNA, 16 bp, H. sapiens
aaaatgtttttcttgt

SEQ ID NO: 4916 - DNA, 16 bp, H. sapiens
aaaatgttttttcaaa

SEQ ID NO: 4917 - DNA, 16 bp, H. sapiens
aaaatgtttttttctt

SEQ ID NO: 4918 - DNA, 16 bp, H. sapiens
aaaattaaaaatgctt

SEQ ID NO: 4919 - DNA, 16 bp, H. sapiens
aaaattaaaacatcag

SEQ ID NO: 4920 - DNA, 16 bp, H. sapiens
aaaattaaaactattg

SEQ ID NO: 4921 - DNA, 16 bp, H. sapiens
aaaattaaaacttcag

SEQ ID NO: 4922 - DNA, 16 bp, H. sapiens
aaaattaaaagttagc

SEQ ID NO: 4923 - DNA, 16 bp, H. sapiens
aaaattaaaatgccaa

SEQ ID NO: 4924 - DNA, 16 bp, H. sapiens
aaaattaaacagattt

SEQ ID NO: 4925 - DNA, 16 bp, H. sapiens
aaaattaaacaggtgt

SEQ ID NO: 4926 - DNA, 16 bp, H. sapiens
aaaattaaagaatttc

SEQ ID NO: 4927 - DNA, 16 bp, H. sapiens
aaaattaaagcaatta

SEQ ID NO: 4928 - DNA, 16 bp, H. sapiens
aaaattaaagcttaaa

SEQ ID NO: 4929 - DNA, 16 bp, H. sapiens
aaaattaaagttcaaa

SEQ ID NO: 4930 - DNA, 16 bp, H. sapiens
aaaattaaatctcatt

SEQ ID NO: 4931 - DNA, 16 bp, H. sapiens
aaaattaaatgcaaat

SEQ ID NO: 4932 - DNA, 16 bp, H. sapiens
aaaattaaatgcatat

SEQ ID NO: 4933 - DNA, 16 bp, H. sapiens
aaaattaaatgtgtta

SEQ ID NO: 4934 - DNA, 16 bp, H. sapiens
aaaattaaattagcta

SEQ ID NO: 4935 - DNA, 16 bp, H. sapiens
aaaattaaattctaag

SEQ ID NO: 4936 - DNA, 16 bp, H. sapiens
aaaattaaatttcaga

SEQ ID NO: 4937 - DNA, 16 bp, H. sapiens
aaaattaacatttgaa

SEQ ID NO: 4938 - DNA, 16 bp, H. sapiens
aaaattaaccaggtgt

SEQ ID NO: 4939 - DNA, 16 bp, H. sapiens
aaaattaaccgggcat

SEQ ID NO: 4940 - DNA, 16 bp, H. sapiens
aaaattaacttggcat

SEQ ID NO: 4941 - DNA, 16 bp, H. sapiens
aaaattaacttgtttt

SEQ ID NO: 4942 - DNA, 16 bp, H. sapiens
aaaattaactttgttt

SEQ ID NO: 4943 - DNA, 16 bp, H. sapiens
aaaattaagaattctt

SEQ ID NO: 4944 - DNA, 16 bp, H. sapiens
aaaattaagaattttg

SEQ ID NO: 4945 - DNA, 16 bp, H. sapiens
aaaattaaggaaatgt

SEQ ID NO: 4946 - DNA, 16 bp, H. sapiens
aaaattaaggctgggc

SEQ ID NO: 4947 - DNA, 16 bp, H. sapiens
aaaattaagtcataaa

SEQ ID NO: 4948 - DNA, 16 bp, H. sapiens
aaaattaataattcct

SEQ ID NO: 4949 - DNA, 16 bp, H. sapiens
aaaattaatctcaatt

SEQ ID NO: 4950 - DNA, 16 bp, H. sapiens
aaaattaatgaaatca

SEQ ID NO: 4951 - DNA, 16 bp, H. sapiens
aaaattaatgaactat

SEQ ID NO: 4952 - DNA, 16 bp, H. sapiens
aaaattaatggcattt

SEQ ID NO: 4953 - DNA, 16 bp, H. sapiens
aaaattaattcatgat

SEQ ID NO: 4954 - DNA, 16 bp, H. sapiens
aaaattaattccattt

SEQ ID NO: 4955 - DNA, 16 bp, H. sapiens
aaaattaattctagat

SEQ ID NO: 4956 - DNA, 16 bp, H. sapiens
aaaattaatttcagtt

SEQ ID NO: 4957 - DNA, 16 bp, H. sapiens
aaaattacaaaaagtt

SEQ ID NO: 4958 - DNA, 16 bp, H. sapiens
aaaattacaaaaatgt

SEQ ID NO: 4959 - DNA, 16 bp, H. sapiens
aaaattacaaatggaa

SEQ ID NO: 4960 - DNA, 16 bp, H. sapiens
aaaattacaagaatta

SEQ ID NO: 4961 - DNA, 16 bp, H. sapiens
aaaattacatttctca

SEQ ID NO: 4962 - DNA, 16 bp, H. sapiens
aaaattacatttgaaa

SEQ ID NO: 4963 - DNA, 17 bp, H. sapiens
aaaattacccaggcatg

SEQ ID NO: 4964 - DNA, 16 bp, H. sapiens
aaaattacccgggcat

SEQ ID NO: 4965 - DNA, 19 bp, H. sapiens
aaaattacccgggcgtggt

SEQ ID NO: 4966 - DNA, 16 bp, H. sapiens
aaaattacccttgaaa

SEQ ID NO: 4967 - DNA, 16 bp, H. sapiens
aaaattactgaaagaa

SEQ ID NO: 4968 - DNA, 16 bp, H. sapiens
aaaattactgaagaaa

SEQ ID NO: 4969 - DNA, 16 bp, H. sapiens
aaaattactgatattt

SEQ ID NO: 4970 - DNA, 16 bp, H. sapiens
aaaattacttaatttc

SEQ ID NO: 4971 - DNA, 16 bp, H. sapiens
aaaattacttctgttt

SEQ ID NO: 4972 - DNA, 16 bp, H. sapiens
aaaattacttggaaaa

SEQ ID NO: 4973 - DNA, 16 bp, H. sapiens
aaaattactttaaagt

SEQ ID NO: 4974 - DNA, 16 bp, H. sapiens
aaaattactttgtttt

SEQ ID NO: 4975 - DNA, 16 bp, H. sapiens
aaaattagaaagtgac

SEQ ID NO: 4976 - DNA, 16 bp, H. sapiens
aaaattagaagaatgt

SEQ ID NO: 4977 - DNA, 16 bp, H. sapiens
aaaattagaagtgcca

SEQ ID NO: 4978 - DNA, 16 bp, H. sapiens
aaaattagaattttgg

SEQ ID NO: 4979 - DNA, 16 bp, H. sapiens
aaaattagacattttt

SEQ ID NO: 4980 - DNA, 17 bp, H. sapiens
aaaattagatgggtgtg

SEQ ID NO: 4981 - DNA, 16 bp, H. sapiens
aaaattagcaatatat

SEQ ID NO: 4982 - DNA, 16 bp, H. sapiens
aaaattagcagggtgt

SEQ ID NO: 4983 - DNA, 16 bp, H. sapiens
aaaattagcatatttt

SEQ ID NO: 4984 - DNA, 16 bp, H. sapiens
aaaattagccaagcat

SEQ ID NO: 4985 - DNA, 16 bp, H. sapiens
aaaattagccaagctt

SEQ ID NO: 4986 - DNA, 16 bp, H. sapiens
aaaattagccacatgt

SEQ ID NO: 4987 - DNA, 16 bp, H. sapiens
aaaattagccagacat

SEQ ID NO: 4988 - DNA, 16 bp, H. sapiens
aaaattagccagccat

SEQ ID NO: 4989 - DNA, 16 bp, H. sapiens
aaaattagccaggagt

SEQ ID NO: 4990 - DNA, 17 bp, H. sapiens
aaaattagccaggagta

SEQ ID NO: 4991 - DNA, 19 bp, H. sapiens
aaaattagccaggcacggt

SEQ ID NO: 4992 - DNA, 16 bp, H. sapiens
aaaattagccaggcag

SEQ ID NO: 4993 - DNA, 16 bp, H. sapiens
aaaattagccaggcat

SEQ ID NO: 4994 - DNA, 16 bp, H. sapiens
aaaattagccaggcga

SEQ ID NO: 4995 - DNA, 16 bp, H. sapiens
aaaattagccaggcgt

SEQ ID NO: 4996 - DNA, 16 bp, H. sapiens
aaaattagccaggtat

SEQ ID NO: 4997 - DNA, 17 bp, H. sapiens
aaaattagccaggtgta

SEQ ID NO: 4998 - DNA, 21 bp, H. sapiens
aaaattagccaggtgtggtgg

SEQ ID NO: 4999 - DNA, 16 bp, H. sapiens
aaaattagccatgtgt

SEQ ID NO: 5000 - DNA, 16 bp, H. sapiens
aaaattagccgagtat

SEQ ID NO: 5001 - DNA, 20 bp, H. sapiens
aaaattagccgggcatggta

SEQ ID NO: 5002 - DNA, 20 bp, H. sapiens
aaaattagccgggcgtggtt

SEQ ID NO: 5003 - DNA, 17 bp, H. sapiens
aaaattagccgggcgtt

SEQ ID NO: 5004 - DNA, 16 bp, H. sapiens
aaaattagccgggctt

SEQ ID NO: 5005 - DNA, 16 bp, H. sapiens
aaaattagccgggggt

SEQ ID NO: 5006 - DNA, 16 bp, H. sapiens
aaaattagccgggtat

SEQ ID NO: 5007 - DNA, 16 bp, H. sapiens
aaaattagccgggtgt

SEQ ID NO: 5008 - DNA, 19 bp, H. sapiens
aaaattagccgggtttggt

SEQ ID NO: 5009 - DNA, 16 bp, H. sapiens
aaaattagcctggcat

SEQ ID NO: 5010 - DNA, 22 bp, H. sapiens
aaaattagcctggtgtggtggt

SEQ ID NO: 5011 - DNA, 16 bp, H. sapiens
aaaattagctaaatgt

SEQ ID NO: 5012 - DNA, 17 bp, H. sapiens
aaaattagctaggcgta

SEQ ID NO: 5013 - DNA, 16 bp, H. sapiens
aaaattagctgaatgt

SEQ ID NO: 5014 - DNA, 16 bp, H. sapiens
aaaattagctgagcgt

SEQ ID NO: 5015 - DNA, 17 bp, H. sapiens
aaaattagctgagtgtg

SEQ ID NO: 5016 - DNA, 16 bp, H. sapiens
aaaattagctggacct

SEQ ID NO: 5017 - DNA, 16 bp, H. sapiens
aaaattagctggactt

SEQ ID NO: 5018 - DNA, 17 bp, H. sapiens
aaaattagctgggcata

SEQ ID NO: 5019 - DNA, 16 bp, H. sapiens
aaaattagctgggcgt

SEQ ID NO: 5020 - DNA, 16 bp, H. sapiens
aaaattagctggtcat

SEQ ID NO: 5021 - DNA, 16 bp, H. sapiens
aaaattagcttaaaaa

SEQ ID NO: 5022 - DNA, 16 bp, H. sapiens
aaaattaggcaggcac

SEQ ID NO: 5023 - DNA, 16 bp, H. sapiens
aaaattaggccgggtg

SEQ ID NO: 5024 - DNA, 19 bp, H. sapiens
aaaattagttgggtgtggt

SEQ ID NO: 5025 - DNA, 16 bp, H. sapiens
aaaattagttttattg

SEQ ID NO: 5026 - DNA, 16 bp, H. sapiens
aaaattataaacttct

SEQ ID NO: 5027 - DNA, 16 bp, H. sapiens
aaaattataaagcatt

SEQ ID NO: 5028 - DNA, 16 bp, H. sapiens
aaaattataaatgaca

SEQ ID NO: 5029 - DNA, 16 bp, H. sapiens
aaaattatagtcattt

SEQ ID NO: 5030 - DNA, 16 bp, H. sapiens
aaaattatatatctga

SEQ ID NO: 5031 - DNA, 16 bp, H. sapiens
aaaattatatcagaaa

SEQ ID NO: 5032 - DNA, 16 bp, H. sapiens
aaaattatatttcaga

SEQ ID NO: 5033 - DNA, 16 bp, H. sapiens
aaaattatatttctca

SEQ ID NO: 5034 - DNA, 16 bp, H. sapiens
aaaattatatttttcc

SEQ ID NO: 5035 - DNA, 16 bp, H. sapiens
aaaattatccaggcgt

SEQ ID NO: 5036 - DNA, 19 bp, H. sapiens
aaaattatccgggcgtggt

SEQ ID NO: 5037 - DNA, 16 bp, H. sapiens
aaaattatccttgaaa

SEQ ID NO: 5038 - DNA, 16 bp, H. sapiens
aaaattatccttttct

SEQ ID NO: 5039 - DNA, 16 bp, H. sapiens
aaaattatctatttct

SEQ ID NO: 5040 - DNA, 16 bp, H. sapiens
aaaattatctctgttt

SEQ ID NO: 5041 - DNA, 16 bp, H. sapiens
aaaattatctcttttg

SEQ ID NO: 5042 - DNA, 16 bp, H. sapiens
aaaattatctgggcat

SEQ ID NO: 5043 - DNA, 16 bp, H. sapiens
aaaattatctttcaaa

SEQ ID NO: 5044 - DNA, 16 bp, H. sapiens
aaaattatctttgaaa

SEQ ID NO: 5045 - DNA, 16 bp, H. sapiens
aaaattatgactgaaa

SEQ ID NO: 5046 - DNA, 16 bp, H. sapiens
aaaattatgcaaaatt

SEQ ID NO: 5047 - DNA, 16 bp, H. sapiens
aaaattatggcagaaa

SEQ ID NO: 5048 - DNA, 16 bp, H. sapiens
aaaattatgggaaact

SEQ ID NO: 5049 - DNA, 16 bp, H. sapiens
aaaattattcagcttt

SEQ ID NO: 5050 - DNA, 16 bp, H. sapiens
aaaattattctgtatt

SEQ ID NO: 5051 - DNA, 16 bp, H. sapiens
aaaattattgaaaaca

SEQ ID NO: 5052 - DNA, 16 bp, H. sapiens
aaaattattgagatat

SEQ ID NO: 5053 - DNA, 16 bp, H. sapiens
aaaattattgcttttt

SEQ ID NO: 5054 - DNA, 16 bp, H. sapiens
aaaattattggcattt

SEQ ID NO: 5055 - DNA, 16 bp, H. sapiens
aaaattattgtttctt

SEQ ID NO: 5056 - DNA, 16 bp, H. sapiens
aaaattatttattgag

SEQ ID NO: 5057 - DNA, 16 bp, H. sapiens
aaaattatttcaagaa

SEQ ID NO: 5058 - DNA, 16 bp, H. sapiens
aaaattatttcagaaa

SEQ ID NO: 5059 - DNA, 16 bp, H. sapiens
aaaattatttcaggaa

SEQ ID NO: 5060 - DNA, 16 bp, H. sapiens
aaaattatttcagtct

SEQ ID NO: 5061 - DNA, 16 bp, H. sapiens
aaaattatttcatctt

SEQ ID NO: 5062 - DNA, 16 bp, H. sapiens
aaaattatttccaaag

SEQ ID NO: 5063 - DNA, 16 bp, H. sapiens
aaaattatttcctaat

SEQ ID NO: 5064 - DNA, 16 bp, H. sapiens
aaaattatttccttta

SEQ ID NO: 5065 - DNA, 16 bp, H. sapiens
aaaattatttctacaa

SEQ ID NO: 5066 - DNA, 16 bp, H. sapiens
aaaattatttgaagtt

SEQ ID NO: 5067 - DNA, 16 bp, H. sapiens
aaaattatttgttgag

SEQ ID NO: 5068 - DNA, 16 bp, H. sapiens
aaaattattttgagaa

SEQ ID NO: 5069 - DNA, 16 bp, H. sapiens
aaaattattttgcatt

SEQ ID NO: 5070 - DNA, 16 bp, H. sapiens
aaaattattttggaaa

SEQ ID NO: 5071 - DNA, 16 bp, H. sapiens
aaaattattttgttca

SEQ ID NO: 5072 - DNA, 16 bp, H. sapiens
aaaattatttttgctt

SEQ ID NO: 5073 - DNA, 16 bp, H. sapiens
aaaattcaaaaaattg

SEQ ID NO: 5074 - DNA, 16 bp, H. sapiens
aaaattcaaaaatgtt

SEQ ID NO: 5075 - DNA, 16 bp, H. sapiens
aaaattcaaaactttt

SEQ ID NO: 5076 - DNA, 16 bp, H. sapiens
aaaattcaacatactt

SEQ ID NO: 5077 - DNA, 16 bp, H. sapiens
aaaattcaacatcctt

SEQ ID NO: 5078 - DNA, 16 bp, H. sapiens
aaaattcaacattcct

SEQ ID NO: 5079 - DNA, 16 bp, H. sapiens
aaaattcaactgaaaa

SEQ ID NO: 5080 - DNA, 16 bp, H. sapiens
aaaattcaagaagaga

SEQ ID NO: 5081 - DNA, 16 bp, H. sapiens
aaaattcaagctttca

SEQ ID NO: 5082 - DNA, 16 bp, H. sapiens
aaaattcaatcagtaa

SEQ ID NO: 5083 - DNA, 16 bp, H. sapiens
aaaattcaatttgcaa

SEQ ID NO: 5084 - DNA, 16 bp, H. sapiens
aaaattcacaaaactt

SEQ ID NO: 5085 - DNA, 16 bp, H. sapiens
aaaattcacactgaaa

SEQ ID NO: 5086 - DNA, 16 bp, H. sapiens
aaaattcacatggaaa

SEQ ID NO: 5087 - DNA, 16 bp, H. sapiens
aaaattcacattgaaa

SEQ ID NO: 5088 - DNA, 16 bp, H. sapiens
aaaattcacatttcta

SEQ ID NO: 5089 - DNA, 16 bp, H. sapiens
aaaattcaccatctta

SEQ ID NO: 5090 - DNA, 16 bp, H. sapiens
aaaattcaccatttta

SEQ ID NO: 5091 - DNA, 16 bp, H. sapiens
aaaattcaccctttta

SEQ ID NO: 5092 - DNA, 16 bp, H. sapiens
aaaattcactcatttt

SEQ ID NO: 5093 - DNA, 16 bp, H. sapiens
aaaattcactcttttt

SEQ ID NO: 5094 - DNA, 16 bp, H. sapiens
aaaattcagaaatata

SEQ ID NO: 5095 - DNA, 16 bp, H. sapiens
aaaattcagaattcca

SEQ ID NO: 5096 - DNA, 16 bp, H. sapiens
aaaattcagatgaaaa

SEQ ID NO: 5097 - DNA, 16 bp, H. sapiens
aaaattcagatgttga

SEQ ID NO: 5098 - DNA, 16 bp, H. sapiens
aaaattcagattctga

SEQ ID NO: 5099 - DNA, 16 bp, H. sapiens
aaaattcagcagtaaa

SEQ ID NO: 5100 - DNA, 16 bp, H. sapiens
aaaattcagcagtgaa

SEQ ID NO: 5101 - DNA, 16 bp, H. sapiens
aaaattcagtaagaaa

SEQ ID NO: 5102 - DNA, 16 bp, H. sapiens
aaaattcagtatttta

SEQ ID NO: 5103 - DNA, 16 bp, H. sapiens
aaaattcagtgctttt

SEQ ID NO: 5104 - DNA, 16 bp, H. sapiens
aaaattcagtggtttt

SEQ ID NO: 5105 - DNA, 16 bp, H. sapiens
aaaattcatacagaac

SEQ ID NO: 5106 - DNA, 16 bp, H. sapiens
aaaattcatagaaaat

SEQ ID NO: 5107 - DNA, 16 bp, H. sapiens
aaaattcatagaaatg

SEQ ID NO: 5108 - DNA, 16 bp, H. sapiens
aaaattcatatggaat

SEQ ID NO: 5109 - DNA, 16 bp, H. sapiens
aaaattcatatgttga

SEQ ID NO: 5110 - DNA, 16 bp, H. sapiens
aaaattcatccatttt

SEQ ID NO: 5111 - DNA, 16 bp, H. sapiens
aaaattcatctgaaat

SEQ ID NO: 5112 - DNA, 16 bp, H. sapiens
aaaattcatgctgaaa

SEQ ID NO: 5113 - DNA, 16 bp, H. sapiens
aaaattcatgttgaaa

SEQ ID NO: 5114 - DNA, 16 bp, H. sapiens
aaaattcatttaaaag

SEQ ID NO: 5115 - DNA, 16 bp, H. sapiens
aaaattcatttaatac

SEQ ID NO: 5116 - DNA, 16 bp, H. sapiens
aaaattcatttatgtt

SEQ ID NO: 5117 - DNA, 16 bp, H. sapiens
aaaattcattttaaag

SEQ ID NO: 5118 - DNA, 16 bp, H. sapiens
aaaattcattttctaa

SEQ ID NO: 5119 - DNA, 16 bp, H. sapiens
aaaattcattttgaaa

SEQ ID NO: 5120 - DNA, 16 bp, H. sapiens
aaaattccaaaaagca

SEQ ID NO: 5121 - DNA, 16 bp, H. sapiens
aaaattccaaaagtaa

SEQ ID NO: 5122 - DNA, 16 bp, H. sapiens
aaaattccaaaatctg

SEQ ID NO: 5123 - DNA, 16 bp, H. sapiens
aaaattccaaattttt

SEQ ID NO: 5124 - DNA, 16 bp, H. sapiens
aaaattccacaaagtt

SEQ ID NO: 5125 - DNA, 16 bp, H. sapiens
aaaattccagaaacaa

SEQ ID NO: 5126 - DNA, 16 bp, H. sapiens
aaaattccagaaataa

SEQ ID NO: 5127 - DNA, 16 bp, H. sapiens
aaaattccagaaatgt

SEQ ID NO: 5128 - DNA, 16 bp, H. sapiens
aaaattccagaaatta

SEQ ID NO: 5129 - DNA, 16 bp, H. sapiens
aaaattccagaagata

SEQ ID NO: 5130 - DNA, 16 bp, H. sapiens
aaaattccatttataa

SEQ ID NO: 5131 - DNA, 16 bp, H. sapiens
aaaattccatttcttt

SEQ ID NO: 5132 - DNA, 16 bp, H. sapiens
aaaattccatttttgt

SEQ ID NO: 5133 - DNA, 16 bp, H. sapiens
aaaattcccaaatatt

SEQ ID NO: 5134 - DNA, 16 bp, H. sapiens
aaaattcccatttaaa

SEQ ID NO: 5135 - DNA, 16 bp, H. sapiens
aaaattccctttcttt

SEQ ID NO: 5136 - DNA, 16 bp, H. sapiens
aaaattcctattgtct

SEQ ID NO: 5137 - DNA, 16 bp, H. sapiens
aaaattcctcttttta

SEQ ID NO: 5138 - DNA, 16 bp, H. sapiens
aaaattcctgaaaatt

SEQ ID NO: 5139 - DNA, 16 bp, H. sapiens
aaaattcctgacctca

SEQ ID NO: 5140 - DNA, 16 bp, H. sapiens
aaaattctaaaaagca

SEQ ID NO: 5141 - DNA, 16 bp, H. sapiens
aaaattctaaagattt

SEQ ID NO: 5142 - DNA, 16 bp, H. sapiens
aaaattctaaatcttt

SEQ ID NO: 5143 - DNA, 16 bp, H. sapiens
aaaattctaatgacat

SEQ ID NO: 5144 - DNA, 16 bp, H. sapiens
aaaattctactgctat

SEQ ID NO: 5145 - DNA, 16 bp, H. sapiens
aaaattctagaacatt

SEQ ID NO: 5146 - DNA, 16 bp, H. sapiens
aaaattctagaagaaa

SEQ ID NO: 5147 - DNA, 16 bp, H. sapiens
aaaattctaggaaatg

SEQ ID NO: 5148 - DNA, 16 bp, H. sapiens
aaaattctaggagata

SEQ ID NO: 5149 - DNA, 16 bp, H. sapiens
aaaattctatcatttt

SEQ ID NO: 5150 - DNA, 16 bp, H. sapiens
aaaattctattttgtt

SEQ ID NO: 5151 - DNA, 16 bp, H. sapiens
aaaattctcaacagaa

SEQ ID NO: 5152 - DNA, 16 bp, H. sapiens
aaaattctcaagaaaa

SEQ ID NO: 5153 - DNA, 16 bp, H. sapiens
aaaattctcaatattt

SEQ ID NO: 5154 - DNA, 16 bp, H. sapiens
aaaattctcagaaaac

SEQ ID NO: 5155 - DNA, 16 bp, H. sapiens
aaaattctcaggaaaa

SEQ ID NO: 5156 - DNA, 16 bp, H. sapiens
aaaattctccacaaaa

SEQ ID NO: 5157 - DNA, 16 bp, H. sapiens
aaaattctctcatttt

SEQ ID NO: 5158 - DNA, 16 bp, H. sapiens
aaaattctcttttctt

SEQ ID NO: 5159 - DNA, 16 bp, H. sapiens
aaaattctgaaaaaat

SEQ ID NO: 5160 - DNA, 16 bp, H. sapiens
aaaattctgaagaaaa

SEQ ID NO: 5161 - DNA, 16 bp, H. sapiens
aaaattctgagtaaaa

SEQ ID NO: 5162 - DNA, 16 bp, H. sapiens
aaaattctggaagata

SEQ ID NO: 5163 - DNA, 16 bp, H. sapiens
aaaattctgtatttct

SEQ ID NO: 5164 - DNA, 16 bp, H. sapiens
aaaattctgttgttta

SEQ ID NO: 5165 - DNA, 16 bp, H. sapiens
aaaattcttagaacag

SEQ ID NO: 5166 - DNA, 16 bp, H. sapiens
aaaattcttaggaaaa

SEQ ID NO: 5167 - DNA, 16 bp, H. sapiens
aaaattcttctctgcc

SEQ ID NO: 5168 - DNA, 16 bp, H. sapiens
aaaattcttctggaca

SEQ ID NO: 5169 - DNA, 16 bp, H. sapiens
aaaattctttatttca

SEQ ID NO: 5170 - DNA, 16 bp, H. sapiens
aaaattctttgaaaat

SEQ ID NO: 5171 - DNA, 16 bp, H. sapiens
aaaattcttttaagaa

SEQ ID NO: 5172 - DNA, 16 bp, H. sapiens
aaaattctttttttgt

SEQ ID NO: 5173 - DNA, 16 bp, H. sapiens
aaaattgaaaacttct

SEQ ID NO: 5174 - DNA, 16 bp, H. sapiens
aaaattgaaaattcag

SEQ ID NO: 5175 - DNA, 16 bp, H. sapiens
aaaattgaaatccatg

SEQ ID NO: 5176 - DNA, 16 bp, H. sapiens
aaaattgaacttttaa

SEQ ID NO: 5177 - DNA, 16 bp, H. sapiens
aaaattgaagaggaca

SEQ ID NO: 5178 - DNA, 16 bp, H. sapiens
aaaattgaatcattaa

SEQ ID NO: 5179 - DNA, 16 bp, H. sapiens
aaaattgaatgttttt

SEQ ID NO: 5180 - DNA, 16 bp, H. sapiens
aaaattgaattcaaat

SEQ ID NO: 5181 - DNA, 16 bp, H. sapiens
aaaattgacaaagctt

SEQ ID NO: 5182 - DNA, 16 bp, H. sapiens
aaaattgacaaatggc

SEQ ID NO: 5183 - DNA, 27 bp, H. sapiens
aaaattgacaaatgggatcgaattaaa

SEQ ID NO: 5184 - DNA, 20 bp, H. sapiens
aaaattgacaaatgggatct

SEQ ID NO: 5185 - DNA, 17 bp, H. sapiens
aaaattgacaagtggga

SEQ ID NO: 5186 - DNA, 16 bp, H. sapiens
aaaattgacacatggg

SEQ ID NO: 5187 - DNA, 17 bp, H. sapiens
aaaattgacgaatggga

SEQ ID NO: 5188 - DNA, 16 bp, H. sapiens
aaaattgactcaagaa

SEQ ID NO: 5189 - DNA, 16 bp, H. sapiens
aaaattgacttatttt

SEQ ID NO: 5190 - DNA, 16 bp, H. sapiens
aaaattgagaagatag

SEQ ID NO: 5191 - DNA, 16 bp, H. sapiens
aaaattgagacccaga

SEQ ID NO: 5192 - DNA, 16 bp, H. sapiens
aaaattgagatatttt

SEQ ID NO: 5193 - DNA, 16 bp, H. sapiens
aaaattgaggaggagg

SEQ ID NO: 5194 - DNA, 16 bp, H. sapiens
aaaattgaggcacaga

SEQ ID NO: 5195 - DNA, 16 bp, H. sapiens
aaaattgatgacataa

SEQ ID NO: 5196 - DNA, 16 bp, H. sapiens
aaaattgattttgaaa

SEQ ID NO: 5197 - DNA, 16 bp, H. sapiens
aaaattgcaaaggaaa

SEQ ID NO: 5198 - DNA, 16 bp, H. sapiens
aaaattgcaccactgc

SEQ ID NO: 5199 - DNA, 16 bp, H. sapiens
aaaattgcagaaaata

SEQ ID NO: 5200 - DNA, 16 bp, H. sapiens
aaaattgccaagagag

SEQ ID NO: 5201 - DNA, 16 bp, H. sapiens
aaaattgcctacagta

SEQ ID NO: 5202 - DNA, 16 bp, H. sapiens
aaaattgccttaaaaa

SEQ ID NO: 5203 - DNA, 16 bp, H. sapiens
aaaattgccttttttt

SEQ ID NO: 5204 - DNA, 16 bp, H. sapiens
aaaattgctaaagaaa

SEQ ID NO: 5205 - DNA, 16 bp, H. sapiens
aaaattgctctgaaaa

SEQ ID NO: 5206 - DNA, 16 bp, H. sapiens
aaaattggaaaataca

SEQ ID NO: 5207 - DNA, 16 bp, H. sapiens
aaaattggaaacaatg

SEQ ID NO: 5208 - DNA, 16 bp, H. sapiens
aaaattggcaaagaat

SEQ ID NO: 5209 - DNA, 17 bp, H. sapiens
aaaattggcaaatggga

SEQ ID NO: 5210 - DNA, 16 bp, H. sapiens
aaaattggcattttaa

SEQ ID NO: 5211 - DNA, 16 bp, H. sapiens
aaaattggttcttggg

SEQ ID NO: 5212 - DNA, 16 bp, H. sapiens
aaaattggtttcattt

SEQ ID NO: 5213 - DNA, 16 bp, H. sapiens
aaaattgtaagcaaaa

SEQ ID NO: 5214 - DNA, 16 bp, H. sapiens
aaaattgtattacaaa

SEQ ID NO: 5215 - DNA, 16 bp, H. sapiens
aaaattgtatttacaa

SEQ ID NO: 5216 - DNA, 16 bp, H. sapiens
aaaattgtatttctat

SEQ ID NO: 5217 - DNA, 16 bp, H. sapiens
aaaattgtcaagaaaa

SEQ ID NO: 5218 - DNA, 16 bp, H. sapiens
aaaattgtctataaaa

SEQ ID NO: 5219 - DNA, 16 bp, H. sapiens
aaaattgtctgggtgt

SEQ ID NO: 5220 - DNA, 16 bp, H. sapiens
aaaattgtcttttctt

SEQ ID NO: 5221 - DNA, 16 bp, H. sapiens
aaaattgtgactgaga

SEQ ID NO: 5222 - DNA, 16 bp, H. sapiens
aaaattgtgtaaattt

SEQ ID NO: 5223 - DNA, 16 bp, H. sapiens
aaaattgtgtacttct

SEQ ID NO: 5224 - DNA, 16 bp, H. sapiens
aaaattgtgttttaaa

SEQ ID NO: 5225 - DNA, 16 bp, H. sapiens
aaaattgttaattttg

SEQ ID NO: 5226 - DNA, 16 bp, H. sapiens
aaaattgttacaaagt

SEQ ID NO: 5227 - DNA, 16 bp, H. sapiens
aaaattgttcatttta

SEQ ID NO: 5228 - DNA, 16 bp, H. sapiens
aaaattgttgaaagaa

SEQ ID NO: 5229 - DNA, 16 bp, H. sapiens
aaaattgtttcaagaa

SEQ ID NO: 5230 - DNA, 16 bp, H. sapiens
aaaattgtttcatttt

SEQ ID NO: 5231 - DNA, 16 bp, H. sapiens
aaaattgtttgctttt

SEQ ID NO: 5232 - DNA, 16 bp, H. sapiens
aaaattgtttggtttt

SEQ ID NO: 5233 - DNA, 16 bp, H. sapiens
aaaattgttttaacat

SEQ ID NO: 5234 - DNA, 16 bp, H. sapiens
aaaattgttttatttc

SEQ ID NO: 5235 - DNA, 16 bp, H. sapiens
aaaattgttttccttt

SEQ ID NO: 5236 - DNA, 16 bp, H. sapiens
aaaattgttttcttaa

SEQ ID NO: 5237 - DNA, 16 bp, H. sapiens
aaaattgttttcttca

SEQ ID NO: 5238 - DNA, 16 bp, H. sapiens
aaaattgtttttctaa

SEQ ID NO: 5239 - DNA, 16 bp, H. sapiens
aaaattgtttttctat

SEQ ID NO: 5240 - DNA, 16 bp, H. sapiens
aaaatttaaaaagttc

SEQ ID NO: 5241 - DNA, 16 bp, H. sapiens
aaaatttaaaactggg

SEQ ID NO: 5242 - DNA, 16 bp, H. sapiens
aaaatttaaaaggctg

SEQ ID NO: 5243 - DNA, 16 bp, H. sapiens
aaaatttaaaatgcta

SEQ ID NO: 5244 - DNA, 16 bp, H. sapiens
aaaatttaaagcaaca

SEQ ID NO: 5245 - DNA, 16 bp, H. sapiens
aaaatttaactctgtg

SEQ ID NO: 5246 - DNA, 16 bp, H. sapiens
aaaatttaactgaaaa

SEQ ID NO: 5247 - DNA, 16 bp, H. sapiens
aaaatttaagtcttta

SEQ ID NO: 5248 - DNA, 16 bp, H. sapiens
aaaatttaatgacatt

SEQ ID NO: 5249 - DNA, 16 bp, H. sapiens
aaaatttaattctgaa

SEQ ID NO: 5250 - DNA, 16 bp, H. sapiens
aaaatttacatgttga

SEQ ID NO: 5251 - DNA, 16 bp, H. sapiens
aaaatttacattttga

SEQ ID NO: 5252 - DNA, 16 bp, H. sapiens
aaaatttaccttttaa

SEQ ID NO: 5253 - DNA, 16 bp, H. sapiens
aaaatttaccttttta

SEQ ID NO: 5254 - DNA, 16 bp, H. sapiens
aaaatttagacatttg

SEQ ID NO: 5255 - DNA, 16 bp, H. sapiens
aaaatttagcaaaatt

SEQ ID NO: 5256 - DNA, 16 bp, H. sapiens
aaaatttagccatgtg

SEQ ID NO: 5257 - DNA, 16 bp, H. sapiens
aaaatttagccgggcg

SEQ ID NO: 5258 - DNA, 17 bp, H. sapiens
aaaatttatagcactaa

SEQ ID NO: 5259 - DNA, 16 bp, H. sapiens
aaaatttatgtggaaa

SEQ ID NO: 5260 - DNA, 16 bp, H. sapiens
aaaatttatgtttgta

SEQ ID NO: 5261 - DNA, 25 bp, H. sapiens
aaaatttattaggtgggaatttcct

SEQ ID NO: 5262 - DNA, 16 bp, H. sapiens
aaaatttattcattca

SEQ ID NO: 5263 - DNA, 16 bp, H. sapiens
aaaatttattctcatt

SEQ ID NO: 5264 - DNA, 16 bp, H. sapiens
aaaatttattttgaag

SEQ ID NO: 5265 - DNA, 16 bp, H. sapiens
aaaatttcaaaaatgt

SEQ ID NO: 5266 - DNA, 16 bp, H. sapiens
aaaatttcaaaagtga

SEQ ID NO: 5267 - DNA, 16 bp, H. sapiens
aaaatttcaaagtaaa

SEQ ID NO: 5268 - DNA, 16 bp, H. sapiens
aaaatttcaaggaaaa

SEQ ID NO: 5269 - DNA, 16 bp, H. sapiens
aaaatttcaagtatat

SEQ ID NO: 5270 - DNA, 16 bp, H. sapiens
aaaatttcaatggcat

SEQ ID NO: 5271 - DNA, 16 bp, H. sapiens
aaaatttcagaaacat

SEQ ID NO: 5272 - DNA, 16 bp, H. sapiens
aaaatttcagaaataa

SEQ ID NO: 5273 - DNA, 16 bp, H. sapiens
aaaatttcagaaatta

SEQ ID NO: 5274 - DNA, 16 bp, H. sapiens
aaaatttcagaatatt

SEQ ID NO: 5275 - DNA, 16 bp, H. sapiens
aaaatttcagatttta

SEQ ID NO: 5276 - DNA, 16 bp, H. sapiens
aaaatttcagcatttt

SEQ ID NO: 5277 - DNA, 16 bp, H. sapiens
aaaatttcaggaaaca

SEQ ID NO: 5278 - DNA, 16 bp, H. sapiens
aaaatttcagtaaaat

SEQ ID NO: 5279 - DNA, 16 bp, H. sapiens
aaaatttcagtatttt

SEQ ID NO: 5280 - DNA, 16 bp, H. sapiens
aaaatttcagttaaat

SEQ ID NO: 5281 - DNA, 16 bp, H. sapiens
aaaatttcatcagaat

SEQ ID NO: 5282 - DNA, 16 bp, H. sapiens
aaaatttcatggaaat

SEQ ID NO: 5283 - DNA, 16 bp, H. sapiens
aaaatttcattttgtt

SEQ ID NO: 5284 - DNA, 16 bp, H. sapiens
aaaatttccaaaattt

SEQ ID NO: 5285 - DNA, 16 bp, H. sapiens
aaaatttccaattttt

SEQ ID NO: 5286 - DNA, 16 bp, H. sapiens
aaaatttccatttgtt

SEQ ID NO: 5287 - DNA, 16 bp, H. sapiens
aaaatttctaagaaaa

SEQ ID NO: 5288 - DNA, 16 bp, H. sapiens
aaaatttctgcacagc

SEQ ID NO: 5289 - DNA, 16 bp, H. sapiens
aaaatttctggaaaga

SEQ ID NO: 5290 - DNA, 16 bp, H. sapiens
aaaatttctgtgaaga

SEQ ID NO: 5291 - DNA, 16 bp, H. sapiens
aaaatttcttaagaaa

SEQ ID NO: 5292 - DNA, 16 bp, H. sapiens
aaaatttcttccacca

SEQ ID NO: 5293 - DNA, 16 bp, H. sapiens
aaaatttcttgaaata

SEQ ID NO: 5294 - DNA, 16 bp, H. sapiens
aaaatttctttggaaa

SEQ ID NO: 5295 - DNA, 16 bp, H. sapiens
aaaatttgaaaaacag

SEQ ID NO: 5296 - DNA, 16 bp, H. sapiens
aaaatttgaaaactta

SEQ ID NO: 5297 - DNA, 16 bp, H. sapiens
aaaatttgaaacatat

SEQ ID NO: 5298 - DNA, 16 bp, H. sapiens
aaaatttgaaacatta

SEQ ID NO: 5299 - DNA, 16 bp, H. sapiens
aaaatttgaacaaata

SEQ ID NO: 5300 - DNA, 16 bp, H. sapiens
aaaatttgaagcatat

SEQ ID NO: 5301 - DNA, 16 bp, H. sapiens
aaaatttgacaatttt

SEQ ID NO: 5302 - DNA, 16 bp, H. sapiens
aaaatttgagctttca

SEQ ID NO: 5303 - DNA, 16 bp, H. sapiens
aaaatttgaggctggg

SEQ ID NO: 5304 - DNA, 16 bp, H. sapiens
aaaatttgagtcagtg

SEQ ID NO: 5305 - DNA, 16 bp, H. sapiens
aaaatttgatgagttt

SEQ ID NO: 5306 - DNA, 16 bp, H. sapiens
aaaatttgcaaaataa

SEQ ID NO: 5307 - DNA, 20 bp, H. sapiens
aaaatttgcagcctgatgat

SEQ ID NO: 5308 - DNA, 16 bp, H. sapiens
aaaatttgcagtctga

SEQ ID NO: 5309 - DNA, 16 bp, H. sapiens
aaaatttgcatatatt

SEQ ID NO: 5310 - DNA, 16 bp, H. sapiens
aaaatttgcattaaaa

SEQ ID NO: 5311 - DNA, 16 bp, H. sapiens
aaaatttgctatttta

SEQ ID NO: 5312 - DNA, 16 bp, H. sapiens
aaaatttgctattttt

SEQ ID NO: 5313 - DNA, 16 bp, H. sapiens
aaaatttgctttaaat

SEQ ID NO: 5314 - DNA, 16 bp, H. sapiens
aaaatttggaaaattt

SEQ ID NO: 5315 - DNA, 16 bp, H. sapiens
aaaatttggaaactat

SEQ ID NO: 5316 - DNA, 16 bp, H. sapiens
aaaatttggaagaaag

SEQ ID NO: 5317 - DNA, 16 bp, H. sapiens
aaaatttggagaaaat

SEQ ID NO: 5318 - DNA, 16 bp, H. sapiens
aaaatttggagaaaga

SEQ ID NO: 5319 - DNA, 16 bp, H. sapiens
aaaatttggaggaaaa

SEQ ID NO: 5320 - DNA, 16 bp, H. sapiens
aaaatttggccaggcg

SEQ ID NO: 5321 - DNA, 16 bp, H. sapiens
aaaatttggccgggca

SEQ ID NO: 5322 - DNA, 16 bp, H. sapiens
aaaatttgtaaatgtt

SEQ ID NO: 5323 - DNA, 16 bp, H. sapiens
aaaatttgtatgaaat

SEQ ID NO: 5324 - DNA, 16 bp, H. sapiens
aaaatttgtatggaat

SEQ ID NO: 5325 - DNA, 16 bp, H. sapiens
aaaatttgtcttttta

SEQ ID NO: 5326 - DNA, 16 bp, H. sapiens
aaaatttgtgtaaatt

SEQ ID NO: 5327 - DNA, 16 bp, H. sapiens
aaaatttgttcttttt

SEQ ID NO: 5328 - DNA, 16 bp, H. sapiens
aaaatttgtttcttta

SEQ ID NO: 5329 - DNA, 16 bp, H. sapiens
aaaatttgttttcaat

SEQ ID NO: 5330 - DNA, 16 bp, H. sapiens
aaaatttgttttgtgt

SEQ ID NO: 5331 - DNA, 16 bp, H. sapiens
aaaatttgtttttctg

SEQ ID NO: 5332 - DNA, 16 bp, H. sapiens
aaaattttaaaaagca

SEQ ID NO: 5333 - DNA, 16 bp, H. sapiens
aaaattttaaacttag

SEQ ID NO: 5334 - DNA, 16 bp, H. sapiens
aaaattttaaagagtt

SEQ ID NO: 5335 - DNA, 16 bp, H. sapiens
aaaattttaaagcaaa

SEQ ID NO: 5336 - DNA, 16 bp, H. sapiens
aaaattttaagtcaaa

SEQ ID NO: 5337 - DNA, 16 bp, H. sapiens
aaaattttaatgatgt

SEQ ID NO: 5338 - DNA, 16 bp, H. sapiens
aaaattttacaaagaa

SEQ ID NO: 5339 - DNA, 16 bp, H. sapiens
aaaattttacagaaat

SEQ ID NO: 5340 - DNA, 16 bp, H. sapiens
aaaattttacatttca

SEQ ID NO: 5341 - DNA, 16 bp, H. sapiens
aaaattttagcaaact

SEQ ID NO: 5342 - DNA, 16 bp, H. sapiens
aaaattttataagcaa

SEQ ID NO: 5343 - DNA, 16 bp, H. sapiens
aaaattttatttgcaa

SEQ ID NO: 5344 - DNA, 16 bp, H. sapiens
aaaattttattttctg

SEQ ID NO: 5345 - DNA, 16 bp, H. sapiens
aaaattttcaaacttt

SEQ ID NO: 5346 - DNA, 16 bp, H. sapiens
aaaattttcaatgaaa

SEQ ID NO: 5347 - DNA, 16 bp, H. sapiens
aaaattttcacaaact

SEQ ID NO: 5348 - DNA, 16 bp, H. sapiens
aaaattttcagaaaat

SEQ ID NO: 5349 - DNA, 16 bp, H. sapiens
aaaattttcagccatt

SEQ ID NO: 5350 - DNA, 16 bp, H. sapiens
aaaattttcaggaaaa

SEQ ID NO: 5351 - DNA, 16 bp, H. sapiens
aaaattttccagaaat

SEQ ID NO: 5352 - DNA, 16 bp, H. sapiens
aaaattttccagaatt

SEQ ID NO: 5353 - DNA, 16 bp, H. sapiens
aaaattttctagaaat

SEQ ID NO: 5354 - DNA, 16 bp, H. sapiens
aaaattttctagtttt

SEQ ID NO: 5355 - DNA, 16 bp, H. sapiens
aaaattttctccaaat

SEQ ID NO: 5356 - DNA, 16 bp, H. sapiens
aaaattttctcccatt

SEQ ID NO: 5357 - DNA, 16 bp, H. sapiens
aaaattttctcctatg

SEQ ID NO: 5358 - DNA, 16 bp, H. sapiens
aaaattttctcctttg

SEQ ID NO: 5359 - DNA, 16 bp, H. sapiens
aaaattttctcctttt

SEQ ID NO: 5360 - DNA, 16 bp, H. sapiens
aaaattttcttctgct

SEQ ID NO: 5361 - DNA, 16 bp, H. sapiens
aaaattttcttttgta

SEQ ID NO: 5362 - DNA, 16 bp, H. sapiens
aaaattttgaacaaaa

SEQ ID NO: 5363 - DNA, 16 bp, H. sapiens
aaaattttgcaaatca

SEQ ID NO: 5364 - DNA, 16 bp, H. sapiens
aaaattttgcaatata

SEQ ID NO: 5365 - DNA, 16 bp, H. sapiens
aaaattttgctaaaat

SEQ ID NO: 5366 - DNA, 16 bp, H. sapiens
aaaattttgtcttaaa

SEQ ID NO: 5367 - DNA, 16 bp, H. sapiens
aaaattttgtgtatat

SEQ ID NO: 5368 - DNA, 16 bp, H. sapiens
aaaattttgtttgaaa

SEQ ID NO: 5369 - DNA, 16 bp, H. sapiens
aaaatttttaaatgct

SEQ ID NO: 5370 - DNA, 16 bp, H. sapiens
aaaatttttaaatgga

SEQ ID NO: 5371 - DNA, 16 bp, H. sapiens
aaaatttttaaatggt

SEQ ID NO: 5372 - DNA, 16 bp, H. sapiens
aaaatttttaagtggt

SEQ ID NO: 5373 - DNA, 16 bp, H. sapiens
aaaatttttcaaagaa

SEQ ID NO: 5374 - DNA, 16 bp, H. sapiens
aaaatttttcaagaaa

SEQ ID NO: 5375 - DNA, 16 bp, H. sapiens
aaaatttttctaaaac

SEQ ID NO: 5376 - DNA, 16 bp, H. sapiens
aaaatttttctgaaat

SEQ ID NO: 5377 - DNA, 16 bp, H. sapiens
aaaatttttggccagg

SEQ ID NO: 5378 - DNA, 16 bp, H. sapiens
aaaatttttgtttcaa

SEQ ID NO: 5379 - DNA, 16 bp, H. sapiens
aaaattttttcagaaa

SEQ ID NO: 5380 - DNA, 16 bp, H. sapiens
aaaattttttgagaaa

SEQ ID NO: 5381 - DNA, 16 bp, H. sapiens
aaaattttttgagact

SEQ ID NO: 5382 - DNA, 16 bp, H. sapiens
aaaatttttttaatgg

SEQ ID NO: 5383 - DNA, 16 bp, H. sapiens
aaaatttttttctttg

SEQ ID NO: 5384 - DNA, 16 bp, H. sapiens
aaaattttttttccaa

SEQ ID NO: 5385 - DNA, 16 bp, H. sapiens
aaacaaaaaaagctct

SEQ ID NO: 5386 - DNA, 16 bp, H. sapiens
aaacaaaaaaccagtt

SEQ ID NO: 5387 - DNA, 16 bp, H. sapiens
aaacaaaaaacctggc

SEQ ID NO: 5388 - DNA, 16 bp, H. sapiens
aaacaaaaaagctttt

SEQ ID NO: 5389 - DNA, 16 bp, H. sapiens
aaacaaaaaattagcc

SEQ ID NO: 5390 - DNA, 16 bp, H. sapiens
aaacaaaaacaagttt

SEQ ID NO: 5391 - DNA, 16 bp, H. sapiens
aaacaaaaacacattg

SEQ ID NO: 5392 - DNA, 16 bp, H. sapiens
aaacaaaaacacttgt

SEQ ID NO: 5393 - DNA, 16 bp, H. sapiens
aaacaaaaacagatgc

SEQ ID NO: 5394 - DNA, 16 bp, H. sapiens
aaacaaaaaccttcct

SEQ ID NO: 5395 - DNA, 16 bp, H. sapiens
aaacaaaaactgagag

SEQ ID NO: 5396 - DNA, 16 bp, H. sapiens
aaacaaaaactgtttt

SEQ ID NO: 5397 - DNA, 16 bp, H. sapiens
aaacaaaaagaacttt

SEQ ID NO: 5398 - DNA, 16 bp, H. sapiens
aaacaaaaagatttat

SEQ ID NO: 5399 - DNA, 16 bp, H. sapiens
aaacaaaaagcagatt

SEQ ID NO: 5400 - DNA, 16 bp, H. sapiens
aaacaaaaagtagatt

SEQ ID NO: 5401 - DNA, 16 bp, H. sapiens
aaacaaaaataagtgt

SEQ ID NO: 5402 - DNA, 16 bp, H. sapiens
aaacaaaaatatttgg

SEQ ID NO: 5403 - DNA, 16 bp, H. sapiens
aaacaaaaatattttg

SEQ ID NO: 5404 - DNA, 16 bp, H. sapiens
aaacaaaaatgaagtt

SEQ ID NO: 5405 - DNA, 16 bp, H. sapiens
aaacaaaaatgtaatt

SEQ ID NO: 5406 - DNA, 16 bp, H. sapiens
aaacaaaaatgtcatt

SEQ ID NO: 5407 - DNA, 16 bp, H. sapiens
aaacaaaaatgtttct

SEQ ID NO: 5408 - DNA, 16 bp, H. sapiens
aaacaaaaattaactg

SEQ ID NO: 5409 - DNA, 16 bp, H. sapiens
aaacaaaacacctttt

SEQ ID NO: 5410 - DNA, 16 bp, H. sapiens
aaacaaaacacttctg

SEQ ID NO: 5411 - DNA, 16 bp, H. sapiens
aaacaaaacagctttt

SEQ ID NO: 5412 - DNA, 16 bp, H. sapiens
aaacaaaacattgttt

SEQ ID NO: 5413 - DNA, 16 bp, H. sapiens
aaacaaaacatttttt

SEQ ID NO: 5414 - DNA, 16 bp, H. sapiens
aaacaaaactattttt

SEQ ID NO: 5415 - DNA, 16 bp, H. sapiens
aaacaaaacttgacaa

SEQ ID NO: 5416 - DNA, 16 bp, H. sapiens
aaacaaaactttttta

SEQ ID NO: 5417 - DNA, 16 bp, H. sapiens
aaacaaaagaagtatt

SEQ ID NO: 5418 - DNA, 16 bp, H. sapiens
aaacaaaagacatcat

SEQ ID NO: 5419 - DNA, 16 bp, H. sapiens
aaacaaaagagattta

SEQ ID NO: 5420 - DNA, 16 bp, H. sapiens
aaacaaaagcaattgt

SEQ ID NO: 5421 - DNA, 16 bp, H. sapiens
aaacaaaagttgaaat

SEQ ID NO: 5422 - DNA, 16 bp, H. sapiens
aaacaaaagtttgaaa

SEQ ID NO: 5423 - DNA, 16 bp, H. sapiens
aaacaaaagttttatt

SEQ ID NO: 5424 - DNA, 16 bp, H. sapiens
aaacaaaataatggca

SEQ ID NO: 5425 - DNA, 16 bp, H. sapiens
aaacaaaatgaaagtt

SEQ ID NO: 5426 - DNA, 16 bp, H. sapiens
aaacaaaatgatattt

SEQ ID NO: 5427 - DNA, 16 bp, H. sapiens
aaacaaaatgtaatgt

SEQ ID NO: 5428 - DNA, 16 bp, H. sapiens
aaacaaaatgtatttt

SEQ ID NO: 5429 - DNA, 16 bp, H. sapiens
aaacaaaatgtgaaat

SEQ ID NO: 5430 - DNA, 16 bp, H. sapiens
aaacaaaatgttatat

SEQ ID NO: 5431 - DNA, 16 bp, H. sapiens
aaacaaaatgttttat

SEQ ID NO: 5432 - DNA, 16 bp, H. sapiens
aaacaaaatgtttttt

SEQ ID NO: 5433 - DNA, 16 bp, H. sapiens
aaacaaaattaaatgg

SEQ ID NO: 5434 - DNA, 16 bp, H. sapiens
aaacaaaattagccag

SEQ ID NO: 5435 - DNA, 16 bp, H. sapiens
aaacaaaattatgtat

SEQ ID NO: 5436 - DNA, 16 bp, H. sapiens
aaacaaaatttaaatg

SEQ ID NO: 5437 - DNA, 16 bp, H. sapiens
aaacaaaatttatgaa

SEQ ID NO: 5438 - DNA, 16 bp, H. sapiens
aaacaaaatttccatt

SEQ ID NO: 5439 - DNA, 16 bp, H. sapiens
aaacaaaatttgacaa

SEQ ID NO: 5440 - DNA, 16 bp, H. sapiens
aaacaaacaaaatgct

SEQ ID NO: 5441 - DNA, 16 bp, H. sapiens
aaacaaacagagagcc

SEQ ID NO: 5442 - DNA, 16 bp, H. sapiens
aaacaaacatggcaca

SEQ ID NO: 5443 - DNA, 16 bp, H. sapiens
aaacaaacatttgttg

SEQ ID NO: 5444 - DNA, 16 bp, H. sapiens
aaacaaacccaaattg

SEQ ID NO: 5445 - DNA, 16 bp, H. sapiens
aaacaaactaatgcag

SEQ ID NO: 5446 - DNA, 16 bp, H. sapiens
aaacaaacttgaaaat

SEQ ID NO: 5447 - DNA, 16 bp, H. sapiens
aaacaaactttaaaag

SEQ ID NO: 5448 - DNA, 16 bp, H. sapiens
aaacaaacttttcatt

SEQ ID NO: 5449 - DNA, 16 bp, H. sapiens
aaacaaagaatatttt

SEQ ID NO: 5450 - DNA, 16 bp, H. sapiens
aaacaaagaatgggta

SEQ ID NO: 5451 - DNA, 16 bp, H. sapiens
aaacaaagaattatct

SEQ ID NO: 5452 - DNA, 16 bp, H. sapiens
aaacaaagacagtttt

SEQ ID NO: 5453 - DNA, 16 bp, H. sapiens
aaacaaagacatttta

SEQ ID NO: 5454 - DNA, 16 bp, H. sapiens
aaacaaagagcctgag

SEQ ID NO: 5455 - DNA, 16 bp, H. sapiens
aaacaaagaggctggg

SEQ ID NO: 5456 - DNA, 16 bp, H. sapiens
aaacaaagatagtttt

SEQ ID NO: 5457 - DNA, 16 bp, H. sapiens
aaacaaagatgataac

SEQ ID NO: 5458 - DNA, 16 bp, H. sapiens
aaacaaagattttaat

SEQ ID NO: 5459 - DNA, 16 bp, H. sapiens
aaacaaagcaaatatt

SEQ ID NO: 5460 - DNA, 16 bp, H. sapiens
aaacaaaggatcagca

SEQ ID NO: 5461 - DNA, 16 bp, H. sapiens
aaacaaagtgtttttt

SEQ ID NO: 5462 - DNA, 16 bp, H. sapiens
aaacaaagttttattt

SEQ ID NO: 5463 - DNA, 16 bp, H. sapiens
aaacaaagtttttttt

SEQ ID NO: 5464 - DNA, 16 bp, H. sapiens
aaacaaataagcatgg

SEQ ID NO: 5465 - DNA, 16 bp, H. sapiens
aaacaaataatttgaa

SEQ ID NO: 5466 - DNA, 16 bp, H. sapiens
aaacaaatatcttttt

SEQ ID NO: 5467 - DNA, 16 bp, H. sapiens
aaacaaatccttgaaa

SEQ ID NO: 5468 - DNA, 16 bp, H. sapiens
aaacaaatgcataaat

SEQ ID NO: 5469 - DNA, 16 bp, H. sapiens
aaacaaatggaaaact

SEQ ID NO: 5470 - DNA, 16 bp, H. sapiens
aaacaaatggaacaga

SEQ ID NO: 5471 - DNA, 16 bp, H. sapiens
aaacaaatggaatctc

SEQ ID NO: 5472 - DNA, 16 bp, H. sapiens
aaacaaatgggaaaat

SEQ ID NO: 5473 - DNA, 16 bp, H. sapiens
aaacaaatggtgctgg

SEQ ID NO: 5474 - DNA, 16 bp, H. sapiens
aaacaaatgtaagaac

SEQ ID NO: 5475 - DNA, 16 bp, H. sapiens
aaacaaatgtggcaaa

SEQ ID NO: 5476 - DNA, 16 bp, H. sapiens
aaacaaatgttattta

SEQ ID NO: 5477 - DNA, 16 bp, H. sapiens
aaacaaattctgaaaa

SEQ ID NO: 5478 - DNA, 16 bp, H. sapiens
aaacaaattctggaaa

SEQ ID NO: 5479 - DNA, 16 bp, H. sapiens
aaacaaattcttattg

SEQ ID NO: 5480 - DNA, 16 bp, H. sapiens
aaacaaattgaagaac

SEQ ID NO: 5481 - DNA, 16 bp, H. sapiens
aaacaaatttcttgtt

SEQ ID NO: 5482 - DNA, 16 bp, H. sapiens
aaacaaatttgtaaga

SEQ ID NO: 5483 - DNA, 16 bp, H. sapiens
aaacaaattttaagta

SEQ ID NO: 5484 - DNA, 16 bp, H. sapiens
aaacaaatttttattg

SEQ ID NO: 5485 - DNA, 16 bp, H. sapiens
aaacaaatttttttct

SEQ ID NO: 5486 - DNA, 16 bp, H. sapiens
aaacaacaaaggtgac

SEQ ID NO: 5487 - DNA, 16 bp, H. sapiens
aaacaacacacactgg

SEQ ID NO: 5488 - DNA, 16 bp, H. sapiens
aaacaacacattttta

SEQ ID NO: 5489 - DNA, 16 bp, H. sapiens
aaacaacagaaacttt

SEQ ID NO: 5490 - DNA, 16 bp, H. sapiens
aaacaacagaaatttg

SEQ ID NO: 5491 - DNA, 16 bp, H. sapiens
aaacaacagatgctgg

SEQ ID NO: 5492 - DNA, 16 bp, H. sapiens
aaacaacagattttca

SEQ ID NO: 5493 - DNA, 16 bp, H. sapiens
aaacaacatattttta

SEQ ID NO: 5494 - DNA, 16 bp, H. sapiens
aaacaacatcagcaaa

SEQ ID NO: 5495 - DNA, 16 bp, H. sapiens
aaacaacatggtgctg

SEQ ID NO: 5496 - DNA, 16 bp, H. sapiens
aaacaaccaaaatcag

SEQ ID NO: 5497 - DNA, 16 bp, H. sapiens
aaacaaccaaatcttg

SEQ ID NO: 5498 - DNA, 16 bp, H. sapiens
aaacaaccagatcttg

SEQ ID NO: 5499 - DNA, 16 bp, H. sapiens
aaacaaccagctctcg

SEQ ID NO: 5500 - DNA, 16 bp, H. sapiens
aaacaaccagtcattt

SEQ ID NO: 5501 - DNA, 16 bp, H. sapiens
aaacaacccaaatgtc

SEQ ID NO: 5502 - DNA, 16 bp, H. sapiens
aaacaacccaagtgtc

SEQ ID NO: 5503 - DNA, 16 bp, H. sapiens
aaacaacccatttaaa

SEQ ID NO: 5504 - DNA, 16 bp, H. sapiens
aaacaacctacagaat

SEQ ID NO: 5505 - DNA, 16 bp, H. sapiens
aaacaacctcaatgtc

SEQ ID NO: 5506 - DNA, 16 bp, H. sapiens
aaacaaccttttattt

SEQ ID NO: 5507 - DNA, 16 bp, H. sapiens
aaacaactcaagtgtc

SEQ ID NO: 5508 - DNA, 16 bp, H. sapiens
aaacaactcaataaga

SEQ ID NO: 5509 - DNA, 16 bp, H. sapiens
aaacaacttcagaaaa

SEQ ID NO: 5510 - DNA, 16 bp, H. sapiens
aaacaacttcagcaaa

SEQ ID NO: 5511 - DNA, 16 bp, H. sapiens
aaacaacttgaaaaca

SEQ ID NO: 5512 - DNA, 16 bp, H. sapiens
aaacaactttttaaat

SEQ ID NO: 5513 - DNA, 16 bp, H. sapiens
aaacaagaaatgtgga

SEQ ID NO: 5514 - DNA, 16 bp, H. sapiens
aaacaagaagtgggga

SEQ ID NO: 5515 - DNA, 16 bp, H. sapiens
aaacaagactccatct

SEQ ID NO: 5516 - DNA, 16 bp, H. sapiens
aaacaagagcaaaact

SEQ ID NO: 5517 - DNA, 17 bp, H. sapiens
aaacaagagtgaaactc

SEQ ID NO: 5518 - DNA, 16 bp, H. sapiens
aaacaagattctttaa

SEQ ID NO: 5519 - DNA, 16 bp, H. sapiens
aaacaagcaaatgctg

SEQ ID NO: 5520 - DNA, 16 bp, H. sapiens
aaacaagcaatggaga

SEQ ID NO: 5521 - DNA, 16 bp, H. sapiens
aaacaagcatttcaaa

SEQ ID NO: 5522 - DNA, 16 bp, H. sapiens
aaacaagcattttaaa

SEQ ID NO: 5523 - DNA, 16 bp, H. sapiens
aaacaagctcagagat

SEQ ID NO: 5524 - DNA, 16 bp, H. sapiens
aaacaagctcctggat

SEQ ID NO: 5525 - DNA, 16 bp, H. sapiens
aaacaagctggaaaac

SEQ ID NO: 5526 - DNA, 16 bp, H. sapiens
aaacaaggaaactgag

SEQ ID NO: 5527 - DNA, 16 bp, H. sapiens
aaacaaggacaatttg

SEQ ID NO: 5528 - DNA, 16 bp, H. sapiens
aaacaaggataatttt

SEQ ID NO: 5529 - DNA, 16 bp, H. sapiens
aaacaagggtaatttg

SEQ ID NO: 5530 - DNA, 16 bp, H. sapiens
aaacaaggtcacattc

SEQ ID NO: 5531 - DNA, 16 bp, H. sapiens
aaacaaggttttaaaa

SEQ ID NO: 5532 - DNA, 16 bp, H. sapiens
aaacaagttcagcaaa

SEQ ID NO: 5533 - DNA, 16 bp, H. sapiens
aaacaagttctgaaat

SEQ ID NO: 5534 - DNA, 16 bp, H. sapiens
aaacaagttttaaaat

SEQ ID NO: 5535 - DNA, 16 bp, H. sapiens
aaacaagtttttaaat

SEQ ID NO: 5536 - DNA, 16 bp, H. sapiens
aaacaataaaacattg

SEQ ID NO: 5537 - DNA, 16 bp, H. sapiens
aaacaataaaatattg

SEQ ID NO: 5538 - DNA, 16 bp, H. sapiens
aaacaataaaatgtta

SEQ ID NO: 5539 - DNA, 16 bp, H. sapiens
aaacaataaattcctg

SEQ ID NO: 5540 - DNA, 16 bp, H. sapiens
aaacaatacagattta

SEQ ID NO: 5541 - DNA, 16 bp, H. sapiens
aaacaatacattttat

SEQ ID NO: 5542 - DNA, 16 bp, H. sapiens
aaacaatatattgttt

SEQ ID NO: 5543 - DNA, 16 bp, H. sapiens
aaacaatatgctcctg

SEQ ID NO: 5544 - DNA, 16 bp, H. sapiens
aaacaatcaagaaagt

SEQ ID NO: 5545 - DNA, 16 bp, H. sapiens
aaacaatcctgaaaaa

SEQ ID NO: 5546 - DNA, 16 bp, H. sapiens
aaacaatctacagaat

SEQ ID NO: 5547 - DNA, 16 bp, H. sapiens
aaacaatctgcccacc

SEQ ID NO: 5548 - DNA, 16 bp, H. sapiens
aaacaatctttatttt

SEQ ID NO: 5549 - DNA, 16 bp, H. sapiens
aaacaatgaagtccag

SEQ ID NO: 5550 - DNA, 16 bp, H. sapiens
aaacaatgaatatttt

SEQ ID NO: 5551 - DNA, 16 bp, H. sapiens
aaacaatgccattctt

SEQ ID NO: 5552 - DNA, 16 bp, H. sapiens
aaacaatggaattaaa

SEQ ID NO: 5553 - DNA, 16 bp, H. sapiens
aaacaatggacttaaa

SEQ ID NO: 5554 - DNA, 16 bp, H. sapiens
aaacaatgttaaataa

SEQ ID NO: 5555 - DNA, 16 bp, H. sapiens
aaacaatgttatttat

SEQ ID NO: 5556 - DNA, 16 bp, H. sapiens
aaacaatgttatttga

SEQ ID NO: 5557 - DNA, 16 bp, H. sapiens
aaacaatgttttcttt

SEQ ID NO: 5558 - DNA, 16 bp, H. sapiens
aaacaattaccagcca

SEQ ID NO: 5559 - DNA, 16 bp, H. sapiens
aaacaattagcaaaat

SEQ ID NO: 5560 - DNA, 16 bp, H. sapiens
aaacaattatttaaag

SEQ ID NO: 5561 - DNA, 16 bp, H. sapiens
aaacaattattttcaa

SEQ ID NO: 5562 - DNA, 16 bp, H. sapiens
aaacaattcaaatgtt

SEQ ID NO: 5563 - DNA, 16 bp, H. sapiens
aaacaattcaatggaa

SEQ ID NO: 5564 - DNA, 16 bp, H. sapiens
aaacaattcaattaca

SEQ ID NO: 5565 - DNA, 16 bp, H. sapiens
aaacaattctgagaaa

SEQ ID NO: 5566 - DNA, 16 bp, H. sapiens
aaacaattgaaaagga

SEQ ID NO: 5567 - DNA, 16 bp, H. sapiens
aaacaattgacaaaat

SEQ ID NO: 5568 - DNA, 16 bp, H. sapiens
aaacaattgctttgct

SEQ ID NO: 5569 - DNA, 16 bp, H. sapiens
aaacaattgtaaatat

SEQ ID NO: 5570 - DNA, 16 bp, H. sapiens
aaacaatttaaaaatg

SEQ ID NO: 5571 - DNA, 16 bp, H. sapiens
aaacaatttaaaagga

SEQ ID NO: 5572 - DNA, 16 bp, H. sapiens
aaacaatttatttctt

SEQ ID NO: 5573 - DNA, 16 bp, H. sapiens
aaacaatttattttca

SEQ ID NO: 5574 - DNA, 16 bp, H. sapiens
aaacaatttcaactta

SEQ ID NO: 5575 - DNA, 16 bp, H. sapiens
aaacaatttgtatttt

SEQ ID NO: 5576 - DNA, 16 bp, H. sapiens
aaacaatttgtgcagt

SEQ ID NO: 5577 - DNA, 16 bp, H. sapiens
aaacaattttacagaa

SEQ ID NO: 5578 - DNA, 16 bp, H. sapiens
aaacaattttagaatt

SEQ ID NO: 5579 - DNA, 16 bp, H. sapiens
aaacaattttgagaaa

SEQ ID NO: 5580 - DNA, 16 bp, H. sapiens
aaacaatttttcaaat

SEQ ID NO: 5581 - DNA, 16 bp, H. sapiens
aaacaatttttctaaa

SEQ ID NO: 5582 - DNA, 16 bp, H. sapiens
aaacaattttttgaaa

SEQ ID NO: 5583 - DNA, 16 bp, H. sapiens
aaacaatttttttcca

SEQ ID NO: 5584 - DNA, 16 bp, H. sapiens
aaacacaaatgtttat

SEQ ID NO: 5585 - DNA, 16 bp, H. sapiens
aaacacaacttttttt

SEQ ID NO: 5586 - DNA, 16 bp, H. sapiens
aaacacaatcatggtg

SEQ ID NO: 5587 - DNA, 16 bp, H. sapiens
aaacacacatgctgta

SEQ ID NO: 5588 - DNA, 16 bp, H. sapiens
aaacacacattttatt

SEQ ID NO: 5589 - DNA, 16 bp, H. sapiens
aaacacaccctctcca

SEQ ID NO: 5590 - DNA, 16 bp, H. sapiens
aaacacagattgctgg

SEQ ID NO: 5591 - DNA, 16 bp, H. sapiens
aaacacagcaggagaa

SEQ ID NO: 5592 - DNA, 16 bp, H. sapiens
aaacacaggagaattc

SEQ ID NO: 5593 - DNA, 16 bp, H. sapiens
aaacacagtctttcca

SEQ ID NO: 5594 - DNA, 16 bp, H. sapiens
aaacacagtttgaaaa

SEQ ID NO: 5595 - DNA, 16 bp, H. sapiens
aaacacatacatttat

SEQ ID NO: 5596 - DNA, 16 bp, H. sapiens
aaacacatactttttt

SEQ ID NO: 5597 - DNA, 16 bp, H. sapiens
aaacacatatgtatat

SEQ ID NO: 5598 - DNA, 16 bp, H. sapiens
aaacacatcttcacat

SEQ ID NO: 5599 - DNA, 16 bp, H. sapiens
aaacacatgaaaaatg

SEQ ID NO: 5600 - DNA, 16 bp, H. sapiens
aaacacatgaagaaat

SEQ ID NO: 5601 - DNA, 16 bp, H. sapiens
aaacacatgaagcaaa

SEQ ID NO: 5602 - DNA, 16 bp, H. sapiens
aaacacatgaataaat

SEQ ID NO: 5603 - DNA, 16 bp, H. sapiens
aaacacatgcaaatta

SEQ ID NO: 5604 - DNA, 16 bp, H. sapiens
aaacacatgtaaaaat

SEQ ID NO: 5605 - DNA, 16 bp, H. sapiens
aaacacattaatattt

SEQ ID NO: 5606 - DNA, 16 bp, H. sapiens
aaacacatttaagaaa

SEQ ID NO: 5607 - DNA, 16 bp, H. sapiens
aaacacatttattgaa

SEQ ID NO: 5608 - DNA, 16 bp, H. sapiens
aaacacattttacaaa

SEQ ID NO: 5609 - DNA, 16 bp, H. sapiens
aaacacattttatttt

SEQ ID NO: 5610 - DNA, 16 bp, H. sapiens
aaacacattttcagat

SEQ ID NO: 5611 - DNA, 16 bp, H. sapiens
aaacaccaaaaggaat

SEQ ID NO: 5612 - DNA, 16 bp, H. sapiens
aaacaccaatgacatt

SEQ ID NO: 5613 - DNA, 16 bp, H. sapiens
aaacaccaggcccaga

SEQ ID NO: 5614 - DNA, 16 bp, H. sapiens
aaacaccatctctaca

SEQ ID NO: 5615 - DNA, 16 bp, H. sapiens
aaacaccatgtgttct

SEQ ID NO: 5616 - DNA, 16 bp, H. sapiens
aaacaccatttcatat

SEQ ID NO: 5617 - DNA, 16 bp, H. sapiens
aaacacctacatcaag

SEQ ID NO: 5618 - DNA, 16 bp, H. sapiens
aaacacctcccaccat

SEQ ID NO: 5619 - DNA, 16 bp, H. sapiens
aaacacctcccagcag

SEQ ID NO: 5620 - DNA, 16 bp, H. sapiens
aaacacctgaggctgg

SEQ ID NO: 5621 - DNA, 16 bp, H. sapiens
aaacacctggcctcaa

SEQ ID NO: 5622 - DNA, 16 bp, H. sapiens
aaacacctgggtctgg

SEQ ID NO: 5623 - DNA, 16 bp, H. sapiens
aaacactaacttccca

SEQ ID NO: 5624 - DNA, 16 bp, H. sapiens
aaacactagacagaag

SEQ ID NO: 5625 - DNA, 16 bp, H. sapiens
aaacactatgtaaata

SEQ ID NO: 5626 - DNA, 16 bp, H. sapiens
aaacactatttatttt

SEQ ID NO: 5627 - DNA, 16 bp, H. sapiens
aaacactcctgaaaga

SEQ ID NO: 5628 - DNA, 16 bp, H. sapiens
aaacactgaaaacaca

SEQ ID NO: 5629 - DNA, 16 bp, H. sapiens
aaacactgaaatgaaa

SEQ ID NO: 5630 - DNA, 16 bp, H. sapiens
aaacactgatttttaa

SEQ ID NO: 5631 - DNA, 16 bp, H. sapiens
aaacactgcataaagc

SEQ ID NO: 5632 - DNA, 16 bp, H. sapiens
aaacactgcctctact

SEQ ID NO: 5633 - DNA, 19 bp, H. sapiens
aaacactgctgaaagaaat

SEQ ID NO: 5634 - DNA, 16 bp, H. sapiens
aaacactgctgctggg

SEQ ID NO: 5635 - DNA, 16 bp, H. sapiens
aaacactggaattaca

SEQ ID NO: 5636 - DNA, 16 bp, H. sapiens
aaacactgggagatgt

SEQ ID NO: 5637 - DNA, 16 bp, H. sapiens
aaacactgtgtcctca

SEQ ID NO: 5638 - DNA, 16 bp, H. sapiens
aaacactgttttctta

SEQ ID NO: 5639 - DNA, 16 bp, H. sapiens
aaacacttaaaatttt

SEQ ID NO: 5640 - DNA, 16 bp, H. sapiens
aaacacttaaagaaga

SEQ ID NO: 5641 - DNA, 16 bp, H. sapiens
aaacacttatttttaa

SEQ ID NO: 5642 - DNA, 16 bp, H. sapiens
aaacacttatttttat

SEQ ID NO: 5643 - DNA, 16 bp, H. sapiens
aaacacttcaagacat

SEQ ID NO: 5644 - DNA, 16 bp, H. sapiens
aaacacttcagaaaaa

SEQ ID NO: 5645 - DNA, 16 bp, H. sapiens
aaacacttcattattt

SEQ ID NO: 5646 - DNA, 16 bp, H. sapiens
aaacacttctcaaaag

SEQ ID NO: 5647 - DNA, 16 bp, H. sapiens
aaacacttctgaaaga

SEQ ID NO: 5648 - DNA, 17 bp, H. sapiens
aaacacttctggtccca

SEQ ID NO: 5649 - DNA, 16 bp, H. sapiens
aaacacttgaaagaaa

SEQ ID NO: 5650 - DNA, 17 bp, H. sapiens
aaacacttggacacagg

SEQ ID NO: 5651 - DNA, 16 bp, H. sapiens
aaacactttattttct

SEQ ID NO: 5652 - DNA, 16 bp, H. sapiens
aaacactttcaaatat

SEQ ID NO: 5653 - DNA, 16 bp, H. sapiens
aaacacttttcaggat

SEQ ID NO: 5654 - DNA, 16 bp, H. sapiens
aaacacttttccaaag

SEQ ID NO: 5655 - DNA, 16 bp, H. sapiens
aaacacttttttaaat

SEQ ID NO: 5656 - DNA, 16 bp, H. sapiens
aaacagaaaaatgact

SEQ ID NO: 5657 - DNA, 16 bp, H. sapiens
aaacagaaaaccaagt

SEQ ID NO: 5658 - DNA, 16 bp, H. sapiens
aaacagaaaagaattt

SEQ ID NO: 5659 - DNA, 16 bp, H. sapiens
aaacagaaaaggcttt

SEQ ID NO: 5660 - DNA, 16 bp, H. sapiens
aaacagaaaatctttt

SEQ ID NO: 5661 - DNA, 16 bp, H. sapiens
aaacagaaaatgattt

SEQ ID NO: 5662 - DNA, 16 bp, H. sapiens
aaacagaaaattttaa

SEQ ID NO: 5663 - DNA, 16 bp, H. sapiens
aaacagaaacatagac

SEQ ID NO: 5664 - DNA, 16 bp, H. sapiens
aaacagaaacttttaa

SEQ ID NO: 5665 - DNA, 16 bp, H. sapiens
aaacagaaaggaaatg

SEQ ID NO: 5666 - DNA, 16 bp, H. sapiens
aaacagaaaggaatag

SEQ ID NO: 5667 - DNA, 26 bp, H. sapiens
aaacagaaaggacatccacaccaaaa

SEQ ID NO: 5668 - DNA, 16 bp, H. sapiens
aaacagaaatagaatt

SEQ ID NO: 5669 - DNA, 16 bp, H. sapiens
aaacagaaatattttg

SEQ ID NO: 5670 - DNA, 16 bp, H. sapiens
aaacagaaatcttgga

SEQ ID NO: 5671 - DNA, 16 bp, H. sapiens
aaacagaaattccaga

SEQ ID NO: 5672 - DNA, 16 bp, H. sapiens
aaacagaaattctaaa

SEQ ID NO: 5673 - DNA, 16 bp, H. sapiens
aaacagaaattctgga

SEQ ID NO: 5674 - DNA, 16 bp, H. sapiens
aaacagaacattgcca

SEQ ID NO: 5675 - DNA, 16 bp, H. sapiens
aaacagaaccaatgat

SEQ ID NO: 5676 - DNA, 16 bp, H. sapiens
aaacagaaccagtgac

SEQ ID NO: 5677 - DNA, 16 bp, H. sapiens
aaacagaacttttaaa

SEQ ID NO: 5678 - DNA, 16 bp, H. sapiens
aaacagaagaaaatgt

SEQ ID NO: 5679 - DNA, 16 bp, H. sapiens
aaacagaagcacagag

SEQ ID NO: 5680 - DNA, 16 bp, H. sapiens
aaacagaagtttaaaa

SEQ ID NO: 5681 - DNA, 16 bp, H. sapiens
aaacagaataaagatt

SEQ ID NO: 5682 - DNA, 16 bp, H. sapiens
aaacagaatatttgaa

SEQ ID NO: 5683 - DNA, 18 bp, H. sapiens
aaacagaatccagcagca

SEQ ID NO: 5684 - DNA, 16 bp, H. sapiens
aaacagaatgaaatca

SEQ ID NO: 5685 - DNA, 16 bp, H. sapiens
aaacagaattaaaagc

SEQ ID NO: 5686 - DNA, 16 bp, H. sapiens
aaacagaattctaaaa

SEQ ID NO: 5687 - DNA, 16 bp, H. sapiens
aaacagaattgccatt

SEQ ID NO: 5688 - DNA, 16 bp, H. sapiens
aaacagaatttatttt

SEQ ID NO: 5689 - DNA, 16 bp, H. sapiens
aaacagacaaaaattc

SEQ ID NO: 5690 - DNA, 16 bp, H. sapiens
aaacagacacagagac

SEQ ID NO: 5691 - DNA, 16 bp, H. sapiens
aaacagacacagagag

SEQ ID NO: 5692 - DNA, 16 bp, H. sapiens
aaacagacacatcaac

SEQ ID NO: 5693 - DNA, 16 bp, H. sapiens
aaacagactaacacac

SEQ ID NO: 5694 - DNA, 16 bp, H. sapiens
aaacagactcagtgct

SEQ ID NO: 5695 - DNA, 16 bp, H. sapiens
aaacagactttaaaaa

SEQ ID NO: 5696 - DNA, 17 bp, H. sapiens
aaacagactttaaagca

SEQ ID NO: 5697 - DNA, 16 bp, H. sapiens
aaacagagacaatttt

SEQ ID NO: 5698 - DNA, 16 bp, H. sapiens
aaacagagactcagag

SEQ ID NO: 5699 - DNA, 16 bp, H. sapiens
aaacagagagagagat

SEQ ID NO: 5700 - DNA, 17 bp, H. sapiens
aaacagagccaaagaca

SEQ ID NO: 5701 - DNA, 16 bp, H. sapiens
aaacagaggcccagag

SEQ ID NO: 5702 - DNA, 16 bp, H. sapiens
aaacagagggagactc

SEQ ID NO: 5703 - DNA, 16 bp, H. sapiens
aaacagataaaaatcc

SEQ ID NO: 5704 - DNA, 16 bp, H. sapiens
aaacagataaattcct

SEQ ID NO: 5705 - DNA, 16 bp, H. sapiens
aaacagatattttaaa

SEQ ID NO: 5706 - DNA, 16 bp, H. sapiens
aaacagatatttttct

SEQ ID NO: 5707 - DNA, 16 bp, H. sapiens
aaacagatcagtagtt

SEQ ID NO: 5708 - DNA, 16 bp, H. sapiens
aaacagatggcacact

SEQ ID NO: 5709 - DNA, 16 bp, H. sapiens
aaacagatgtgttgtc

SEQ ID NO: 5710 - DNA, 16 bp, H. sapiens
aaacagattaaattct

SEQ ID NO: 5711 - DNA, 16 bp, H. sapiens
aaacagattattaaaa

SEQ ID NO: 5712 - DNA, 16 bp, H. sapiens
aaacagattttaaaaa

SEQ ID NO: 5713 - DNA, 16 bp, H. sapiens
aaacagattttaaaag

SEQ ID NO: 5714 - DNA, 16 bp, H. sapiens
aaacagattttaaatg

SEQ ID NO: 5715 - DNA, 16 bp, H. sapiens
aaacagattttgaaaa

SEQ ID NO: 5716 - DNA, 16 bp, H. sapiens
aaacagattttgtttt

SEQ ID NO: 5717 - DNA, 16 bp, H. sapiens
aaacagatttttcatt

SEQ ID NO: 5718 - DNA, 16 bp, H. sapiens
aaacagcaaactgttt

SEQ ID NO: 5719 - DNA, 16 bp, H. sapiens
aaacagcaaagatggt

SEQ ID NO: 5720 - DNA, 16 bp, H. sapiens
aaacagcaaagcattc

SEQ ID NO: 5721 - DNA, 16 bp, H. sapiens
aaacagcaagtgctga

SEQ ID NO: 5722 - DNA, 16 bp, H. sapiens
aaacagcagaaactta

SEQ ID NO: 5723 - DNA, 16 bp, H. sapiens
aaacagcagaagcaga

SEQ ID NO: 5724 - DNA, 16 bp, H. sapiens
aaacagcagatattta

SEQ ID NO: 5725 - DNA, 16 bp, H. sapiens
aaacagcagcagcagc

SEQ ID NO: 5726 - DNA, 16 bp, H. sapiens
aaacagcatgagaact

SEQ ID NO: 5727 - DNA, 20 bp, H. sapiens
aaacagcatggtactggtat

SEQ ID NO: 5728 - DNA, 16 bp, H. sapiens
aaacagcatttaaaaa

SEQ ID NO: 5729 - DNA, 16 bp, H. sapiens
aaacagcatttttaaa

SEQ ID NO: 5730 - DNA, 16 bp, H. sapiens
aaacagcctggcacct

SEQ ID NO: 5731 - DNA, 16 bp, H. sapiens
aaacagccttattgct

SEQ ID NO: 5732 - DNA, 16 bp, H. sapiens
aaacagccttgttgct

SEQ ID NO: 5733 - DNA, 16 bp, H. sapiens
aaacagctattataaa

SEQ ID NO: 5734 - DNA, 16 bp, H. sapiens
aaacagctttattgct

SEQ ID NO: 5735 - DNA, 16 bp, H. sapiens
aaacagctttgttgaa

SEQ ID NO: 5736 - DNA, 16 bp, H. sapiens
aaacagcttttttttt

SEQ ID NO: 5737 - DNA, 16 bp, H. sapiens
aaacaggaaaaaatgc

SEQ ID NO: 5738 - DNA, 16 bp, H. sapiens
aaacaggaagaagttg

SEQ ID NO: 5739 - DNA, 16 bp, H. sapiens
aaacaggaataatttt

SEQ ID NO: 5740 - DNA, 16 bp, H. sapiens
aaacaggagaaaatct

SEQ ID NO: 5741 - DNA, 16 bp, H. sapiens
aaacaggattttgcca

SEQ ID NO: 5742 - DNA, 16 bp, H. sapiens
aaacaggcaaaaaagt

SEQ ID NO: 5743 - DNA, 16 bp, H. sapiens
aaacaggcaaaagata

SEQ ID NO: 5744 - DNA, 16 bp, H. sapiens
aaacaggcaaaatgaa

SEQ ID NO: 5745 - DNA, 16 bp, H. sapiens
aaacaggcaaaggaca

SEQ ID NO: 5746 - DNA, 16 bp, H. sapiens
aaacaggcagcaggcc

SEQ ID NO: 5747 - DNA, 18 bp, H. sapiens
aaacaggccactcggctc

SEQ ID NO: 5748 - DNA, 16 bp, H. sapiens
aaacaggcccagagaa

SEQ ID NO: 5749 - DNA, 16 bp, H. sapiens
aaacaggctcagaggg

SEQ ID NO: 5750 - DNA, 16 bp, H. sapiens
aaacaggctgggtttg

SEQ ID NO: 5751 - DNA, 16 bp, H. sapiens
aaacaggcttagagag

SEQ ID NO: 5752 - DNA, 16 bp, H. sapiens
aaacagggataatttt

SEQ ID NO: 5753 - DNA, 23 bp, H. sapiens
aaacagggtctggagtggacctc

SEQ ID NO: 5754 - DNA, 16 bp, H. sapiens
aaacagggtttggagt

SEQ ID NO: 5755 - DNA, 16 bp, H. sapiens
aaacaggtgaatttta

SEQ ID NO: 5756 - DNA, 19 bp, H. sapiens
aaacaggtggatttggatg

SEQ ID NO: 5757 - DNA, 16 bp, H. sapiens
aaacaggttctggagt

SEQ ID NO: 5758 - DNA, 16 bp, H. sapiens
aaacaggttttaaaat

SEQ ID NO: 5759 - DNA, 16 bp, H. sapiens
aaacagtaaaatattt

SEQ ID NO: 5760 - DNA, 16 bp, H. sapiens
aaacagtaataataac

SEQ ID NO: 5761 - DNA, 16 bp, H. sapiens
aaacagtacaaattta

SEQ ID NO: 5762 - DNA, 16 bp, H. sapiens
aaacagtatggtattg

SEQ ID NO: 5763 - DNA, 16 bp, H. sapiens
aaacagtatttctggt

SEQ ID NO: 5764 - DNA, 16 bp, H. sapiens
aaacagtattttaaat

SEQ ID NO: 5765 - DNA, 16 bp, H. sapiens
aaacagtattttgttt

SEQ ID NO: 5766 - DNA, 16 bp, H. sapiens
aaacagtattttttaa

SEQ ID NO: 5767 - DNA, 16 bp, H. sapiens
aaacagtctggcagtt

SEQ ID NO: 5768 - DNA, 16 bp, H. sapiens
aaacagtctgtcagac

SEQ ID NO: 5769 - DNA, 16 bp, H. sapiens
aaacagtctttttata

SEQ ID NO: 5770 - DNA, 16 bp, H. sapiens
aaacagtgaaataaat

SEQ ID NO: 5771 - DNA, 16 bp, H. sapiens
aaacagtgacttttac

SEQ ID NO: 5772 - DNA, 16 bp, H. sapiens
aaacagtgattccaaa

SEQ ID NO: 5773 - DNA, 16 bp, H. sapiens
aaacagtgcttccaaa

SEQ ID NO: 5774 - DNA, 16 bp, H. sapiens
aaacagtgtaaaccag

SEQ ID NO: 5775 - DNA, 16 bp, H. sapiens
aaacagtgtggtgctg

SEQ ID NO: 5776 - DNA, 16 bp, H. sapiens
aaacagtgtttcagaa

SEQ ID NO: 5777 - DNA, 16 bp, H. sapiens
aaacagttaaataaat

SEQ ID NO: 5778 - DNA, 16 bp, H. sapiens
aaacagttatttaaaa

SEQ ID NO: 5779 - DNA, 16 bp, H. sapiens
aaacagttgttttaaa

SEQ ID NO: 5780 - DNA, 16 bp, H. sapiens
aaacagtttcttttgt

SEQ ID NO: 5781 - DNA, 17 bp, H. sapiens
aaacagtttgcagtaaa

SEQ ID NO: 5782 - DNA, 16 bp, H. sapiens
aaacagtttgctgttt

SEQ ID NO: 5783 - DNA, 16 bp, H. sapiens
aaacagtttggcagtt

SEQ ID NO: 5784 - DNA, 16 bp, H. sapiens
aaacagtttggttttt

SEQ ID NO: 5785 - DNA, 16 bp, H. sapiens
aaacagttttatttaa

SEQ ID NO: 5786 - DNA, 16 bp, H. sapiens
aaacagttttcaaaag

SEQ ID NO: 5787 - DNA, 16 bp, H. sapiens
aaacagttttccaaag

SEQ ID NO: 5788 - DNA, 16 bp, H. sapiens
aaacagttttgaaaaa

SEQ ID NO: 5789 - DNA, 16 bp, H. sapiens
aaacagttttggaaaa

SEQ ID NO: 5790 - DNA, 16 bp, H. sapiens
aaacagttttgtaaaa

SEQ ID NO: 5791 - DNA, 16 bp, H. sapiens
aaacagtttttttttt

SEQ ID NO: 5792 - DNA, 16 bp, H. sapiens
aaacataaaattagcc

SEQ ID NO: 5793 - DNA, 16 bp, H. sapiens
aaacataaagtagaat

SEQ ID NO: 5794 - DNA, 16 bp, H. sapiens
aaacataaatgaattt

SEQ ID NO: 5795 - DNA, 17 bp, H. sapiens
aaacataaatgacctga

SEQ ID NO: 5796 - DNA, 16 bp, H. sapiens
aaacataaatgtaaat

SEQ ID NO: 5797 - DNA, 16 bp, H. sapiens
aaacataaatgttttc

SEQ ID NO: 5798 - DNA, 16 bp, H. sapiens
aaacataagaaaatgt

SEQ ID NO: 5799 - DNA, 16 bp, H. sapiens
aaacataagaaaattt

SEQ ID NO: 5800 - DNA, 16 bp, H. sapiens
aaacataattcatcac

SEQ ID NO: 5801 - DNA, 16 bp, H. sapiens
aaacataatttgaaaa

SEQ ID NO: 5802 - DNA, 16 bp, H. sapiens
aaacatacagaaaagt

SEQ ID NO: 5803 - DNA, 16 bp, H. sapiens
aaacatacagtaaaat

SEQ ID NO: 5804 - DNA, 16 bp, H. sapiens
aaacatagaaatggta

SEQ ID NO: 5805 - DNA, 16 bp, H. sapiens
aaacatatacagaaca

SEQ ID NO: 5806 - DNA, 16 bp, H. sapiens
aaacatatacattttt

SEQ ID NO: 5807 - DNA, 16 bp, H. sapiens
aaacatatagaaaatt

SEQ ID NO: 5808 - DNA, 16 bp, H. sapiens
aaacatatatacatgt

SEQ ID NO: 5809 - DNA, 16 bp, H. sapiens
aaacatatatacattt

SEQ ID NO: 5810 - DNA, 16 bp, H. sapiens
aaacatatatttatgt

SEQ ID NO: 5811 - DNA, 16 bp, H. sapiens
aaacatatgaaatata

SEQ ID NO: 5812 - DNA, 16 bp, H. sapiens
aaacatatgaagagat

SEQ ID NO: 5813 - DNA, 16 bp, H. sapiens
aaacatatggaatcaa

SEQ ID NO: 5814 - DNA, 16 bp, H. sapiens
aaacatatgtaaaatt

SEQ ID NO: 5815 - DNA, 16 bp, H. sapiens
aaacatatgtttaaaa

SEQ ID NO: 5816 - DNA, 16 bp, H. sapiens
aaacatatttaaaagt

SEQ ID NO: 5817 - DNA, 16 bp, H. sapiens
aaacatatttctgaaa

SEQ ID NO: 5818 - DNA, 16 bp, H. sapiens
aaacatatttgtaaat

SEQ ID NO: 5819 - DNA, 16 bp, H. sapiens
aaacatatttgtgcat

SEQ ID NO: 5820 - DNA, 16 bp, H. sapiens
aaacatatttttgaaa

SEQ ID NO: 5821 - DNA, 16 bp, H. sapiens
aaacatatttttggaa

SEQ ID NO: 5822 - DNA, 16 bp, H. sapiens
aaacatcaatgaaaca

SEQ ID NO: 5823 - DNA, 16 bp, H. sapiens
aaacatcaattttttt

SEQ ID NO: 5824 - DNA, 16 bp, H. sapiens
aaacatcacaaagcag

SEQ ID NO: 5825 - DNA, 16 bp, H. sapiens
aaacatcacaaagtag

SEQ ID NO: 5826 - DNA, 16 bp, H. sapiens
aaacatcacagagtgt

SEQ ID NO: 5827 - DNA, 16 bp, H. sapiens
aaacatcaccatcatc

SEQ ID NO: 5828 - DNA, 16 bp, H. sapiens
aaacatcagaaaaacc

SEQ ID NO: 5829 - DNA, 16 bp, H. sapiens
aaacatcagaaggaac

SEQ ID NO: 5830 - DNA, 16 bp, H. sapiens
aaacatcagacaaatt

SEQ ID NO: 5831 - DNA, 16 bp, H. sapiens
aaacatcatatgttct

SEQ ID NO: 5832 - DNA, 16 bp, H. sapiens
aaacatccagaaaaga

SEQ ID NO: 5833 - DNA, 16 bp, H. sapiens
aaacatcccaaatgtc

SEQ ID NO: 5834 - DNA, 16 bp, H. sapiens
aaacatcctacaaggc

SEQ ID NO: 5835 - DNA, 16 bp, H. sapiens
aaacatctacagaact

SEQ ID NO: 5836 - DNA, 16 bp, H. sapiens
aaacatctgttcatgt

SEQ ID NO: 5837 - DNA, 30 bp, H. sapiens
aaacatctgttgacctgtgttctagaagga

SEQ ID NO: 5838 - DNA, 16 bp, H. sapiens
aaacatcttaaaaaga

SEQ ID NO: 5839 - DNA, 16 bp, H. sapiens
aaacatcttaaatttt

SEQ ID NO: 5840 - DNA, 16 bp, H. sapiens
aaacatcttaatattt

SEQ ID NO: 5841 - DNA, 16 bp, H. sapiens
aaacatcttttcaaat

SEQ ID NO: 5842 - DNA, 16 bp, H. sapiens
aaacatctttttcttc

SEQ ID NO: 5843 - DNA, 16 bp, H. sapiens
aaacatgaaaaacatt

SEQ ID NO: 5844 - DNA, 16 bp, H. sapiens
aaacatgaaaaatttt

SEQ ID NO: 5845 - DNA, 16 bp, H. sapiens
aaacatgaaaatgtta

SEQ ID NO: 5846 - DNA, 16 bp, H. sapiens
aaacatgaaaatgttt

SEQ ID NO: 5847 - DNA, 16 bp, H. sapiens
aaacatgaaattcatt

SEQ ID NO: 5848 - DNA, 16 bp, H. sapiens
aaacatgaaatttggt

SEQ ID NO: 5849 - DNA, 16 bp, H. sapiens
aaacatgaagaaaagc

SEQ ID NO: 5850 - DNA, 16 bp, H. sapiens
aaacatgatgaaaccc

SEQ ID NO: 5851 - DNA, 16 bp, H. sapiens
aaacatgatgctggca

SEQ ID NO: 5852 - DNA, 16 bp, H. sapiens
aaacatgcacatatac

SEQ ID NO: 5853 - DNA, 16 bp, H. sapiens
aaacatgcatttttaa

SEQ ID NO: 5854 - DNA, 16 bp, H. sapiens
aaacatgccaaatttt

SEQ ID NO: 5855 - DNA, 16 bp, H. sapiens
aaacatgctttgaaaa

SEQ ID NO: 5856 - DNA, 16 bp, H. sapiens
aaacatggaaaaatgc

SEQ ID NO: 5857 - DNA, 16 bp, H. sapiens
aaacatggaaaatatt

SEQ ID NO: 5858 - DNA, 21 bp, H. sapiens
aaacatggaaaggaacaactg

SEQ ID NO: 5859 - DNA, 16 bp, H. sapiens
aaacatggaaaggaat

SEQ ID NO: 5860 - DNA, 16 bp, H. sapiens
aaacatggacaatttg

SEQ ID NO: 5861 - DNA, 16 bp, H. sapiens
aaacatggcaaaaccc

SEQ ID NO: 5862 - DNA, 16 bp, H. sapiens
aaacatggcaaaatat

SEQ ID NO: 5863 - DNA, 16 bp, H. sapiens
aaacatggggttggag

SEQ ID NO: 5864 - DNA, 16 bp, H. sapiens
aaacatggtgaaaccc

SEQ ID NO: 5865 - DNA, 17 bp, H. sapiens
aaacatggtgaaacccc

SEQ ID NO: 5866 - DNA, 16 bp, H. sapiens
aaacatgtaaagaaga

SEQ ID NO: 5867 - DNA, 16 bp, H. sapiens
aaacatgtacaaaaat

SEQ ID NO: 5868 - DNA, 16 bp, H. sapiens
aaacatgtatataaaa

SEQ ID NO: 5869 - DNA, 16 bp, H. sapiens
aaacatgtatgtgcat

SEQ ID NO: 5870 - DNA, 16 bp, H. sapiens
aaacatgtattatttc

SEQ ID NO: 5871 - DNA, 16 bp, H. sapiens
aaacatgtctttttct

SEQ ID NO: 5872 - DNA, 16 bp, H. sapiens
aaacatgtttaaagaa

SEQ ID NO: 5873 - DNA, 16 bp, H. sapiens
aaacatgttttatttt

SEQ ID NO: 5874 - DNA, 16 bp, H. sapiens
aaacatgttttcattt

SEQ ID NO: 5875 - DNA, 16 bp, H. sapiens
aaacatgtttttaaca

SEQ ID NO: 5876 - DNA, 16 bp, H. sapiens
aaacatgtttttattt

SEQ ID NO: 5877 - DNA, 16 bp, H. sapiens
aaacatgttttttaaa

SEQ ID NO: 5878 - DNA, 16 bp, H. sapiens
aaacattaaaaagatt

SEQ ID NO: 5879 - DNA, 16 bp, H. sapiens
aaacattaaaatgaca

SEQ ID NO: 5880 - DNA, 16 bp, H. sapiens
aaacattaaacataga

SEQ ID NO: 5881 - DNA, 16 bp, H. sapiens
aaacattaacaaaatg

SEQ ID NO: 5882 - DNA, 16 bp, H. sapiens
aaacattacattttta

SEQ ID NO: 5883 - DNA, 16 bp, H. sapiens
aaacattacttctggg

SEQ ID NO: 5884 - DNA, 16 bp, H. sapiens
aaacattagagaaaat

SEQ ID NO: 5885 - DNA, 16 bp, H. sapiens
aaacattatatgttct

SEQ ID NO: 5886 - DNA, 16 bp, H. sapiens
aaacattatgaaaata

SEQ ID NO: 5887 - DNA, 16 bp, H. sapiens
aaacattattgaaaaa

SEQ ID NO: 5888 - DNA, 16 bp, H. sapiens
aaacattatttctggg

SEQ ID NO: 5889 - DNA, 16 bp, H. sapiens
aaacattattttctgt

SEQ ID NO: 5890 - DNA, 16 bp, H. sapiens
aaacattattttgaaa

SEQ ID NO: 5891 - DNA, 16 bp, H. sapiens
aaacattcaaaatgtt

SEQ ID NO: 5892 - DNA, 16 bp, H. sapiens
aaacattcaaagaaat

SEQ ID NO: 5893 - DNA, 16 bp, H. sapiens
aaacattcagtttcca

SEQ ID NO: 5894 - DNA, 16 bp, H. sapiens
aaacattcatatattt

SEQ ID NO: 5895 - DNA, 16 bp, H. sapiens
aaacattcattccata

SEQ ID NO: 5896 - DNA, 16 bp, H. sapiens
aaacattcattctttt

SEQ ID NO: 5897 - DNA, 16 bp, H. sapiens
aaacattcatttcaaa

SEQ ID NO: 5898 - DNA, 16 bp, H. sapiens
aaacattcccattcca

SEQ ID NO: 5899 - DNA, 16 bp, H. sapiens
aaacattccctttttt

SEQ ID NO: 5900 - DNA, 16 bp, H. sapiens
aaacattctaaatatt

SEQ ID NO: 5901 - DNA, 16 bp, H. sapiens
aaacattcttatttct

SEQ ID NO: 5902 - DNA, 16 bp, H. sapiens
aaacattcttatttta

SEQ ID NO: 5903 - DNA, 16 bp, H. sapiens
aaacattgaaaaatat

SEQ ID NO: 5904 - DNA, 16 bp, H. sapiens
aaacattgaaataaat

SEQ ID NO: 5905 - DNA, 16 bp, H. sapiens
aaacattgattttttt

SEQ ID NO: 5906 - DNA, 16 bp, H. sapiens
aaacattgcatgttct

SEQ ID NO: 5907 - DNA, 16 bp, H. sapiens
aaacattgctgaaaga

SEQ ID NO: 5908 - DNA, 16 bp, H. sapiens
aaacattgttgaaaga

SEQ ID NO: 5909 - DNA, 16 bp, H. sapiens
aaacatttaaaaagta

SEQ ID NO: 5910 - DNA, 16 bp, H. sapiens
aaacatttaaagtgtt

SEQ ID NO: 5911 - DNA, 16 bp, H. sapiens
aaacatttaatgaaga

SEQ ID NO: 5912 - DNA, 16 bp, H. sapiens
aaacatttacaagaaa

SEQ ID NO: 5913 - DNA, 16 bp, H. sapiens
aaacatttacatattt

SEQ ID NO: 5914 - DNA, 16 bp, H. sapiens
aaacatttactgaaaa

SEQ ID NO: 5915 - DNA, 16 bp, H. sapiens
aaacatttactgaaca

SEQ ID NO: 5916 - DNA, 16 bp, H. sapiens
aaacatttactgaatg

SEQ ID NO: 5917 - DNA, 16 bp, H. sapiens
aaacatttactgagtg

SEQ ID NO: 5918 - DNA, 16 bp, H. sapiens
aaacatttacttgttt

SEQ ID NO: 5919 - DNA, 16 bp, H. sapiens
aaacatttactttttc

SEQ ID NO: 5920 - DNA, 16 bp, H. sapiens
aaacatttagaaaatg

SEQ ID NO: 5921 - DNA, 16 bp, H. sapiens
aaacatttagaagaaa

SEQ ID NO: 5922 - DNA, 16 bp, H. sapiens
aaacatttagaccata

SEQ ID NO: 5923 - DNA, 16 bp, H. sapiens
aaacatttagggaaaa

SEQ ID NO: 5924 - DNA, 16 bp, H. sapiens
aaacatttatctttgt

SEQ ID NO: 5925 - DNA, 16 bp, H. sapiens
aaacatttattatctt

SEQ ID NO: 5926 - DNA, 16 bp, H. sapiens
aaacatttattgagca

SEQ ID NO: 5927 - DNA, 16 bp, H. sapiens
aaacatttatttccca

SEQ ID NO: 5928 - DNA, 16 bp, H. sapiens
aaacatttattttgat

SEQ ID NO: 5929 - DNA, 16 bp, H. sapiens
aaacatttcaaatttt

SEQ ID NO: 5930 - DNA, 16 bp, H. sapiens
aaacatttcaagaaaa

SEQ ID NO: 5931 - DNA, 16 bp, H. sapiens
aaacatttcaagaaga

SEQ ID NO: 5932 - DNA, 16 bp, H. sapiens
aaacatttcagatttt

SEQ ID NO: 5933 - DNA, 16 bp, H. sapiens
aaacatttcataattt

SEQ ID NO: 5934 - DNA, 16 bp, H. sapiens
aaacatttccaaaaat

SEQ ID NO: 5935 - DNA, 16 bp, H. sapiens
aaacatttcctttgaa

SEQ ID NO: 5936 - DNA, 16 bp, H. sapiens
aaacatttctggagct

SEQ ID NO: 5937 - DNA, 16 bp, H. sapiens
aaacatttctttggat

SEQ ID NO: 5938 - DNA, 16 bp, H. sapiens
aaacatttgaaaactt

SEQ ID NO: 5939 - DNA, 16 bp, H. sapiens
aaacatttgaaaagaa

SEQ ID NO: 5940 - DNA, 16 bp, H. sapiens
aaacatttgaaacaaa

SEQ ID NO: 5941 - DNA, 16 bp, H. sapiens
aaacatttgaggaaga

SEQ ID NO: 5942 - DNA, 16 bp, H. sapiens
aaacatttggaaaaaa

SEQ ID NO: 5943 - DNA, 16 bp, H. sapiens
aaacatttggaaaaat

SEQ ID NO: 5944 - DNA, 16 bp, H. sapiens
aaacatttgtaaaaat

SEQ ID NO: 5945 - DNA, 16 bp, H. sapiens
aaacatttgtcaaatg

SEQ ID NO: 5946 - DNA, 16 bp, H. sapiens
aaacatttgttgaaat

SEQ ID NO: 5947 - DNA, 16 bp, H. sapiens
aaacatttgttgagtt

SEQ ID NO: 5948 - DNA, 16 bp, H. sapiens
aaacattttaaaaaga

SEQ ID NO: 5949 - DNA, 16 bp, H. sapiens
aaacattttaaaaagc

SEQ ID NO: 5950 - DNA, 16 bp, H. sapiens
aaacattttaaaaatg

SEQ ID NO: 5951 - DNA, 16 bp, H. sapiens
aaacattttaaatgtt

SEQ ID NO: 5952 - DNA, 16 bp, H. sapiens
aaacattttaaattca

SEQ ID NO: 5953 - DNA, 16 bp, H. sapiens
aaacattttaagagaa

SEQ ID NO: 5954 - DNA, 16 bp, H. sapiens
aaacattttaagtttt

SEQ ID NO: 5955 - DNA, 16 bp, H. sapiens
aaacattttaatatgt

SEQ ID NO: 5956 - DNA, 16 bp, H. sapiens
aaacattttacagagt

SEQ ID NO: 5957 - DNA, 16 bp, H. sapiens
aaacattttacatgca

SEQ ID NO: 5958 - DNA, 16 bp, H. sapiens
aaacattttacattca

SEQ ID NO: 5959 - DNA, 16 bp, H. sapiens
aaacattttacatttt

SEQ ID NO: 5960 - DNA, 16 bp, H. sapiens
aaacattttacttaaa

SEQ ID NO: 5961 - DNA, 16 bp, H. sapiens
aaacattttagttttt

SEQ ID NO: 5962 - DNA, 16 bp, H. sapiens
aaacattttatcattt

SEQ ID NO: 5963 - DNA, 16 bp, H. sapiens
aaacattttattcagt

SEQ ID NO: 5964 - DNA, 16 bp, H. sapiens
aaacattttcaaatga

SEQ ID NO: 5965 - DNA, 16 bp, H. sapiens
aaacattttcaagaaa

SEQ ID NO: 5966 - DNA, 16 bp, H. sapiens
aaacattttcatcatt

SEQ ID NO: 5967 - DNA, 16 bp, H. sapiens
aaacattttcattacc

SEQ ID NO: 5968 - DNA, 16 bp, H. sapiens
aaacattttccataaa

SEQ ID NO: 5969 - DNA, 16 bp, H. sapiens
aaacattttcctattt

SEQ ID NO: 5970 - DNA, 16 bp, H. sapiens
aaacattttctaaatg

SEQ ID NO: 5971 - DNA, 16 bp, H. sapiens
aaacattttctattat

SEQ ID NO: 5972 - DNA, 16 bp, H. sapiens
aaacattttctcttta

SEQ ID NO: 5973 - DNA, 16 bp, H. sapiens
aaacattttcttcttt

SEQ ID NO: 5974 - DNA, 16 bp, H. sapiens
aaacattttctttata

SEQ ID NO: 5975 - DNA, 16 bp, H. sapiens
aaacattttgaaggaa

SEQ ID NO: 5976 - DNA, 16 bp, H. sapiens
aaacattttgacattt

SEQ ID NO: 5977 - DNA, 16 bp, H. sapiens
aaacattttgataaaa

SEQ ID NO: 5978 - DNA, 16 bp, H. sapiens
aaacattttgctaagt

SEQ ID NO: 5979 - DNA, 16 bp, H. sapiens
aaacattttggttatt

SEQ ID NO: 5980 - DNA, 16 bp, H. sapiens
aaacattttgtaaaaa

SEQ ID NO: 5981 - DNA, 16 bp, H. sapiens
aaacattttgtgaaaa

SEQ ID NO: 5982 - DNA, 16 bp, H. sapiens
aaacattttgttaaaa

SEQ ID NO: 5983 - DNA, 16 bp, H. sapiens
aaacatttttaaagac

SEQ ID NO: 5984 - DNA, 16 bp, H. sapiens
aaacatttttaaaggg

SEQ ID NO: 5985 - DNA, 16 bp, H. sapiens
aaacatttttaaagtt

SEQ ID NO: 5986 - DNA, 16 bp, H. sapiens
aaacatttttaaatag

SEQ ID NO: 5987 - DNA, 16 bp, H. sapiens
aaacatttttaagaag

SEQ ID NO: 5988 - DNA, 16 bp, H. sapiens
aaacatttttagaata

SEQ ID NO: 5989 - DNA, 16 bp, H. sapiens
aaacatttttagagaa

SEQ ID NO: 5990 - DNA, 16 bp, H. sapiens
aaacatttttcatttg

SEQ ID NO: 5991 - DNA, 16 bp, H. sapiens
aaacatttttcctttg

SEQ ID NO: 5992 - DNA, 16 bp, H. sapiens
aaacatttttctctct

SEQ ID NO: 5993 - DNA, 16 bp, H. sapiens
aaacatttttgaaaaa

SEQ ID NO: 5994 - DNA, 16 bp, H. sapiens
aaacatttttgaaatg

SEQ ID NO: 5995 - DNA, 16 bp, H. sapiens
aaacatttttggtttt

SEQ ID NO: 5996 - DNA, 16 bp, H. sapiens
aaacatttttgtaaaa

SEQ ID NO: 5997 - DNA, 16 bp, H. sapiens
aaacattttttaaaag

SEQ ID NO: 5998 - DNA, 16 bp, H. sapiens
aaacattttttcagtt

SEQ ID NO: 5999 - DNA, 16 bp, H. sapiens
aaacattttttccaaa

SEQ ID NO: 6000 - DNA, 16 bp, H. sapiens
aaacattttttcttca

SEQ ID NO: 6001 - DNA, 16 bp, H. sapiens
aaacattttttcttct

SEQ ID NO: 6002 - DNA, 16 bp, H. sapiens
aaacatttttttctaa

SEQ ID NO: 6003 - DNA, 16 bp, H. sapiens
aaacatttttttctct

SEQ ID NO: 6004 - DNA, 16 bp, H. sapiens
aaaccaaaaacatttt

SEQ ID NO: 6005 - DNA, 16 bp, H. sapiens
aaaccaaaaagtatct

SEQ ID NO: 6006 - DNA, 16 bp, H. sapiens
aaaccaaaaccaaagt

SEQ ID NO: 6007 - DNA, 16 bp, H. sapiens
aaaccaaaagctgttt

SEQ ID NO: 6008 - DNA, 16 bp, H. sapiens
aaaccaaaatatttca

SEQ ID NO: 6009 - DNA, 16 bp, H. sapiens
aaaccaaaatattttt

SEQ ID NO: 6010 - DNA, 16 bp, H. sapiens
aaaccaaaatgaagtc

SEQ ID NO: 6011 - DNA, 16 bp, H. sapiens
aaaccaaaatgtatct

SEQ ID NO: 6012 - DNA, 16 bp, H. sapiens
aaaccaaacactgtat

SEQ ID NO: 6013 - DNA, 16 bp, H. sapiens
aaaccaaacacttcat

SEQ ID NO: 6014 - DNA, 16 bp, H. sapiens
aaaccaaagactgcat

SEQ ID NO: 6015 - DNA, 16 bp, H. sapiens
aaaccaaagcccagag

SEQ ID NO: 6016 - DNA, 16 bp, H. sapiens
aaaccaaagtttaaaa

SEQ ID NO: 6017 - DNA, 16 bp, H. sapiens
aaaccaaatccagaaa

SEQ ID NO: 6018 - DNA, 16 bp, H. sapiens
aaaccaaatttatttt

SEQ ID NO: 6019 - DNA, 16 bp, H. sapiens
aaaccaacaaaggtca

SEQ ID NO: 6020 - DNA, 16 bp, H. sapiens
aaaccaacagcaatgt

SEQ ID NO: 6021 - DNA, 16 bp, H. sapiens
aaaccaacctggacaa

SEQ ID NO: 6022 - DNA, 16 bp, H. sapiens
aaaccaacctggccaa

SEQ ID NO: 6023 - DNA, 16 bp, H. sapiens
aaaccaagatgaaatc

SEQ ID NO: 6024 - DNA, 16 bp, H. sapiens
aaaccaaggaaccaga

SEQ ID NO: 6025 - DNA, 16 bp, H. sapiens
aaaccaaggcccagag

SEQ ID NO: 6026 - DNA, 16 bp, H. sapiens
aaaccaaggctcagag

SEQ ID NO: 6027 - DNA, 16 bp, H. sapiens
aaaccaaggttcagag

SEQ ID NO: 6028 - DNA, 16 bp, H. sapiens
aaaccaataacaagta

SEQ ID NO: 6029 - DNA, 17 bp, H. sapiens
aaaccaatcatgccttt

SEQ ID NO: 6030 - DNA, 16 bp, H. sapiens
aaaccaatgctcccaa

SEQ ID NO: 6031 - DNA, 16 bp, H. sapiens
aaaccaatttacaaga

SEQ ID NO: 6032 - DNA, 16 bp, H. sapiens
aaaccaattttaccat

SEQ ID NO: 6033 - DNA, 16 bp, H. sapiens
aaaccaattttttgtt

SEQ ID NO: 6034 - DNA, 16 bp, H. sapiens
aaaccacaaccttgca

SEQ ID NO: 6035 - DNA, 17 bp, H. sapiens
aaaccacaattactttt

SEQ ID NO: 6036 - DNA, 16 bp, H. sapiens
aaaccacagaaaatga

SEQ ID NO: 6037 - DNA, 17 bp, H. sapiens
aaaccacagaaagtgaa

SEQ ID NO: 6038 - DNA, 16 bp, H. sapiens
aaaccacagatagtac

SEQ ID NO: 6039 - DNA, 16 bp, H. sapiens
aaaccacatctctact

SEQ ID NO: 6040 - DNA, 16 bp, H. sapiens
aaaccacatgagtatc

SEQ ID NO: 6041 - DNA, 16 bp, H. sapiens
aaaccaccatacctgg

SEQ ID NO: 6042 - DNA, 16 bp, H. sapiens
aaaccaccatgacaca

SEQ ID NO: 6043 - DNA, 19 bp, H. sapiens
aaaccaccatggcacacgt

SEQ ID NO: 6044 - DNA, 16 bp, H. sapiens
aaaccacctcagcctg

SEQ ID NO: 6045 - DNA, 16 bp, H. sapiens
aaaccacctgtttccc

SEQ ID NO: 6046 - DNA, 16 bp, H. sapiens
aaaccaccttttgaag

SEQ ID NO: 6047 - DNA, 24 bp, H. sapiens
aaaccactgctcaaggaaataaga

SEQ ID NO: 6048 - DNA, 20 bp, H. sapiens
aaaccactgctcaaggaagt

SEQ ID NO: 6049 - DNA, 16 bp, H. sapiens
aaaccactttaaagtt

SEQ ID NO: 6050 - DNA, 16 bp, H. sapiens
aaaccagaaaatgttt

SEQ ID NO: 6051 - DNA, 16 bp, H. sapiens
aaaccagaaagaagtc

SEQ ID NO: 6052 - DNA, 16 bp, H. sapiens
aaaccagaagacaatg

SEQ ID NO: 6053 - DNA, 16 bp, H. sapiens
aaaccagaagagattg

SEQ ID NO: 6054 - DNA, 16 bp, H. sapiens
aaaccagaagctgaaa

SEQ ID NO: 6055 - DNA, 16 bp, H. sapiens
aaaccagacaaggata

SEQ ID NO: 6056 - DNA, 16 bp, H. sapiens
aaaccagacaagttat

SEQ ID NO: 6057 - DNA, 16 bp, H. sapiens
aaaccagaggcagagg

SEQ ID NO: 6058 - DNA, 16 bp, H. sapiens
aaaccagcagcagtgc

SEQ ID NO: 6059 - DNA, 16 bp, H. sapiens
aaaccagcatggccaa

SEQ ID NO: 6060 - DNA, 16 bp, H. sapiens
aaaccagcctgaccaa

SEQ ID NO: 6061 - DNA, 16 bp, H. sapiens
aaaccagcctggccaa

SEQ ID NO: 6062 - DNA, 16 bp, H. sapiens
aaaccagctcctggaa

SEQ ID NO: 6063 - DNA, 16 bp, H. sapiens
aaaccagctcctggag

SEQ ID NO: 6064 - DNA, 16 bp, H. sapiens
aaaccagctcctggtt

SEQ ID NO: 6065 - DNA, 16 bp, H. sapiens
aaaccaggaaattgac

SEQ ID NO: 6066 - DNA, 16 bp, H. sapiens
aaaccaggaagaagtg

SEQ ID NO: 6067 - DNA, 16 bp, H. sapiens
aaaccaggaagaatta

SEQ ID NO: 6068 - DNA, 16 bp, H. sapiens
aaaccaggcacggtgg

SEQ ID NO: 6069 - DNA, 16 bp, H. sapiens
aaaccaggcagaagaa

SEQ ID NO: 6070 - DNA, 22 bp, H. sapiens
aaaccaggcctgggcctgcctg

SEQ ID NO: 6071 - DNA, 16 bp, H. sapiens
aaaccagtgcaaaaag

SEQ ID NO: 6072 - DNA, 16 bp, H. sapiens
aaaccagtggttctca

SEQ ID NO: 6073 - DNA, 16 bp, H. sapiens
aaaccagttaggaggc

SEQ ID NO: 6074 - DNA, 16 bp, H. sapiens
aaaccagttttatcta

SEQ ID NO: 6075 - DNA, 17 bp, H. sapiens
aaaccataaaaacgcta

SEQ ID NO: 6076 - DNA, 16 bp, H. sapiens
aaaccatagcattctg

SEQ ID NO: 6077 - DNA, 16 bp, H. sapiens
aaaccatatcaagcac

SEQ ID NO: 6078 - DNA, 16 bp, H. sapiens
aaaccatatcaatgtg

SEQ ID NO: 6079 - DNA, 16 bp, H. sapiens
aaaccatatcacatgc

SEQ ID NO: 6080 - DNA, 16 bp, H. sapiens
aaaccatatcagagat

SEQ ID NO: 6081 - DNA, 16 bp, H. sapiens
aaaccatatcattcta

SEQ ID NO: 6082 - DNA, 16 bp, H. sapiens
aaaccatatctttgtg

SEQ ID NO: 6083 - DNA, 16 bp, H. sapiens
aaaccatcaccacaat

SEQ ID NO: 6084 - DNA, 16 bp, H. sapiens
aaaccatcagagaata

SEQ ID NO: 6085 - DNA, 16 bp, H. sapiens
aaaccatcagatttca

SEQ ID NO: 6086 - DNA, 16 bp, H. sapiens
aaaccatcatcagagt

SEQ ID NO: 6087 - DNA, 16 bp, H. sapiens
aaaccatcattcacag

SEQ ID NO: 6088 - DNA, 16 bp, H. sapiens
aaaccatccaaatgtc

SEQ ID NO: 6089 - DNA, 16 bp, H. sapiens
aaaccatcctcccact

SEQ ID NO: 6090 - DNA, 16 bp, H. sapiens
aaaccatctttcttcc

SEQ ID NO: 6091 - DNA, 16 bp, H. sapiens
aaaccatggaaaatga

SEQ ID NO: 6092 - DNA, 16 bp, H. sapiens
aaaccatggataaggg

SEQ ID NO: 6093 - DNA, 19 bp, H. sapiens
aaaccattacatctgagaa

SEQ ID NO: 6094 - DNA, 16 bp, H. sapiens
aaaccatttttaaaag

SEQ ID NO: 6095 - DNA, 16 bp, H. sapiens
aaaccatttttttcct

SEQ ID NO: 6096 - DNA, 16 bp, H. sapiens
aaacccaaagcaagta

SEQ ID NO: 6097 - DNA, 16 bp, H. sapiens
aaacccaaaggaaaat

SEQ ID NO: 6098 - DNA, 16 bp, H. sapiens
aaacccaaagttagca

SEQ ID NO: 6099 - DNA, 16 bp, H. sapiens
aaacccaatgggaaaa

SEQ ID NO: 6100 - DNA, 16 bp, H. sapiens
aaacccacagccagca

SEQ ID NO: 6101 - DNA, 16 bp, H. sapiens
aaacccacagccagtg

SEQ ID NO: 6102 - DNA, 16 bp, H. sapiens
aaacccagagccaaca

SEQ ID NO: 6103 - DNA, 16 bp, H. sapiens
aaacccagagccctgg

SEQ ID NO: 6104 - DNA, 16 bp, H. sapiens
aaacccagataatttt

SEQ ID NO: 6105 - DNA, 17 bp, H. sapiens
aaacccagcagaagaaa

SEQ ID NO: 6106 - DNA, 16 bp, H. sapiens
aaacccagtgtctact

SEQ ID NO: 6107 - DNA, 16 bp, H. sapiens
aaacccatctctacaa

SEQ ID NO: 6108 - DNA, 18 bp, H. sapiens
aaacccatctctactaaa

SEQ ID NO: 6109 - DNA, 16 bp, H. sapiens
aaacccatttctacaa

SEQ ID NO: 6110 - DNA, 16 bp, H. sapiens
aaacccatttctggat

SEQ ID NO: 6111 - DNA, 16 bp, H. sapiens
aaacccattttcttgg

SEQ ID NO: 6112 - DNA, 16 bp, H. sapiens
aaaccccacagtctct

SEQ ID NO: 6113 - DNA, 16 bp, H. sapiens
aaaccccaggaccaga

SEQ ID NO: 6114 - DNA, 16 bp, H. sapiens
aaaccccaggctccac

SEQ ID NO: 6115 - DNA, 20 bp, H. sapiens
aaaccccatatctactaaaa

SEQ ID NO: 6116 - DNA, 16 bp, H. sapiens
aaaccccatctatatt

SEQ ID NO: 6117 - DNA, 22 bp, H. sapiens
aaaccccatctctaccaaaaaa

SEQ ID NO: 6118 - DNA, 21 bp, H. sapiens
aaaccccatctctactaaaag

SEQ ID NO: 6119 - DNA, 20 bp, H. sapiens
aaaccccatctctactaaac

SEQ ID NO: 6120 - DNA, 17 bp, H. sapiens
aaaccccatctgaaggt

SEQ ID NO: 6121 - DNA, 16 bp, H. sapiens
aaacccccaagagtat

SEQ ID NO: 6122 - DNA, 21 bp, H. sapiens
aaaccccggctctactaaaaa

SEQ ID NO: 6123 - DNA, 20 bp, H. sapiens
aaaccccgtctctactaaaa

SEQ ID NO: 6124 - DNA, 23 bp, H. sapiens
aaaccccgtctctactaaaaaaa

SEQ ID NO: 6125 - DNA, 24 bp, H. sapiens
aaaccccgtctctactaaaaagta

SEQ ID NO: 6126 - DNA, 24 bp, H. sapiens
aaaccccgtctctactaaaaataa

SEQ ID NO: 6127 - DNA, 18 bp, H. sapiens
aaaccccgtctctactat

SEQ ID NO: 6128 - DNA, 17 bp, H. sapiens
aaaccccgtctctatca

SEQ ID NO: 6129 - DNA, 16 bp, H. sapiens
aaacccctgtctctac

SEQ ID NO: 6130 - DNA, 18 bp, H. sapiens
aaaccccttctctactaa

SEQ ID NO: 6131 - DNA, 16 bp, H. sapiens
aaaccccttctttact

SEQ ID NO: 6132 - DNA, 18 bp, H. sapiens
aaacccgggaggtggagg

SEQ ID NO: 6133 - DNA, 18 bp, H. sapiens
aaacccgtctctaccaaa

SEQ ID NO: 6134 - DNA, 16 bp, H. sapiens
aaaccctaaagcaacc

SEQ ID NO: 6135 - DNA, 16 bp, H. sapiens
aaaccctacaatccag

SEQ ID NO: 6136 - DNA, 16 bp, H. sapiens
aaaccctatctctaaa

SEQ ID NO: 6137 - DNA, 16 bp, H. sapiens
aaaccctatgaatgta

SEQ ID NO: 6138 - DNA, 16 bp, H. sapiens
aaaccctcaagggcat

SEQ ID NO: 6139 - DNA, 16 bp, H. sapiens
aaaccctcagcaaact

SEQ ID NO: 6140 - DNA, 16 bp, H. sapiens
aaaccctctgcctggc

SEQ ID NO: 6141 - DNA, 18 bp, H. sapiens
aaaccctgactctactaa

SEQ ID NO: 6142 - DNA, 16 bp, H. sapiens
aaaccctgccttcaag

SEQ ID NO: 6143 - DNA, 16 bp, H. sapiens
aaaccctgtatatact

SEQ ID NO: 6144 - DNA, 16 bp, H. sapiens
aaaccctgtctccaaa

SEQ ID NO: 6145 - DNA, 19 bp, H. sapiens
aaaccctgtctccacaaaa

SEQ ID NO: 6146 - DNA, 16 bp, H. sapiens
aaaccctgtctctaaa

SEQ ID NO: 6147 - DNA, 19 bp, H. sapiens
aaaccctgtctctacaaaa

SEQ ID NO: 6148 - DNA, 19 bp, H. sapiens
aaaccctgtctctacaaat

SEQ ID NO: 6149 - DNA, 21 bp, H. sapiens
aaaccctgtctctaccaaaat

SEQ ID NO: 6150 - DNA, 20 bp, H. sapiens
aaaccctgtctctagtaaaa

SEQ ID NO: 6151 - DNA, 17 bp, H. sapiens
aaaccctgtctttacaa

SEQ ID NO: 6152 - DNA, 20 bp, H. sapiens
aaaccctgtctttactaaaa

SEQ ID NO: 6153 - DNA, 16 bp, H. sapiens
aaacccttaagaaaaa

SEQ ID NO: 6154 - DNA, 16 bp, H. sapiens
aaacccttgtgacatg

SEQ ID NO: 6155 - DNA, 18 bp, H. sapiens
aaaccgaatccagaagca

SEQ ID NO: 6156 - DNA, 16 bp, H. sapiens
aaaccgcccccatgat

SEQ ID NO: 6157 - DNA, 16 bp, H. sapiens
aaaccggtccctggtg

SEQ ID NO: 6158 - DNA, 16 bp, H. sapiens
aaacctaagaaatgag

SEQ ID NO: 6159 - DNA, 16 bp, H. sapiens
aaacctacaaaatggg

SEQ ID NO: 6160 - DNA, 16 bp, H. sapiens
aaacctacaaagagac

SEQ ID NO: 6161 - DNA, 16 bp, H. sapiens
aaacctacttgatcat

SEQ ID NO: 6162 - DNA, 16 bp, H. sapiens
aaacctagaagagatg

SEQ ID NO: 6163 - DNA, 16 bp, H. sapiens
aaacctagagaaaatg

SEQ ID NO: 6164 - DNA, 16 bp, H. sapiens
aaacctagatggcaca

SEQ ID NO: 6165 - DNA, 16 bp, H. sapiens
aaacctattttttaaa

SEQ ID NO: 6166 - DNA, 17 bp, H. sapiens
aaacctcatcatctcag

SEQ ID NO: 6167 - DNA, 16 bp, H. sapiens
aaacctccaagaaata

SEQ ID NO: 6168 - DNA, 16 bp, H. sapiens
aaacctccacatcctg

SEQ ID NO: 6169 - DNA, 16 bp, H. sapiens
aaacctccacctccag

SEQ ID NO: 6170 - DNA, 16 bp, H. sapiens
aaacctccacctcctg

SEQ ID NO: 6171 - DNA, 16 bp, H. sapiens
aaacctccagaggaac

SEQ ID NO: 6172 - DNA, 16 bp, H. sapiens
aaacctccatctcccg

SEQ ID NO: 6173 - DNA, 16 bp, H. sapiens
aaacctcctaaaatga

SEQ ID NO: 6174 - DNA, 16 bp, H. sapiens
aaacctcctgcagcta

SEQ ID NO: 6175 - DNA, 16 bp, H. sapiens
aaacctcctttccttt

SEQ ID NO: 6176 - DNA, 16 bp, H. sapiens
aaacctcgtctctacc

SEQ ID NO: 6177 - DNA, 18 bp, H. sapiens
aaacctcgtctctgctaa

SEQ ID NO: 6178 - DNA, 16 bp, H. sapiens
aaacctctagccaggc

SEQ ID NO: 6179 - DNA, 16 bp, H. sapiens
aaacctctatggaaaa

SEQ ID NO: 6180 - DNA, 16 bp, H. sapiens
aaacctctctgagctt

SEQ ID NO: 6181 - DNA, 16 bp, H. sapiens
aaacctcttatcttta

SEQ ID NO: 6182 - DNA, 16 bp, H. sapiens
aaacctctttctctgc

SEQ ID NO: 6183 - DNA, 16 bp, H. sapiens
aaacctctttcttcat

SEQ ID NO: 6184 - DNA, 16 bp, H. sapiens
aaacctcttttataaa

SEQ ID NO: 6185 - DNA, 16 bp, H. sapiens
aaacctcttttataag

SEQ ID NO: 6186 - DNA, 16 bp, H. sapiens
aaacctgaaactatga

SEQ ID NO: 6187 - DNA, 16 bp, H. sapiens
aaacctgaacataaag

SEQ ID NO: 6188 - DNA, 16 bp, H. sapiens
aaacctgaagagacca

SEQ ID NO: 6189 - DNA, 16 bp, H. sapiens
aaacctgacaaaagca

SEQ ID NO: 6190 - DNA, 16 bp, H. sapiens
aaacctgaggaaaaca

SEQ ID NO: 6191 - DNA, 18 bp, H. sapiens
aaacctgataaaaacaag

SEQ ID NO: 6192 - DNA, 27 bp, H. sapiens
aaacctgcacgttgtgcacatgtaccc

SEQ ID NO: 6193 - DNA, 16 bp, H. sapiens
aaacctggaaaaaaat

SEQ ID NO: 6194 - DNA, 16 bp, H. sapiens
aaacctggaggcatca

SEQ ID NO: 6195 - DNA, 16 bp, H. sapiens
aaacctggatggagaa

SEQ ID NO: 6196 - DNA, 16 bp, H. sapiens
aaacctggcaaagaca

SEQ ID NO: 6197 - DNA, 16 bp, H. sapiens
aaacctgtacagcatg

SEQ ID NO: 6198 - DNA, 16 bp, H. sapiens
aaacctgtccctggtg

SEQ ID NO: 6199 - DNA, 16 bp, H. sapiens
aaacctgtctctatta

SEQ ID NO: 6200 - DNA, 16 bp, H. sapiens
aaacctgttttatcag

SEQ ID NO: 6201 - DNA, 16 bp, H. sapiens
aaaccttaaaaaccct

SEQ ID NO: 6202 - DNA, 16 bp, H. sapiens
aaaccttacaaatgta

SEQ ID NO: 6203 - DNA, 16 bp, H. sapiens
aaaccttatgaatgta

SEQ ID NO: 6204 - DNA, 17 bp, H. sapiens
aaaccttcttggaaggc

SEQ ID NO: 6205 - DNA, 16 bp, H. sapiens
aaacctttagattttt

SEQ ID NO: 6206 - DNA, 16 bp, H. sapiens
aaacctttagccagat

SEQ ID NO: 6207 - DNA, 16 bp, H. sapiens
aaacctttcttttgat

SEQ ID NO: 6208 - DNA, 16 bp, H. sapiens
aaaccttttaaaaagt

SEQ ID NO: 6209 - DNA, 16 bp, H. sapiens
aaacctttttaaaaag

SEQ ID NO: 6210 - DNA, 16 bp, H. sapiens
aaacctttttttgatt

SEQ ID NO: 6211 - DNA, 18 bp, H. sapiens
aaacgagcaatggggaaa

SEQ ID NO: 6212 - DNA, 18 bp, H. sapiens
aaacgcaccaatcagctc

SEQ ID NO: 6213 - DNA, 16 bp, H. sapiens
aaacggaggctcagag

SEQ ID NO: 6214 - DNA, 17 bp, H. sapiens
aaacggagtctcgctct

SEQ ID NO: 6215 - DNA, 18 bp, H. sapiens
aaacggcgcaccacaaga

SEQ ID NO: 6216 - DNA, 16 bp, H. sapiens
aaacggtatggaggtt

SEQ ID NO: 6217 - DNA, 16 bp, H. sapiens
aaacgtaattcatcac

SEQ ID NO: 6218 - DNA, 16 bp, H. sapiens
aaacgtgcatgtgcaa

SEQ ID NO: 6219 - DNA, 16 bp, H. sapiens
aaactaaaaaatgttt

SEQ ID NO: 6220 - DNA, 16 bp, H. sapiens
aaactaaaaacttttg

SEQ ID NO: 6221 - DNA, 16 bp, H. sapiens
aaactaaaaatacagc

SEQ ID NO: 6222 - DNA, 16 bp, H. sapiens
aaactaaaagtataat

SEQ ID NO: 6223 - DNA, 16 bp, H. sapiens
aaactaaaatgatttt

SEQ ID NO: 6224 - DNA, 16 bp, H. sapiens
aaactaaacttcataa

SEQ ID NO: 6225 - DNA, 16 bp, H. sapiens
aaactaaagagcttca

SEQ ID NO: 6226 - DNA, 16 bp, H. sapiens
aaactaaagagctttt

SEQ ID NO: 6227 - DNA, 16 bp, H. sapiens
aaactaaagcacttct

SEQ ID NO: 6228 - DNA, 16 bp, H. sapiens
aaactaaagcccagag

SEQ ID NO: 6229 - DNA, 16 bp, H. sapiens
aaactaaagggcttct

SEQ ID NO: 6230 - DNA, 16 bp, H. sapiens
aaactaacaaactgaa

SEQ ID NO: 6231 - DNA, 16 bp, H. sapiens
aaactaagactcagag

SEQ ID NO: 6232 - DNA, 16 bp, H. sapiens
aaactaagattttttt

SEQ ID NO: 6233 - DNA, 16 bp, H. sapiens
aaactaagctttataa

SEQ ID NO: 6234 - DNA, 16 bp, H. sapiens
aaactaaggcccagag

SEQ ID NO: 6235 - DNA, 16 bp, H. sapiens
aaactaaggctcagaa

SEQ ID NO: 6236 - DNA, 16 bp, H. sapiens
aaactaaggctcagag

SEQ ID NO: 6237 - DNA, 16 bp, H. sapiens
aaactaaggctcagtg

SEQ ID NO: 6238 - DNA, 16 bp, H. sapiens
aaactaatacaggaat

SEQ ID NO: 6239 - DNA, 16 bp, H. sapiens
aaactaatctgtggtg

SEQ ID NO: 6240 - DNA, 17 bp, H. sapiens
aaactaatgaaaggcca

SEQ ID NO: 6241 - DNA, 16 bp, H. sapiens
aaactaatggaagata

SEQ ID NO: 6242 - DNA, 16 bp, H. sapiens
aaactacaaaaatgag

SEQ ID NO: 6243 - DNA, 16 bp, H. sapiens
aaactacaactcccag

SEQ ID NO: 6244 - DNA, 16 bp, H. sapiens
aaactacaatgtctga

SEQ ID NO: 6245 - DNA, 16 bp, H. sapiens
aaactacacactagac

SEQ ID NO: 6246 - DNA, 16 bp, H. sapiens
aaactacagaatggga

SEQ ID NO: 6247 - DNA, 16 bp, H. sapiens
aaactacagactttgg

SEQ ID NO: 6248 - DNA, 16 bp, H. sapiens
aaactacatttcacct

SEQ ID NO: 6249 - DNA, 16 bp, H. sapiens
aaactacatttcccag

SEQ ID NO: 6250 - DNA, 16 bp, H. sapiens
aaactacatttctcag

SEQ ID NO: 6251 - DNA, 31 bp, H. sapiens
aaactaccatcagagaatactataaacacct

SEQ ID NO: 6252 - DNA, 16 bp, H. sapiens
aaactacctttgaaaa

SEQ ID NO: 6253 - DNA, 16 bp, H. sapiens
aaactactagaagaaa

SEQ ID NO: 6254 - DNA, 16 bp, H. sapiens
aaactactcagaagca

SEQ ID NO: 6255 - DNA, 16 bp, H. sapiens
aaactacttgaaattt

SEQ ID NO: 6256 - DNA, 16 bp, H. sapiens
aaactactttttaaca

SEQ ID NO: 6257 - DNA, 16 bp, H. sapiens
aaactagaaaacactg

SEQ ID NO: 6258 - DNA, 17 bp, H. sapiens
aaactagaaaacctaga

SEQ ID NO: 6259 - DNA, 16 bp, H. sapiens
aaactagaaaagcaag

SEQ ID NO: 6260 - DNA, 16 bp, H. sapiens
aaactagaaaatcaag

SEQ ID NO: 6261 - DNA, 16 bp, H. sapiens
aaactagaaagagaag

SEQ ID NO: 6262 - DNA, 16 bp, H. sapiens
aaactagcctggccaa

SEQ ID NO: 6263 - DNA, 16 bp, H. sapiens
aaactaggcatagaag

SEQ ID NO: 6264 - DNA, 19 bp, H. sapiens
aaactaggtattgatggaa

SEQ ID NO: 6265 - DNA, 16 bp, H. sapiens
aaactagtgtttctgc

SEQ ID NO: 6266 - DNA, 16 bp, H. sapiens
aaactataaaaaccct

SEQ ID NO: 6267 - DNA, 16 bp, H. sapiens
aaactataaaaactct

SEQ ID NO: 6268 - DNA, 16 bp, H. sapiens
aaactataaaattttg

SEQ ID NO: 6269 - DNA, 16 bp, H. sapiens
aaactataaagacagt

SEQ ID NO: 6270 - DNA, 16 bp, H. sapiens
aaactataaatgttat

SEQ ID NO: 6271 - DNA, 16 bp, H. sapiens
aaactatattttaaag

SEQ ID NO: 6272 - DNA, 16 bp, H. sapiens
aaactatcgcaaggac

SEQ ID NO: 6273 - DNA, 16 bp, H. sapiens
aaactatctcaagaac

SEQ ID NO: 6274 - DNA, 16 bp, H. sapiens
aaactatgaaaattct

SEQ ID NO: 6275 - DNA, 16 bp, H. sapiens
aaactatgaggacaca

SEQ ID NO: 6276 - DNA, 16 bp, H. sapiens
aaactattaaactatt

SEQ ID NO: 6277 - DNA, 16 bp, H. sapiens
aaactattacaagaaa

SEQ ID NO: 6278 - DNA, 16 bp, H. sapiens
aaactattagaaatga

SEQ ID NO: 6279 - DNA, 16 bp, H. sapiens
aaactattcaaaatga

SEQ ID NO: 6280 - DNA, 16 bp, H. sapiens
aaactattcatttgac

SEQ ID NO: 6281 - DNA, 16 bp, H. sapiens
aaactattccaataaa

SEQ ID NO: 6282 - DNA, 16 bp, H. sapiens
aaactattcttagctc

SEQ ID NO: 6283 - DNA, 16 bp, H. sapiens
aaactatttgacaaaa

SEQ ID NO: 6284 - DNA, 16 bp, H. sapiens
aaactattttccaaaa

SEQ ID NO: 6285 - DNA, 16 bp, H. sapiens
aaactattttctttct

SEQ ID NO: 6286 - DNA, 16 bp, H. sapiens
aaactattttgtgatg

SEQ ID NO: 6287 - DNA, 16 bp, H. sapiens
aaactatttttcagag

SEQ ID NO: 6288 - DNA, 16 bp, H. sapiens
aaactattttttaaac

SEQ ID NO: 6289 - DNA, 16 bp, H. sapiens
aaactatttttttgtt

SEQ ID NO: 6290 - DNA, 16 bp, H. sapiens
aaactcaaaatggatt

SEQ ID NO: 6291 - DNA, 16 bp, H. sapiens
aaactcaaatgccttt

SEQ ID NO: 6292 - DNA, 16 bp, H. sapiens
aaactcaacagcaaaa

SEQ ID NO: 6293 - DNA, 16 bp, H. sapiens
aaactcaacaggaaaa

SEQ ID NO: 6294 - DNA, 16 bp, H. sapiens
aaactcacagaaacag

SEQ ID NO: 6295 - DNA, 16 bp, H. sapiens
aaactcacagaagcag

SEQ ID NO: 6296 - DNA, 16 bp, H. sapiens
aaactcagaaagccaa

SEQ ID NO: 6297 - DNA, 16 bp, H. sapiens
aaactcagaaatgaca

SEQ ID NO: 6298 - DNA, 16 bp, H. sapiens
aaactcagagaaaaat

SEQ ID NO: 6299 - DNA, 16 bp, H. sapiens
aaactcagagaaattc

SEQ ID NO: 6300 - DNA, 16 bp, H. sapiens
aaactcaggcacagag

SEQ ID NO: 6301 - DNA, 16 bp, H. sapiens
aaactcaggcagtctg

SEQ ID NO: 6302 - DNA, 16 bp, H. sapiens
aaactcagggagaaaa

SEQ ID NO: 6303 - DNA, 16 bp, H. sapiens
aaactcagtcttctga

SEQ ID NO: 6304 - DNA, 16 bp, H. sapiens
aaactcagtttcaaaa

SEQ ID NO: 6305 - DNA, 16 bp, H. sapiens
aaactcatagaagaaa

SEQ ID NO: 6306 - DNA, 16 bp, H. sapiens
aaactcatcaagttgt

SEQ ID NO: 6307 - DNA, 16 bp, H. sapiens
aaactcatcttccctg

SEQ ID NO: 6308 - DNA, 16 bp, H. sapiens
aaactcatgaattgtt

SEQ ID NO: 6309 - DNA, 16 bp, H. sapiens
aaactcattcttcatc

SEQ ID NO: 6310 - DNA, 16 bp, H. sapiens
aaactcatttttgaaa

SEQ ID NO: 6311 - DNA, 16 bp, H. sapiens
aaactccaacacacct

SEQ ID NO: 6312 - DNA, 16 bp, H. sapiens
aaactccactgtacac

SEQ ID NO: 6313 - DNA, 16 bp, H. sapiens
aaactccaggaccaga

SEQ ID NO: 6314 - DNA, 16 bp, H. sapiens
aaactccatctcaaaa

SEQ ID NO: 6315 - DNA, 20 bp, H. sapiens
aaactccatctcaaaaaaac

SEQ ID NO: 6316 - DNA, 18 bp, H. sapiens
aaactccatctcaaaaat

SEQ ID NO: 6317 - DNA, 16 bp, H. sapiens
aaactcccaggctcaa

SEQ ID NO: 6318 - DNA, 16 bp, H. sapiens
aaactcccatctccct

SEQ ID NO: 6319 - DNA, 16 bp, H. sapiens
aaactcccattcacaa

SEQ ID NO: 6320 - DNA, 16 bp, H. sapiens
aaactccctttcatgt

SEQ ID NO: 6321 - DNA, 17 bp, H. sapiens
aaactccgaacacatcc

SEQ ID NO: 6322 - DNA, 16 bp, H. sapiens
aaactccgtctcaaaa

SEQ ID NO: 6323 - DNA, 20 bp, H. sapiens
aaactccgtctcaaaaaaag

SEQ ID NO: 6324 - DNA, 17 bp, H. sapiens
aaactccgtctcaataa

SEQ ID NO: 6325 - DNA, 16 bp, H. sapiens
aaactcctagcctcaa

SEQ ID NO: 6326 - DNA, 16 bp, H. sapiens
aaactcctctaaaaaa

SEQ ID NO: 6327 - DNA, 17 bp, H. sapiens
aaactcctgacctcaga

SEQ ID NO: 6328 - DNA, 16 bp, H. sapiens
aaactcctgcctcagc

SEQ ID NO: 6329 - DNA, 16 bp, H. sapiens
aaactcctggactcat

SEQ ID NO: 6330 - DNA, 16 bp, H. sapiens
aaactcctggactcca

SEQ ID NO: 6331 - DNA, 16 bp, H. sapiens
aaactcctggccgcaa

SEQ ID NO: 6332 - DNA, 16 bp, H. sapiens
aaactcctgggcacaa

SEQ ID NO: 6333 - DNA, 16 bp, H. sapiens
aaactcctgggctcag

SEQ ID NO: 6334 - DNA, 17 bp, H. sapiens
aaactcctgggctcagt

SEQ ID NO: 6335 - DNA, 16 bp, H. sapiens
aaactcctgttaatgt

SEQ ID NO: 6336 - DNA, 16 bp, H. sapiens
aaactccttgagggca

SEQ ID NO: 6337 - DNA, 16 bp, H. sapiens
aaactcctttatatat

SEQ ID NO: 6338 - DNA, 16 bp, H. sapiens
aaactctaaaatgttt

SEQ ID NO: 6339 - DNA, 16 bp, H. sapiens
aaactctaaacagacc

SEQ ID NO: 6340 - DNA, 16 bp, H. sapiens
aaactctacaaataca

SEQ ID NO: 6341 - DNA, 16 bp, H. sapiens
aaactctagacataac

SEQ ID NO: 6342 - DNA, 16 bp, H. sapiens
aaactctcaatgaact

SEQ ID NO: 6343 - DNA, 16 bp, H. sapiens
aaactctcagaaaact

SEQ ID NO: 6344 - DNA, 16 bp, H. sapiens
aaactctcagaaccca

SEQ ID NO: 6345 - DNA, 16 bp, H. sapiens
aaactctcagaagaaa

SEQ ID NO: 6346 - DNA, 16 bp, H. sapiens
aaactctccaatggct

SEQ ID NO: 6347 - DNA, 16 bp, H. sapiens
aaactctcctggacat

SEQ ID NO: 6348 - DNA, 16 bp, H. sapiens
aaactctgaaaaaata

SEQ ID NO: 6349 - DNA, 16 bp, H. sapiens
aaactctgaaaagcag

SEQ ID NO: 6350 - DNA, 16 bp, H. sapiens
aaactctgccatttta

SEQ ID NO: 6351 - DNA, 16 bp, H. sapiens
aaactctggaagaaaa

SEQ ID NO: 6352 - DNA, 16 bp, H. sapiens
aaactctgtccctact

SEQ ID NO: 6353 - DNA, 16 bp, H. sapiens
aaactctgtctcaaaa

SEQ ID NO: 6354 - DNA, 18 bp, H. sapiens
aaactctgtctcaaaaca

SEQ ID NO: 6355 - DNA, 16 bp, H. sapiens
aaactctgtctcaaac

SEQ ID NO: 6356 - DNA, 16 bp, H. sapiens
aaactctgtctcaaca

SEQ ID NO: 6357 - DNA, 16 bp, H. sapiens
aaactctgtctctaat

SEQ ID NO: 6358 - DNA, 18 bp, H. sapiens
aaactctgtgctgggaga

SEQ ID NO: 6359 - DNA, 16 bp, H. sapiens
aaactctgtttaaaaa

SEQ ID NO: 6360 - DNA, 16 bp, H. sapiens
aaactcttaaaagaaa

SEQ ID NO: 6361 - DNA, 16 bp, H. sapiens
aaactcttaaatttaa

SEQ ID NO: 6362 - DNA, 16 bp, H. sapiens
aaactcttagaagata

SEQ ID NO: 6363 - DNA, 16 bp, H. sapiens
aaactcttagagaaaa

SEQ ID NO: 6364 - DNA, 16 bp, H. sapiens
aaactcttcagtttaa

SEQ ID NO: 6365 - DNA, 16 bp, H. sapiens
aaactcttccagcctc

SEQ ID NO: 6366 - DNA, 16 bp, H. sapiens
aaactcttgaagaaaa

SEQ ID NO: 6367 - DNA, 17 bp, H. sapiens
aaactcttgacctcatg

SEQ ID NO: 6368 - DNA, 16 bp, H. sapiens
aaactcttgggcccaa

SEQ ID NO: 6369 - DNA, 16 bp, H. sapiens
aaactcttgggctgaa

SEQ ID NO: 6370 - DNA, 16 bp, H. sapiens
aaactcttgtgctcaa

SEQ ID NO: 6371 - DNA, 16 bp, H. sapiens
aaactctttcttaaaa

SEQ ID NO: 6372 - DNA, 16 bp, H. sapiens
aaactctttgaagaaa

SEQ ID NO: 6373 - DNA, 16 bp, H. sapiens
aaactgaaaaattagc

SEQ ID NO: 6374 - DNA, 16 bp, H. sapiens
aaactgaaaaccaaat

SEQ ID NO: 6375 - DNA, 16 bp, H. sapiens
aaactgaaaaggagaa

SEQ ID NO: 6376 - DNA, 16 bp, H. sapiens
aaactgaaaatagagc

SEQ ID NO: 6377 - DNA, 16 bp, H. sapiens
aaactgaaaatgaaat

SEQ ID NO: 6378 - DNA, 16 bp, H. sapiens
aaactgaaactatacc

SEQ ID NO: 6379 - DNA, 16 bp, H. sapiens
aaactgaaactctgtg

SEQ ID NO: 6380 - DNA, 16 bp, H. sapiens
aaactgaaactgaaaa

SEQ ID NO: 6381 - DNA, 16 bp, H. sapiens
aaactgaaagagagaa

SEQ ID NO: 6382 - DNA, 16 bp, H. sapiens
aaactgaaagctttcc

SEQ ID NO: 6383 - DNA, 16 bp, H. sapiens
aaactgaaaggaaata

SEQ ID NO: 6384 - DNA, 16 bp, H. sapiens
aaactgaaataaaatt

SEQ ID NO: 6385 - DNA, 16 bp, H. sapiens
aaactgaaataattca

SEQ ID NO: 6386 - DNA, 16 bp, H. sapiens
aaactgaaatgaagaa

SEQ ID NO: 6387 - DNA, 16 bp, H. sapiens
aaactgaaattcagag

SEQ ID NO: 6388 - DNA, 16 bp, H. sapiens
aaactgaaattctata

SEQ ID NO: 6389 - DNA, 16 bp, H. sapiens
aaactgaaattttaaa

SEQ ID NO: 6390 - DNA, 16 bp, H. sapiens
aaactgaactcctgat

SEQ ID NO: 6391 - DNA, 16 bp, H. sapiens
aaactgaacttctaga

SEQ ID NO: 6392 - DNA, 16 bp, H. sapiens
aaactgaagaaaagta

SEQ ID NO: 6393 - DNA, 16 bp, H. sapiens
aaactgaagaaaattt

SEQ ID NO: 6394 - DNA, 16 bp, H. sapiens
aaactgaagaaagaat

SEQ ID NO: 6395 - DNA, 16 bp, H. sapiens
aaactgaagaagacac

SEQ ID NO: 6396 - DNA, 16 bp, H. sapiens
aaactgaagaatgcat

SEQ ID NO: 6397 - DNA, 16 bp, H. sapiens
aaactgaagagaaaat

SEQ ID NO: 6398 - DNA, 16 bp, H. sapiens
aaactgaagaggaggg

SEQ ID NO: 6399 - DNA, 16 bp, H. sapiens
aaactgaagcccacag

SEQ ID NO: 6400 - DNA, 16 bp, H. sapiens
aaactgaagctcagag

SEQ ID NO: 6401 - DNA, 16 bp, H. sapiens
aaactgaagctctgag

SEQ ID NO: 6402 - DNA, 16 bp, H. sapiens
aaactgaagctgaaag

SEQ ID NO: 6403 - DNA, 16 bp, H. sapiens
aaactgaaggagaaat

SEQ ID NO: 6404 - DNA, 16 bp, H. sapiens
aaactgaagtacaaag

SEQ ID NO: 6405 - DNA, 16 bp, H. sapiens
aaactgaagtttaaaa

SEQ ID NO: 6406 - DNA, 16 bp, H. sapiens
aaactgaataaaatat

SEQ ID NO: 6407 - DNA, 16 bp, H. sapiens
aaactgaatacagcag

SEQ ID NO: 6408 - DNA, 16 bp, H. sapiens
aaactgaatattcaca

SEQ ID NO: 6409 - DNA, 16 bp, H. sapiens
aaactgaatgcattta

SEQ ID NO: 6410 - DNA, 16 bp, H. sapiens
aaactgaatttttctt

SEQ ID NO: 6411 - DNA, 16 bp, H. sapiens
aaactgacaaacagaa

SEQ ID NO: 6412 - DNA, 16 bp, H. sapiens
aaactgacaaaccttt

SEQ ID NO: 6413 - DNA, 16 bp, H. sapiens
aaactgactaatacat

SEQ ID NO: 6414 - DNA, 16 bp, H. sapiens
aaactgagaaaaatga

SEQ ID NO: 6415 - DNA, 16 bp, H. sapiens
aaactgagacacataa

SEQ ID NO: 6416 - DNA, 16 bp, H. sapiens
aaactgagacagagag

SEQ ID NO: 6417 - DNA, 16 bp, H. sapiens
aaactgagacccagag

SEQ ID NO: 6418 - DNA, 16 bp, H. sapiens
aaactgagacctggag

SEQ ID NO: 6419 - DNA, 16 bp, H. sapiens
aaactgagcagaaggt

SEQ ID NO: 6420 - DNA, 16 bp, H. sapiens
aaactgaggaaagaga

SEQ ID NO: 6421 - DNA, 16 bp, H. sapiens
aaactgaggaagaaag

SEQ ID NO: 6422 - DNA, 16 bp, H. sapiens
aaactgaggaggaggg

SEQ ID NO: 6423 - DNA, 16 bp, H. sapiens
aaactgaggcacacag

SEQ ID NO: 6424 - DNA, 16 bp, H. sapiens
aaactgaggcacaggg

SEQ ID NO: 6425 - DNA, 16 bp, H. sapiens
aaactgaggcaccaag

SEQ ID NO: 6426 - DNA, 16 bp, H. sapiens
aaactgaggcctagaa

SEQ ID NO: 6427 - DNA, 16 bp, H. sapiens
aaactgaggctcaaag

SEQ ID NO: 6428 - DNA, 16 bp, H. sapiens
aaactgaggctcagag

SEQ ID NO: 6429 - DNA, 16 bp, H. sapiens
aaactgaggctcagga

SEQ ID NO: 6430 - DNA, 16 bp, H. sapiens
aaactgaggctcgggg

SEQ ID NO: 6431 - DNA, 16 bp, H. sapiens
aaactgaggctctggg

SEQ ID NO: 6432 - DNA, 16 bp, H. sapiens
aaactgaggcttaaag

SEQ ID NO: 6433 - DNA, 16 bp, H. sapiens
aaactgaggcttagtg

SEQ ID NO: 6434 - DNA, 16 bp, H. sapiens
aaactgaggtacacag

SEQ ID NO: 6435 - DNA, 16 bp, H. sapiens
aaactgaggtctggag

SEQ ID NO: 6436 - DNA, 16 bp, H. sapiens
aaactgaggtgtagag

SEQ ID NO: 6437 - DNA, 16 bp, H. sapiens
aaactgaggttcagag

SEQ ID NO: 6438 - DNA, 16 bp, H. sapiens
aaactgagtccaacac

SEQ ID NO: 6439 - DNA, 16 bp, H. sapiens
aaactgatattttaaa

SEQ ID NO: 6440 - DNA, 16 bp, H. sapiens
aaactgattttaaaaa

SEQ ID NO: 6441 - DNA, 16 bp, H. sapiens
aaactgatttttttca

SEQ ID NO: 6442 - DNA, 16 bp, H. sapiens
aaactgcagaagaaaa

SEQ ID NO: 6443 - DNA, 16 bp, H. sapiens
aaactgcagaatgaaa

SEQ ID NO: 6444 - DNA, 16 bp, H. sapiens
aaactgcatatattta

SEQ ID NO: 6445 - DNA, 16 bp, H. sapiens
aaactgcatctctaca

SEQ ID NO: 6446 - DNA, 16 bp, H. sapiens
aaactgcatgtattta

SEQ ID NO: 6447 - DNA, 16 bp, H. sapiens
aaactgcatgtcatgg

SEQ ID NO: 6448 - DNA, 16 bp, H. sapiens
aaactgcatgttttcc

SEQ ID NO: 6449 - DNA, 16 bp, H. sapiens
aaactgccaacaaaaa

SEQ ID NO: 6450 - DNA, 16 bp, H. sapiens
aaactgcctttccctg

SEQ ID NO: 6451 - DNA, 16 bp, H. sapiens
aaactgctaaatcaaa

SEQ ID NO: 6452 - DNA, 16 bp, H. sapiens
aaactgctctatgaaa

SEQ ID NO: 6453 - DNA, 16 bp, H. sapiens
aaactgctctgtgaaa

SEQ ID NO: 6454 - DNA, 16 bp, H. sapiens
aaactgctctgtgatg

SEQ ID NO: 6455 - DNA, 16 bp, H. sapiens
aaactgctgaaagaaa

SEQ ID NO: 6456 - DNA, 16 bp, H. sapiens
aaactgctgaaggaaa

SEQ ID NO: 6457 - DNA, 16 bp, H. sapiens
aaactgctgaataaaa

SEQ ID NO: 6458 - DNA, 16 bp, H. sapiens
aaactgctgaatgtaa

SEQ ID NO: 6459 - DNA, 16 bp, H. sapiens
aaactgctggtgcctt

SEQ ID NO: 6460 - DNA, 16 bp, H. sapiens
aaactgctttgggatg

SEQ ID NO: 6461 - DNA, 16 bp, H. sapiens
aaactgctttgtaatg

SEQ ID NO: 6462 - DNA, 16 bp, H. sapiens
aaactgctttgtgaag

SEQ ID NO: 6463 - DNA, 16 bp, H. sapiens
aaactgcttttgctgc

SEQ ID NO: 6464 - DNA, 16 bp, H. sapiens
aaactggaaaagacaa

SEQ ID NO: 6465 - DNA, 16 bp, H. sapiens
aaactggaaaagagga

SEQ ID NO: 6466 - DNA, 16 bp, H. sapiens
aaactggaaaatataa

SEQ ID NO: 6467 - DNA, 16 bp, H. sapiens
aaactggaaagaagaa

SEQ ID NO: 6468 - DNA, 16 bp, H. sapiens
aaactggaaaggaaga

SEQ ID NO: 6469 - DNA, 16 bp, H. sapiens
aaactggaaatgtaaa

SEQ ID NO: 6470 - DNA, 16 bp, H. sapiens
aaactggaagagtcta

SEQ ID NO: 6471 - DNA, 16 bp, H. sapiens
aaactggacttcatta

SEQ ID NO: 6472 - DNA, 16 bp, H. sapiens
aaactggagaaatcac

SEQ ID NO: 6473 - DNA, 16 bp, H. sapiens
aaactggagaaccagg

SEQ ID NO: 6474 - DNA, 16 bp, H. sapiens
aaactggaggcatcac

SEQ ID NO: 6475 - DNA, 16 bp, H. sapiens
aaactggaggctttag

SEQ ID NO: 6476 - DNA, 16 bp, H. sapiens
aaactggatggaaaat

SEQ ID NO: 6477 - DNA, 16 bp, H. sapiens
aaactggattttaaaa

SEQ ID NO: 6478 - DNA, 32 bp, H. sapiens
aaactggctagccatatgtagaaagctgaaaa

SEQ ID NO: 6479 - DNA, 16 bp, H. sapiens
aaactgggaaaataaa

SEQ ID NO: 6480 - DNA, 16 bp, H. sapiens
aaactgggaggtggaa

SEQ ID NO: 6481 - DNA, 16 bp, H. sapiens
aaactggggcacagag

SEQ ID NO: 6482 - DNA, 16 bp, H. sapiens
aaactgggggaaaaaa

SEQ ID NO: 6483 - DNA, 16 bp, H. sapiens
aaactgggtaatttat

SEQ ID NO: 6484 - DNA, 16 bp, H. sapiens
aaactgggtgaagggt

SEQ ID NO: 6485 - DNA, 16 bp, H. sapiens
aaactgggtgacagag

SEQ ID NO: 6486 - DNA, 16 bp, H. sapiens
aaactggtggcttaaa

SEQ ID NO: 6487 - DNA, 16 bp, H. sapiens
aaactggttaaataaa

SEQ ID NO: 6488 - DNA, 16 bp, H. sapiens
aaactggttgaatgaa

SEQ ID NO: 6489 - DNA, 16 bp, H. sapiens
aaactgtaaaaatcct

SEQ ID NO: 6490 - DNA, 16 bp, H. sapiens
aaactgtaaaatatat

SEQ ID NO: 6491 - DNA, 16 bp, H. sapiens
aaactgtaaaatatta

SEQ ID NO: 6492 - DNA, 16 bp, H. sapiens
aaactgtaaaatattt

SEQ ID NO: 6493 - DNA, 16 bp, H. sapiens
aaactgtagaaaataa

SEQ ID NO: 6494 - DNA, 16 bp, H. sapiens
aaactgtagaagaaaa

SEQ ID NO: 6495 - DNA, 16 bp, H. sapiens
aaactgtagattgctt

SEQ ID NO: 6496 - DNA, 16 bp, H. sapiens
aaactgtataaataca

SEQ ID NO: 6497 - DNA, 16 bp, H. sapiens
aaactgtatcaactaa

SEQ ID NO: 6498 - DNA, 16 bp, H. sapiens
aaactgtatcaattaa

SEQ ID NO: 6499 - DNA, 16 bp, H. sapiens
aaactgtattcaaata

SEQ ID NO: 6500 - DNA, 16 bp, H. sapiens
aaactgtattttaaaa

SEQ ID NO: 6501 - DNA, 16 bp, H. sapiens
aaactgtatttttttt

SEQ ID NO: 6502 - DNA, 16 bp, H. sapiens
aaactgtcacagtcaa

SEQ ID NO: 6503 - DNA, 16 bp, H. sapiens
aaactgtctttttttt

SEQ ID NO: 6504 - DNA, 16 bp, H. sapiens
aaactgtgaaaagaaa

SEQ ID NO: 6505 - DNA, 16 bp, H. sapiens
aaactgtgatttttct

SEQ ID NO: 6506 - DNA, 16 bp, H. sapiens
aaactgtgctcaactc

SEQ ID NO: 6507 - DNA, 16 bp, H. sapiens
aaactgtggctcagag

SEQ ID NO: 6508 - DNA, 16 bp, H. sapiens
aaactgtggtatacat

SEQ ID NO: 6509 - DNA, 16 bp, H. sapiens
aaactgtggtatattc

SEQ ID NO: 6510 - DNA, 16 bp, H. sapiens
aaactgtgtttcactt

SEQ ID NO: 6511 - DNA, 16 bp, H. sapiens
aaactgtgtttccaaa

SEQ ID NO: 6512 - DNA, 16 bp, H. sapiens
aaactgttaaagaaaa

SEQ ID NO: 6513 - DNA, 16 bp, H. sapiens
aaactgttattatttt

SEQ ID NO: 6514 - DNA, 17 bp, H. sapiens
aaactgttccaacctct

SEQ ID NO: 6515 - DNA, 16 bp, H. sapiens
aaactgttcctatttg

SEQ ID NO: 6516 - DNA, 16 bp, H. sapiens
aaactgttggtgggac

SEQ ID NO: 6517 - DNA, 16 bp, H. sapiens
aaactgtttaaataaa

SEQ ID NO: 6518 - DNA, 16 bp, H. sapiens
aaactgtttccaagta

SEQ ID NO: 6519 - DNA, 16 bp, H. sapiens
aaactgtttcttcagt

SEQ ID NO: 6520 - DNA, 16 bp, H. sapiens
aaactgttttattttt

SEQ ID NO: 6521 - DNA, 16 bp, H. sapiens
aaactgttttcaaaaa

SEQ ID NO: 6522 - DNA, 16 bp, H. sapiens
aaactgttttcatttt

SEQ ID NO: 6523 - DNA, 16 bp, H. sapiens
aaactgttttcttttt

SEQ ID NO: 6524 - DNA, 16 bp, H. sapiens
aaactgttttgttttg

SEQ ID NO: 6525 - DNA, 16 bp, H. sapiens
aaactgtttttcaaaa

SEQ ID NO: 6526 - DNA, 16 bp, H. sapiens
aaactgtttttgtttg

SEQ ID NO: 6527 - DNA, 16 bp, H. sapiens
aaactgttttttcttt

SEQ ID NO: 6528 - DNA, 16 bp, H. sapiens
aaactgtttttttaaa

SEQ ID NO: 6529 - DNA, 16 bp, H. sapiens
aaacttaaaactttgt

SEQ ID NO: 6530 - DNA, 16 bp, H. sapiens
aaacttaaaaggtttt

SEQ ID NO: 6531 - DNA, 16 bp, H. sapiens
aaacttaaaagttttt

SEQ ID NO: 6532 - DNA, 16 bp, H. sapiens
aaacttaaaataagta

SEQ ID NO: 6533 - DNA, 16 bp, H. sapiens
aaacttaaatgtccct

SEQ ID NO: 6534 - DNA, 16 bp, H. sapiens
aaacttaactcaaaat

SEQ ID NO: 6535 - DNA, 16 bp, H. sapiens
aaacttaagaataatc

SEQ ID NO: 6536 - DNA, 16 bp, H. sapiens
aaacttaagaggaaaa

SEQ ID NO: 6537 - DNA, 16 bp, H. sapiens
aaacttaattgataaa

SEQ ID NO: 6538 - DNA, 16 bp, H. sapiens
aaacttacatttgtct

SEQ ID NO: 6539 - DNA, 16 bp, H. sapiens
aaacttaccaaattgt

SEQ ID NO: 6540 - DNA, 16 bp, H. sapiens
aaacttacttttaaaa

SEQ ID NO: 6541 - DNA, 16 bp, H. sapiens
aaacttagctgagtgt

SEQ ID NO: 6542 - DNA, 16 bp, H. sapiens
aaacttaggccaggca

SEQ ID NO: 6543 - DNA, 16 bp, H. sapiens
aaacttagtggctaaa

SEQ ID NO: 6544 - DNA, 16 bp, H. sapiens
aaacttagtggcttaa

SEQ ID NO: 6545 - DNA, 16 bp, H. sapiens
aaacttagttgataaa

SEQ ID NO: 6546 - DNA, 16 bp, H. sapiens
aaacttatttctaaat

SEQ ID NO: 6547 - DNA, 16 bp, H. sapiens
aaacttatttctaagt

SEQ ID NO: 6548 - DNA, 16 bp, H. sapiens
aaacttatttctcatt

SEQ ID NO: 6549 - DNA, 16 bp, H. sapiens
aaacttcaaccaatca

SEQ ID NO: 6550 - DNA, 16 bp, H. sapiens
aaacttcagaagaaaa

SEQ ID NO: 6551 - DNA, 16 bp, H. sapiens
aaacttcatactgttt

SEQ ID NO: 6552 - DNA, 16 bp, H. sapiens
aaacttcatcccagag

SEQ ID NO: 6553 - DNA, 16 bp, H. sapiens
aaacttcatctcaaaa

SEQ ID NO: 6554 - DNA, 16 bp, H. sapiens
aaacttcatgccaata

SEQ ID NO: 6555 - DNA, 16 bp, H. sapiens
aaacttcattgctgtc

SEQ ID NO: 6556 - DNA, 16 bp, H. sapiens
aaacttccaggctcaa

SEQ ID NO: 6557 - DNA, 16 bp, H. sapiens
aaacttcccaaattta

SEQ ID NO: 6558 - DNA, 16 bp, H. sapiens
aaacttccccaggtct

SEQ ID NO: 6559 - DNA, 16 bp, H. sapiens
aaacttcctcagtaaa

SEQ ID NO: 6560 - DNA, 16 bp, H. sapiens
aaacttcctgaggcct

SEQ ID NO: 6561 - DNA, 16 bp, H. sapiens
aaacttctaaaaacta

SEQ ID NO: 6562 - DNA, 16 bp, H. sapiens
aaacttctagaaataa

SEQ ID NO: 6563 - DNA, 16 bp, H. sapiens
aaacttctcaatgaaa

SEQ ID NO: 6564 - DNA, 21 bp, H. sapiens
aaacttctccgagctaaagga

SEQ ID NO: 6565 - DNA, 16 bp, H. sapiens
aaacttctgaatgaaa

SEQ ID NO: 6566 - DNA, 16 bp, H. sapiens
aaacttctgctctgtg

SEQ ID NO: 6567 - DNA, 16 bp, H. sapiens
aaacttctgctcttca

SEQ ID NO: 6568 - DNA, 16 bp, H. sapiens
aaacttctgggataca

SEQ ID NO: 6569 - DNA, 16 bp, H. sapiens
aaacttcttagagatt

SEQ ID NO: 6570 - DNA, 16 bp, H. sapiens
aaacttcttctcaaaa

SEQ ID NO: 6571 - DNA, 16 bp, H. sapiens
aaacttctttctcttt

SEQ ID NO: 6572 - DNA, 16 bp, H. sapiens
aaacttcttttcaaaa

SEQ ID NO: 6573 - DNA, 16 bp, H. sapiens
aaacttgaaaaatatt

SEQ ID NO: 6574 - DNA, 16 bp, H. sapiens
aaacttgaaaagaaat

SEQ ID NO: 6575 - DNA, 16 bp, H. sapiens
aaacttgaaaatgaaa

SEQ ID NO: 6576 - DNA, 16 bp, H. sapiens
aaacttgaaagcattc

SEQ ID NO: 6577 - DNA, 16 bp, H. sapiens
aaacttgaagaaaata

SEQ ID NO: 6578 - DNA, 16 bp, H. sapiens
aaacttgaaggaaaaa

SEQ ID NO: 6579 - DNA, 16 bp, H. sapiens
aaacttgaatgtaaat

SEQ ID NO: 6580 - DNA, 16 bp, H. sapiens
aaacttgagaaaatat

SEQ ID NO: 6581 - DNA, 16 bp, H. sapiens
aaacttgaggatatta

SEQ ID NO: 6582 - DNA, 16 bp, H. sapiens
aaacttgattttattt

SEQ ID NO: 6583 - DNA, 16 bp, H. sapiens
aaacttgcctctgtct

SEQ ID NO: 6584 - DNA, 16 bp, H. sapiens
aaacttggaaaataaa

SEQ ID NO: 6585 - DNA, 16 bp, H. sapiens
aaacttggaaataaaa

SEQ ID NO: 6586 - DNA, 16 bp, H. sapiens
aaacttggcagagaca

SEQ ID NO: 6587 - DNA, 16 bp, H. sapiens
aaacttgggaagtttt

SEQ ID NO: 6588 - DNA, 16 bp, H. sapiens
aaacttgtacacaaat

SEQ ID NO: 6589 - DNA, 16 bp, H. sapiens
aaacttgtagaagaaa

SEQ ID NO: 6590 - DNA, 16 bp, H. sapiens
aaacttgtatatattt

SEQ ID NO: 6591 - DNA, 16 bp, H. sapiens
aaacttgtttaatcct

SEQ ID NO: 6592 - DNA, 16 bp, H. sapiens
aaacttgttttataaa

SEQ ID NO: 6593 - DNA, 16 bp, H. sapiens
aaacttgtttttattt

SEQ ID NO: 6594 - DNA, 16 bp, H. sapiens
aaacttgtttttttaa

SEQ ID NO: 6595 - DNA, 16 bp, H. sapiens
aaactttaaaaaaatg

SEQ ID NO: 6596 - DNA, 16 bp, H. sapiens
aaactttaaaagttaa

SEQ ID NO: 6597 - DNA, 16 bp, H. sapiens
aaactttaaaatcagt

SEQ ID NO: 6598 - DNA, 16 bp, H. sapiens
aaactttaaataaatg

SEQ ID NO: 6599 - DNA, 16 bp, H. sapiens
aaactttaacatttta

SEQ ID NO: 6600 - DNA, 16 bp, H. sapiens
aaactttacactttaa

SEQ ID NO: 6601 - DNA, 16 bp, H. sapiens
aaactttaccttttga

SEQ ID NO: 6602 - DNA, 16 bp, H. sapiens
aaactttactgaattt

SEQ ID NO: 6603 - DNA, 16 bp, H. sapiens
aaactttacttataaa

SEQ ID NO: 6604 - DNA, 16 bp, H. sapiens
aaactttagaatcagc

SEQ ID NO: 6605 - DNA, 16 bp, H. sapiens
aaactttattcacaaa

SEQ ID NO: 6606 - DNA, 16 bp, H. sapiens
aaactttatttctaaa

SEQ ID NO: 6607 - DNA, 16 bp, H. sapiens
aaactttatttgtaaa

SEQ ID NO: 6608 - DNA, 16 bp, H. sapiens
aaactttattttcaaa

SEQ ID NO: 6609 - DNA, 16 bp, H. sapiens
aaactttcaatatttt

SEQ ID NO: 6610 - DNA, 16 bp, H. sapiens
aaactttcacacattt

SEQ ID NO: 6611 - DNA, 16 bp, H. sapiens
aaactttcatcttaga

SEQ ID NO: 6612 - DNA, 16 bp, H. sapiens
aaactttcatgctctg

SEQ ID NO: 6613 - DNA, 16 bp, H. sapiens
aaactttccaaaatca

SEQ ID NO: 6614 - DNA, 16 bp, H. sapiens
aaactttccaaacttt

SEQ ID NO: 6615 - DNA, 16 bp, H. sapiens
aaactttccattttat

SEQ ID NO: 6616 - DNA, 16 bp, H. sapiens
aaactttccctgttca

SEQ ID NO: 6617 - DNA, 16 bp, H. sapiens
aaactttctcaaaaca

SEQ ID NO: 6618 - DNA, 16 bp, H. sapiens
aaactttctgaattaa

SEQ ID NO: 6619 - DNA, 16 bp, H. sapiens
aaactttcttttaaaa

SEQ ID NO: 6620 - DNA, 16 bp, H. sapiens
aaactttcttttcatt

SEQ ID NO: 6621 - DNA, 16 bp, H. sapiens
aaactttgaaaacatt

SEQ ID NO: 6622 - DNA, 16 bp, H. sapiens
aaactttgaaatatat

SEQ ID NO: 6623 - DNA, 16 bp, H. sapiens
aaactttgaacttgaa

SEQ ID NO: 6624 - DNA, 16 bp, H. sapiens
aaactttgaggacatt

SEQ ID NO: 6625 - DNA, 16 bp, H. sapiens
aaactttgcctcccgg

SEQ ID NO: 6626 - DNA, 16 bp, H. sapiens
aaactttgtaaatatt

SEQ ID NO: 6627 - DNA, 16 bp, H. sapiens
aaactttgtaatttta

SEQ ID NO: 6628 - DNA, 16 bp, H. sapiens
aaactttgtacacttt

SEQ ID NO: 6629 - DNA, 19 bp, H. sapiens
aaactttgtctcaaaaaaa

SEQ ID NO: 6630 - DNA, 16 bp, H. sapiens
aaactttgtgtgtgtg

SEQ ID NO: 6631 - DNA, 16 bp, H. sapiens
aaacttttaaaagata

SEQ ID NO: 6632 - DNA, 16 bp, H. sapiens
aaacttttaaaataag

SEQ ID NO: 6633 - DNA, 16 bp, H. sapiens
aaacttttaaaatgta

SEQ ID NO: 6634 - DNA, 16 bp, H. sapiens
aaacttttaaatgtaa

SEQ ID NO: 6635 - DNA, 16 bp, H. sapiens
aaacttttaaatttct

SEQ ID NO: 6636 - DNA, 16 bp, H. sapiens
aaacttttatgctttg

SEQ ID NO: 6637 - DNA, 16 bp, H. sapiens
aaacttttatggtctg

SEQ ID NO: 6638 - DNA, 16 bp, H. sapiens
aaacttttattttgaa

SEQ ID NO: 6639 - DNA, 16 bp, H. sapiens
aaacttttcaaaagaa

SEQ ID NO: 6640 - DNA, 16 bp, H. sapiens
aaacttttcaaaattt

SEQ ID NO: 6641 - DNA, 16 bp, H. sapiens
aaacttttcattttgt

SEQ ID NO: 6642 - DNA, 16 bp, H. sapiens
aaacttttccaaaaaa

SEQ ID NO: 6643 - DNA, 16 bp, H. sapiens
aaacttttcctgtaaa

SEQ ID NO: 6644 - DNA, 16 bp, H. sapiens
aaacttttcctttgca

SEQ ID NO: 6645 - DNA, 16 bp, H. sapiens
aaacttttctagacat

SEQ ID NO: 6646 - DNA, 16 bp, H. sapiens
aaacttttctataaaa

SEQ ID NO: 6647 - DNA, 16 bp, H. sapiens
aaacttttcttaaaaa

SEQ ID NO: 6648 - DNA, 16 bp, H. sapiens
aaacttttctttaaaa

SEQ ID NO: 6649 - DNA, 16 bp, H. sapiens
aaacttttcttttgat

SEQ ID NO: 6650 - DNA, 16 bp, H. sapiens
aaacttttgaaaacta

SEQ ID NO: 6651 - DNA, 16 bp, H. sapiens
aaacttttgaatattt

SEQ ID NO: 6652 - DNA, 16 bp, H. sapiens
aaacttttgctttttt

SEQ ID NO: 6653 - DNA, 16 bp, H. sapiens
aaacttttggactcaa

SEQ ID NO: 6654 - DNA, 16 bp, H. sapiens
aaactttttaaaaagt

SEQ ID NO: 6655 - DNA, 16 bp, H. sapiens
aaactttttaaaactt

SEQ ID NO: 6656 - DNA, 16 bp, H. sapiens
aaactttttaaagatt

SEQ ID NO: 6657 - DNA, 16 bp, H. sapiens
aaactttttagttttt

SEQ ID NO: 6658 - DNA, 16 bp, H. sapiens
aaactttttatctgag

SEQ ID NO: 6659 - DNA, 16 bp, H. sapiens
aaactttttattttgg

SEQ ID NO: 6660 - DNA, 16 bp, H. sapiens
aaactttttccataaa

SEQ ID NO: 6661 - DNA, 16 bp, H. sapiens
aaactttttctaaaaa

SEQ ID NO: 6662 - DNA, 16 bp, H. sapiens
aaactttttctataaa

SEQ ID NO: 6663 - DNA, 16 bp, H. sapiens
aaactttttctatgaa

SEQ ID NO: 6664 - DNA, 16 bp, H. sapiens
aaactttttctgtaaa

SEQ ID NO: 6665 - DNA, 16 bp, H. sapiens
aaactttttcttcctt

SEQ ID NO: 6666 - DNA, 16 bp, H. sapiens
aaactttttgttgttt

SEQ ID NO: 6667 - DNA, 16 bp, H. sapiens
aaactttttgttttga

SEQ ID NO: 6668 - DNA, 16 bp, H. sapiens
aaacttttttaaagca

SEQ ID NO: 6669 - DNA, 16 bp, H. sapiens
aaacttttttgttaaa

SEQ ID NO: 6670 - DNA, 16 bp, H. sapiens
aaacttttttgttatt

SEQ ID NO: 6671 - DNA, 16 bp, H. sapiens
aaactttttttagaat

SEQ ID NO: 6672 - DNA, 16 bp, H. sapiens
aaactttttttctgta

SEQ ID NO: 6673 - DNA, 16 bp, H. sapiens
aaacttttttttgaga

SEQ ID NO: 6674 - DNA, 16 bp, H. sapiens
aaactttttttttggt

SEQ ID NO: 6675 - DNA, 16 bp, H. sapiens
aaagaaaaaaaccctg

SEQ ID NO: 6676 - DNA, 16 bp, H. sapiens
aaagaaaaaaaccttg

SEQ ID NO: 6677 - DNA, 16 bp, H. sapiens
aaagaaaaaaaggctc

SEQ ID NO: 6678 - DNA, 16 bp, H. sapiens
aaagaaaaaacagttt

SEQ ID NO: 6679 - DNA, 16 bp, H. sapiens
aaagaaaaaacatttt

SEQ ID NO: 6680 - DNA, 16 bp, H. sapiens
aaagaaaaaagtcttg

SEQ ID NO: 6681 - DNA, 16 bp, H. sapiens
aaagaaaaaagtgact

SEQ ID NO: 6682 - DNA, 16 bp, H. sapiens
aaagaaaaaatattcc

SEQ ID NO: 6683 - DNA, 16 bp, H. sapiens
aaagaaaaaatatttc

SEQ ID NO: 6684 - DNA, 16 bp, H. sapiens
aaagaaaaaatgcttt

SEQ ID NO: 6685 - DNA, 16 bp, H. sapiens
aaagaaaaaattagct

SEQ ID NO: 6686 - DNA, 16 bp, H. sapiens
aaagaaaaaattctga

SEQ ID NO: 6687 - DNA, 16 bp, H. sapiens
aaagaaaaacatttta

SEQ ID NO: 6688 - DNA, 16 bp, H. sapiens
aaagaaaaaccaattt

SEQ ID NO: 6689 - DNA, 16 bp, H. sapiens
aaagaaaaacctgaga

SEQ ID NO: 6690 - DNA, 16 bp, H. sapiens
aaagaaaaactcagga

SEQ ID NO: 6691 - DNA, 16 bp, H. sapiens
aaagaaaaacttatgt

SEQ ID NO: 6692 - DNA, 16 bp, H. sapiens
aaagaaaaacttattt

SEQ ID NO: 6693 - DNA, 16 bp, H. sapiens
aaagaaaaacttcaca

SEQ ID NO: 6694 - DNA, 16 bp, H. sapiens
aaagaaaaacttcaga

SEQ ID NO: 6695 - DNA, 16 bp, H. sapiens
aaagaaaaactttaca

SEQ ID NO: 6696 - DNA, 16 bp, H. sapiens
aaagaaaaagaatctt

SEQ ID NO: 6697 - DNA, 16 bp, H. sapiens
aaagaaaaagaatgct

SEQ ID NO: 6698 - DNA, 16 bp, H. sapiens
aaagaaaaagactttt

SEQ ID NO: 6699 - DNA, 16 bp, H. sapiens
aaagaaaaagatattc

SEQ ID NO: 6700 - DNA, 16 bp, H. sapiens
aaagaaaaagattcca

SEQ ID NO: 6701 - DNA, 16 bp, H. sapiens
aaagaaaaagattttc

SEQ ID NO: 6702 - DNA, 16 bp, H. sapiens
aaagaaaaagcatttg

SEQ ID NO: 6703 - DNA, 16 bp, H. sapiens
aaagaaaaagccattt

SEQ ID NO: 6704 - DNA, 16 bp, H. sapiens
aaagaaaaagcccagg

SEQ ID NO: 6705 - DNA, 16 bp, H. sapiens
aaagaaaaagctttct

SEQ ID NO: 6706 - DNA, 16 bp, H. sapiens
aaagaaaaagggttta

SEQ ID NO: 6707 - DNA, 16 bp, H. sapiens
aaagaaaaagtgattt

SEQ ID NO: 6708 - DNA, 16 bp, H. sapiens
aaagaaaaagtggttt

SEQ ID NO: 6709 - DNA, 16 bp, H. sapiens
aaagaaaaagtgtttc

SEQ ID NO: 6710 - DNA, 16 bp, H. sapiens
aaagaaaaatacaggt

SEQ ID NO: 6711 - DNA, 16 bp, H. sapiens
aaagaaaaatactctt

SEQ ID NO: 6712 - DNA, 16 bp, H. sapiens
aaagaaaaatatcttg

SEQ ID NO: 6713 - DNA, 16 bp, H. sapiens
aaagaaaaatcatttg

SEQ ID NO: 6714 - DNA, 16 bp, H. sapiens
aaagaaaaatctattt

SEQ ID NO: 6715 - DNA, 16 bp, H. sapiens
aaagaaaaatctgtat

SEQ ID NO: 6716 - DNA, 16 bp, H. sapiens
aaagaaaaatcttttt

SEQ ID NO: 6717 - DNA, 16 bp, H. sapiens
aaagaaaaatgccatt

SEQ ID NO: 6718 - DNA, 16 bp, H. sapiens
aaagaaaaattactga

SEQ ID NO: 6719 - DNA, 16 bp, H. sapiens
aaagaaaaattattca

SEQ ID NO: 6720 - DNA, 16 bp, H. sapiens
aaagaaaaattcacat

SEQ ID NO: 6721 - DNA, 16 bp, H. sapiens
aaagaaaaattcttca

SEQ ID NO: 6722 - DNA, 16 bp, H. sapiens
aaagaaaaattctttt

SEQ ID NO: 6723 - DNA, 16 bp, H. sapiens
aaagaaaaattgtatg

SEQ ID NO: 6724 - DNA, 16 bp, H. sapiens
aaagaaaaatttccaa

SEQ ID NO: 6725 - DNA, 16 bp, H. sapiens
aaagaaaaatttcttt

SEQ ID NO: 6726 - DNA, 16 bp, H. sapiens
aaagaaaacaaagttt

SEQ ID NO: 6727 - DNA, 16 bp, H. sapiens
aaagaaaacaaatttt

SEQ ID NO: 6728 - DNA, 16 bp, H. sapiens
aaagaaaacaactgtc

SEQ ID NO: 6729 - DNA, 16 bp, H. sapiens
aaagaaaacaactttt

SEQ ID NO: 6730 - DNA, 16 bp, H. sapiens
aaagaaaacaattatc

SEQ ID NO: 6731 - DNA, 16 bp, H. sapiens
aaagaaaacaatttct

SEQ ID NO: 6732 - DNA, 16 bp, H. sapiens
aaagaaaacaattttc

SEQ ID NO: 6733 - DNA, 16 bp, H. sapiens
aaagaaaacacaattg

SEQ ID NO: 6734 - DNA, 16 bp, H. sapiens
aaagaaaacacatgta

SEQ ID NO: 6735 - DNA, 16 bp, H. sapiens
aaagaaaacaccaggc

SEQ ID NO: 6736 - DNA, 16 bp, H. sapiens
aaagaaaacactgaat

SEQ ID NO: 6737 - DNA, 16 bp, H. sapiens
aaagaaaacaggattt

SEQ ID NO: 6738 - DNA, 16 bp, H. sapiens
aaagaaaacatatttt

SEQ ID NO: 6739 - DNA, 16 bp, H. sapiens
aaagaaaacatgatat

SEQ ID NO: 6740 - DNA, 16 bp, H. sapiens
aaagaaaacatggtac

SEQ ID NO: 6741 - DNA, 16 bp, H. sapiens
aaagaaaacatggtat

SEQ ID NO: 6742 - DNA, 16 bp, H. sapiens
aaagaaaacatgtttt

SEQ ID NO: 6743 - DNA, 16 bp, H. sapiens
aaagaaaacattattt

SEQ ID NO: 6744 - DNA, 16 bp, H. sapiens
aaagaaaacattctta

SEQ ID NO: 6745 - DNA, 16 bp, H. sapiens
aaagaaaacattggaa

SEQ ID NO: 6746 - DNA, 16 bp, H. sapiens
aaagaaaacattgttt

SEQ ID NO: 6747 - DNA, 16 bp, H. sapiens
aaagaaaacatttaca

SEQ ID NO: 6748 - DNA, 16 bp, H. sapiens
aaagaaaacatttcaa

SEQ ID NO: 6749 - DNA, 16 bp, H. sapiens
aaagaaaacatttctg

SEQ ID NO: 6750 - DNA, 16 bp, H. sapiens
aaagaaaacatttgct

SEQ ID NO: 6751 - DNA, 16 bp, H. sapiens
aaagaaaacatttgga

SEQ ID NO: 6752 - DNA, 16 bp, H. sapiens
aaagaaaacatttgtt

SEQ ID NO: 6753 - DNA, 16 bp, H. sapiens
aaagaaaacattttgt

SEQ ID NO: 6754 - DNA, 16 bp, H. sapiens
aaagaaaacattttta

SEQ ID NO: 6755 - DNA, 16 bp, H. sapiens
aaagaaaaccacattt

SEQ ID NO: 6756 - DNA, 16 bp, H. sapiens
aaagaaaacctcaggc

SEQ ID NO: 6757 - DNA, 16 bp, H. sapiens
aaagaaaaccttgaaa

SEQ ID NO: 6758 - DNA, 16 bp, H. sapiens
aaagaaaactaaatgt

SEQ ID NO: 6759 - DNA, 16 bp, H. sapiens
aaagaaaactaattta

SEQ ID NO: 6760 - DNA, 16 bp, H. sapiens
aaagaaaactacaggc

SEQ ID NO: 6761 - DNA, 16 bp, H. sapiens
aaagaaaactccattt

SEQ ID NO: 6762 - DNA, 16 bp, H. sapiens
aaagaaaactgaagac

SEQ ID NO: 6763 - DNA, 16 bp, H. sapiens
aaagaaaactgaggaa

SEQ ID NO: 6764 - DNA, 16 bp, H. sapiens
aaagaaaactgcagat

SEQ ID NO: 6765 - DNA, 16 bp, H. sapiens
aaagaaaactgcaggt

SEQ ID NO: 6766 - DNA, 16 bp, H. sapiens
aaagaaaactgcattt

SEQ ID NO: 6767 - DNA, 16 bp, H. sapiens
aaagaaaactgggaaa

SEQ ID NO: 6768 - DNA, 16 bp, H. sapiens
aaagaaaactgtcttt

SEQ ID NO: 6769 - DNA, 16 bp, H. sapiens
aaagaaaacttccaaa

SEQ ID NO: 6770 - DNA, 16 bp, H. sapiens
aaagaaaacttgaaag

SEQ ID NO: 6771 - DNA, 16 bp, H. sapiens
aaagaaaacttttttt

SEQ ID NO: 6772 - DNA, 16 bp, H. sapiens
aaagaaaagaaagtgc

SEQ ID NO: 6773 - DNA, 16 bp, H. sapiens
aaagaaaagaaatctc

SEQ ID NO: 6774 - DNA, 16 bp, H. sapiens
aaagaaaagaaattcc

SEQ ID NO: 6775 - DNA, 16 bp, H. sapiens
aaagaaaagaaatttc

SEQ ID NO: 6776 - DNA, 16 bp, H. sapiens
aaagaaaagaagctta

SEQ ID NO: 6777 - DNA, 16 bp, H. sapiens
aaagaaaagaatgcta

SEQ ID NO: 6778 - DNA, 16 bp, H. sapiens
aaagaaaagaattcca

SEQ ID NO: 6779 - DNA, 16 bp, H. sapiens
aaagaaaagaatttct

SEQ ID NO: 6780 - DNA, 16 bp, H. sapiens
aaagaaaagacatcca

SEQ ID NO: 6781 - DNA, 16 bp, H. sapiens
aaagaaaagacattta

SEQ ID NO: 6782 - DNA, 16 bp, H. sapiens
aaagaaaagactgata

SEQ ID NO: 6783 - DNA, 16 bp, H. sapiens
aaagaaaagaggcttt

SEQ ID NO: 6784 - DNA, 17 bp, H. sapiens
aaagaaaagaggtttat

SEQ ID NO: 6785 - DNA, 16 bp, H. sapiens
aaagaaaagaggtttg

SEQ ID NO: 6786 - DNA, 16 bp, H. sapiens
aaagaaaagcaagttg

SEQ ID NO: 6787 - DNA, 16 bp, H. sapiens
aaagaaaagcagaagt

SEQ ID NO: 6788 - DNA, 16 bp, H. sapiens
aaagaaaagcatttca

SEQ ID NO: 6789 - DNA, 16 bp, H. sapiens
aaagaaaagctctttg

SEQ ID NO: 6790 - DNA, 16 bp, H. sapiens
aaagaaaaggacatta

SEQ ID NO: 6791 - DNA, 16 bp, H. sapiens
aaagaaaaggatgtta

SEQ ID NO: 6792 - DNA, 16 bp, H. sapiens
aaagaaaaggattttc

SEQ ID NO: 6793 - DNA, 16 bp, H. sapiens
aaagaaaaggcaatat

SEQ ID NO: 6794 - DNA, 16 bp, H. sapiens
aaagaaaaggcagttt

SEQ ID NO: 6795 - DNA, 16 bp, H. sapiens
aaagaaaaggcatcca

SEQ ID NO: 6796 - DNA, 16 bp, H. sapiens
aaagaaaaggctttca

SEQ ID NO: 6797 - DNA, 20 bp, H. sapiens
aaagaaaagggcctattgaa

SEQ ID NO: 6798 - DNA, 16 bp, H. sapiens
aaagaaaaggtttaat

SEQ ID NO: 6799 - DNA, 16 bp, H. sapiens
aaagaaaagtagttta

SEQ ID NO: 6800 - DNA, 16 bp, H. sapiens
aaagaaaagtcatttt

SEQ ID NO: 6801 - DNA, 16 bp, H. sapiens
aaagaaaagtctattt

SEQ ID NO: 6802 - DNA, 16 bp, H. sapiens
aaagaaaagtctcaaa

SEQ ID NO: 6803 - DNA, 16 bp, H. sapiens
aaagaaaagtttattt

SEQ ID NO: 6804 - DNA, 16 bp, H. sapiens
aaagaaaagtttcttt

SEQ ID NO: 6805 - DNA, 16 bp, H. sapiens
aaagaaaagtttgaag

SEQ ID NO: 6806 - DNA, 16 bp, H. sapiens
aaagaaaataaatctt

SEQ ID NO: 6807 - DNA, 16 bp, H. sapiens
aaagaaaataattctt

SEQ ID NO: 6808 - DNA, 16 bp, H. sapiens
aaagaaaatacagatt

SEQ ID NO: 6809 - DNA, 16 bp, H. sapiens
aaagaaaatatcctca

SEQ ID NO: 6810 - DNA, 16 bp, H. sapiens
aaagaaaatatctgaa

SEQ ID NO: 6811 - DNA, 16 bp, H. sapiens
aaagaaaatatgcata

SEQ ID NO: 6812 - DNA, 16 bp, H. sapiens
aaagaaaatatgtttc

SEQ ID NO: 6813 - DNA, 16 bp, H. sapiens
aaagaaaatattagca

SEQ ID NO: 6814 - DNA, 16 bp, H. sapiens
aaagaaaatattgttt

SEQ ID NO: 6815 - DNA, 16 bp, H. sapiens
aaagaaaatatttcat

SEQ ID NO: 6816 - DNA, 16 bp, H. sapiens
aaagaaaatcagagag

SEQ ID NO: 6817 - DNA, 16 bp, H. sapiens
aaagaaaatcagcaag

SEQ ID NO: 6818 - DNA, 16 bp, H. sapiens
aaagaaaatcagtata

SEQ ID NO: 6819 - DNA, 16 bp, H. sapiens
aaagaaaatcattttg

SEQ ID NO: 6820 - DNA, 16 bp, H. sapiens
aaagaaaatccacaga

SEQ ID NO: 6821 - DNA, 16 bp, H. sapiens
aaagaaaatctagaag

SEQ ID NO: 6822 - DNA, 16 bp, H. sapiens
aaagaaaatctatgaa

SEQ ID NO: 6823 - DNA, 16 bp, H. sapiens
aaagaaaatcttagaa

SEQ ID NO: 6824 - DNA, 16 bp, H. sapiens
aaagaaaatctttgaa

SEQ ID NO: 6825 - DNA, 16 bp, H. sapiens
aaagaaaatctttgag

SEQ ID NO: 6826 - DNA, 16 bp, H. sapiens
aaagaaaatgaactca

SEQ ID NO: 6827 - DNA, 16 bp, H. sapiens
aaagaaaatgaagttt

SEQ ID NO: 6828 - DNA, 16 bp, H. sapiens
aaagaaaatgaatgca

SEQ ID NO: 6829 - DNA, 16 bp, H. sapiens
aaagaaaatgaatgtg

SEQ ID NO: 6830 - DNA, 16 bp, H. sapiens
aaagaaaatgacagat

SEQ ID NO: 6831 - DNA, 16 bp, H. sapiens
aaagaaaatgacattt

SEQ ID NO: 6832 - DNA, 16 bp, H. sapiens
aaagaaaatgagcttt

SEQ ID NO: 6833 - DNA, 16 bp, H. sapiens
aaagaaaatgaggaac

SEQ ID NO: 6834 - DNA, 16 bp, H. sapiens
aaagaaaatgaggctg

SEQ ID NO: 6835 - DNA, 16 bp, H. sapiens
aaagaaaatgatcaag

SEQ ID NO: 6836 - DNA, 16 bp, H. sapiens
aaagaaaatgcttata

SEQ ID NO: 6837 - DNA, 16 bp, H. sapiens
aaagaaaatggacatt

SEQ ID NO: 6838 - DNA, 16 bp, H. sapiens
aaagaaaatggacttt

SEQ ID NO: 6839 - DNA, 16 bp, H. sapiens
aaagaaaatgtcagaa

SEQ ID NO: 6840 - DNA, 16 bp, H. sapiens
aaagaaaatgtgccac

SEQ ID NO: 6841 - DNA, 16 bp, H. sapiens
aaagaaaatgtgggac

SEQ ID NO: 6842 - DNA, 16 bp, H. sapiens
aaagaaaatgtggggt

SEQ ID NO: 6843 - DNA, 16 bp, H. sapiens
aaagaaaatgttggag

SEQ ID NO: 6844 - DNA, 16 bp, H. sapiens
aaagaaaatgttttgt

SEQ ID NO: 6845 - DNA, 16 bp, H. sapiens
aaagaaaattattttc

SEQ ID NO: 6846 - DNA, 16 bp, H. sapiens
aaagaaaattcaaatt

SEQ ID NO: 6847 - DNA, 16 bp, H. sapiens
aaagaaaattcttcag

SEQ ID NO: 6848 - DNA, 16 bp, H. sapiens
aaagaaaattgagatt

SEQ ID NO: 6849 - DNA, 22 bp, H. sapiens
aaagaaaatttcaggccaatat

SEQ ID NO: 6850 - DNA, 16 bp, H. sapiens
aaagaaaattttcaga

SEQ ID NO: 6851 - DNA, 16 bp, H. sapiens
aaagaaaattttgaga

SEQ ID NO: 6852 - DNA, 16 bp, H. sapiens
aaagaaacaaaacttg

SEQ ID NO: 6853 - DNA, 16 bp, H. sapiens
aaagaaacaaactatt

SEQ ID NO: 6854 - DNA, 16 bp, H. sapiens
aaagaaacaaagtatt

SEQ ID NO: 6855 - DNA, 16 bp, H. sapiens
aaagaaacacaaatgg

SEQ ID NO: 6856 - DNA, 16 bp, H. sapiens
aaagaaacacctgaga

SEQ ID NO: 6857 - DNA, 16 bp, H. sapiens
aaagaaacagaagatg

SEQ ID NO: 6858 - DNA, 16 bp, H. sapiens
aaagaaacagagactt

SEQ ID NO: 6859 - DNA, 16 bp, H. sapiens
aaagaaacagattttc

SEQ ID NO: 6860 - DNA, 16 bp, H. sapiens
aaagaaacagcagagt

SEQ ID NO: 6861 - DNA, 16 bp, H. sapiens
aaagaaacagtcaaca

SEQ ID NO: 6862 - DNA, 16 bp, H. sapiens
aaagaaacatctgaga

SEQ ID NO: 6863 - DNA, 16 bp, H. sapiens
aaagaaacattaaatt

SEQ ID NO: 6864 - DNA, 16 bp, H. sapiens
aaagaaacatttaata

SEQ ID NO: 6865 - DNA, 16 bp, H. sapiens
aaagaaacatttcaaa

SEQ ID NO: 6866 - DNA, 16 bp, H. sapiens
aaagaaacatttctca

SEQ ID NO: 6867 - DNA, 16 bp, H. sapiens
aaagaaacattttaag

SEQ ID NO: 6868 - DNA, 16 bp, H. sapiens
aaagaaacattttaat

SEQ ID NO: 6869 - DNA, 16 bp, H. sapiens
aaagaaacattttcag

SEQ ID NO: 6870 - DNA, 16 bp, H. sapiens
aaagaaacattttctg

SEQ ID NO: 6871 - DNA, 16 bp, H. sapiens
aaagaaacatttttca

SEQ ID NO: 6872 - DNA, 16 bp, H. sapiens
aaagaaaccctcaaaa

SEQ ID NO: 6873 - DNA, 16 bp, H. sapiens
aaagaaacctcatacc

SEQ ID NO: 6874 - DNA, 16 bp, H. sapiens
aaagaaactagcaaca

SEQ ID NO: 6875 - DNA, 16 bp, H. sapiens
aaagaaactatccaca

SEQ ID NO: 6876 - DNA, 16 bp, H. sapiens
aaagaaactattttat

SEQ ID NO: 6877 - DNA, 16 bp, H. sapiens
aaagaaactgaaatta

SEQ ID NO: 6878 - DNA, 16 bp, H. sapiens
aaagaaactgaagaag

SEQ ID NO: 6879 - DNA, 16 bp, H. sapiens
aaagaaactgaagaga

SEQ ID NO: 6880 - DNA, 16 bp, H. sapiens
aaagaaactgaagata

SEQ ID NO: 6881 - DNA, 16 bp, H. sapiens
aaagaaactgaatttg

SEQ ID NO: 6882 - DNA, 16 bp, H. sapiens
aaagaaactgacaaac

SEQ ID NO: 6883 - DNA, 16 bp, H. sapiens
aaagaaactggaagaa

SEQ ID NO: 6884 - DNA, 16 bp, H. sapiens
aaagaaactgtatttt

SEQ ID NO: 6885 - DNA, 16 bp, H. sapiens
aaagaaactgtcaaaa

SEQ ID NO: 6886 - DNA, 16 bp, H. sapiens
aaagaaactgtggtgt

SEQ ID NO: 6887 - DNA, 16 bp, H. sapiens
aaagaaacttatttct

SEQ ID NO: 6888 - DNA, 16 bp, H. sapiens
aaagaaactttaaaga

SEQ ID NO: 6889 - DNA, 16 bp, H. sapiens
aaagaaactttctaaa

SEQ ID NO: 6890 - DNA, 16 bp, H. sapiens
aaagaaactttctttt

SEQ ID NO: 6891 - DNA, 16 bp, H. sapiens
aaagaaacttttaaaa

SEQ ID NO: 6892 - DNA, 16 bp, H. sapiens
aaagaaacttttaaat

SEQ ID NO: 6893 - DNA, 16 bp, H. sapiens
aaagaaactttttaat

SEQ ID NO: 6894 - DNA, 16 bp, H. sapiens
aaagaaagaaaacctt

SEQ ID NO: 6895 - DNA, 16 bp, H. sapiens
aaagaaagaaaagttc

SEQ ID NO: 6896 - DNA, 16 bp, H. sapiens
aaagaaagaaaatctc

SEQ ID NO: 6897 - DNA, 16 bp, H. sapiens
aaagaaagaaaattcc

SEQ ID NO: 6898 - DNA, 16 bp, H. sapiens
aaagaaagaaactcag

SEQ ID NO: 6899 - DNA, 16 bp, H. sapiens
aaagaaagaaactgat

SEQ ID NO: 6900 - DNA, 16 bp, H. sapiens
aaagaaagaaactgca

SEQ ID NO: 6901 - DNA, 16 bp, H. sapiens
aaagaaagaaactgtg

SEQ ID NO: 6902 - DNA, 16 bp, H. sapiens
aaagaaagaaaggtca

SEQ ID NO: 6903 - DNA, 16 bp, H. sapiens
aaagaaagaaagtcat

SEQ ID NO: 6904 - DNA, 16 bp, H. sapiens
aaagaaagaaagtgac

SEQ ID NO: 6905 - DNA, 16 bp, H. sapiens
aaagaaagaaatctct

SEQ ID NO: 6906 - DNA, 16 bp, H. sapiens
aaagaaagaaatctgc

SEQ ID NO: 6907 - DNA, 16 bp, H. sapiens
aaagaaagaaatggca

SEQ ID NO: 6908 - DNA, 16 bp, H. sapiens
aaagaaagaaatgtgt

SEQ ID NO: 6909 - DNA, 16 bp, H. sapiens
aaagaaagaaatgttt

SEQ ID NO: 6910 - DNA, 16 bp, H. sapiens
aaagaaagaaattact

SEQ ID NO: 6911 - DNA, 16 bp, H. sapiens
aaagaaagaaattctt

SEQ ID NO: 6912 - DNA, 16 bp, H. sapiens
aaagaaagaaattttg

SEQ ID NO: 6913 - DNA, 16 bp, H. sapiens
aaagaaagaacttcag

SEQ ID NO: 6914 - DNA, 16 bp, H. sapiens
aaagaaagaagattca

SEQ ID NO: 6915 - DNA, 16 bp, H. sapiens
aaagaaagaagatttg

SEQ ID NO: 6916 - DNA, 16 bp, H. sapiens
aaagaaagaatcagca

SEQ ID NO: 6917 - DNA, 16 bp, H. sapiens
aaagaaagaatctgaa

SEQ ID NO: 6918 - DNA, 16 bp, H. sapiens
aaagaaagaatggcaa

SEQ ID NO: 6919 - DNA, 16 bp, H. sapiens
aaagaaagacattttt

SEQ ID NO: 6920 - DNA, 16 bp, H. sapiens
aaagaaagactgagga

SEQ ID NO: 6921 - DNA, 16 bp, H. sapiens
aaagaaagagaaagct

SEQ ID NO: 6922 - DNA, 16 bp, H. sapiens
aaagaaagagtattca

SEQ ID NO: 6923 - DNA, 16 bp, H. sapiens
aaagaaagatgttctt

SEQ ID NO: 6924 - DNA, 16 bp, H. sapiens
aaagaaagcaaaagtt

SEQ ID NO: 6925 - DNA, 16 bp, H. sapiens
aaagaaagcaaaattt

SEQ ID NO: 6926 - DNA, 16 bp, H. sapiens
aaagaaagcttcaaca

SEQ ID NO: 6927 - DNA, 16 bp, H. sapiens
aaagaaagctttaaat

SEQ ID NO: 6928 - DNA, 16 bp, H. sapiens
aaagaaagcttttctt

SEQ ID NO: 6929 - DNA, 16 bp, H. sapiens
aaagaaaggaaactat

SEQ ID NO: 6930 - DNA, 16 bp, H. sapiens
aaagaaaggaaattct

SEQ ID NO: 6931 - DNA, 16 bp, H. sapiens
aaagaaaggaagattt

SEQ ID NO: 6932 - DNA, 16 bp, H. sapiens
aaagaaaggacatcag

SEQ ID NO: 6933 - DNA, 16 bp, H. sapiens
aaagaaaggatatttt

SEQ ID NO: 6934 - DNA, 16 bp, H. sapiens
aaagaaaggctgagaa

SEQ ID NO: 6935 - DNA, 16 bp, H. sapiens
aaagaaagggccaggc

SEQ ID NO: 6936 - DNA, 16 bp, H. sapiens
aaagaaaggttcaagt

SEQ ID NO: 6937 - DNA, 16 bp, H. sapiens
aaagaaaggtttacct

SEQ ID NO: 6938 - DNA, 16 bp, H. sapiens
aaagaaagtccagaaa

SEQ ID NO: 6939 - DNA, 16 bp, H. sapiens
aaagaaagtccttaga

SEQ ID NO: 6940 - DNA, 16 bp, H. sapiens
aaagaaagtgacttta

SEQ ID NO: 6941 - DNA, 16 bp, H. sapiens
aaagaaagtgactttt

SEQ ID NO: 6942 - DNA, 16 bp, H. sapiens
aaagaaagtggtttcc

SEQ ID NO: 6943 - DNA, 16 bp, H. sapiens
aaagaaagtttcaagt

SEQ ID NO: 6944 - DNA, 16 bp, H. sapiens
aaagaaagttttaaca

SEQ ID NO: 6945 - DNA, 16 bp, H. sapiens
aaagaaataaaattgc

SEQ ID NO: 6946 - DNA, 16 bp, H. sapiens
aaagaaataaacttct

SEQ ID NO: 6947 - DNA, 16 bp, H. sapiens
aaagaaataaaggcat

SEQ ID NO: 6948 - DNA, 16 bp, H. sapiens
aaagaaataactttat

SEQ ID NO: 6949 - DNA, 16 bp, H. sapiens
aaagaaataagtcata

SEQ ID NO: 6950 - DNA, 16 bp, H. sapiens
aaagaaataatcatca

SEQ ID NO: 6951 - DNA, 16 bp, H. sapiens
aaagaaataatgcaga

SEQ ID NO: 6952 - DNA, 16 bp, H. sapiens
aaagaaataatttcat

SEQ ID NO: 6953 - DNA, 16 bp, H. sapiens
aaagaaatacaattta

SEQ ID NO: 6954 - DNA, 16 bp, H. sapiens
aaagaaatacagaatt

SEQ ID NO: 6955 - DNA, 16 bp, H. sapiens
aaagaaatacttgagg

SEQ ID NO: 6956 - DNA, 16 bp, H. sapiens
aaagaaatagaagtca

SEQ ID NO: 6957 - DNA, 16 bp, H. sapiens
aaagaaatagcatcaa

SEQ ID NO: 6958 - DNA, 16 bp, H. sapiens
aaagaaatagctgaga

SEQ ID NO: 6959 - DNA, 16 bp, H. sapiens
aaagaaatagctgtaa

SEQ ID NO: 6960 - DNA, 16 bp, H. sapiens
aaagaaatagtcaaat

SEQ ID NO: 6961 - DNA, 16 bp, H. sapiens
aaagaaatataattca

SEQ ID NO: 6962 - DNA, 16 bp, H. sapiens
aaagaaatatatacat

SEQ ID NO: 6963 - DNA, 16 bp, H. sapiens
aaagaaatatattcaa

SEQ ID NO: 6964 - DNA, 16 bp, H. sapiens
aaagaaatatatttgg

SEQ ID NO: 6965 - DNA, 16 bp, H. sapiens
aaagaaatatctttgt

SEQ ID NO: 6966 - DNA, 16 bp, H. sapiens
aaagaaatcacagaag

SEQ ID NO: 6967 - DNA, 16 bp, H. sapiens
aaagaaatcagaaatg

SEQ ID NO: 6968 - DNA, 17 bp, H. sapiens
aaagaaatcagacctaa

SEQ ID NO: 6969 - DNA, 16 bp, H. sapiens
aaagaaatcagagaca

SEQ ID NO: 6970 - DNA, 16 bp, H. sapiens
aaagaaatcagccagg

SEQ ID NO: 6971 - DNA, 16 bp, H. sapiens
aaagaaatcataaatg

SEQ ID NO: 6972 - DNA, 16 bp, H. sapiens
aaagaaatcatagaca

SEQ ID NO: 6973 - DNA, 16 bp, H. sapiens
aaagaaatcataggtg

SEQ ID NO: 6974 - DNA, 16 bp, H. sapiens
aaagaaatcatcaaca

SEQ ID NO: 6975 - DNA, 16 bp, H. sapiens
aaagaaatcatgtcct

SEQ ID NO: 6976 - DNA, 16 bp, H. sapiens
aaagaaatcatttaaa

SEQ ID NO: 6977 - DNA, 16 bp, H. sapiens
aaagaaatcctaaaat

SEQ ID NO: 6978 - DNA, 16 bp, H. sapiens
aaagaaatctggaaaa

SEQ ID NO: 6979 - DNA, 16 bp, H. sapiens
aaagaaatcttaaaag

SEQ ID NO: 6980 - DNA, 16 bp, H. sapiens
aaagaaatcttatttt

SEQ ID NO: 6981 - DNA, 16 bp, H. sapiens
aaagaaatctttatat

SEQ ID NO: 6982 - DNA, 16 bp, H. sapiens
aaagaaatgaaaggca

SEQ ID NO: 6983 - DNA, 16 bp, H. sapiens
aaagaaatgaattttc

SEQ ID NO: 6984 - DNA, 16 bp, H. sapiens
aaagaaatgacagatg

SEQ ID NO: 6985 - DNA, 16 bp, H. sapiens
aaagaaatgagctatc

SEQ ID NO: 6986 - DNA, 16 bp, H. sapiens
aaagaaatgcaagtca

SEQ ID NO: 6987 - DNA, 16 bp, H. sapiens
aaagaaatgcaattga

SEQ ID NO: 6988 - DNA, 16 bp, H. sapiens
aaagaaatggcatttt

SEQ ID NO: 6989 - DNA, 16 bp, H. sapiens
aaagaaatgtattttt

SEQ ID NO: 6990 - DNA, 16 bp, H. sapiens
aaagaaatgtgatttt

SEQ ID NO: 6991 - DNA, 16 bp, H. sapiens
aaagaaatgtgcattt

SEQ ID NO: 6992 - DNA, 16 bp, H. sapiens
aaagaaatgttatgaa

SEQ ID NO: 6993 - DNA, 16 bp, H. sapiens
aaagaaatgtttaatt

SEQ ID NO: 6994 - DNA, 16 bp, H. sapiens
aaagaaatgtttattt

SEQ ID NO: 6995 - DNA, 16 bp, H. sapiens
aaagaaatgtttcaaa

SEQ ID NO: 6996 - DNA, 16 bp, H. sapiens
aaagaaatgtttttct

SEQ ID NO: 6997 - DNA, 16 bp, H. sapiens
aaagaaattaaatctg

SEQ ID NO: 6998 - DNA, 16 bp, H. sapiens
aaagaaattacagaag

SEQ ID NO: 6999 - DNA, 16 bp, H. sapiens
aaagaaattataccaa

SEQ ID NO: 7000 - DNA, 16 bp, H. sapiens
aaagaaattcaagaag

SEQ ID NO: 7001 - DNA, 16 bp, H. sapiens
aaagaaattcagaatt

SEQ ID NO: 7002 - DNA, 16 bp, H. sapiens
aaagaaattcagagct

SEQ ID NO: 7003 - DNA, 16 bp, H. sapiens
aaagaaattcatttct

SEQ ID NO: 7004 - DNA, 16 bp, H. sapiens
aaagaaattctggact

SEQ ID NO: 7005 - DNA, 16 bp, H. sapiens
aaagaaattctgtgtg

SEQ ID NO: 7006 - DNA, 16 bp, H. sapiens
aaagaaattgcaacaa

SEQ ID NO: 7007 - DNA, 16 bp, H. sapiens
aaagaaattgtggttt

SEQ ID NO: 7008 - DNA, 16 bp, H. sapiens
aaagaaatttaaaggt

SEQ ID NO: 7009 - DNA, 16 bp, H. sapiens
aaagaaatttcaaatt

SEQ ID NO: 7010 - DNA, 16 bp, H. sapiens
aaagaaatttcaacca

SEQ ID NO: 7011 - DNA, 16 bp, H. sapiens
aaagaaatttcagaaa

SEQ ID NO: 7012 - DNA, 16 bp, H. sapiens
aaagaaatttctgaga

SEQ ID NO: 7013 - DNA, 16 bp, H. sapiens
aaagaaatttctttaa

SEQ ID NO: 7014 - DNA, 16 bp, H. sapiens
aaagaaatttcttttt

SEQ ID NO: 7015 - DNA, 16 bp, H. sapiens
aaagaaatttgggaaa

SEQ ID NO: 7016 - DNA, 16 bp, H. sapiens
aaagaaattttacaaa

SEQ ID NO: 7017 - DNA, 16 bp, H. sapiens
aaagaaattttacatt

SEQ ID NO: 7018 - DNA, 16 bp, H. sapiens
aaagaaattttggaaa

SEQ ID NO: 7019 - DNA, 16 bp, H. sapiens
aaagaacaaaactgta

SEQ ID NO: 7020 - DNA, 16 bp, H. sapiens
aaagaacaaagaattt

SEQ ID NO: 7021 - DNA, 16 bp, H. sapiens
aaagaacaaagatgga

SEQ ID NO: 7022 - DNA, 16 bp, H. sapiens
aaagaacaaagccagg

SEQ ID NO: 7023 - DNA, 18 bp, H. sapiens
aaagaacaaagcttccac

SEQ ID NO: 7024 - DNA, 16 bp, H. sapiens
aaagaacaaatattca

SEQ ID NO: 7025 - DNA, 16 bp, H. sapiens
aaagaacaaatctgaa

SEQ ID NO: 7026 - DNA, 16 bp, H. sapiens
aaagaacaactccttt

SEQ ID NO: 7027 - DNA, 16 bp, H. sapiens
aaagaacaagatcatg

SEQ ID NO: 7028 - DNA, 16 bp, H. sapiens
aaagaacaagctggag

SEQ ID NO: 7029 - DNA, 16 bp, H. sapiens
aaagaacaatttgtga

SEQ ID NO: 7030 - DNA, 16 bp, H. sapiens
aaagaacacctacaaa

SEQ ID NO: 7031 - DNA, 16 bp, H. sapiens
aaagaacacctgggaa

SEQ ID NO: 7032 - DNA, 18 bp, H. sapiens
aaagaacacctgggaaat

SEQ ID NO: 7033 - DNA, 20 bp, H. sapiens
aaagaacagaaatcacaaca

SEQ ID NO: 7034 - DNA, 16 bp, H. sapiens
aaagaacagaaattac

SEQ ID NO: 7035 - DNA, 16 bp, H. sapiens
aaagaacaggctgact

SEQ ID NO: 7036 - DNA, 16 bp, H. sapiens
aaagaacataaattgt

SEQ ID NO: 7037 - DNA, 16 bp, H. sapiens
aaagaacataatttca

SEQ ID NO: 7038 - DNA, 16 bp, H. sapiens
aaagaacatattttaa

SEQ ID NO: 7039 - DNA, 16 bp, H. sapiens
aaagaacatattttta

SEQ ID NO: 7040 - DNA, 16 bp, H. sapiens
aaagaacatgaacaga

SEQ ID NO: 7041 - DNA, 17 bp, H. sapiens
aaagaacatgaactcat

SEQ ID NO: 7042 - DNA, 16 bp, H. sapiens
aaagaacatgagattt

SEQ ID NO: 7043 - DNA, 16 bp, H. sapiens
aaagaacatgggcttt

SEQ ID NO: 7044 - DNA, 16 bp, H. sapiens
aaagaacatttacaaa

SEQ ID NO: 7045 - DNA, 16 bp, H. sapiens
aaagaacatttcataa

SEQ ID NO: 7046 - DNA, 16 bp, H. sapiens
aaagaacatttctaaa

SEQ ID NO: 7047 - DNA, 16 bp, H. sapiens
aaagaacattttaaaa

SEQ ID NO: 7048 - DNA, 16 bp, H. sapiens
aaagaacattttcatt

SEQ ID NO: 7049 - DNA, 16 bp, H. sapiens
aaagaaccaaattttg

SEQ ID NO: 7050 - DNA, 16 bp, H. sapiens
aaagaaccaatgcaag

SEQ ID NO: 7051 - DNA, 16 bp, H. sapiens
aaagaaccactggaaa

SEQ ID NO: 7052 - DNA, 16 bp, H. sapiens
aaagaaccagatctca

SEQ ID NO: 7053 - DNA, 16 bp, H. sapiens
aaagaaccttcttaag

SEQ ID NO: 7054 - DNA, 16 bp, H. sapiens
aaagaactaaaaatgg

SEQ ID NO: 7055 - DNA, 16 bp, H. sapiens
aaagaactaaaaattg

SEQ ID NO: 7056 - DNA, 16 bp, H. sapiens
aaagaactaaaatttt

SEQ ID NO: 7057 - DNA, 16 bp, H. sapiens
aaagaactaaagaagc

SEQ ID NO: 7058 - DNA, 16 bp, H. sapiens
aaagaactctcaaaac

SEQ ID NO: 7059 - DNA, 16 bp, H. sapiens
aaagaactctgaaaac

SEQ ID NO: 7060 - DNA, 16 bp, H. sapiens
aaagaactgcccaaga

SEQ ID NO: 7061 - DNA, 16 bp, H. sapiens
aaagaactgcttgaac

SEQ ID NO: 7062 - DNA, 16 bp, H. sapiens
aaagaactggaagaaa

SEQ ID NO: 7063 - DNA, 16 bp, H. sapiens
aaagaactggagaagc

SEQ ID NO: 7064 - DNA, 16 bp, H. sapiens
aaagaactgtttgagt

SEQ ID NO: 7065 - DNA, 16 bp, H. sapiens
aaagaacttaaaatgg

SEQ ID NO: 7066 - DNA, 16 bp, H. sapiens
aaagaacttaaattta

SEQ ID NO: 7067 - DNA, 16 bp, H. sapiens
aaagaacttcaacaaa

SEQ ID NO: 7068 - DNA, 16 bp, H. sapiens
aaagaacttcagcaaa

SEQ ID NO: 7069 - DNA, 16 bp, H. sapiens
aaagaacttgaaacag

SEQ ID NO: 7070 - DNA, 16 bp, H. sapiens
aaagaacttgcccaag

SEQ ID NO: 7071 - DNA, 16 bp, H. sapiens
aaagaactttaaaaca

SEQ ID NO: 7072 - DNA, 16 bp, H. sapiens
aaagaagaaaaacttt

SEQ ID NO: 7073 - DNA, 16 bp, H. sapiens
aaagaagaaaactgga

SEQ ID NO: 7074 - DNA, 16 bp, H. sapiens
aaagaagaaaatcctt

SEQ ID NO: 7075 - DNA, 16 bp, H. sapiens
aaagaagaaaatgtca

SEQ ID NO: 7076 - DNA, 16 bp, H. sapiens
aaagaagaaaattctg

SEQ ID NO: 7077 - DNA, 16 bp, H. sapiens
aaagaagaaaatttca

SEQ ID NO: 7078 - DNA, 16 bp, H. sapiens
aaagaagaaacattta

SEQ ID NO: 7079 - DNA, 16 bp, H. sapiens
aaagaagaaactgagg

SEQ ID NO: 7080 - DNA, 16 bp, H. sapiens
aaagaagaaagctgga

SEQ ID NO: 7081 - DNA, 16 bp, H. sapiens
aaagaagaaagtccag

SEQ ID NO: 7082 - DNA, 16 bp, H. sapiens
aaagaagaaagtttta

SEQ ID NO: 7083 - DNA, 16 bp, H. sapiens
aaagaagaaatctgaa

SEQ ID NO: 7084 - DNA, 16 bp, H. sapiens
aaagaagaaatctgga

SEQ ID NO: 7085 - DNA, 16 bp, H. sapiens
aaagaagaaatcttga

SEQ ID NO: 7086 - DNA, 16 bp, H. sapiens
aaagaagaaattcaga

SEQ ID NO: 7087 - DNA, 16 bp, H. sapiens
aaagaagaaatttatg

SEQ ID NO: 7088 - DNA, 16 bp, H. sapiens
aaagaagaatgtgttt

SEQ ID NO: 7089 - DNA, 16 bp, H. sapiens
aaagaagaattccaaa

SEQ ID NO: 7090 - DNA, 16 bp, H. sapiens
aaagaagaattttcaa

SEQ ID NO: 7091 - DNA, 16 bp, H. sapiens
aaagaagaattttttt

SEQ ID NO: 7092 - DNA, 16 bp, H. sapiens
aaagaagacatacatg

SEQ ID NO: 7093 - DNA, 16 bp, H. sapiens
aaagaagacatatgtg

SEQ ID NO: 7094 - DNA, 16 bp, H. sapiens
aaagaagacatggaaa

SEQ ID NO: 7095 - DNA, 16 bp, H. sapiens
aaagaagacatgtttt

SEQ ID NO: 7096 - DNA, 16 bp, H. sapiens
aaagaagacattataa

SEQ ID NO: 7097 - DNA, 16 bp, H. sapiens
aaagaagacattgatg

SEQ ID NO: 7098 - DNA, 23 bp, H. sapiens
aaagaagacatttatgcaaccaa

SEQ ID NO: 7099 - DNA, 16 bp, H. sapiens
aaagaagacctaaata

SEQ ID NO: 7100 - DNA, 16 bp, H. sapiens
aaagaagacttacaaa

SEQ ID NO: 7101 - DNA, 16 bp, H. sapiens
aaagaagagaaaactg

SEQ ID NO: 7102 - DNA, 16 bp, H. sapiens
aaagaagagatttatt

SEQ ID NO: 7103 - DNA, 16 bp, H. sapiens
aaagaagagctggtac

SEQ ID NO: 7104 - DNA, 16 bp, H. sapiens
aaagaagagctggtgc

SEQ ID NO: 7105 - DNA, 16 bp, H. sapiens
aaagaagagtcttttc

SEQ ID NO: 7106 - DNA, 16 bp, H. sapiens
aaagaagataatgttt

SEQ ID NO: 7107 - DNA, 16 bp, H. sapiens
aaagaagatatacaca

SEQ ID NO: 7108 - DNA, 16 bp, H. sapiens
aaagaagatatatttt

SEQ ID NO: 7109 - DNA, 16 bp, H. sapiens
aaagaagatatctgtg

SEQ ID NO: 7110 - DNA, 16 bp, H. sapiens
aaagaagatatgcaaa

SEQ ID NO: 7111 - DNA, 16 bp, H. sapiens
aaagaagatatttatg

SEQ ID NO: 7112 - DNA, 16 bp, H. sapiens
aaagaagatcattttg

SEQ ID NO: 7113 - DNA, 16 bp, H. sapiens
aaagaagatgcagaaa

SEQ ID NO: 7114 - DNA, 16 bp, H. sapiens
aaagaagattctcaga

SEQ ID NO: 7115 - DNA, 16 bp, H. sapiens
aaagaagcaaataact

SEQ ID NO: 7116 - DNA, 16 bp, H. sapiens
aaagaagcaaatattt

SEQ ID NO: 7117 - DNA, 16 bp, H. sapiens
aaagaagcactgaaga

SEQ ID NO: 7118 - DNA, 16 bp, H. sapiens
aaagaagcagagaaat

SEQ ID NO: 7119 - DNA, 16 bp, H. sapiens
aaagaagccagacaca

SEQ ID NO: 7120 - DNA, 16 bp, H. sapiens
aaagaagccagaccca

SEQ ID NO: 7121 - DNA, 16 bp, H. sapiens
aaagaagccagaggga

SEQ ID NO: 7122 - DNA, 16 bp, H. sapiens
aaagaagccagccaaa

SEQ ID NO: 7123 - DNA, 16 bp, H. sapiens
aaagaagccaggcaga

SEQ ID NO: 7124 - DNA, 16 bp, H. sapiens
aaagaagccagtcaca

SEQ ID NO: 7125 - DNA, 16 bp, H. sapiens
aaagaagccgtctcca

SEQ ID NO: 7126 - DNA, 16 bp, H. sapiens
aaagaagctaaaaact

SEQ ID NO: 7127 - DNA, 16 bp, H. sapiens
aaagaagctctaaatc

SEQ ID NO: 7128 - DNA, 16 bp, H. sapiens
aaagaagctgaaaact

SEQ ID NO: 7129 - DNA, 16 bp, H. sapiens
aaagaagctgaaataa

SEQ ID NO: 7130 - DNA, 16 bp, H. sapiens
aaagaagctgtctcca

SEQ ID NO: 7131 - DNA, 16 bp, H. sapiens
aaagaaggaaaatcat

SEQ ID NO: 7132 - DNA, 16 bp, H. sapiens
aaagaaggaaagatct

SEQ ID NO: 7133 - DNA, 16 bp, H. sapiens
aaagaaggaaattatt

SEQ ID NO: 7134 - DNA, 16 bp, H. sapiens
aaagaaggaaattcag

SEQ ID NO: 7135 - DNA, 16 bp, H. sapiens
aaagaaggaaggagct

SEQ ID NO: 7136 - DNA, 16 bp, H. sapiens
aaagaaggacatttta

SEQ ID NO: 7137 - DNA, 16 bp, H. sapiens
aaagaagggagtttat

SEQ ID NO: 7138 - DNA, 16 bp, H. sapiens
aaagaagtaaacattt

SEQ ID NO: 7139 - DNA, 16 bp, H. sapiens
aaagaagtattttctt

SEQ ID NO: 7140 - DNA, 16 bp, H. sapiens
aaagaagtatttttaa

SEQ ID NO: 7141 - DNA, 16 bp, H. sapiens
aaagaagtcagagaaa

SEQ ID NO: 7142 - DNA, 16 bp, H. sapiens
aaagaagtcaggaaaa

SEQ ID NO: 7143 - DNA, 16 bp, H. sapiens
aaagaagtcaggaaag

SEQ ID NO: 7144 - DNA, 16 bp, H. sapiens
aaagaagtcattattt

SEQ ID NO: 7145 - DNA, 16 bp, H. sapiens
aaagaagtcatttttt

SEQ ID NO: 7146 - DNA, 16 bp, H. sapiens
aaagaagtccttaaag

SEQ ID NO: 7147 - DNA, 16 bp, H. sapiens
aaagaagtgaaagatc

SEQ ID NO: 7148 - DNA, 16 bp, H. sapiens
aaagaagtgaaagatt

SEQ ID NO: 7149 - DNA, 16 bp, H. sapiens
aaagaagtgagaacat

SEQ ID NO: 7150 - DNA, 16 bp, H. sapiens
aaagaagtgagcaaga

SEQ ID NO: 7151 - DNA, 16 bp, H. sapiens
aaagaagtgataaatg

SEQ ID NO: 7152 - DNA, 16 bp, H. sapiens
aaagaagttaaaaact

SEQ ID NO: 7153 - DNA, 16 bp, H. sapiens
aaagaagttattttaa

SEQ ID NO: 7154 - DNA, 16 bp, H. sapiens
aaagaagttgaaaatt

SEQ ID NO: 7155 - DNA, 16 bp, H. sapiens
aaagaagttgaagagg

SEQ ID NO: 7156 - DNA, 16 bp, H. sapiens
aaagaagtttaatttt

SEQ ID NO: 7157 - DNA, 16 bp, H. sapiens
aaagaagtttcattaa

SEQ ID NO: 7158 - DNA, 16 bp, H. sapiens
aaagaagtttggttat

SEQ ID NO: 7159 - DNA, 16 bp, H. sapiens
aaagaagttttatttt

SEQ ID NO: 7160 - DNA, 16 bp, H. sapiens
aaagaagttttttcca

SEQ ID NO: 7161 - DNA, 16 bp, H. sapiens
aaagaataaaagcagg

SEQ ID NO: 7162 - DNA, 16 bp, H. sapiens
aaagaataaaatactt

SEQ ID NO: 7163 - DNA, 16 bp, H. sapiens
aaagaataaaatttct

SEQ ID NO: 7164 - DNA, 16 bp, H. sapiens
aaagaataaagatctc

SEQ ID NO: 7165 - DNA, 16 bp, H. sapiens
aaagaataaagctgga

SEQ ID NO: 7166 - DNA, 16 bp, H. sapiens
aaagaatacaatattt

SEQ ID NO: 7167 - DNA, 16 bp, H. sapiens
aaagaatacagaattt

SEQ ID NO: 7168 - DNA, 16 bp, H. sapiens
aaagaatacagtattt

SEQ ID NO: 7169 - DNA, 16 bp, H. sapiens
aaagaatacatttaaa

SEQ ID NO: 7170 - DNA, 16 bp, H. sapiens
aaagaatactacctga

SEQ ID NO: 7171 - DNA, 16 bp, H. sapiens
aaagaatactttgaaa

SEQ ID NO: 7172 - DNA, 16 bp, H. sapiens
aaagaatatctgagac

SEQ ID NO: 7173 - DNA, 16 bp, H. sapiens
aaagaatatgattttg

SEQ ID NO: 7174 - DNA, 16 bp, H. sapiens
aaagaatatggcagaa

SEQ ID NO: 7175 - DNA, 16 bp, H. sapiens
aaagaatatgtatttt

SEQ ID NO: 7176 - DNA, 16 bp, H. sapiens
aaagaatatttggaaa

SEQ ID NO: 7177 - DNA, 16 bp, H. sapiens
aaagaatattttacaa

SEQ ID NO: 7178 - DNA, 16 bp, H. sapiens
aaagaatcaaatggaa

SEQ ID NO: 7179 - DNA, 16 bp, H. sapiens
aaagaatcaatatcat

SEQ ID NO: 7180 - DNA, 16 bp, H. sapiens
aaagaatcaggcagaa

SEQ ID NO: 7181 - DNA, 16 bp, H. sapiens
aaagaatcattagaaa

SEQ ID NO: 7182 - DNA, 16 bp, H. sapiens
aaagaatcatttaaaa

SEQ ID NO: 7183 - DNA, 16 bp, H. sapiens
aaagaatcatttaaat

SEQ ID NO: 7184 - DNA, 16 bp, H. sapiens
aaagaatcctgtgtca

SEQ ID NO: 7185 - DNA, 16 bp, H. sapiens
aaagaatctcagagct

SEQ ID NO: 7186 - DNA, 16 bp, H. sapiens
aaagaatctttaaaaa

SEQ ID NO: 7187 - DNA, 16 bp, H. sapiens
aaagaatgaaattcag

SEQ ID NO: 7188 - DNA, 16 bp, H. sapiens
aaagaatgaaggacaa

SEQ ID NO: 7189 - DNA, 16 bp, H. sapiens
aaagaatgaagttgga

SEQ ID NO: 7190 - DNA, 16 bp, H. sapiens
aaagaatgaataaagc

SEQ ID NO: 7191 - DNA, 16 bp, H. sapiens
aaagaatgaatcaaac

SEQ ID NO: 7192 - DNA, 16 bp, H. sapiens
aaagaatgaatttatt

SEQ ID NO: 7193 - DNA, 16 bp, H. sapiens
aaagaatgaattttat

SEQ ID NO: 7194 - DNA, 16 bp, H. sapiens
aaagaatgaggttgga

SEQ ID NO: 7195 - DNA, 16 bp, H. sapiens
aaagaatgcaaaatgt

SEQ ID NO: 7196 - DNA, 16 bp, H. sapiens
aaagaatgcaaaggaa

SEQ ID NO: 7197 - DNA, 16 bp, H. sapiens
aaagaatgccacaaag

SEQ ID NO: 7198 - DNA, 17 bp, H. sapiens
aaagaatggctactcca

SEQ ID NO: 7199 - DNA, 16 bp, H. sapiens
aaagaatggctattcc

SEQ ID NO: 7200 - DNA, 16 bp, H. sapiens
aaagaatggctgaaaa

SEQ ID NO: 7201 - DNA, 16 bp, H. sapiens
aaagaatgtacatttt

SEQ ID NO: 7202 - DNA, 16 bp, H. sapiens
aaagaatgtatttgtg

SEQ ID NO: 7203 - DNA, 16 bp, H. sapiens
aaagaatgtctattct

SEQ ID NO: 7204 - DNA, 16 bp, H. sapiens
aaagaatgtcttgatt

SEQ ID NO: 7205 - DNA, 16 bp, H. sapiens
aaagaatgtggcagaa

SEQ ID NO: 7206 - DNA, 16 bp, H. sapiens
aaagaatgttgtccaa

SEQ ID NO: 7207 - DNA, 16 bp, H. sapiens
aaagaattaaatgagt

SEQ ID NO: 7208 - DNA, 16 bp, H. sapiens
aaagaattaagcagaa

SEQ ID NO: 7209 - DNA, 16 bp, H. sapiens
aaagaattagaaaagc

SEQ ID NO: 7210 - DNA, 16 bp, H. sapiens
aaagaattatttttca

SEQ ID NO: 7211 - DNA, 16 bp, H. sapiens
aaagaattcagaaaat

SEQ ID NO: 7212 - DNA, 16 bp, H. sapiens
aaagaattcagaaggt

SEQ ID NO: 7213 - DNA, 16 bp, H. sapiens
aaagaattcagaattc

SEQ ID NO: 7214 - DNA, 16 bp, H. sapiens
aaagaattcagccaag

SEQ ID NO: 7215 - DNA, 16 bp, H. sapiens
aaagaattctcaaaac

SEQ ID NO: 7216 - DNA, 16 bp, H. sapiens
aaagaattctgaggct

SEQ ID NO: 7217 - DNA, 16 bp, H. sapiens
aaagaattgaaatcag

SEQ ID NO: 7218 - DNA, 16 bp, H. sapiens
aaagaattggacaaaa

SEQ ID NO: 7219 - DNA, 16 bp, H. sapiens
aaagaatttaggattt

SEQ ID NO: 7220 - DNA, 16 bp, H. sapiens
aaagaatttcaagaaa

SEQ ID NO: 7221 - DNA, 16 bp, H. sapiens
aaagaatttcaagaag

SEQ ID NO: 7222 - DNA, 16 bp, H. sapiens
aaagaatttcttaatt

SEQ ID NO: 7223 - DNA, 16 bp, H. sapiens
aaagaatttcttcttt

SEQ ID NO: 7224 - DNA, 16 bp, H. sapiens
aaagaatttgaggcaa

SEQ ID NO: 7225 - DNA, 16 bp, H. sapiens
aaagaatttgtggaca

SEQ ID NO: 7226 - DNA, 16 bp, H. sapiens
aaagaattttaaagag

SEQ ID NO: 7227 - DNA, 16 bp, H. sapiens
aaagaattttcacaaa

SEQ ID NO: 7228 - DNA, 16 bp, H. sapiens
aaagaattttcatccc

SEQ ID NO: 7229 - DNA, 16 bp, H. sapiens
aaagaattttcatttt

SEQ ID NO: 7230 - DNA, 16 bp, H. sapiens
aaagaattttggaaat

SEQ ID NO: 7231 - DNA, 16 bp, H. sapiens
aaagaattttgtgttt

SEQ ID NO: 7232 - DNA, 16 bp, H. sapiens
aaagacaaaactatgg

SEQ ID NO: 7233 - DNA, 16 bp, H. sapiens
aaagacaaaagaattt

SEQ ID NO: 7234 - DNA, 16 bp, H. sapiens
aaagacaaaataattt

SEQ ID NO: 7235 - DNA, 16 bp, H. sapiens
aaagacaaaatgaatt

SEQ ID NO: 7236 - DNA, 16 bp, H. sapiens
aaagacaaacattgca

SEQ ID NO: 7237 - DNA, 16 bp, H. sapiens
aaagacaaactggaaa

SEQ ID NO: 7238 - DNA, 16 bp, H. sapiens
aaagacaaacttcata

SEQ ID NO: 7239 - DNA, 16 bp, H. sapiens
aaagacaaactttgca

SEQ ID NO: 7240 - DNA, 16 bp, H. sapiens
aaagacaaactttgta

SEQ ID NO: 7241 - DNA, 16 bp, H. sapiens
aaagacaaacttttca

SEQ ID NO: 7242 - DNA, 16 bp, H. sapiens
aaagacaaagaagatc

SEQ ID NO: 7243 - DNA, 16 bp, H. sapiens
aaagacaaagacatta

SEQ ID NO: 7244 - DNA, 16 bp, H. sapiens
aaagacaaatacttca

SEQ ID NO: 7245 - DNA, 16 bp, H. sapiens
aaagacaaatacttta

SEQ ID NO: 7246 - DNA, 16 bp, H. sapiens
aaagacaaatgcacat

SEQ ID NO: 7247 - DNA, 16 bp, H. sapiens
aaagacaaattttgca

SEQ ID NO: 7248 - DNA, 16 bp, H. sapiens
aaagacaacaagtgtt

SEQ ID NO: 7249 - DNA, 16 bp, H. sapiens
aaagacaacccagaga

SEQ ID NO: 7250 - DNA, 16 bp, H. sapiens
aaagacaacttgaaaa

SEQ ID NO: 7251 - DNA, 16 bp, H. sapiens
aaagacaagaaaatgt

SEQ ID NO: 7252 - DNA, 16 bp, H. sapiens
aaagacaaggaaatgg

SEQ ID NO: 7253 - DNA, 16 bp, H. sapiens
aaagacaaggaatcaa

SEQ ID NO: 7254 - DNA, 16 bp, H. sapiens
aaagacaatcacaact

SEQ ID NO: 7255 - DNA, 16 bp, H. sapiens
aaagacaatcctaagc

SEQ ID NO: 7256 - DNA, 16 bp, H. sapiens
aaagacaattttaaaa

SEQ ID NO: 7257 - DNA, 16 bp, H. sapiens
aaagacaattttactt

SEQ ID NO: 7258 - DNA, 16 bp, H. sapiens
aaagacaatttttttt

SEQ ID NO: 7259 - DNA, 16 bp, H. sapiens
aaagacacaatcaaca

SEQ ID NO: 7260 - DNA, 16 bp, H. sapiens
aaagacacacataaac

SEQ ID NO: 7261 - DNA, 16 bp, H. sapiens
aaagacacagaagcag

SEQ ID NO: 7262 - DNA, 17 bp, H. sapiens
aaagacacatgcacaca

SEQ ID NO: 7263 - DNA, 16 bp, H. sapiens
aaagacacatgcatgt

SEQ ID NO: 7264 - DNA, 16 bp, H. sapiens
aaagacacattaaaat

SEQ ID NO: 7265 - DNA, 16 bp, H. sapiens
aaagacacattataat

SEQ ID NO: 7266 - DNA, 16 bp, H. sapiens
aaagacacattttaaa

SEQ ID NO: 7267 - DNA, 16 bp, H. sapiens
aaagacacatttttct

SEQ ID NO: 7268 - DNA, 16 bp, H. sapiens
aaagacaccactcaaa

SEQ ID NO: 7269 - DNA, 16 bp, H. sapiens
aaagacactcatcact

SEQ ID NO: 7270 - DNA, 16 bp, H. sapiens
aaagacactgtctcaa

SEQ ID NO: 7271 - DNA, 17 bp, H. sapiens
aaagacacttcttacat

SEQ ID NO: 7272 - DNA, 16 bp, H. sapiens
aaagacacttttaaaa

SEQ ID NO: 7273 - DNA, 16 bp, H. sapiens
aaagacagaaaaatgt

SEQ ID NO: 7274 - DNA, 16 bp, H. sapiens
aaagacagaaaatatc

SEQ ID NO: 7275 - DNA, 16 bp, H. sapiens
aaagacagaaatgcca

SEQ ID NO: 7276 - DNA, 16 bp, H. sapiens
aaagacagacacacag

SEQ ID NO: 7277 - DNA, 16 bp, H. sapiens
aaagacaggaaataac

SEQ ID NO: 7278 - DNA, 16 bp, H. sapiens
aaagacagggaataac

SEQ ID NO: 7279 - DNA, 16 bp, H. sapiens
aaagacagggtcttgc

SEQ ID NO: 7280 - DNA, 16 bp, H. sapiens
aaagacagggtttcac

SEQ ID NO: 7281 - DNA, 16 bp, H. sapiens
aaagacagggtttctc

SEQ ID NO: 7282 - DNA, 16 bp, H. sapiens
aaagacaggttttcac

SEQ ID NO: 7283 - DNA, 16 bp, H. sapiens
aaagacagtcttgaat

SEQ ID NO: 7284 - DNA, 16 bp, H. sapiens
aaagacagtgagtgag

SEQ ID NO: 7285 - DNA, 16 bp, H. sapiens
aaagacagttattcaa

SEQ ID NO: 7286 - DNA, 16 bp, H. sapiens
aaagacagtttcaaaa

SEQ ID NO: 7287 - DNA, 16 bp, H. sapiens
aaagacagtttccaaa

SEQ ID NO: 7288 - DNA, 16 bp, H. sapiens
aaagacagtttcttca

SEQ ID NO: 7289 - DNA, 16 bp, H. sapiens
aaagacagttttaaaa

SEQ ID NO: 7290 - DNA, 16 bp, H. sapiens
aaagacagttttaaag

SEQ ID NO: 7291 - DNA, 16 bp, H. sapiens
aaagacagtttttaaa

SEQ ID NO: 7292 - DNA, 16 bp, H. sapiens
aaagacatacaaattt

SEQ ID NO: 7293 - DNA, 16 bp, H. sapiens
aaagacatacccaaga

SEQ ID NO: 7294 - DNA, 16 bp, H. sapiens
aaagacatatgcaaga

SEQ ID NO: 7295 - DNA, 16 bp, H. sapiens
aaagacatattttatt

SEQ ID NO: 7296 - DNA, 16 bp, H. sapiens
aaagacatcaaaagca

SEQ ID NO: 7297 - DNA, 16 bp, H. sapiens
aaagacatgaaaagac

SEQ ID NO: 7298 - DNA, 16 bp, H. sapiens
aaagacatgaaaatta

SEQ ID NO: 7299 - DNA, 16 bp, H. sapiens
aaagacatgaaggcaa

SEQ ID NO: 7300 - DNA, 16 bp, H. sapiens
aaagacatgcccaaga

SEQ ID NO: 7301 - DNA, 16 bp, H. sapiens
aaagacatggaataaa

SEQ ID NO: 7302 - DNA, 16 bp, H. sapiens
aaagacatggaggaaa

SEQ ID NO: 7303 - DNA, 16 bp, H. sapiens
aaagacatgtgaaaaa

SEQ ID NO: 7304 - DNA, 16 bp, H. sapiens
aaagacattattttat

SEQ ID NO: 7305 - DNA, 16 bp, H. sapiens
aaagacattcaacaaa

SEQ ID NO: 7306 - DNA, 16 bp, H. sapiens
aaagacatttatgtgg

SEQ ID NO: 7307 - DNA, 16 bp, H. sapiens
aaagacatttcaaata

SEQ ID NO: 7308 - DNA, 16 bp, H. sapiens
aaagacatttcttttt

SEQ ID NO: 7309 - DNA, 16 bp, H. sapiens
aaagacattttatttt

SEQ ID NO: 7310 - DNA, 16 bp, H. sapiens
aaagacattttctgtt

SEQ ID NO: 7311 - DNA, 16 bp, H. sapiens
aaagacattttcttct

SEQ ID NO: 7312 - DNA, 16 bp, H. sapiens
aaagacatttttaaaa

SEQ ID NO: 7313 - DNA, 16 bp, H. sapiens
aaagacatttttattt

SEQ ID NO: 7314 - DNA, 16 bp, H. sapiens
aaagaccacatatttt

SEQ ID NO: 7315 - DNA, 16 bp, H. sapiens
aaagaccacattcaca

SEQ ID NO: 7316 - DNA, 16 bp, H. sapiens
aaagaccagcttgggc

SEQ ID NO: 7317 - DNA, 16 bp, H. sapiens
aaagaccatgtgaaga

SEQ ID NO: 7318 - DNA, 16 bp, H. sapiens
aaagacccagaatagc

SEQ ID NO: 7319 - DNA, 16 bp, H. sapiens
aaagacccagaatggc

SEQ ID NO: 7320 - DNA, 29 bp, H. sapiens
aaagacccatcagtgtgctgtattcagga

SEQ ID NO: 7321 - DNA, 16 bp, H. sapiens
aaagaccccacctctt

SEQ ID NO: 7322 - DNA, 16 bp, H. sapiens
aaagaccctattttca

SEQ ID NO: 7323 - DNA, 16 bp, H. sapiens
aaagaccctgtctcaa

SEQ ID NO: 7324 - DNA, 16 bp, H. sapiens
aaagaccctgtctcta

SEQ ID NO: 7325 - DNA, 16 bp, H. sapiens
aaagaccctgttttca

SEQ ID NO: 7326 - DNA, 16 bp, H. sapiens
aaagacctcattttaa

SEQ ID NO: 7327 - DNA, 16 bp, H. sapiens
aaagacctgaaggaag

SEQ ID NO: 7328 - DNA, 16 bp, H. sapiens
aaagacctgaaggaga

SEQ ID NO: 7329 - DNA, 16 bp, H. sapiens
aaagacctggaatcaa

SEQ ID NO: 7330 - DNA, 16 bp, H. sapiens
aaagacggggtttcac

SEQ ID NO: 7331 - DNA, 16 bp, H. sapiens
aaagactaaaatattt

SEQ ID NO: 7332 - DNA, 16 bp, H. sapiens
aaagactaaataatga

SEQ ID NO: 7333 - DNA, 16 bp, H. sapiens
aaagactaaatgagat

SEQ ID NO: 7334 - DNA, 16 bp, H. sapiens
aaagactacatattgg

SEQ ID NO: 7335 - DNA, 16 bp, H. sapiens
aaagactagaaggaaa

SEQ ID NO: 7336 - DNA, 16 bp, H. sapiens
aaagactatcctttcc

SEQ ID NO: 7337 - DNA, 16 bp, H. sapiens
aaagactattatttcc

SEQ ID NO: 7338 - DNA, 16 bp, H. sapiens
aaagactatttcaaaa

SEQ ID NO: 7339 - DNA, 16 bp, H. sapiens
aaagactcaataaata

SEQ ID NO: 7340 - DNA, 17 bp, H. sapiens
aaagactccatctcaaa

SEQ ID NO: 7341 - DNA, 16 bp, H. sapiens
aaagactcctccaaaa

SEQ ID NO: 7342 - DNA, 16 bp, H. sapiens
aaagactgaaaatttt

SEQ ID NO: 7343 - DNA, 16 bp, H. sapiens
aaagactgaaatcttt

SEQ ID NO: 7344 - DNA, 16 bp, H. sapiens
aaagactgaagaaaca

SEQ ID NO: 7345 - DNA, 16 bp, H. sapiens
aaagactgtaaaaaga

SEQ ID NO: 7346 - DNA, 16 bp, H. sapiens
aaagactgtctcaaaa

SEQ ID NO: 7347 - DNA, 16 bp, H. sapiens
aaagactgtggcttcc

SEQ ID NO: 7348 - DNA, 16 bp, H. sapiens
aaagactgtttccaac

SEQ ID NO: 7349 - DNA, 16 bp, H. sapiens
aaagactgtttgcaaa

SEQ ID NO: 7350 - DNA, 16 bp, H. sapiens
aaagacttaaaggtaa

SEQ ID NO: 7351 - DNA, 16 bp, H. sapiens
aaagacttaaatatga

SEQ ID NO: 7352 - DNA, 16 bp, H. sapiens
aaagacttaaatgtaa

SEQ ID NO: 7353 - DNA, 16 bp, H. sapiens
aaagacttaaatgtca

SEQ ID NO: 7354 - DNA, 16 bp, H. sapiens
aaagacttaaatttaa

SEQ ID NO: 7355 - DNA, 17 bp, H. sapiens
aaagacttcatgatgaa

SEQ ID NO: 7356 - DNA, 16 bp, H. sapiens
aaagacttcattttaa

SEQ ID NO: 7357 - DNA, 16 bp, H. sapiens
aaagacttctgaaatg

SEQ ID NO: 7358 - DNA, 16 bp, H. sapiens
aaagacttcttgagca

SEQ ID NO: 7359 - DNA, 16 bp, H. sapiens
aaagacttgaaagaag

SEQ ID NO: 7360 - DNA, 16 bp, H. sapiens
aaagacttgaaggaaa

SEQ ID NO: 7361 - DNA, 16 bp, H. sapiens
aaagacttgaaggaga

SEQ ID NO: 7362 - DNA, 16 bp, H. sapiens
aaagacttggaacaaa

SEQ ID NO: 7363 - DNA, 16 bp, H. sapiens
aaagactttaaaacaa

SEQ ID NO: 7364 - DNA, 16 bp, H. sapiens
aaagactttatatttt

SEQ ID NO: 7365 - DNA, 16 bp, H. sapiens
aaagactttcagcttt

SEQ ID NO: 7366 - DNA, 16 bp, H. sapiens
aaagactttggctttt

SEQ ID NO: 7367 - DNA, 16 bp, H. sapiens
aaagacttttagtttt

SEQ ID NO: 7368 - DNA, 16 bp, H. sapiens
aaagactttttaaaaa

SEQ ID NO: 7369 - DNA, 16 bp, H. sapiens
aaagagaaaaagactt

SEQ ID NO: 7370 - DNA, 16 bp, H. sapiens
aaagagaaaagaatgc

SEQ ID NO: 7371 - DNA, 16 bp, H. sapiens
aaagagaaaatatgca

SEQ ID NO: 7372 - DNA, 16 bp, H. sapiens
aaagagaaaatgcttt

SEQ ID NO: 7373 - DNA, 16 bp, H. sapiens
aaagagaaaatgtatt

SEQ ID NO: 7374 - DNA, 16 bp, H. sapiens
aaagagaaacagcttc

SEQ ID NO: 7375 - DNA, 16 bp, H. sapiens
aaagagaaactctgtc

SEQ ID NO: 7376 - DNA, 16 bp, H. sapiens
aaagagaaactggagg

SEQ ID NO: 7377 - DNA, 16 bp, H. sapiens
aaagagaaagaaactt

SEQ ID NO: 7378 - DNA, 16 bp, H. sapiens
aaagagaaagaatcag

SEQ ID NO: 7379 - DNA, 16 bp, H. sapiens
aaagagaaagattatt

SEQ ID NO: 7380 - DNA, 16 bp, H. sapiens
aaagagaaagcagctg

SEQ ID NO: 7381 - DNA, 16 bp, H. sapiens
aaagagaaagtcaaat

SEQ ID NO: 7382 - DNA, 16 bp, H. sapiens
aaagagaaatatttca

SEQ ID NO: 7383 - DNA, 16 bp, H. sapiens
aaagagaaatgttttc

SEQ ID NO: 7384 - DNA, 16 bp, H. sapiens
aaagagaaattctgga

SEQ ID NO: 7385 - DNA, 16 bp, H. sapiens
aaagagaactttaaaa

SEQ ID NO: 7386 - DNA, 16 bp, H. sapiens
aaagagaagaaaattc

SEQ ID NO: 7387 - DNA, 16 bp, H. sapiens
aaagagaagaagtcaa

SEQ ID NO: 7388 - DNA, 16 bp, H. sapiens
aaagagaagaatcaag

SEQ ID NO: 7389 - DNA, 16 bp, H. sapiens
aaagagaagactgaaa

SEQ ID NO: 7390 - DNA, 16 bp, H. sapiens
aaagagaagagtcaca

SEQ ID NO: 7391 - DNA, 16 bp, H. sapiens
aaagagaagatggagc

SEQ ID NO: 7392 - DNA, 16 bp, H. sapiens
aaagagaagcagcagc

SEQ ID NO: 7393 - DNA, 16 bp, H. sapiens
aaagagaagccacaga

SEQ ID NO: 7394 - DNA, 16 bp, H. sapiens
aaagagaagcccagga

SEQ ID NO: 7395 - DNA, 16 bp, H. sapiens
aaagagaaggaaattc

SEQ ID NO: 7396 - DNA, 16 bp, H. sapiens
aaagagaagttttttt

SEQ ID NO: 7397 - DNA, 16 bp, H. sapiens
aaagagaatacatttt

SEQ ID NO: 7398 - DNA, 16 bp, H. sapiens
aaagagaatatcccag

SEQ ID NO: 7399 - DNA, 16 bp, H. sapiens
aaagagaatattattt

SEQ ID NO: 7400 - DNA, 16 bp, H. sapiens
aaagagaatgaaatca

SEQ ID NO: 7401 - DNA, 16 bp, H. sapiens
aaagagaatgagacag

SEQ ID NO: 7402 - DNA, 16 bp, H. sapiens
aaagagaattttatac

SEQ ID NO: 7403 - DNA, 16 bp, H. sapiens
aaagagaattttattt

SEQ ID NO: 7404 - DNA, 16 bp, H. sapiens
aaagagacaaaaattt

SEQ ID NO: 7405 - DNA, 16 bp, H. sapiens
aaagagacaaatggaa

SEQ ID NO: 7406 - DNA, 16 bp, H. sapiens
aaagagacagaaatta

SEQ ID NO: 7407 - DNA, 16 bp, H. sapiens
aaagagacagacagac

SEQ ID NO: 7408 - DNA, 16 bp, H. sapiens
aaagagacagggtctc

SEQ ID NO: 7409 - DNA, 16 bp, H. sapiens
aaagagaccaaattta

SEQ ID NO: 7410 - DNA, 16 bp, H. sapiens
aaagagacccagagag

SEQ ID NO: 7411 - DNA, 17 bp, H. sapiens
aaagagactagtggcat

SEQ ID NO: 7412 - DNA, 20 bp, H. sapiens
aaagagacttagactcccaa

SEQ ID NO: 7413 - DNA, 20 bp, H. sapiens
aaagagacttagactcccat

SEQ ID NO: 7414 - DNA, 16 bp, H. sapiens
aaagagacttcagaga

SEQ ID NO: 7415 - DNA, 16 bp, H. sapiens
aaagagagaagaatcc

SEQ ID NO: 7416 - DNA, 16 bp, H. sapiens
aaagagagaagaatct

SEQ ID NO: 7417 - DNA, 16 bp, H. sapiens
aaagagagaagatcca

SEQ ID NO: 7418 - DNA, 18 bp, H. sapiens
aaagagagaatcctccct

SEQ ID NO: 7419 - DNA, 16 bp, H. sapiens
aaagagagaccccatc

SEQ ID NO: 7420 - DNA, 16 bp, H. sapiens
aaagagagagaatatt

SEQ ID NO: 7421 - DNA, 16 bp, H. sapiens
aaagagagagcttgtg

SEQ ID NO: 7422 - DNA, 16 bp, H. sapiens
aaagagagaggatcca

SEQ ID NO: 7423 - DNA, 16 bp, H. sapiens
aaagagagcaggggtg

SEQ ID NO: 7424 - DNA, 16 bp, H. sapiens
aaagagaggaaatcag

SEQ ID NO: 7425 - DNA, 16 bp, H. sapiens
aaagagagtaaaatac

SEQ ID NO: 7426 - DNA, 16 bp, H. sapiens
aaagagagtcagagaa

SEQ ID NO: 7427 - DNA, 16 bp, H. sapiens
aaagagatgaacattt

SEQ ID NO: 7428 - DNA, 16 bp, H. sapiens
aaagagatgctggatt

SEQ ID NO: 7429 - DNA, 16 bp, H. sapiens
aaagagatttgagaaa

SEQ ID NO: 7430 - DNA, 16 bp, H. sapiens
aaagagatttgtaaaa

SEQ ID NO: 7431 - DNA, 16 bp, H. sapiens
aaagagcaaaactctg

SEQ ID NO: 7432 - DNA, 16 bp, H. sapiens
aaagagcaaaattcca

SEQ ID NO: 7433 - DNA, 16 bp, H. sapiens
aaagagcaaatctaag

SEQ ID NO: 7434 - DNA, 16 bp, H. sapiens
aaagagcaaccccaag

SEQ ID NO: 7435 - DNA, 16 bp, H. sapiens
aaagagcaagtcaaat

SEQ ID NO: 7436 - DNA, 16 bp, H. sapiens
aaagagcaataaaatt

SEQ ID NO: 7437 - DNA, 18 bp, H. sapiens
aaagagcaggaggacagg

SEQ ID NO: 7438 - DNA, 16 bp, H. sapiens
aaagagcatctatgaa

SEQ ID NO: 7439 - DNA, 16 bp, H. sapiens
aaagagcccaaacagc

SEQ ID NO: 7440 - DNA, 16 bp, H. sapiens
aaagagccctggctga

SEQ ID NO: 7441 - DNA, 16 bp, H. sapiens
aaagagcctgaagagc

SEQ ID NO: 7442 - DNA, 16 bp, H. sapiens
aaagagcctggcacct

SEQ ID NO: 7443 - DNA, 16 bp, H. sapiens
aaagagctaaaggaaa

SEQ ID NO: 7444 - DNA, 16 bp, H. sapiens
aaagagctaatgcatg

SEQ ID NO: 7445 - DNA, 16 bp, H. sapiens
aaagagctccagaaat

SEQ ID NO: 7446 - DNA, 16 bp, H. sapiens
aaagagctcccaaatg

SEQ ID NO: 7447 - DNA, 16 bp, H. sapiens
aaagagctctggagag

SEQ ID NO: 7448 - DNA, 16 bp, H. sapiens
aaagagctcttagaaa

SEQ ID NO: 7449 - DNA, 16 bp, H. sapiens
aaagagctcttggaaa

SEQ ID NO: 7450 - DNA, 16 bp, H. sapiens
aaagagcttagaacag

SEQ ID NO: 7451 - DNA, 16 bp, H. sapiens
aaagagcttcaaaata

SEQ ID NO: 7452 - DNA, 16 bp, H. sapiens
aaagagctttgtaaat

SEQ ID NO: 7453 - DNA, 16 bp, H. sapiens
aaagagcttttaaaaa

SEQ ID NO: 7454 - DNA, 16 bp, H. sapiens
aaagaggaaaatttat

SEQ ID NO: 7455 - DNA, 16 bp, H. sapiens
aaagaggaaactgaga

SEQ ID NO: 7456 - DNA, 16 bp, H. sapiens
aaagaggaaacttcca

SEQ ID NO: 7457 - DNA, 16 bp, H. sapiens
aaagaggaactgaaga

SEQ ID NO: 7458 - DNA, 16 bp, H. sapiens
aaagaggaagcaggca

SEQ ID NO: 7459 - DNA, 16 bp, H. sapiens
aaagaggaagccaaac

SEQ ID NO: 7460 - DNA, 17 bp, H. sapiens
aaagaggaagtcaaact

SEQ ID NO: 7461 - DNA, 16 bp, H. sapiens
aaagaggaagtcagat

SEQ ID NO: 7462 - DNA, 16 bp, H. sapiens
aaagaggaagtgaaac

SEQ ID NO: 7463 - DNA, 16 bp, H. sapiens
aaagaggaattttaca

SEQ ID NO: 7464 - DNA, 16 bp, H. sapiens
aaagaggaattttttt

SEQ ID NO: 7465 - DNA, 16 bp, H. sapiens
aaagaggactgagaaa

SEQ ID NO: 7466 - DNA, 16 bp, H. sapiens
aaagaggagcaggaca

SEQ ID NO: 7467 - DNA, 16 bp, H. sapiens
aaagaggagctgatac

SEQ ID NO: 7468 - DNA, 16 bp, H. sapiens
aaagaggatcaggaaa

SEQ ID NO: 7469 - DNA, 16 bp, H. sapiens
aaagaggatgagttca

SEQ ID NO: 7470 - DNA, 16 bp, H. sapiens
aaagaggatgtcaaat

SEQ ID NO: 7471 - DNA, 16 bp, H. sapiens
aaagaggattttaaat

SEQ ID NO: 7472 - DNA, 16 bp, H. sapiens
aaagaggcaatcagat

SEQ ID NO: 7473 - DNA, 16 bp, H. sapiens
aaagaggcactgaaaa

SEQ ID NO: 7474 - DNA, 16 bp, H. sapiens
aaagaggcactgaaga

SEQ ID NO: 7475 - DNA, 16 bp, H. sapiens
aaagaggcaggggctg

SEQ ID NO: 7476 - DNA, 16 bp, H. sapiens
aaagaggccccaggga

SEQ ID NO: 7477 - DNA, 16 bp, H. sapiens
aaagaggcctgagaga

SEQ ID NO: 7478 - DNA, 16 bp, H. sapiens
aaagaggctcaccaaa

SEQ ID NO: 7479 - DNA, 16 bp, H. sapiens
aaagaggctcagagag

SEQ ID NO: 7480 - DNA, 16 bp, H. sapiens
aaagaggctgtgtgca

SEQ ID NO: 7481 - DNA, 16 bp, H. sapiens
aaagagggaaatttgg

SEQ ID NO: 7482 - DNA, 16 bp, H. sapiens
aaagagggaagaatca

SEQ ID NO: 7483 - DNA, 16 bp, H. sapiens
aaagagggagtcaaat

SEQ ID NO: 7484 - DNA, 16 bp, H. sapiens
aaagagggatgttcag

SEQ ID NO: 7485 - DNA, 16 bp, H. sapiens
aaagaggtggctggag

SEQ ID NO: 7486 - DNA, 16 bp, H. sapiens
aaagaggttaaataac

SEQ ID NO: 7487 - DNA, 16 bp, H. sapiens
aaagaggtttatgtgg

SEQ ID NO: 7488 - DNA, 16 bp, H. sapiens
aaagaggttttaaaat

SEQ ID NO: 7489 - DNA, 16 bp, H. sapiens
aaagaggtttttaaaa

SEQ ID NO: 7490 - DNA, 16 bp, H. sapiens
aaagagtaaaaatgtt

SEQ ID NO: 7491 - DNA, 16 bp, H. sapiens
aaagagtaaaacattt

SEQ ID NO: 7492 - DNA, 16 bp, H. sapiens
aaagagtcaagatcca

SEQ ID NO: 7493 - DNA, 16 bp, H. sapiens
aaagagtgcttcaaaa

SEQ ID NO: 7494 - DNA, 16 bp, H. sapiens
aaagagtgtttcaaaa

SEQ ID NO: 7495 - DNA, 16 bp, H. sapiens
aaagagtgttttaaaa

SEQ ID NO: 7496 - DNA, 16 bp, H. sapiens
aaagagttgaaaactt

SEQ ID NO: 7497 - DNA, 16 bp, H. sapiens
aaagagtttattcaag

SEQ ID NO: 7498 - DNA, 16 bp, H. sapiens
aaagagtttgaaatat

SEQ ID NO: 7499 - DNA, 16 bp, H. sapiens
aaagagtttttaaaat

SEQ ID NO: 7500 - DNA, 16 bp, H. sapiens
aaagataaaacattta

SEQ ID NO: 7501 - DNA, 16 bp, H. sapiens
aaagataaaatgtttt

SEQ ID NO: 7502 - DNA, 16 bp, H. sapiens
aaagataaacatattt

SEQ ID NO: 7503 - DNA, 16 bp, H. sapiens
aaagataaagtctttt

SEQ ID NO: 7504 - DNA, 16 bp, H. sapiens
aaagataaatactaca

SEQ ID NO: 7505 - DNA, 16 bp, H. sapiens
aaagataaatatgtga

SEQ ID NO: 7506 - DNA, 16 bp, H. sapiens
aaagataaatgtttta

SEQ ID NO: 7507 - DNA, 16 bp, H. sapiens
aaagataaattgtttt

SEQ ID NO: 7508 - DNA, 16 bp, H. sapiens
aaagataataaatcat

SEQ ID NO: 7509 - DNA, 16 bp, H. sapiens
aaagataatttagttt

SEQ ID NO: 7510 - DNA, 16 bp, H. sapiens
aaagataatttctttt

SEQ ID NO: 7511 - DNA, 16 bp, H. sapiens
aaagatacaaagaagg

SEQ ID NO: 7512 - DNA, 16 bp, H. sapiens
aaagatacagattggc

SEQ ID NO: 7513 - DNA, 16 bp, H. sapiens
aaagatacataaatat

SEQ ID NO: 7514 - DNA, 16 bp, H. sapiens
aaagatacattttttt

SEQ ID NO: 7515 - DNA, 16 bp, H. sapiens
aaagataccaagaaca

SEQ ID NO: 7516 - DNA, 16 bp, H. sapiens
aaagatacccaggaat

SEQ ID NO: 7517 - DNA, 16 bp, H. sapiens
aaagatacctgaagat

SEQ ID NO: 7518 - DNA, 16 bp, H. sapiens
aaagatacctgcacat

SEQ ID NO: 7519 - DNA, 16 bp, H. sapiens
aaagataccttaaaat

SEQ ID NO: 7520 - DNA, 16 bp, H. sapiens
aaagatactgttaaga

SEQ ID NO: 7521 - DNA, 16 bp, H. sapiens
aaagatacttaaaaat

SEQ ID NO: 7522 - DNA, 16 bp, H. sapiens
aaagatactttaaaat

SEQ ID NO: 7523 - DNA, 16 bp, H. sapiens
aaagatagatagatag

SEQ ID NO: 7524 - DNA, 16 bp, H. sapiens
aaagatagttttattt

SEQ ID NO: 7525 - DNA, 16 bp, H. sapiens
aaagatagttttgctg

SEQ ID NO: 7526 - DNA, 16 bp, H. sapiens
aaagatataaaaggca

SEQ ID NO: 7527 - DNA, 16 bp, H. sapiens
aaagatatacattaaa

SEQ ID NO: 7528 - DNA, 16 bp, H. sapiens
aaagatatctaaaaat

SEQ ID NO: 7529 - DNA, 16 bp, H. sapiens
aaagatatctgcactc

SEQ ID NO: 7530 - DNA, 16 bp, H. sapiens
aaagatatggaatcaa

SEQ ID NO: 7531 - DNA, 16 bp, H. sapiens
aaagatatttgttggt

SEQ ID NO: 7532 - DNA, 16 bp, H. sapiens
aaagatattttcctat

SEQ ID NO: 7533 - DNA, 16 bp, H. sapiens
aaagatattttgaaat

SEQ ID NO: 7534 - DNA, 19 bp, H. sapiens
aaagatcaaaagagacaag

SEQ ID NO: 7535 - DNA, 16 bp, H. sapiens
aaagatcaagagacaa

SEQ ID NO: 7536 - DNA, 19 bp, H. sapiens
aaagatcacacacaaggct

SEQ ID NO: 7537 - DNA, 16 bp, H. sapiens
aaagatcacatattgt

SEQ ID NO: 7538 - DNA, 16 bp, H. sapiens
aaagatcagaacagaa

SEQ ID NO: 7539 - DNA, 16 bp, H. sapiens
aaagatcagatggtgg

SEQ ID NO: 7540 - DNA, 16 bp, H. sapiens
aaagatcatcacctag

SEQ ID NO: 7541 - DNA, 16 bp, H. sapiens
aaagatcatctttatt

SEQ ID NO: 7542 - DNA, 16 bp, H. sapiens
aaagatcatgtctttt

SEQ ID NO: 7543 - DNA, 16 bp, H. sapiens
aaagatcattaaaatt

SEQ ID NO: 7544 - DNA, 16 bp, H. sapiens
aaagatcattcaggag

SEQ ID NO: 7545 - DNA, 16 bp, H. sapiens
aaagatccatcttctg

SEQ ID NO: 7546 - DNA, 16 bp, H. sapiens
aaagatctcaaataaa

SEQ ID NO: 7547 - DNA, 16 bp, H. sapiens
aaagatctcaaatcag

SEQ ID NO: 7548 - DNA, 16 bp, H. sapiens
aaagatctgaaagaaa

SEQ ID NO: 7549 - DNA, 16 bp, H. sapiens
aaagatctgaaattga

SEQ ID NO: 7550 - DNA, 16 bp, H. sapiens
aaagatgaaaaacttc

SEQ ID NO: 7551 - DNA, 16 bp, H. sapiens
aaagatgaaaactaca

SEQ ID NO: 7552 - DNA, 16 bp, H. sapiens
aaagatgaaaaggcaa

SEQ ID NO: 7553 - DNA, 16 bp, H. sapiens
aaagatgaaaattcta

SEQ ID NO: 7554 - DNA, 16 bp, H. sapiens
aaagatgaagaaacag

SEQ ID NO: 7555 - DNA, 16 bp, H. sapiens
aaagatgaagactgga

SEQ ID NO: 7556 - DNA, 16 bp, H. sapiens
aaagatgaaggctgga

SEQ ID NO: 7557 - DNA, 16 bp, H. sapiens
aaagatgaagtctcac

SEQ ID NO: 7558 - DNA, 16 bp, H. sapiens
aaagatgaatgagaca

SEQ ID NO: 7559 - DNA, 16 bp, H. sapiens
aaagatgacataaata

SEQ ID NO: 7560 - DNA, 16 bp, H. sapiens
aaagatgactttaaaa

SEQ ID NO: 7561 - DNA, 16 bp, H. sapiens
aaagatgagaaagaac

SEQ ID NO: 7562 - DNA, 16 bp, H. sapiens
aaagatgagaaattat

SEQ ID NO: 7563 - DNA, 16 bp, H. sapiens
aaagatgagaaggagt

SEQ ID NO: 7564 - DNA, 16 bp, H. sapiens
aaagatgaggaagagt

SEQ ID NO: 7565 - DNA, 16 bp, H. sapiens
aaagatgaggagaaac

SEQ ID NO: 7566 - DNA, 16 bp, H. sapiens
aaagatgataaagggg

SEQ ID NO: 7567 - DNA, 16 bp, H. sapiens
aaagatgatatacaaa

SEQ ID NO: 7568 - DNA, 16 bp, H. sapiens
aaagatgatattttaa

SEQ ID NO: 7569 - DNA, 16 bp, H. sapiens
aaagatgattttaaag

SEQ ID NO: 7570 - DNA, 16 bp, H. sapiens
aaagatgcaaaggaaa

SEQ ID NO: 7571 - DNA, 16 bp, H. sapiens
aaagatgcagaaagaa

SEQ ID NO: 7572 - DNA, 16 bp, H. sapiens
aaagatgcaggaaaaa

SEQ ID NO: 7573 - DNA, 16 bp, H. sapiens
aaagatgctcaaagaa

SEQ ID NO: 7574 - DNA, 16 bp, H. sapiens
aaagatgcttatctaa

SEQ ID NO: 7575 - DNA, 16 bp, H. sapiens
aaagatggaatttata

SEQ ID NO: 7576 - DNA, 16 bp, H. sapiens
aaagatggctgcctgc

SEQ ID NO: 7577 - DNA, 16 bp, H. sapiens
aaagatggctttgcag

SEQ ID NO: 7578 - DNA, 16 bp, H. sapiens
aaagatgggaacaaga

SEQ ID NO: 7579 - DNA, 16 bp, H. sapiens
aaagatgggaacaata

SEQ ID NO: 7580 - DNA, 16 bp, H. sapiens
aaagatgggcaaaaga

SEQ ID NO: 7581 - DNA, 16 bp, H. sapiens
aaagatgggcattaca

SEQ ID NO: 7582 - DNA, 16 bp, H. sapiens
aaagatggtcttttca

SEQ ID NO: 7583 - DNA, 16 bp, H. sapiens
aaagatgtattttaaa

SEQ ID NO: 7584 - DNA, 16 bp, H. sapiens
aaagatgtctttaaaa

SEQ ID NO: 7585 - DNA, 16 bp, H. sapiens
aaagatgtgattaaga

SEQ ID NO: 7586 - DNA, 16 bp, H. sapiens
aaagatgtgatttcat

SEQ ID NO: 7587 - DNA, 16 bp, H. sapiens
aaagatgtggaaccaa

SEQ ID NO: 7588 - DNA, 16 bp, H. sapiens
aaagatgtggagaaat

SEQ ID NO: 7589 - DNA, 16 bp, H. sapiens
aaagatgttaaatttt

SEQ ID NO: 7590 - DNA, 23 bp, H. sapiens
aaagatgttctttgaaaccaacc

SEQ ID NO: 7591 - DNA, 16 bp, H. sapiens
aaagatgtttattgca

SEQ ID NO: 7592 - DNA, 16 bp, H. sapiens
aaagatgtttcttttt

SEQ ID NO: 7593 - DNA, 16 bp, H. sapiens
aaagatgttttaaatt

SEQ ID NO: 7594 - DNA, 16 bp, H. sapiens
aaagatgttttccaaa

SEQ ID NO: 7595 - DNA, 16 bp, H. sapiens
aaagattaaaaacatt

SEQ ID NO: 7596 - DNA, 16 bp, H. sapiens
aaagattaaaggaaca

SEQ ID NO: 7597 - DNA, 16 bp, H. sapiens
aaagattaagtaattt

SEQ ID NO: 7598 - DNA, 16 bp, H. sapiens
aaagattatctttttt

SEQ ID NO: 7599 - DNA, 16 bp, H. sapiens
aaagattattaaaaac

SEQ ID NO: 7600 - DNA, 16 bp, H. sapiens
aaagattattcaaaaa

SEQ ID NO: 7601 - DNA, 16 bp, H. sapiens
aaagattatttgaaat

SEQ ID NO: 7602 - DNA, 16 bp, H. sapiens
aaagattatttttctt

SEQ ID NO: 7603 - DNA, 16 bp, H. sapiens
aaagattcaaaattga

SEQ ID NO: 7604 - DNA, 16 bp, H. sapiens
aaagattcatttaaaa

SEQ ID NO: 7605 - DNA, 16 bp, H. sapiens
aaagattcctttttct

SEQ ID NO: 7606 - DNA, 16 bp, H. sapiens
aaagattctagaagat

SEQ ID NO: 7607 - DNA, 16 bp, H. sapiens
aaagattctcagagac

SEQ ID NO: 7608 - DNA, 16 bp, H. sapiens
aaagattcttttaaaa

SEQ ID NO: 7609 - DNA, 16 bp, H. sapiens
aaagattcttttcaaa

SEQ ID NO: 7610 - DNA, 16 bp, H. sapiens
aaagattgtcctttcc

SEQ ID NO: 7611 - DNA, 16 bp, H. sapiens
aaagattgtgtttctg

SEQ ID NO: 7612 - DNA, 16 bp, H. sapiens
aaagatttaaatgtag

SEQ ID NO: 7613 - DNA, 16 bp, H. sapiens
aaagatttcaaataaa

SEQ ID NO: 7614 - DNA, 16 bp, H. sapiens
aaagatttcaaatatt

SEQ ID NO: 7615 - DNA, 16 bp, H. sapiens
aaagatttcacatgaa

SEQ ID NO: 7616 - DNA, 17 bp, H. sapiens
aaagatttcatgacaaa

SEQ ID NO: 7617 - DNA, 16 bp, H. sapiens
aaagatttctctgtag

SEQ ID NO: 7618 - DNA, 16 bp, H. sapiens
aaagatttcttaagta

SEQ ID NO: 7619 - DNA, 16 bp, H. sapiens
aaagatttctttcaaa

SEQ ID NO: 7620 - DNA, 16 bp, H. sapiens
aaagatttctttttaa

SEQ ID NO: 7621 - DNA, 16 bp, H. sapiens
aaagatttcttttttt

SEQ ID NO: 7622 - DNA, 16 bp, H. sapiens
aaagatttggaaaatt

SEQ ID NO: 7623 - DNA, 16 bp, H. sapiens
aaagatttgtttaaat

SEQ ID NO: 7624 - DNA, 16 bp, H. sapiens
aaagattttaaaagga

SEQ ID NO: 7625 - DNA, 17 bp, H. sapiens
aaagattttatgacaaa

SEQ ID NO: 7626 - DNA, 16 bp, H. sapiens
aaagattttatgataa

SEQ ID NO: 7627 - DNA, 16 bp, H. sapiens
aaagattttctatttt

SEQ ID NO: 7628 - DNA, 16 bp, H. sapiens
aaagattttcttctgt

SEQ ID NO: 7629 - DNA, 16 bp, H. sapiens
aaagattttcttcttt

SEQ ID NO: 7630 - DNA, 16 bp, H. sapiens
aaagattttgaatatt

SEQ ID NO: 7631 - DNA, 16 bp, H. sapiens
aaagattttgagatga

SEQ ID NO: 7632 - DNA, 16 bp, H. sapiens
aaagattttgagatgg

SEQ ID NO: 7633 - DNA, 16 bp, H. sapiens
aaagatttttatcttt

SEQ ID NO: 7634 - DNA, 16 bp, H. sapiens
aaagatttttcaaaat

SEQ ID NO: 7635 - DNA, 16 bp, H. sapiens
aaagatttttctattt

SEQ ID NO: 7636 - DNA, 16 bp, H. sapiens
aaagatttttgtgttt

SEQ ID NO: 7637 - DNA, 16 bp, H. sapiens
aaagatttttgtttgc

SEQ ID NO: 7638 - DNA, 16 bp, H. sapiens
aaagatttttttcaaa

SEQ ID NO: 7639 - DNA, 16 bp, H. sapiens
aaagatttttttctct

SEQ ID NO: 7640 - DNA, 16 bp, H. sapiens
aaagcaaaaaatattt

SEQ ID NO: 7641 - DNA, 16 bp, H. sapiens
aaagcaaaaacctgta

SEQ ID NO: 7642 - DNA, 16 bp, H. sapiens
aaagcaaaaatagatg

SEQ ID NO: 7643 - DNA, 16 bp, H. sapiens
aaagcaaaaatggaca

SEQ ID NO: 7644 - DNA, 16 bp, H. sapiens
aaagcaaaaattcaca

SEQ ID NO: 7645 - DNA, 16 bp, H. sapiens
aaagcaaaaatttaca

SEQ ID NO: 7646 - DNA, 16 bp, H. sapiens
aaagcaaaaattttaa

SEQ ID NO: 7647 - DNA, 16 bp, H. sapiens
aaagcaaaacaaattt

SEQ ID NO: 7648 - DNA, 16 bp, H. sapiens
aaagcaaaacagattt

SEQ ID NO: 7649 - DNA, 16 bp, H. sapiens
aaagcaaaaccacaat

SEQ ID NO: 7650 - DNA, 16 bp, H. sapiens
aaagcaaaacctgaaa

SEQ ID NO: 7651 - DNA, 16 bp, H. sapiens
aaagcaaaactgcaaa

SEQ ID NO: 7652 - DNA, 16 bp, H. sapiens
aaagcaaaagaatatt

SEQ ID NO: 7653 - DNA, 16 bp, H. sapiens
aaagcaaaagtggaaa

SEQ ID NO: 7654 - DNA, 16 bp, H. sapiens
aaagcaaaatatttca

SEQ ID NO: 7655 - DNA, 16 bp, H. sapiens
aaagcaaaatatttta

SEQ ID NO: 7656 - DNA, 16 bp, H. sapiens
aaagcaaaatcatttt

SEQ ID NO: 7657 - DNA, 16 bp, H. sapiens
aaagcaaaattatttt

SEQ ID NO: 7658 - DNA, 16 bp, H. sapiens
aaagcaaaatttaaat

SEQ ID NO: 7659 - DNA, 16 bp, H. sapiens
aaagcaaaattttgaa

SEQ ID NO: 7660 - DNA, 16 bp, H. sapiens
aaagcaaacaacttgg

SEQ ID NO: 7661 - DNA, 16 bp, H. sapiens
aaagcaaacattgaaa

SEQ ID NO: 7662 - DNA, 16 bp, H. sapiens
aaagcaaactgaaata

SEQ ID NO: 7663 - DNA, 16 bp, H. sapiens
aaagcaaactggaaaa

SEQ ID NO: 7664 - DNA, 16 bp, H. sapiens
aaagcaaacttttatt

SEQ ID NO: 7665 - DNA, 16 bp, H. sapiens
aaagcaaagaaacatg

SEQ ID NO: 7666 - DNA, 16 bp, H. sapiens
aaagcaaaggaaaatg

SEQ ID NO: 7667 - DNA, 16 bp, H. sapiens
aaagcaaagtacagaa

SEQ ID NO: 7668 - DNA, 16 bp, H. sapiens
aaagcaaagttttaaa

SEQ ID NO: 7669 - DNA, 16 bp, H. sapiens
aaagcaaataagtaat

SEQ ID NO: 7670 - DNA, 16 bp, H. sapiens
aaagcaaataattttt

SEQ ID NO: 7671 - DNA, 16 bp, H. sapiens
aaagcaaatatcacat

SEQ ID NO: 7672 - DNA, 16 bp, H. sapiens
aaagcaaatatttctt

SEQ ID NO: 7673 - DNA, 16 bp, H. sapiens
aaagcaaatcaaaact

SEQ ID NO: 7674 - DNA, 16 bp, H. sapiens
aaagcaaatgcaagaa

SEQ ID NO: 7675 - DNA, 16 bp, H. sapiens
aaagcaaatgctgaga

SEQ ID NO: 7676 - DNA, 16 bp, H. sapiens
aaagcaaatgcttcca

SEQ ID NO: 7677 - DNA, 16 bp, H. sapiens
aaagcaaatggaaaag

SEQ ID NO: 7678 - DNA, 16 bp, H. sapiens
aaagcaaattaaaatt

SEQ ID NO: 7679 - DNA, 16 bp, H. sapiens
aaagcaaattattttc

SEQ ID NO: 7680 - DNA, 16 bp, H. sapiens
aaagcaaatttttaaa

SEQ ID NO: 7681 - DNA, 16 bp, H. sapiens
aaagcaacaacagcag

SEQ ID NO: 7682 - DNA, 16 bp, H. sapiens
aaagcaacatggaaaa

SEQ ID NO: 7683 - DNA, 16 bp, H. sapiens
aaagcaagaaaatatg

SEQ ID NO: 7684 - DNA, 16 bp, H. sapiens
aaagcaagaaaatgga

SEQ ID NO: 7685 - DNA, 16 bp, H. sapiens
aaagcaagaccctgtg

SEQ ID NO: 7686 - DNA, 16 bp, H. sapiens
aaagcaagcaggagtg

SEQ ID NO: 7687 - DNA, 16 bp, H. sapiens
aaagcaagcccttaga

SEQ ID NO: 7688 - DNA, 16 bp, H. sapiens
aaagcaaggaaataat

SEQ ID NO: 7689 - DNA, 16 bp, H. sapiens
aaagcaagggcaacaa

SEQ ID NO: 7690 - DNA, 16 bp, H. sapiens
aaagcaagtagaagaa

SEQ ID NO: 7691 - DNA, 16 bp, H. sapiens
aaagcaagtcatatgg

SEQ ID NO: 7692 - DNA, 16 bp, H. sapiens
aaagcaagtgaagaaa

SEQ ID NO: 7693 - DNA, 16 bp, H. sapiens
aaagcaataaatattt

SEQ ID NO: 7694 - DNA, 16 bp, H. sapiens
aaagcaataaatgtaa

SEQ ID NO: 7695 - DNA, 16 bp, H. sapiens
aaagcaatagcatcaa

SEQ ID NO: 7696 - DNA, 16 bp, H. sapiens
aaagcaatccagaaaa

SEQ ID NO: 7697 - DNA, 16 bp, H. sapiens
aaagcaatctacagat

SEQ ID NO: 7698 - DNA, 16 bp, H. sapiens
aaagcaattatttaaa

SEQ ID NO: 7699 - DNA, 16 bp, H. sapiens
aaagcaattcaataaa

SEQ ID NO: 7700 - DNA, 18 bp, H. sapiens
aaagcaattgcaacaaaa

SEQ ID NO: 7701 - DNA, 16 bp, H. sapiens
aaagcaatttaaaaag

SEQ ID NO: 7702 - DNA, 16 bp, H. sapiens
aaagcaattttcaaaa

SEQ ID NO: 7703 - DNA, 16 bp, H. sapiens
aaagcacaagcaataa

SEQ ID NO: 7704 - DNA, 16 bp, H. sapiens
aaagcacagaggattt

SEQ ID NO: 7705 - DNA, 16 bp, H. sapiens
aaagcacaggcaacca

SEQ ID NO: 7706 - DNA, 16 bp, H. sapiens
aaagcacaggcagagt

SEQ ID NO: 7707 - DNA, 16 bp, H. sapiens
aaagcacagggaacaa

SEQ ID NO: 7708 - DNA, 16 bp, H. sapiens
aaagcacagtaaggaa

SEQ ID NO: 7709 - DNA, 16 bp, H. sapiens
aaagcacatttattaa

SEQ ID NO: 7710 - DNA, 16 bp, H. sapiens
aaagcacattttaaaa

SEQ ID NO: 7711 - DNA, 16 bp, H. sapiens
aaagcaccacagactg

SEQ ID NO: 7712 - DNA, 16 bp, H. sapiens
aaagcaccataagttc

SEQ ID NO: 7713 - DNA, 16 bp, H. sapiens
aaagcactaggattac

SEQ ID NO: 7714 - DNA, 16 bp, H. sapiens
aaagcactctaaatat

SEQ ID NO: 7715 - DNA, 16 bp, H. sapiens
aaagcactgagaacag

SEQ ID NO: 7716 - DNA, 16 bp, H. sapiens
aaagcactgctgaaag

SEQ ID NO: 7717 - DNA, 16 bp, H. sapiens
aaagcactgggattat

SEQ ID NO: 7718 - DNA, 16 bp, H. sapiens
aaagcacttagaacag

SEQ ID NO: 7719 - DNA, 16 bp, H. sapiens
aaagcacttagaatag

SEQ ID NO: 7720 - DNA, 16 bp, H. sapiens
aaagcacttgaaaaaa

SEQ ID NO: 7721 - DNA, 16 bp, H. sapiens
aaagcactttgtaaac

SEQ ID NO: 7722 - DNA, 16 bp, H. sapiens
aaagcactttgtaaat

SEQ ID NO: 7723 - DNA, 16 bp, H. sapiens
aaagcactttttaaaa

SEQ ID NO: 7724 - DNA, 16 bp, H. sapiens
aaagcagaaaaagcat

SEQ ID NO: 7725 - DNA, 16 bp, H. sapiens
aaagcagaaaataatt

SEQ ID NO: 7726 - DNA, 16 bp, H. sapiens
aaagcagaaactgaaa

SEQ ID NO: 7727 - DNA, 16 bp, H. sapiens
aaagcagaaagctttt

SEQ ID NO: 7728 - DNA, 16 bp, H. sapiens
aaagcagaaatatttt

SEQ ID NO: 7729 - DNA, 16 bp, H. sapiens
aaagcagaaatgcaaa

SEQ ID NO: 7730 - DNA, 16 bp, H. sapiens
aaagcagaaatggaaa

SEQ ID NO: 7731 - DNA, 16 bp, H. sapiens
aaagcagaaattgaca

SEQ ID NO: 7732 - DNA, 16 bp, H. sapiens
aaagcagaaatttaaa

SEQ ID NO: 7733 - DNA, 16 bp, H. sapiens
aaagcagaaattttta

SEQ ID NO: 7734 - DNA, 16 bp, H. sapiens
aaagcagaagagttta

SEQ ID NO: 7735 - DNA, 16 bp, H. sapiens
aaagcagaagctgcca

SEQ ID NO: 7736 - DNA, 16 bp, H. sapiens
aaagcagaatttattt

SEQ ID NO: 7737 - DNA, 16 bp, H. sapiens
aaagcagacatttatg

SEQ ID NO: 7738 - DNA, 16 bp, H. sapiens
aaagcagagaatagaa

SEQ ID NO: 7739 - DNA, 16 bp, H. sapiens
aaagcagagagaaaat

SEQ ID NO: 7740 - DNA, 16 bp, H. sapiens
aaagcagatatacaaa

SEQ ID NO: 7741 - DNA, 16 bp, H. sapiens
aaagcagattttaaaa

SEQ ID NO: 7742 - DNA, 16 bp, H. sapiens
aaagcagcaagagaca

SEQ ID NO: 7743 - DNA, 16 bp, H. sapiens
aaagcagccacagaca

SEQ ID NO: 7744 - DNA, 16 bp, H. sapiens
aaagcagccagaggaa

SEQ ID NO: 7745 - DNA, 16 bp, H. sapiens
aaagcagccaggaagc

SEQ ID NO: 7746 - DNA, 16 bp, H. sapiens
aaagcagccaggaagg

SEQ ID NO: 7747 - DNA, 16 bp, H. sapiens
aaagcagccatagaca

SEQ ID NO: 7748 - DNA, 16 bp, H. sapiens
aaagcagcctgaaaaa

SEQ ID NO: 7749 - DNA, 16 bp, H. sapiens
aaagcagctattttga

SEQ ID NO: 7750 - DNA, 16 bp, H. sapiens
aaagcagctgttataa

SEQ ID NO: 7751 - DNA, 16 bp, H. sapiens
aaagcaggaaagattt

SEQ ID NO: 7752 - DNA, 16 bp, H. sapiens
aaagcaggaaatatcc

SEQ ID NO: 7753 - DNA, 16 bp, H. sapiens
aaagcagggaacagag

SEQ ID NO: 7754 - DNA, 16 bp, H. sapiens
aaagcagggactcaaa

SEQ ID NO: 7755 - DNA, 16 bp, H. sapiens
aaagcaggggtcccca

SEQ ID NO: 7756 - DNA, 16 bp, H. sapiens
aaagcaggttataaaa

SEQ ID NO: 7757 - DNA, 16 bp, H. sapiens
aaagcagtatggagat

SEQ ID NO: 7758 - DNA, 16 bp, H. sapiens
aaagcagtcagaaaaa

SEQ ID NO: 7759 - DNA, 16 bp, H. sapiens
aaagcagtctacagat

SEQ ID NO: 7760 - DNA, 16 bp, H. sapiens
aaagcagtctgtagag

SEQ ID NO: 7761 - DNA, 16 bp, H. sapiens
aaagcagtgctaacag

SEQ ID NO: 7762 - DNA, 16 bp, H. sapiens
aaagcagtgtgaagag

SEQ ID NO: 7763 - DNA, 16 bp, H. sapiens
aaagcagtgtgcagag

SEQ ID NO: 7764 - DNA, 16 bp, H. sapiens
aaagcagtgttaaaag

SEQ ID NO: 7765 - DNA, 16 bp, H. sapiens
aaagcagtgttaagaa

SEQ ID NO: 7766 - DNA, 16 bp, H. sapiens
aaagcagtgtttacag

SEQ ID NO: 7767 - DNA, 16 bp, H. sapiens
aaagcagtgtttagag

SEQ ID NO: 7768 - DNA, 16 bp, H. sapiens
aaagcagtgtttttca

SEQ ID NO: 7769 - DNA, 16 bp, H. sapiens
aaagcagttacacaga

SEQ ID NO: 7770 - DNA, 16 bp, H. sapiens
aaagcagtttaacaga

SEQ ID NO: 7771 - DNA, 16 bp, H. sapiens
aaagcagtttctgaaa

SEQ ID NO: 7772 - DNA, 16 bp, H. sapiens
aaagcagtttgcagat

SEQ ID NO: 7773 - DNA, 16 bp, H. sapiens
aaagcagttttaattt

SEQ ID NO: 7774 - DNA, 16 bp, H. sapiens
aaagcagtttttaaaa

SEQ ID NO: 7775 - DNA, 16 bp, H. sapiens
aaagcagttttttttt

SEQ ID NO: 7776 - DNA, 16 bp, H. sapiens
aaagcataaaatattt

SEQ ID NO: 7777 - DNA, 16 bp, H. sapiens
aaagcataattatttt

SEQ ID NO: 7778 - DNA, 16 bp, H. sapiens
aaagcatacatttttt

SEQ ID NO: 7779 - DNA, 16 bp, H. sapiens
aaagcataggagaaaa

SEQ ID NO: 7780 - DNA, 16 bp, H. sapiens
aaagcatatttaaaag

SEQ ID NO: 7781 - DNA, 16 bp, H. sapiens
aaagcatatttaaaga

SEQ ID NO: 7782 - DNA, 16 bp, H. sapiens
aaagcatattttaaaa

SEQ ID NO: 7783 - DNA, 16 bp, H. sapiens
aaagcatattttaaag

SEQ ID NO: 7784 - DNA, 16 bp, H. sapiens
aaagcatattttattt

SEQ ID NO: 7785 - DNA, 16 bp, H. sapiens
aaagcatcagaaaaat

SEQ ID NO: 7786 - DNA, 16 bp, H. sapiens
aaagcatcagataacc

SEQ ID NO: 7787 - DNA, 16 bp, H. sapiens
aaagcatcagtgattt

SEQ ID NO: 7788 - DNA, 16 bp, H. sapiens
aaagcatctggaaata

SEQ ID NO: 7789 - DNA, 16 bp, H. sapiens
aaagcatctttgaaaa

SEQ ID NO: 7790 - DNA, 16 bp, H. sapiens
aaagcatgtgttgaaa

SEQ ID NO: 7791 - DNA, 16 bp, H. sapiens
aaagcattattattat

SEQ ID NO: 7792 - DNA, 16 bp, H. sapiens
aaagcattattttaaa

SEQ ID NO: 7793 - DNA, 16 bp, H. sapiens
aaagcattattttggg

SEQ ID NO: 7794 - DNA, 16 bp, H. sapiens
aaagcattcaggatgt

SEQ ID NO: 7795 - DNA, 16 bp, H. sapiens
aaagcattccaaatat

SEQ ID NO: 7796 - DNA, 16 bp, H. sapiens
aaagcattccaacaaa

SEQ ID NO: 7797 - DNA, 16 bp, H. sapiens
aaagcattcctataca

SEQ ID NO: 7798 - DNA, 16 bp, H. sapiens
aaagcatttattttta

SEQ ID NO: 7799 - DNA, 16 bp, H. sapiens
aaagcatttctgaaaa

SEQ ID NO: 7800 - DNA, 16 bp, H. sapiens
aaagcatttgaaaaaa

SEQ ID NO: 7801 - DNA, 16 bp, H. sapiens
aaagcatttgaggaaa

SEQ ID NO: 7802 - DNA, 16 bp, H. sapiens
aaagcattttaaaatc

SEQ ID NO: 7803 - DNA, 16 bp, H. sapiens
aaagcattttaaatgt

SEQ ID NO: 7804 - DNA, 16 bp, H. sapiens
aaagcattttacaaga

SEQ ID NO: 7805 - DNA, 16 bp, H. sapiens
aaagcattttataaat

SEQ ID NO: 7806 - DNA, 16 bp, H. sapiens
aaagcattttcagaaa

SEQ ID NO: 7807 - DNA, 16 bp, H. sapiens
aaagcattttcatttt

SEQ ID NO: 7808 - DNA, 16 bp, H. sapiens
aaagcattttctcaaa

SEQ ID NO: 7809 - DNA, 16 bp, H. sapiens
aaagcattttctcaga

SEQ ID NO: 7810 - DNA, 16 bp, H. sapiens
aaagcattttctttct

SEQ ID NO: 7811 - DNA, 16 bp, H. sapiens
aaagcattttgatttt

SEQ ID NO: 7812 - DNA, 16 bp, H. sapiens
aaagcattttgcattt

SEQ ID NO: 7813 - DNA, 16 bp, H. sapiens
aaagcatttttatttc

SEQ ID NO: 7814 - DNA, 16 bp, H. sapiens
aaagcattttttaaaa

SEQ ID NO: 7815 - DNA, 16 bp, H. sapiens
aaagcatttttttcta

SEQ ID NO: 7816 - DNA, 16 bp, H. sapiens
aaagccaaaaaatatt

SEQ ID NO: 7817 - DNA, 16 bp, H. sapiens
aaagccaaaattaaca

SEQ ID NO: 7818 - DNA, 16 bp, H. sapiens
aaagccaaaattgaga

SEQ ID NO: 7819 - DNA, 16 bp, H. sapiens
aaagccaaagccaaag

SEQ ID NO: 7820 - DNA, 16 bp, H. sapiens
aaagccaaagtttaaa

SEQ ID NO: 7821 - DNA, 16 bp, H. sapiens
aaagccaaatatattt

SEQ ID NO: 7822 - DNA, 16 bp, H. sapiens
aaagccaaatatttac

SEQ ID NO: 7823 - DNA, 16 bp, H. sapiens
aaagccaagcccagcc

SEQ ID NO: 7824 - DNA, 16 bp, H. sapiens
aaagccacagagatgg

SEQ ID NO: 7825 - DNA, 16 bp, H. sapiens
aaagccacagggatgg

SEQ ID NO: 7826 - DNA, 16 bp, H. sapiens
aaagccacctatgaca

SEQ ID NO: 7827 - DNA, 16 bp, H. sapiens
aaagccacttccacat

SEQ ID NO: 7828 - DNA, 16 bp, H. sapiens
aaagccacttctgctt

SEQ ID NO: 7829 - DNA, 16 bp, H. sapiens
aaagccactttaaaaa

SEQ ID NO: 7830 - DNA, 16 bp, H. sapiens
aaagccactttggaaa

SEQ ID NO: 7831 - DNA, 16 bp, H. sapiens
aaagccagactctgtc

SEQ ID NO: 7832 - DNA, 16 bp, H. sapiens
aaagccagcaggctgg

SEQ ID NO: 7833 - DNA, 16 bp, H. sapiens
aaagccagccaggctt

SEQ ID NO: 7834 - DNA, 16 bp, H. sapiens
aaagccaggaacaggg

SEQ ID NO: 7835 - DNA, 16 bp, H. sapiens
aaagccaggcacaaaa

SEQ ID NO: 7836 - DNA, 16 bp, H. sapiens
aaagccaggcacagtg

SEQ ID NO: 7837 - DNA, 16 bp, H. sapiens
aaagccatcaaaaagg

SEQ ID NO: 7838 - DNA, 16 bp, H. sapiens
aaagccatcaggtcct

SEQ ID NO: 7839 - DNA, 16 bp, H. sapiens
aaagccattgaacaag

SEQ ID NO: 7840 - DNA, 16 bp, H. sapiens
aaagccattgaattgt

SEQ ID NO: 7841 - DNA, 16 bp, H. sapiens
aaagccatttaaaaaa

SEQ ID NO: 7842 - DNA, 16 bp, H. sapiens
aaagccattttataaa

SEQ ID NO: 7843 - DNA, 16 bp, H. sapiens
aaagcccagaacctga

SEQ ID NO: 7844 - DNA, 16 bp, H. sapiens
aaagcccaggaccaga

SEQ ID NO: 7845 - DNA, 16 bp, H. sapiens
aaagcccaggacccag

SEQ ID NO: 7846 - DNA, 16 bp, H. sapiens
aaagcccaggatctga

SEQ ID NO: 7847 - DNA, 16 bp, H. sapiens
aaagcccaggcccaga

SEQ ID NO: 7848 - DNA, 16 bp, H. sapiens
aaagccccaagccttg

SEQ ID NO: 7849 - DNA, 16 bp, H. sapiens
aaagcccccacctcct

SEQ ID NO: 7850 - DNA, 17 bp, H. sapiens
aaagccctagaagaaaa

SEQ ID NO: 7851 - DNA, 16 bp, H. sapiens
aaagccctgatttgta

SEQ ID NO: 7852 - DNA, 16 bp, H. sapiens
aaagccctggacccag

SEQ ID NO: 7853 - DNA, 16 bp, H. sapiens
aaagccctgggctcag

SEQ ID NO: 7854 - DNA, 16 bp, H. sapiens
aaagccctggggctcc

SEQ ID NO: 7855 - DNA, 16 bp, H. sapiens
aaagccctgtgaactg

SEQ ID NO: 7856 - DNA, 16 bp, H. sapiens
aaagccctttttaaaa

SEQ ID NO: 7857 - DNA, 16 bp, H. sapiens
aaagcctaatccagag

SEQ ID NO: 7858 - DNA, 16 bp, H. sapiens
aaagcctacagctttt

SEQ ID NO: 7859 - DNA, 16 bp, H. sapiens
aaagcctagaggaaat

SEQ ID NO: 7860 - DNA, 16 bp, H. sapiens
aaagcctatgtgaaaa

SEQ ID NO: 7861 - DNA, 16 bp, H. sapiens
aaagcctattttaaaa

SEQ ID NO: 7862 - DNA, 16 bp, H. sapiens
aaagcctcaaagaaat

SEQ ID NO: 7863 - DNA, 16 bp, H. sapiens
aaagcctcagaaccag

SEQ ID NO: 7864 - DNA, 16 bp, H. sapiens
aaagcctcatcttcag

SEQ ID NO: 7865 - DNA, 25 bp, H. sapiens
aaagcctccaagaaatatgggacta

SEQ ID NO: 7866 - DNA, 40 bp, H. sapiens
aaagcctccaagaaatatgggactatgtgaaaagaccaaa

SEQ ID NO: 7867 - DNA, 16 bp, H. sapiens
aaagcctccaggaaat

SEQ ID NO: 7868 - DNA, 16 bp, H. sapiens
aaagcctgcaagaaat

SEQ ID NO: 7869 - DNA, 16 bp, H. sapiens
aaagcctgcctcccac

SEQ ID NO: 7870 - DNA, 16 bp, H. sapiens
aaagcctgctacctgg

SEQ ID NO: 7871 - DNA, 16 bp, H. sapiens
aaagcctgctgggatt

SEQ ID NO: 7872 - DNA, 16 bp, H. sapiens
aaagcctggatgtcca

SEQ ID NO: 7873 - DNA, 16 bp, H. sapiens
aaagcctgggtgccca

SEQ ID NO: 7874 - DNA, 16 bp, H. sapiens
aaagccttaaaaatat

SEQ ID NO: 7875 - DNA, 16 bp, H. sapiens
aaagccttcaacaaaa

SEQ ID NO: 7876 - DNA, 16 bp, H. sapiens
aaagccttcctttttc

SEQ ID NO: 7877 - DNA, 16 bp, H. sapiens
aaagccttcttctctg

SEQ ID NO: 7878 - DNA, 16 bp, H. sapiens
aaagcctttaagaaat

SEQ ID NO: 7879 - DNA, 16 bp, H. sapiens
aaagcctttcttctaa

SEQ ID NO: 7880 - DNA, 16 bp, H. sapiens
aaagccttttctacat

SEQ ID NO: 7881 - DNA, 16 bp, H. sapiens
aaagccttttgataaa

SEQ ID NO: 7882 - DNA, 16 bp, H. sapiens
aaagcctttttgtttt

SEQ ID NO: 7883 - DNA, 16 bp, H. sapiens
aaagcgagattccatc

SEQ ID NO: 7884 - DNA, 16 bp, H. sapiens
aaagcgagcaggagta

SEQ ID NO: 7885 - DNA, 17 bp, H. sapiens
aaagcgctggggttaca

SEQ ID NO: 7886 - DNA, 16 bp, H. sapiens
aaagcgtgtgtgtgtg

SEQ ID NO: 7887 - DNA, 16 bp, H. sapiens
aaagctactgaaataa

SEQ ID NO: 7888 - DNA, 16 bp, H. sapiens
aaagctagcagaaaac

SEQ ID NO: 7889 - DNA, 17 bp, H. sapiens
aaagctagtagaaggca

SEQ ID NO: 7890 - DNA, 16 bp, H. sapiens
aaagctataaaaatta

SEQ ID NO: 7891 - DNA, 16 bp, H. sapiens
aaagctatagtaaaca

SEQ ID NO: 7892 - DNA, 16 bp, H. sapiens
aaagctatatatattt

SEQ ID NO: 7893 - DNA, 16 bp, H. sapiens
aaagctatatttattt

SEQ ID NO: 7894 - DNA, 16 bp, H. sapiens
aaagctatggtaacca

SEQ ID NO: 7895 - DNA, 16 bp, H. sapiens
aaagctattgaaatta

SEQ ID NO: 7896 - DNA, 16 bp, H. sapiens
aaagctattgtaattt

SEQ ID NO: 7897 - DNA, 16 bp, H. sapiens
aaagctatttaaaaaa

SEQ ID NO: 7898 - DNA, 16 bp, H. sapiens
aaagctatttaaaata

SEQ ID NO: 7899 - DNA, 16 bp, H. sapiens
aaagctatttaaataa

SEQ ID NO: 7900 - DNA, 16 bp, H. sapiens
aaagctatttatttta

SEQ ID NO: 7901 - DNA, 16 bp, H. sapiens
aaagctatttattttt

SEQ ID NO: 7902 - DNA, 16 bp, H. sapiens
aaagctatttttaaaa

SEQ ID NO: 7903 - DNA, 16 bp, H. sapiens
aaagctcaaataaata

SEQ ID NO: 7904 - DNA, 16 bp, H. sapiens
aaagctcaacatcact

SEQ ID NO: 7905 - DNA, 16 bp, H. sapiens
aaagctcaacatccct

SEQ ID NO: 7906 - DNA, 16 bp, H. sapiens
aaagctcagcatcact

SEQ ID NO: 7907 - DNA, 16 bp, H. sapiens
aaagctcagctcaagc

SEQ ID NO: 7908 - DNA, 16 bp, H. sapiens
aaagctcagctccagc

SEQ ID NO: 7909 - DNA, 16 bp, H. sapiens
aaagctcaggacctga

SEQ ID NO: 7910 - DNA, 16 bp, H. sapiens
aaagctcaggcaacaa

SEQ ID NO: 7911 - DNA, 16 bp, H. sapiens
aaagctcatttttaaa

SEQ ID NO: 7912 - DNA, 16 bp, H. sapiens
aaagctccccaggtga

SEQ ID NO: 7913 - DNA, 16 bp, H. sapiens
aaagctcctaaaactg

SEQ ID NO: 7914 - DNA, 16 bp, H. sapiens
aaagctctgatggaga

SEQ ID NO: 7915 - DNA, 17 bp, H. sapiens
aaagctctgttgacatt

SEQ ID NO: 7916 - DNA, 16 bp, H. sapiens
aaagctcttattattt

SEQ ID NO: 7917 - DNA, 16 bp, H. sapiens
aaagctctttcttttg

SEQ ID NO: 7918 - DNA, 16 bp, H. sapiens
aaagctgaaaaataca

SEQ ID NO: 7919 - DNA, 16 bp, H. sapiens
aaagctgaaaacattt

SEQ ID NO: 7920 - DNA, 16 bp, H. sapiens
aaagctgaaaataaat

SEQ ID NO: 7921 - DNA, 16 bp, H. sapiens
aaagctgaaagtggat

SEQ ID NO: 7922 - DNA, 16 bp, H. sapiens
aaagctgaaattataa

SEQ ID NO: 7923 - DNA, 16 bp, H. sapiens
aaagctgaagaatttg

SEQ ID NO: 7924 - DNA, 16 bp, H. sapiens
aaagctgaccagcatt

SEQ ID NO: 7925 - DNA, 16 bp, H. sapiens
aaagctgacttttaaa

SEQ ID NO: 7926 - DNA, 16 bp, H. sapiens
aaagctgagaaaatta

SEQ ID NO: 7927 - DNA, 16 bp, H. sapiens
aaagctgagagaggtg

SEQ ID NO: 7928 - DNA, 16 bp, H. sapiens
aaagctgaggtgggag

SEQ ID NO: 7929 - DNA, 16 bp, H. sapiens
aaagctgatttttaaa

SEQ ID NO: 7930 - DNA, 16 bp, H. sapiens
aaagctgcagaagaaa

SEQ ID NO: 7931 - DNA, 16 bp, H. sapiens
aaagctgctatcaaca

SEQ ID NO: 7932 - DNA, 16 bp, H. sapiens
aaagctgctatgaaaa

SEQ ID NO: 7933 - DNA, 16 bp, H. sapiens
aaagctgctatgaata

SEQ ID NO: 7934 - DNA, 16 bp, H. sapiens
aaagctgcttccacat

SEQ ID NO: 7935 - DNA, 16 bp, H. sapiens
aaagctgctttaaaaa

SEQ ID NO: 7936 - DNA, 16 bp, H. sapiens
aaagctgctttaataa

SEQ ID NO: 7937 - DNA, 16 bp, H. sapiens
aaagctggaaaagaaa

SEQ ID NO: 7938 - DNA, 16 bp, H. sapiens
aaagctggaaagatct

SEQ ID NO: 7939 - DNA, 16 bp, H. sapiens
aaagctggaagaattc

SEQ ID NO: 7940 - DNA, 16 bp, H. sapiens
aaagctggaaggagaa

SEQ ID NO: 7941 - DNA, 17 bp, H. sapiens
aaagctggacagagaat

SEQ ID NO: 7942 - DNA, 16 bp, H. sapiens
aaagctggaggtatca

SEQ ID NO: 7943 - DNA, 16 bp, H. sapiens
aaagctggcagagaca

SEQ ID NO: 7944 - DNA, 16 bp, H. sapiens
aaagctggccaggcac

SEQ ID NO: 7945 - DNA, 16 bp, H. sapiens
aaagctggctgcagaa

SEQ ID NO: 7946 - DNA, 16 bp, H. sapiens
aaagctgggcatgatg

SEQ ID NO: 7947 - DNA, 16 bp, H. sapiens
aaagctgggcctcttg

SEQ ID NO: 7948 - DNA, 16 bp, H. sapiens
aaagctgggtattgtc

SEQ ID NO: 7949 - DNA, 16 bp, H. sapiens
aaagctgggtgtgatg

SEQ ID NO: 7950 - DNA, 16 bp, H. sapiens
aaagctggtggtgtag

SEQ ID NO: 7951 - DNA, 16 bp, H. sapiens
aaagctgtaagaaaaa

SEQ ID NO: 7952 - DNA, 16 bp, H. sapiens
aaagctgtcacactgg

SEQ ID NO: 7953 - DNA, 16 bp, H. sapiens
aaagctgtgacagatg

SEQ ID NO: 7954 - DNA, 16 bp, H. sapiens
aaagctgtggagaaaa

SEQ ID NO: 7955 - DNA, 16 bp, H. sapiens
aaagctgttgaatttt

SEQ ID NO: 7956 - DNA, 16 bp, H. sapiens
aaagctgtttcacaga

SEQ ID NO: 7957 - DNA, 16 bp, H. sapiens
aaagctgtttttcttt

SEQ ID NO: 7958 - DNA, 16 bp, H. sapiens
aaagcttaaaagcaaa

SEQ ID NO: 7959 - DNA, 16 bp, H. sapiens
aaagcttataaaataa

SEQ ID NO: 7960 - DNA, 16 bp, H. sapiens
aaagcttatagaataa

SEQ ID NO: 7961 - DNA, 16 bp, H. sapiens
aaagcttatggaataa

SEQ ID NO: 7962 - DNA, 16 bp, H. sapiens
aaagcttattttgcca

SEQ ID NO: 7963 - DNA, 16 bp, H. sapiens
aaagcttcaaaagaca

SEQ ID NO: 7964 - DNA, 16 bp, H. sapiens
aaagcttcaaaatgat

SEQ ID NO: 7965 - DNA, 16 bp, H. sapiens
aaagcttcattttttt

SEQ ID NO: 7966 - DNA, 16 bp, H. sapiens
aaagcttccaaaggaa

SEQ ID NO: 7967 - DNA, 16 bp, H. sapiens
aaagcttccaggtgat

SEQ ID NO: 7968 - DNA, 16 bp, H. sapiens
aaagcttctagaagaa

SEQ ID NO: 7969 - DNA, 16 bp, H. sapiens
aaagcttgcagaaggc

SEQ ID NO: 7970 - DNA, 16 bp, H. sapiens
aaagcttgtacatgaa

SEQ ID NO: 7971 - DNA, 16 bp, H. sapiens
aaagctttaaaaacat

SEQ ID NO: 7972 - DNA, 16 bp, H. sapiens
aaagctttaaaaagtt

SEQ ID NO: 7973 - DNA, 16 bp, H. sapiens
aaagctttatttttat

SEQ ID NO: 7974 - DNA, 16 bp, H. sapiens
aaagctttcagaaaaa

SEQ ID NO: 7975 - DNA, 16 bp, H. sapiens
aaagctttcagaagaa

SEQ ID NO: 7976 - DNA, 16 bp, H. sapiens
aaagctttcattaaaa

SEQ ID NO: 7977 - DNA, 16 bp, H. sapiens
aaagctttctgttttt

SEQ ID NO: 7978 - DNA, 16 bp, H. sapiens
aaagctttcttttttc

SEQ ID NO: 7979 - DNA, 16 bp, H. sapiens
aaagcttttaattttg

SEQ ID NO: 7980 - DNA, 16 bp, H. sapiens
aaagcttttctttttc

SEQ ID NO: 7981 - DNA, 16 bp, H. sapiens
aaagcttttgagaaaa

SEQ ID NO: 7982 - DNA, 16 bp, H. sapiens
aaagctttttatttct

SEQ ID NO: 7983 - DNA, 16 bp, H. sapiens
aaagctttttctttaa

SEQ ID NO: 7984 - DNA, 16 bp, H. sapiens
aaagctttttgttttt

SEQ ID NO: 7985 - DNA, 16 bp, H. sapiens
aaaggaaaaaaattct

SEQ ID NO: 7986 - DNA, 16 bp, H. sapiens
aaaggaaaaaagtcat

SEQ ID NO: 7987 - DNA, 16 bp, H. sapiens
aaaggaaaaaatactt

SEQ ID NO: 7988 - DNA, 16 bp, H. sapiens
aaaggaaaaacttcaa

SEQ ID NO: 7989 - DNA, 16 bp, H. sapiens
aaaggaaaaatgatca

SEQ ID NO: 7990 - DNA, 16 bp, H. sapiens
aaaggaaaaatgattt

SEQ ID NO: 7991 - DNA, 16 bp, H. sapiens
aaaggaaaacaagatt

SEQ ID NO: 7992 - DNA, 16 bp, H. sapiens
aaaggaaaacatttca

SEQ ID NO: 7993 - DNA, 16 bp, H. sapiens
aaaggaaaaccagacc

SEQ ID NO: 7994 - DNA, 16 bp, H. sapiens
aaaggaaaacccattt

SEQ ID NO: 7995 - DNA, 16 bp, H. sapiens
aaaggaaaaccctaac

SEQ ID NO: 7996 - DNA, 16 bp, H. sapiens
aaaggaaaactcaaat

SEQ ID NO: 7997 - DNA, 16 bp, H. sapiens
aaaggaaaactggacc

SEQ ID NO: 7998 - DNA, 16 bp, H. sapiens
aaaggaaaagaagtca

SEQ ID NO: 7999 - DNA, 16 bp, H. sapiens
aaaggaaaagactgat

SEQ ID NO: 8000 - DNA, 16 bp, H. sapiens
aaaggaaaagatttca

SEQ ID NO: 8001 - DNA, 16 bp, H. sapiens
aaaggaaaagcatttt

SEQ ID NO: 8002 - DNA, 16 bp, H. sapiens
aaaggaaaataagtca

SEQ ID NO: 8003 - DNA, 16 bp, H. sapiens
aaaggaaaataagttt

SEQ ID NO: 8004 - DNA, 16 bp, H. sapiens
aaaggaaaatacagta

SEQ ID NO: 8005 - DNA, 16 bp, H. sapiens
aaaggaaaatacattt

SEQ ID NO: 8006 - DNA, 16 bp, H. sapiens
aaaggaaaatatccaa

SEQ ID NO: 8007 - DNA, 16 bp, H. sapiens
aaaggaaaatattgca

SEQ ID NO: 8008 - DNA, 16 bp, H. sapiens
aaaggaaaatattttc

SEQ ID NO: 8009 - DNA, 16 bp, H. sapiens
aaaggaaaatcttaaa

SEQ ID NO: 8010 - DNA, 16 bp, H. sapiens
aaaggaaaatcttttt

SEQ ID NO: 8011 - DNA, 16 bp, H. sapiens
aaaggaaaatgaaact

SEQ ID NO: 8012 - DNA, 16 bp, H. sapiens
aaaggaaaatgaagca

SEQ ID NO: 8013 - DNA, 16 bp, H. sapiens
aaaggaaaatgtttat

SEQ ID NO: 8014 - DNA, 16 bp, H. sapiens
aaaggaaaattttaga

SEQ ID NO: 8015 - DNA, 16 bp, H. sapiens
aaaggaaacagagcat

SEQ ID NO: 8016 - DNA, 16 bp, H. sapiens
aaaggaaacatcttta

SEQ ID NO: 8017 - DNA, 16 bp, H. sapiens
aaaggaaacatttaaa

SEQ ID NO: 8018 - DNA, 16 bp, H. sapiens
aaaggaaacatttcaa

SEQ ID NO: 8019 - DNA, 16 bp, H. sapiens
aaaggaaacattttaa

SEQ ID NO: 8020 - DNA, 16 bp, H. sapiens
aaaggaaacatttttg

SEQ ID NO: 8021 - DNA, 16 bp, H. sapiens
aaaggaaacttttaaa

SEQ ID NO: 8022 - DNA, 16 bp, H. sapiens
aaaggaaagaaaattc

SEQ ID NO: 8023 - DNA, 16 bp, H. sapiens
aaaggaaagaaagctt

SEQ ID NO: 8024 - DNA, 16 bp, H. sapiens
aaaggaaagaaattca

SEQ ID NO: 8025 - DNA, 16 bp, H. sapiens
aaaggaaagaacagct

SEQ ID NO: 8026 - DNA, 16 bp, H. sapiens
aaaggaaagactgcta

SEQ ID NO: 8027 - DNA, 16 bp, H. sapiens
aaaggaaagaggttta

SEQ ID NO: 8028 - DNA, 16 bp, H. sapiens
aaaggaaagaggtttc

SEQ ID NO: 8029 - DNA, 16 bp, H. sapiens
aaaggaaagcaaatat

SEQ ID NO: 8030 - DNA, 16 bp, H. sapiens
aaaggaaaggaaaatc

SEQ ID NO: 8031 - DNA, 16 bp, H. sapiens
aaaggaaaggggttta

SEQ ID NO: 8032 - DNA, 16 bp, H. sapiens
aaaggaaagttccaaa

SEQ ID NO: 8033 - DNA, 16 bp, H. sapiens
aaaggaaataatgtta

SEQ ID NO: 8034 - DNA, 16 bp, H. sapiens
aaaggaaatatctgca

SEQ ID NO: 8035 - DNA, 16 bp, H. sapiens
aaaggaaatgaaacca

SEQ ID NO: 8036 - DNA, 16 bp, H. sapiens
aaaggaaatgaaatca

SEQ ID NO: 8037 - DNA, 16 bp, H. sapiens
aaaggaaatgaagtca

SEQ ID NO: 8038 - DNA, 16 bp, H. sapiens
aaaggaaatgaattct

SEQ ID NO: 8039 - DNA, 16 bp, H. sapiens
aaaggaaatgctttca

SEQ ID NO: 8040 - DNA, 16 bp, H. sapiens
aaaggaaatgttgaaa

SEQ ID NO: 8041 - DNA, 16 bp, H. sapiens
aaaggaaattattttg

SEQ ID NO: 8042 - DNA, 16 bp, H. sapiens
aaaggaaattctaaag

SEQ ID NO: 8043 - DNA, 16 bp, H. sapiens
aaaggaaattgagaca

SEQ ID NO: 8044 - DNA, 16 bp, H. sapiens
aaaggaaatttatctt

SEQ ID NO: 8045 - DNA, 16 bp, H. sapiens
aaaggaaatttgtgaa

SEQ ID NO: 8046 - DNA, 16 bp, H. sapiens
aaaggaaattttgaaa

SEQ ID NO: 8047 - DNA, 16 bp, H. sapiens
aaaggaacaaaactgg

SEQ ID NO: 8048 - DNA, 16 bp, H. sapiens
aaaggaacaaaattat

SEQ ID NO: 8049 - DNA, 16 bp, H. sapiens
aaaggaacaaacagta

SEQ ID NO: 8050 - DNA, 16 bp, H. sapiens
aaaggaacaactgata

SEQ ID NO: 8051 - DNA, 16 bp, H. sapiens
aaaggaacaatcagca

SEQ ID NO: 8052 - DNA, 16 bp, H. sapiens
aaaggaacaattggta

SEQ ID NO: 8053 - DNA, 16 bp, H. sapiens
aaaggaacactcaaaa

SEQ ID NO: 8054 - DNA, 16 bp, H. sapiens
aaaggaacagagaaat

SEQ ID NO: 8055 - DNA, 16 bp, H. sapiens
aaaggaacatcagccc

SEQ ID NO: 8056 - DNA, 16 bp, H. sapiens
aaaggaacatttaaaa

SEQ ID NO: 8057 - DNA, 16 bp, H. sapiens
aaaggaactccctgac

SEQ ID NO: 8058 - DNA, 16 bp, H. sapiens
aaaggaactctcaaaa

SEQ ID NO: 8059 - DNA, 16 bp, H. sapiens
aaaggaagaaaaatct

SEQ ID NO: 8060 - DNA, 16 bp, H. sapiens
aaaggaagaaaagttt

SEQ ID NO: 8061 - DNA, 16 bp, H. sapiens
aaaggaagaaaatcct

SEQ ID NO: 8062 - DNA, 16 bp, H. sapiens
aaaggaagaaaatgct

SEQ ID NO: 8063 - DNA, 16 bp, H. sapiens
aaaggaagaaaatgtt

SEQ ID NO: 8064 - DNA, 16 bp, H. sapiens
aaaggaagaaatcaga

SEQ ID NO: 8065 - DNA, 16 bp, H. sapiens
aaaggaagaacaaagt

SEQ ID NO: 8066 - DNA, 16 bp, H. sapiens
aaaggaagaatatatt

SEQ ID NO: 8067 - DNA, 16 bp, H. sapiens
aaaggaagaatgggta

SEQ ID NO: 8068 - DNA, 16 bp, H. sapiens
aaaggaagacaaaggt

SEQ ID NO: 8069 - DNA, 16 bp, H. sapiens
aaaggaagacattttc

SEQ ID NO: 8070 - DNA, 16 bp, H. sapiens
aaaggaagaggctggg

SEQ ID NO: 8071 - DNA, 16 bp, H. sapiens
aaaggaagcagaaaat

SEQ ID NO: 8072 - DNA, 16 bp, H. sapiens
aaaggaaggaaatctt

SEQ ID NO: 8073 - DNA, 16 bp, H. sapiens
aaaggaaggaaattct

SEQ ID NO: 8074 - DNA, 16 bp, H. sapiens
aaaggaaggaaatttt

SEQ ID NO: 8075 - DNA, 16 bp, H. sapiens
aaaggaagggaattct

SEQ ID NO: 8076 - DNA, 16 bp, H. sapiens
aaaggaagtaaaacta

SEQ ID NO: 8077 - DNA, 16 bp, H. sapiens
aaaggaagtggtttct

SEQ ID NO: 8078 - DNA, 16 bp, H. sapiens
aaaggaagttcttcaa

SEQ ID NO: 8079 - DNA, 16 bp, H. sapiens
aaaggaataaaattct

SEQ ID NO: 8080 - DNA, 16 bp, H. sapiens
aaaggaatatctgaga

SEQ ID NO: 8081 - DNA, 16 bp, H. sapiens
aaaggaatatttttat

SEQ ID NO: 8082 - DNA, 16 bp, H. sapiens
aaaggaatcagagatg

SEQ ID NO: 8083 - DNA, 16 bp, H. sapiens
aaaggaatctgaaaaa

SEQ ID NO: 8084 - DNA, 16 bp, H. sapiens
aaaggaatgaaacaat

SEQ ID NO: 8085 - DNA, 16 bp, H. sapiens
aaaggaatgaaatgct

SEQ ID NO: 8086 - DNA, 16 bp, H. sapiens
aaaggaatgaagaaca

SEQ ID NO: 8087 - DNA, 16 bp, H. sapiens
aaaggaatgaagcact

SEQ ID NO: 8088 - DNA, 16 bp, H. sapiens
aaaggaatgaagttct

SEQ ID NO: 8089 - DNA, 16 bp, H. sapiens
aaaggaatgacatcat

SEQ ID NO: 8090 - DNA, 16 bp, H. sapiens
aaaggaatggcaacaa

SEQ ID NO: 8091 - DNA, 16 bp, H. sapiens
aaaggaatgtgagctg

SEQ ID NO: 8092 - DNA, 16 bp, H. sapiens
aaaggaatgtgcttat

SEQ ID NO: 8093 - DNA, 16 bp, H. sapiens
aaaggaattatacagc

SEQ ID NO: 8094 - DNA, 16 bp, H. sapiens
aaaggaattcaaaata

SEQ ID NO: 8095 - DNA, 16 bp, H. sapiens
aaaggaattcagtaaa

SEQ ID NO: 8096 - DNA, 16 bp, H. sapiens
aaaggaattcagtttt

SEQ ID NO: 8097 - DNA, 16 bp, H. sapiens
aaaggaattgaaaaca

SEQ ID NO: 8098 - DNA, 16 bp, H. sapiens
aaaggaattgaaatta

SEQ ID NO: 8099 - DNA, 16 bp, H. sapiens
aaaggacaaatatcca

SEQ ID NO: 8100 - DNA, 16 bp, H. sapiens
aaaggacacaaataga

SEQ ID NO: 8101 - DNA, 16 bp, H. sapiens
aaaggacataaaatat

SEQ ID NO: 8102 - DNA, 19 bp, H. sapiens
aaaggacatcattggctaa

SEQ ID NO: 8103 - DNA, 16 bp, H. sapiens
aaaggacatccacaca

SEQ ID NO: 8104 - DNA, 16 bp, H. sapiens
aaaggacatccacatc

SEQ ID NO: 8105 - DNA, 16 bp, H. sapiens
aaaggacatctacacc

SEQ ID NO: 8106 - DNA, 16 bp, H. sapiens
aaaggacatgaaaaga

SEQ ID NO: 8107 - DNA, 16 bp, H. sapiens
aaaggacatgaaaata

SEQ ID NO: 8108 - DNA, 16 bp, H. sapiens
aaaggacatgaagaaa

SEQ ID NO: 8109 - DNA, 16 bp, H. sapiens
aaaggacatgatttct

SEQ ID NO: 8110 - DNA, 16 bp, H. sapiens
aaaggacattaggaaa

SEQ ID NO: 8111 - DNA, 16 bp, H. sapiens
aaaggacatttcagag

SEQ ID NO: 8112 - DNA, 16 bp, H. sapiens
aaaggacattttaaaa

SEQ ID NO: 8113 - DNA, 16 bp, H. sapiens
aaaggacattttggag

SEQ ID NO: 8114 - DNA, 16 bp, H. sapiens
aaaggaccctgaaaag

SEQ ID NO: 8115 - DNA, 16 bp, H. sapiens
aaaggacttagaaaag

SEQ ID NO: 8116 - DNA, 16 bp, H. sapiens
aaaggactttgcagat

SEQ ID NO: 8117 - DNA, 16 bp, H. sapiens
aaaggagaaaaatcac

SEQ ID NO: 8118 - DNA, 16 bp, H. sapiens
aaaggagaaaaatcat

SEQ ID NO: 8119 - DNA, 16 bp, H. sapiens
aaaggagaaacaagat

SEQ ID NO: 8120 - DNA, 16 bp, H. sapiens
aaaggagaaacatgca

SEQ ID NO: 8121 - DNA, 16 bp, H. sapiens
aaaggagaaactgagg

SEQ ID NO: 8122 - DNA, 16 bp, H. sapiens
aaaggagacattaaaa

SEQ ID NO: 8123 - DNA, 16 bp, H. sapiens
aaaggagactgaagag

SEQ ID NO: 8124 - DNA, 16 bp, H. sapiens
aaaggagagaagagct

SEQ ID NO: 8125 - DNA, 16 bp, H. sapiens
aaaggagatagacaaa

SEQ ID NO: 8126 - DNA, 17 bp, H. sapiens
aaaggagatatcaccac

SEQ ID NO: 8127 - DNA, 16 bp, H. sapiens
aaaggagatcatttcg

SEQ ID NO: 8128 - DNA, 16 bp, H. sapiens
aaaggagattatttta

SEQ ID NO: 8129 - DNA, 16 bp, H. sapiens
aaaggagattggaagg

SEQ ID NO: 8130 - DNA, 16 bp, H. sapiens
aaaggagccaagaaca

SEQ ID NO: 8131 - DNA, 16 bp, H. sapiens
aaaggagctacccact

SEQ ID NO: 8132 - DNA, 16 bp, H. sapiens
aaaggaggaaattgag

SEQ ID NO: 8133 - DNA, 16 bp, H. sapiens
aaaggaggactctgca

SEQ ID NO: 8134 - DNA, 16 bp, H. sapiens
aaaggaggctgagaag

SEQ ID NO: 8135 - DNA, 16 bp, H. sapiens
aaaggagtccaggacc

SEQ ID NO: 8136 - DNA, 16 bp, H. sapiens
aaaggagtgaattaat

SEQ ID NO: 8137 - DNA, 16 bp, H. sapiens
aaaggagtggaatgga

SEQ ID NO: 8138 - DNA, 16 bp, H. sapiens
aaaggatacagatgaa

SEQ ID NO: 8139 - DNA, 16 bp, H. sapiens
aaaggatacatgcttg

SEQ ID NO: 8140 - DNA, 16 bp, H. sapiens
aaaggatatattttaa

SEQ ID NO: 8141 - DNA, 16 bp, H. sapiens
aaaggatatgaaatca

SEQ ID NO: 8142 - DNA, 16 bp, H. sapiens
aaaggatatttttgct

SEQ ID NO: 8143 - DNA, 16 bp, H. sapiens
aaaggatcaaaggcta

SEQ ID NO: 8144 - DNA, 16 bp, H. sapiens
aaaggatcagaatcca

SEQ ID NO: 8145 - DNA, 16 bp, H. sapiens
aaaggatctgaataaa

SEQ ID NO: 8146 - DNA, 16 bp, H. sapiens
aaaggatgattttttt

SEQ ID NO: 8147 - DNA, 16 bp, H. sapiens
aaaggatgcaaaattt

SEQ ID NO: 8148 - DNA, 16 bp, H. sapiens
aaaggatgcagagaaa

SEQ ID NO: 8149 - DNA, 16 bp, H. sapiens
aaaggatggaaaatat

SEQ ID NO: 8150 - DNA, 16 bp, H. sapiens
aaaggatgttgagttt

SEQ ID NO: 8151 - DNA, 16 bp, H. sapiens
aaaggattataaaaca

SEQ ID NO: 8152 - DNA, 16 bp, H. sapiens
aaaggattataaagca

SEQ ID NO: 8153 - DNA, 16 bp, H. sapiens
aaaggattcaaaataa

SEQ ID NO: 8154 - DNA, 17 bp, H. sapiens
aaaggattccctatttg

SEQ ID NO: 8155 - DNA, 16 bp, H. sapiens
aaaggattggtaccaa

SEQ ID NO: 8156 - DNA, 17 bp, H. sapiens
aaaggatttcctattta

SEQ ID NO: 8157 - DNA, 16 bp, H. sapiens
aaaggattttgttttt

SEQ ID NO: 8158 - DNA, 16 bp, H. sapiens
aaaggattttttaaaa

SEQ ID NO: 8159 - DNA, 16 bp, H. sapiens
aaaggattttttgttt

SEQ ID NO: 8160 - DNA, 16 bp, H. sapiens
aaaggcaaaaacattt

SEQ ID NO: 8161 - DNA, 16 bp, H. sapiens
aaaggcaaaaaccttt

SEQ ID NO: 8162 - DNA, 16 bp, H. sapiens
aaaggcaaaaataatt

SEQ ID NO: 8163 - DNA, 16 bp, H. sapiens
aaaggcaaaaccacag

SEQ ID NO: 8164 - DNA, 16 bp, H. sapiens
aaaggcaaaagatttg

SEQ ID NO: 8165 - DNA, 16 bp, H. sapiens
aaaggcaaaataatta

SEQ ID NO: 8166 - DNA, 16 bp, H. sapiens
aaaggcaaaatgagaa

SEQ ID NO: 8167 - DNA, 16 bp, H. sapiens
aaaggcaaacaagaat

SEQ ID NO: 8168 - DNA, 16 bp, H. sapiens
aaaggcaaagaaacta

SEQ ID NO: 8169 - DNA, 16 bp, H. sapiens
aaaggcaaagaaattt

SEQ ID NO: 8170 - DNA, 16 bp, H. sapiens
aaaggcaaagaagtgg

SEQ ID NO: 8171 - DNA, 16 bp, H. sapiens
aaaggcaaatcaaaac

SEQ ID NO: 8172 - DNA, 16 bp, H. sapiens
aaaggcaaattatttt

SEQ ID NO: 8173 - DNA, 16 bp, H. sapiens
aaaggcaacatttgag

SEQ ID NO: 8174 - DNA, 16 bp, H. sapiens
aaaggcaagaaaatga

SEQ ID NO: 8175 - DNA, 16 bp, H. sapiens
aaaggcaatttaaaaa

SEQ ID NO: 8176 - DNA, 16 bp, H. sapiens
aaaggcacacacacac

SEQ ID NO: 8177 - DNA, 16 bp, H. sapiens
aaaggcacaggcaaca

SEQ ID NO: 8178 - DNA, 16 bp, H. sapiens
aaaggcaccaccagcc

SEQ ID NO: 8179 - DNA, 16 bp, H. sapiens
aaaggcacttcttaca

SEQ ID NO: 8180 - DNA, 16 bp, H. sapiens
aaaggcactttttttt

SEQ ID NO: 8181 - DNA, 16 bp, H. sapiens
aaaggcagaaaaagta

SEQ ID NO: 8182 - DNA, 16 bp, H. sapiens
aaaggcagaaaatgaa

SEQ ID NO: 8183 - DNA, 16 bp, H. sapiens
aaaggcagaagaaaat

SEQ ID NO: 8184 - DNA, 16 bp, H. sapiens
aaaggcagaagcccca

SEQ ID NO: 8185 - DNA, 16 bp, H. sapiens
aaaggcagcagtccca

SEQ ID NO: 8186 - DNA, 16 bp, H. sapiens
aaaggcaggaaacaac

SEQ ID NO: 8187 - DNA, 16 bp, H. sapiens
aaaggcaggcaggcct

SEQ ID NO: 8188 - DNA, 16 bp, H. sapiens
aaaggcataagaatta

SEQ ID NO: 8189 - DNA, 16 bp, H. sapiens
aaaggcatcaaggaag

SEQ ID NO: 8190 - DNA, 16 bp, H. sapiens
aaaggcattaaataaa

SEQ ID NO: 8191 - DNA, 16 bp, H. sapiens
aaaggcattttctttt

SEQ ID NO: 8192 - DNA, 16 bp, H. sapiens
aaaggcatttttaaaa

SEQ ID NO: 8193 - DNA, 16 bp, H. sapiens
aaaggcatttttaaat

SEQ ID NO: 8194 - DNA, 16 bp, H. sapiens
aaaggccacatactgt

SEQ ID NO: 8195 - DNA, 16 bp, H. sapiens
aaaggccacgtgagga

SEQ ID NO: 8196 - DNA, 16 bp, H. sapiens
aaaggccatgaacaga

SEQ ID NO: 8197 - DNA, 16 bp, H. sapiens
aaaggccatgtgaaga

SEQ ID NO: 8198 - DNA, 16 bp, H. sapiens
aaaggccatttatgaa

SEQ ID NO: 8199 - DNA, 16 bp, H. sapiens
aaaggcccaggaccag

SEQ ID NO: 8200 - DNA, 17 bp, H. sapiens
aaaggccgagaagcaat

SEQ ID NO: 8201 - DNA, 16 bp, H. sapiens
aaaggcctagagaaca

SEQ ID NO: 8202 - DNA, 16 bp, H. sapiens
aaaggcctccagctcc

SEQ ID NO: 8203 - DNA, 16 bp, H. sapiens
aaaggcctggtccagt

SEQ ID NO: 8204 - DNA, 16 bp, H. sapiens
aaaggccttcagtaaa

SEQ ID NO: 8205 - DNA, 16 bp, H. sapiens
aaaggcctttaataaa

SEQ ID NO: 8206 - DNA, 16 bp, H. sapiens
aaaggccttttcttca

SEQ ID NO: 8207 - DNA, 16 bp, H. sapiens
aaaggctacagggtgc

SEQ ID NO: 8208 - DNA, 16 bp, H. sapiens
aaaggctagaaaaaga

SEQ ID NO: 8209 - DNA, 16 bp, H. sapiens
aaaggctctgagaagt

SEQ ID NO: 8210 - DNA, 16 bp, H. sapiens
aaaggctgaaaattca

SEQ ID NO: 8211 - DNA, 16 bp, H. sapiens
aaaggctggggcagga

SEQ ID NO: 8212 - DNA, 16 bp, H. sapiens
aaaggctgtcaccctg

SEQ ID NO: 8213 - DNA, 16 bp, H. sapiens
aaaggcttggagcaaa

SEQ ID NO: 8214 - DNA, 16 bp, H. sapiens
aaaggcttgtcaattt

SEQ ID NO: 8215 - DNA, 16 bp, H. sapiens
aaaggctttattttta

SEQ ID NO: 8216 - DNA, 16 bp, H. sapiens
aaaggctttcaataaa

SEQ ID NO: 8217 - DNA, 16 bp, H. sapiens
aaaggctttcagtttt

SEQ ID NO: 8218 - DNA, 16 bp, H. sapiens
aaaggctttctgtttt

SEQ ID NO: 8219 - DNA, 16 bp, H. sapiens
aaaggctttttaaaaa

SEQ ID NO: 8220 - DNA, 16 bp, H. sapiens
aaagggaaaaaagttt

SEQ ID NO: 8221 - DNA, 16 bp, H. sapiens
aaagggaaaaatcaag

SEQ ID NO: 8222 - DNA, 16 bp, H. sapiens
aaagggaaaagtcaaa

SEQ ID NO: 8223 - DNA, 16 bp, H. sapiens
aaagggaaaattcaag

SEQ ID NO: 8224 - DNA, 16 bp, H. sapiens
aaagggaaaccttgcc

SEQ ID NO: 8225 - DNA, 18 bp, H. sapiens
aaagggaaagagtacaaa

SEQ ID NO: 8226 - DNA, 16 bp, H. sapiens
aaagggaaatattaat

SEQ ID NO: 8227 - DNA, 16 bp, H. sapiens
aaagggaaatcagaaa

SEQ ID NO: 8228 - DNA, 16 bp, H. sapiens
aaagggaacaaaatat

SEQ ID NO: 8229 - DNA, 16 bp, H. sapiens
aaagggaacacatata

SEQ ID NO: 8230 - DNA, 16 bp, H. sapiens
aaagggaaccaaatat

SEQ ID NO: 8231 - DNA, 16 bp, H. sapiens
aaagggaagcagaact

SEQ ID NO: 8232 - DNA, 16 bp, H. sapiens
aaagggaagcagggca

SEQ ID NO: 8233 - DNA, 20 bp, H. sapiens
aaagggaagcccatcagacc

SEQ ID NO: 8234 - DNA, 17 bp, H. sapiens
aaagggaatgcctccag

SEQ ID NO: 8235 - DNA, 16 bp, H. sapiens
aaagggaatgcttaaa

SEQ ID NO: 8236 - DNA, 16 bp, H. sapiens
aaagggacacaggagc

SEQ ID NO: 8237 - DNA, 16 bp, H. sapiens
aaagggacatttcaga

SEQ ID NO: 8238 - DNA, 16 bp, H. sapiens
aaagggactttgcaga

SEQ ID NO: 8239 - DNA, 16 bp, H. sapiens
aaagggagaaattggc

SEQ ID NO: 8240 - DNA, 16 bp, H. sapiens
aaagggagaagtcaaa

SEQ ID NO: 8241 - DNA, 16 bp, H. sapiens
aaagggagaccctcct

SEQ ID NO: 8242 - DNA, 16 bp, H. sapiens
aaagggagagacagac

SEQ ID NO: 8243 - DNA, 21 bp, H. sapiens
aaagggatcaattcaacaaga

SEQ ID NO: 8244 - DNA, 16 bp, H. sapiens
aaagggatccagtttc

SEQ ID NO: 8245 - DNA, 16 bp, H. sapiens
aaagggatttttattt

SEQ ID NO: 8246 - DNA, 16 bp, H. sapiens
aaagggcactggttgg

SEQ ID NO: 8247 - DNA, 16 bp, H. sapiens
aaagggcagttcccct

SEQ ID NO: 8248 - DNA, 16 bp, H. sapiens
aaagggccaggtgcgg

SEQ ID NO: 8249 - DNA, 16 bp, H. sapiens
aaagggctatttaaaa

SEQ ID NO: 8250 - DNA, 16 bp, H. sapiens
aaagggctgaggaaag

SEQ ID NO: 8251 - DNA, 16 bp, H. sapiens
aaagggctgcagctct

SEQ ID NO: 8252 - DNA, 16 bp, H. sapiens
aaagggcttgatggag

SEQ ID NO: 8253 - DNA, 16 bp, H. sapiens
aaaggggaaactgagg

SEQ ID NO: 8254 - DNA, 16 bp, H. sapiens
aaaggggaaatttaaa

SEQ ID NO: 8255 - DNA, 16 bp, H. sapiens
aaaggggactttgcag

SEQ ID NO: 8256 - DNA, 16 bp, H. sapiens
aaaggggatggagcag

SEQ ID NO: 8257 - DNA, 16 bp, H. sapiens
aaaggggctagaggcc

SEQ ID NO: 8258 - DNA, 16 bp, H. sapiens
aaaggggctgcaggcc

SEQ ID NO: 8259 - DNA, 16 bp, H. sapiens
aaaggggtgggcaatt

SEQ ID NO: 8260 - DNA, 16 bp, H. sapiens
aaaggggtgggtcccc

SEQ ID NO: 8261 - DNA, 16 bp, H. sapiens
aaaggggtgttgggag

SEQ ID NO: 8262 - DNA, 16 bp, H. sapiens
aaagggtctgtttgtc

SEQ ID NO: 8263 - DNA, 16 bp, H. sapiens
aaagggtgctgggaaa

SEQ ID NO: 8264 - DNA, 16 bp, H. sapiens
aaagggttggaaaaag

SEQ ID NO: 8265 - DNA, 16 bp, H. sapiens
aaagggtttttatttt

SEQ ID NO: 8266 - DNA, 16 bp, H. sapiens
aaaggtaaatttttaa

SEQ ID NO: 8267 - DNA, 16 bp, H. sapiens
aaaggtaacaagtgtt

SEQ ID NO: 8268 - DNA, 16 bp, H. sapiens
aaaggtacagttaaaa

SEQ ID NO: 8269 - DNA, 16 bp, H. sapiens
aaaggtaccaagaaca

SEQ ID NO: 8270 - DNA, 18 bp, H. sapiens
aaaggtataattgccctg

SEQ ID NO: 8271 - DNA, 16 bp, H. sapiens
aaaggtatattttaaa

SEQ ID NO: 8272 - DNA, 16 bp, H. sapiens
aaaggtattcaaatag

SEQ ID NO: 8273 - DNA, 16 bp, H. sapiens
aaaggtatttatattt

SEQ ID NO: 8274 - DNA, 16 bp, H. sapiens
aaaggtattttgtttt

SEQ ID NO: 8275 - DNA, 16 bp, H. sapiens
aaaggtcaaactgtgc

SEQ ID NO: 8276 - DNA, 16 bp, H. sapiens
aaaggtcaaagacaaa

SEQ ID NO: 8277 - DNA, 16 bp, H. sapiens
aaaggtcacatatttc

SEQ ID NO: 8278 - DNA, 16 bp, H. sapiens
aaaggtcactcttgct

SEQ ID NO: 8279 - DNA, 16 bp, H. sapiens
aaaggtcagttggctg

SEQ ID NO: 8280 - DNA, 16 bp, H. sapiens
aaaggtcattttattt

SEQ ID NO: 8281 - DNA, 16 bp, H. sapiens
aaaggtctaaaatcca

SEQ ID NO: 8282 - DNA, 16 bp, H. sapiens
aaaggtctaatatcca

SEQ ID NO: 8283 - DNA, 16 bp, H. sapiens
aaaggtctcaaattaa

SEQ ID NO: 8284 - DNA, 16 bp, H. sapiens
aaaggtctcactctgt

SEQ ID NO: 8285 - DNA, 16 bp, H. sapiens
aaaggtctcttccaac

SEQ ID NO: 8286 - DNA, 16 bp, H. sapiens
aaaggtgaaaattcta

SEQ ID NO: 8287 - DNA, 16 bp, H. sapiens
aaaggtgaggaaactg

SEQ ID NO: 8288 - DNA, 16 bp, H. sapiens
aaaggtgatatggttt

SEQ ID NO: 8289 - DNA, 16 bp, H. sapiens
aaaggtgccaaaaata

SEQ ID NO: 8290 - DNA, 16 bp, H. sapiens
aaaggtggaggctgca

SEQ ID NO: 8291 - DNA, 16 bp, H. sapiens
aaaggtgttttgtttt

SEQ ID NO: 8292 - DNA, 16 bp, H. sapiens
aaaggttaaatgagtt

SEQ ID NO: 8293 - DNA, 16 bp, H. sapiens
aaaggttaagtaactt

SEQ ID NO: 8294 - DNA, 16 bp, H. sapiens
aaaggttcctttcaaa

SEQ ID NO: 8295 - DNA, 17 bp, H. sapiens
aaaggttctccacgtcc

SEQ ID NO: 8296 - DNA, 16 bp, H. sapiens
aaaggttgaataatat

SEQ ID NO: 8297 - DNA, 17 bp, H. sapiens
aaaggttggggaccgct

SEQ ID NO: 8298 - DNA, 16 bp, H. sapiens
aaaggttggtttctgg

SEQ ID NO: 8299 - DNA, 16 bp, H. sapiens
aaaggttgtttttgtt

SEQ ID NO: 8300 - DNA, 16 bp, H. sapiens
aaaggtttaaacaagt

SEQ ID NO: 8301 - DNA, 16 bp, H. sapiens
aaaggtttagctctgt

SEQ ID NO: 8302 - DNA, 16 bp, H. sapiens
aaaggtttctctgtag

SEQ ID NO: 8303 - DNA, 16 bp, H. sapiens
aaaggtttgctgaaaa

SEQ ID NO: 8304 - DNA, 16 bp, H. sapiens
aaaggttttaaaaatg

SEQ ID NO: 8305 - DNA, 16 bp, H. sapiens
aaaggttttaagcagg

SEQ ID NO: 8306 - DNA, 16 bp, H. sapiens
aaaggttttctttctt

SEQ ID NO: 8307 - DNA, 16 bp, H. sapiens
aaaggttttgttttgt

SEQ ID NO: 8308 - DNA, 16 bp, H. sapiens
aaaggttttttaaaaa

SEQ ID NO: 8309 - DNA, 16 bp, H. sapiens
aaagtaaaacatattt

SEQ ID NO: 8310 - DNA, 16 bp, H. sapiens
aaagtaaaagaggttt

SEQ ID NO: 8311 - DNA, 16 bp, H. sapiens
aaagtaaaaggacaga

SEQ ID NO: 8312 - DNA, 16 bp, H. sapiens
aaagtaaaatatactt

SEQ ID NO: 8313 - DNA, 16 bp, H. sapiens
aaagtaaaatgactgg

SEQ ID NO: 8314 - DNA, 16 bp, H. sapiens
aaagtaaaatgtgttt

SEQ ID NO: 8315 - DNA, 16 bp, H. sapiens
aaagtaaaatttgcta

SEQ ID NO: 8316 - DNA, 16 bp, H. sapiens
aaagtaaactttaaaa

SEQ ID NO: 8317 - DNA, 16 bp, H. sapiens
aaagtaaaggggtgga

SEQ ID NO: 8318 - DNA, 16 bp, H. sapiens
aaagtaaagtttattt

SEQ ID NO: 8319 - DNA, 16 bp, H. sapiens
aaagtaaatgcaataa

SEQ ID NO: 8320 - DNA, 16 bp, H. sapiens
aaagtaaattgaaagc

SEQ ID NO: 8321 - DNA, 16 bp, H. sapiens
aaagtaaattttcata

SEQ ID NO: 8322 - DNA, 16 bp, H. sapiens
aaagtaacatttaaaa

SEQ ID NO: 8323 - DNA, 16 bp, H. sapiens
aaagtaactttatttt

SEQ ID NO: 8324 - DNA, 16 bp, H. sapiens
aaagtaagcaacttgg

SEQ ID NO: 8325 - DNA, 16 bp, H. sapiens
aaagtaagcagaagga

SEQ ID NO: 8326 - DNA, 16 bp, H. sapiens
aaagtaagttgaaaac

SEQ ID NO: 8327 - DNA, 16 bp, H. sapiens
aaagtaagtttttaaa

SEQ ID NO: 8328 - DNA, 16 bp, H. sapiens
aaagtaatacatgcac

SEQ ID NO: 8329 - DNA, 16 bp, H. sapiens
aaagtaatacatttaa

SEQ ID NO: 8330 - DNA, 16 bp, H. sapiens
aaagtaatcccattta

SEQ ID NO: 8331 - DNA, 16 bp, H. sapiens
aaagtaatggcaaaaa

SEQ ID NO: 8332 - DNA, 16 bp, H. sapiens
aaagtaattgcatttt

SEQ ID NO: 8333 - DNA, 16 bp, H. sapiens
aaagtaattgtgtttt

SEQ ID NO: 8334 - DNA, 16 bp, H. sapiens
aaagtacaaaaagtta

SEQ ID NO: 8335 - DNA, 22 bp, H. sapiens
aaagtacaaaaattagctgggt

SEQ ID NO: 8336 - DNA, 16 bp, H. sapiens
aaagtacaaaaattta

SEQ ID NO: 8337 - DNA, 16 bp, H. sapiens
aaagtacaaagctgga

SEQ ID NO: 8338 - DNA, 16 bp, H. sapiens
aaagtacagagagttc

SEQ ID NO: 8339 - DNA, 16 bp, H. sapiens
aaagtacagcaaaaat

SEQ ID NO: 8340 - DNA, 16 bp, H. sapiens
aaagtacataaaatat

SEQ ID NO: 8341 - DNA, 16 bp, H. sapiens
aaagtacatttaaaat

SEQ ID NO: 8342 - DNA, 16 bp, H. sapiens
aaagtacatttagaaa

SEQ ID NO: 8343 - DNA, 16 bp, H. sapiens
aaagtaccacagactg

SEQ ID NO: 8344 - DNA, 16 bp, H. sapiens
aaagtaccacctcctg

SEQ ID NO: 8345 - DNA, 16 bp, H. sapiens
aaagtaccttcataag

SEQ ID NO: 8346 - DNA, 16 bp, H. sapiens
aaagtactcaacatca

SEQ ID NO: 8347 - DNA, 16 bp, H. sapiens
aaagtactttaaagtt

SEQ ID NO: 8348 - DNA, 16 bp, H. sapiens
aaagtactttgaaaac

SEQ ID NO: 8349 - DNA, 16 bp, H. sapiens
aaagtacttttaaatt

SEQ ID NO: 8350 - DNA, 16 bp, H. sapiens
aaagtagaaaaacttc

SEQ ID NO: 8351 - DNA, 16 bp, H. sapiens
aaagtagaaataatct

SEQ ID NO: 8352 - DNA, 16 bp, H. sapiens
aaagtagaaggcaaag

SEQ ID NO: 8353 - DNA, 16 bp, H. sapiens
aaagtagacaaaatat

SEQ ID NO: 8354 - DNA, 16 bp, H. sapiens
aaagtagacatttatg

SEQ ID NO: 8355 - DNA, 16 bp, H. sapiens
aaagtagactttaaga

SEQ ID NO: 8356 - DNA, 16 bp, H. sapiens
aaagtagataaaacct

SEQ ID NO: 8357 - DNA, 16 bp, H. sapiens
aaagtagatattttat

SEQ ID NO: 8358 - DNA, 16 bp, H. sapiens
aaagtagattttaagt

SEQ ID NO: 8359 - DNA, 16 bp, H. sapiens
aaagtagcaaatatgt

SEQ ID NO: 8360 - DNA, 16 bp, H. sapiens
aaagtagccaggcatt

SEQ ID NO: 8361 - DNA, 16 bp, H. sapiens
aaagtaggtttttcta

SEQ ID NO: 8362 - DNA, 16 bp, H. sapiens
aaagtagtcaaattca

SEQ ID NO: 8363 - DNA, 16 bp, H. sapiens
aaagtagtgtttaaaa

SEQ ID NO: 8364 - DNA, 16 bp, H. sapiens
aaagtagttatatttt

SEQ ID NO: 8365 - DNA, 16 bp, H. sapiens
aaagtataaaaatggc

SEQ ID NO: 8366 - DNA, 16 bp, H. sapiens
aaagtataaaacttac

SEQ ID NO: 8367 - DNA, 16 bp, H. sapiens
aaagtataattagatt

SEQ ID NO: 8368 - DNA, 16 bp, H. sapiens
aaagtatacctcaata

SEQ ID NO: 8369 - DNA, 16 bp, H. sapiens
aaagtatattttacat

SEQ ID NO: 8370 - DNA, 16 bp, H. sapiens
aaagtatattttctaa

SEQ ID NO: 8371 - DNA, 16 bp, H. sapiens
aaagtatattttgtct

SEQ ID NO: 8372 - DNA, 16 bp, H. sapiens
aaagtatgaaaatatg

SEQ ID NO: 8373 - DNA, 16 bp, H. sapiens
aaagtatgattttaaa

SEQ ID NO: 8374 - DNA, 16 bp, H. sapiens
aaagtatgatttttaa

SEQ ID NO: 8375 - DNA, 16 bp, H. sapiens
aaagtatggacagcca

SEQ ID NO: 8376 - DNA, 16 bp, H. sapiens
aaagtatgtattattt

SEQ ID NO: 8377 - DNA, 16 bp, H. sapiens
aaagtatgttttctaa

SEQ ID NO: 8378 - DNA, 16 bp, H. sapiens
aaagtattcaaataaa

SEQ ID NO: 8379 - DNA, 16 bp, H. sapiens
aaagtattcaagatgt

SEQ ID NO: 8380 - DNA, 16 bp, H. sapiens
aaagtattgtttaaaa

SEQ ID NO: 8381 - DNA, 16 bp, H. sapiens
aaagtatttagcacag

SEQ ID NO: 8382 - DNA, 16 bp, H. sapiens
aaagtatttattgagt

SEQ ID NO: 8383 - DNA, 16 bp, H. sapiens
aaagtatttccaaact

SEQ ID NO: 8384 - DNA, 16 bp, H. sapiens
aaagtatttctaaaat

SEQ ID NO: 8385 - DNA, 16 bp, H. sapiens
aaagtatttgaagaaa

SEQ ID NO: 8386 - DNA, 16 bp, H. sapiens
aaagtatttgacaaaa

SEQ ID NO: 8387 - DNA, 16 bp, H. sapiens
aaagtatttgatgaaa

SEQ ID NO: 8388 - DNA, 16 bp, H. sapiens
aaagtatttgcaaact

SEQ ID NO: 8389 - DNA, 16 bp, H. sapiens
aaagtattttacattt

SEQ ID NO: 8390 - DNA, 16 bp, H. sapiens
aaagtattttattact

SEQ ID NO: 8391 - DNA, 16 bp, H. sapiens
aaagtattttctttaa

SEQ ID NO: 8392 - DNA, 16 bp, H. sapiens
aaagtattttttcaaa

SEQ ID NO: 8393 - DNA, 16 bp, H. sapiens
aaagtcaaaaaattat

SEQ ID NO: 8394 - DNA, 16 bp, H. sapiens
aaagtcaaaagataat

SEQ ID NO: 8395 - DNA, 17 bp, H. sapiens
aaagtcaaaattgacaa

SEQ ID NO: 8396 - DNA, 16 bp, H. sapiens
aaagtcaaactcacag

SEQ ID NO: 8397 - DNA, 16 bp, H. sapiens
aaagtcaaagtgaaag

SEQ ID NO: 8398 - DNA, 16 bp, H. sapiens
aaagtcaacaagaata

SEQ ID NO: 8399 - DNA, 16 bp, H. sapiens
aaagtcaacttttttt

SEQ ID NO: 8400 - DNA, 16 bp, H. sapiens
aaagtcaagaaacaga

SEQ ID NO: 8401 - DNA, 16 bp, H. sapiens
aaagtcaagctggaaa

SEQ ID NO: 8402 - DNA, 16 bp, H. sapiens
aaagtcaagctgggaa

SEQ ID NO: 8403 - DNA, 16 bp, H. sapiens
aaagtcaaggaagaaa

SEQ ID NO: 8404 - DNA, 16 bp, H. sapiens
aaagtcaaggagaaaa

SEQ ID NO: 8405 - DNA, 16 bp, H. sapiens
aaagtcaattaacaca

SEQ ID NO: 8406 - DNA, 16 bp, H. sapiens
aaagtcacacagctca

SEQ ID NO: 8407 - DNA, 16 bp, H. sapiens
aaagtcacacagctga

SEQ ID NO: 8408 - DNA, 16 bp, H. sapiens
aaagtcacagagctag

SEQ ID NO: 8409 - DNA, 16 bp, H. sapiens
aaagtcacatcttaca

SEQ ID NO: 8410 - DNA, 16 bp, H. sapiens
aaagtcaccaagaaca

SEQ ID NO: 8411 - DNA, 16 bp, H. sapiens
aaagtcactttccttt

SEQ ID NO: 8412 - DNA, 16 bp, H. sapiens
aaagtcactttttaaa

SEQ ID NO: 8413 - DNA, 16 bp, H. sapiens
aaagtcagagttcatg

SEQ ID NO: 8414 - DNA, 16 bp, H. sapiens
aaagtcagtttgaaaa

SEQ ID NO: 8415 - DNA, 16 bp, H. sapiens
aaagtcataaatattt

SEQ ID NO: 8416 - DNA, 16 bp, H. sapiens
aaagtcatattttatt

SEQ ID NO: 8417 - DNA, 16 bp, H. sapiens
aaagtcatccataagg

SEQ ID NO: 8418 - DNA, 16 bp, H. sapiens
aaagtcatgaagatat

SEQ ID NO: 8419 - DNA, 16 bp, H. sapiens
aaagtcattgccattc

SEQ ID NO: 8420 - DNA, 16 bp, H. sapiens
aaagtcattggaattt

SEQ ID NO: 8421 - DNA, 16 bp, H. sapiens
aaagtcatttatattt

SEQ ID NO: 8422 - DNA, 16 bp, H. sapiens
aaagtcatttttcaaa

SEQ ID NO: 8423 - DNA, 16 bp, H. sapiens
aaagtcattttttaaa

SEQ ID NO: 8424 - DNA, 16 bp, H. sapiens
aaagtcattttttaat

SEQ ID NO: 8425 - DNA, 16 bp, H. sapiens
aaagtccaaagtccaa

SEQ ID NO: 8426 - DNA, 16 bp, H. sapiens
aaagtccaagcatgtt

SEQ ID NO: 8427 - DNA, 16 bp, H. sapiens
aaagtccaggaacaga

SEQ ID NO: 8428 - DNA, 16 bp, H. sapiens
aaagtccaggacctga

SEQ ID NO: 8429 - DNA, 16 bp, H. sapiens
aaagtccatagtttac

SEQ ID NO: 8430 - DNA, 16 bp, H. sapiens
aaagtcctagaagaaa

SEQ ID NO: 8431 - DNA, 16 bp, H. sapiens
aaagtcctaggattat

SEQ ID NO: 8432 - DNA, 16 bp, H. sapiens
aaagtcctttatcaga

SEQ ID NO: 8433 - DNA, 16 bp, H. sapiens
aaagtctaaaaaatat

SEQ ID NO: 8434 - DNA, 16 bp, H. sapiens
aaagtctagaaataaa

SEQ ID NO: 8435 - DNA, 16 bp, H. sapiens
aaagtctcacaaatca

SEQ ID NO: 8436 - DNA, 16 bp, H. sapiens
aaagtctcactctgtc

SEQ ID NO: 8437 - DNA, 16 bp, H. sapiens
aaagtctcatctgaga

SEQ ID NO: 8438 - DNA, 16 bp, H. sapiens
aaagtctccctctgtc

SEQ ID NO: 8439 - DNA, 16 bp, H. sapiens
aaagtctctcatcaaa

SEQ ID NO: 8440 - DNA, 16 bp, H. sapiens
aaagtctggaagaaaa

SEQ ID NO: 8441 - DNA, 16 bp, H. sapiens
aaagtctggaaggatt

SEQ ID NO: 8442 - DNA, 16 bp, H. sapiens
aaagtctggcagagac

SEQ ID NO: 8443 - DNA, 16 bp, H. sapiens
aaagtctgtacatatt

SEQ ID NO: 8444 - DNA, 16 bp, H. sapiens
aaagtcttaaaatttt

SEQ ID NO: 8445 - DNA, 16 bp, H. sapiens
aaagtcttaactcatt

SEQ ID NO: 8446 - DNA, 16 bp, H. sapiens
aaagtcttaactcttt

SEQ ID NO: 8447 - DNA, 16 bp, H. sapiens
aaagtcttagaagaaa

SEQ ID NO: 8448 - DNA, 16 bp, H. sapiens
aaagtcttatctgaga

SEQ ID NO: 8449 - DNA, 16 bp, H. sapiens
aaagtcttcccaagaa

SEQ ID NO: 8450 - DNA, 16 bp, H. sapiens
aaagtcttgctgtgtc

SEQ ID NO: 8451 - DNA, 16 bp, H. sapiens
aaagtctttaaatatt

SEQ ID NO: 8452 - DNA, 16 bp, H. sapiens
aaagtctttgaaaata

SEQ ID NO: 8453 - DNA, 16 bp, H. sapiens
aaagtcttttttgttt

SEQ ID NO: 8454 - DNA, 16 bp, H. sapiens
aaagtctttttttctt

SEQ ID NO: 8455 - DNA, 16 bp, H. sapiens
aaagtgaaaacacaat

SEQ ID NO: 8456 - DNA, 16 bp, H. sapiens
aaagtgaaaactgaaa

SEQ ID NO: 8457 - DNA, 16 bp, H. sapiens
aaagtgaaaagcagaa

SEQ ID NO: 8458 - DNA, 16 bp, H. sapiens
aaagtgaaaaggcaac

SEQ ID NO: 8459 - DNA, 16 bp, H. sapiens
aaagtgaaaatgtttt

SEQ ID NO: 8460 - DNA, 16 bp, H. sapiens
aaagtgaaaccccatc

SEQ ID NO: 8461 - DNA, 16 bp, H. sapiens
aaagtgaaagcaaaat

SEQ ID NO: 8462 - DNA, 16 bp, H. sapiens
aaagtgaaatattcaa

SEQ ID NO: 8463 - DNA, 16 bp, H. sapiens
aaagtgaaatttgaaa

SEQ ID NO: 8464 - DNA, 16 bp, H. sapiens
aaagtgaaattttatt

SEQ ID NO: 8465 - DNA, 16 bp, H. sapiens
aaagtgaacattttaa

SEQ ID NO: 8466 - DNA, 16 bp, H. sapiens
aaagtgaacctgaaaa

SEQ ID NO: 8467 - DNA, 16 bp, H. sapiens
aaagtgaagatgtaga

SEQ ID NO: 8468 - DNA, 16 bp, H. sapiens
aaagtgaagcccatca

SEQ ID NO: 8469 - DNA, 16 bp, H. sapiens
aaagtgaaggcaaaaa

SEQ ID NO: 8470 - DNA, 16 bp, H. sapiens
aaagtgaatatttatt

SEQ ID NO: 8471 - DNA, 16 bp, H. sapiens
aaagtgaatgaaagca

SEQ ID NO: 8472 - DNA, 16 bp, H. sapiens
aaagtgaatttcttat

SEQ ID NO: 8473 - DNA, 16 bp, H. sapiens
aaagtgaattttattt

SEQ ID NO: 8474 - DNA, 16 bp, H. sapiens
aaagtgacaggaaaca

SEQ ID NO: 8475 - DNA, 16 bp, H. sapiens
aaagtgagaaagatct

SEQ ID NO: 8476 - DNA, 16 bp, H. sapiens
aaagtgagaagacaaa

SEQ ID NO: 8477 - DNA, 16 bp, H. sapiens
aaagtgagagacatga

SEQ ID NO: 8478 - DNA, 16 bp, H. sapiens
aaagtgagagtctcaa

SEQ ID NO: 8479 - DNA, 16 bp, H. sapiens
aaagtgaggaaacaac

SEQ ID NO: 8480 - DNA, 16 bp, H. sapiens
aaagtgaggatgataa

SEQ ID NO: 8481 - DNA, 16 bp, H. sapiens
aaagtgaggctcaaag

SEQ ID NO: 8482 - DNA, 16 bp, H. sapiens
aaagtgagtctcttat

SEQ ID NO: 8483 - DNA, 16 bp, H. sapiens
aaagtgataaaaccaa

SEQ ID NO: 8484 - DNA, 16 bp, H. sapiens
aaagtgatattttaaa

SEQ ID NO: 8485 - DNA, 16 bp, H. sapiens
aaagtgatctgcccac

SEQ ID NO: 8486 - DNA, 16 bp, H. sapiens
aaagtgatggtgagaa

SEQ ID NO: 8487 - DNA, 16 bp, H. sapiens
aaagtgattattgata

SEQ ID NO: 8488 - DNA, 16 bp, H. sapiens
aaagtgattcagaaga

SEQ ID NO: 8489 - DNA, 16 bp, H. sapiens
aaagtgatttttctaa

SEQ ID NO: 8490 - DNA, 16 bp, H. sapiens
aaagtgatttttctct

SEQ ID NO: 8491 - DNA, 16 bp, H. sapiens
aaagtgatttttttaa

SEQ ID NO: 8492 - DNA, 16 bp, H. sapiens
aaagtgcacagccagg

SEQ ID NO: 8493 - DNA, 16 bp, H. sapiens
aaagtgcagctcgctg

SEQ ID NO: 8494 - DNA, 16 bp, H. sapiens
aaagtgccaagaaaaa

SEQ ID NO: 8495 - DNA, 16 bp, H. sapiens
aaagtgccacctccca

SEQ ID NO: 8496 - DNA, 16 bp, H. sapiens
aaagtgccattctctg

SEQ ID NO: 8497 - DNA, 18 bp, H. sapiens
aaagtgccattttctggc

SEQ ID NO: 8498 - DNA, 16 bp, H. sapiens
aaagtgctaaaggaaa

SEQ ID NO: 8499 - DNA, 16 bp, H. sapiens
aaagtgctaggattat

SEQ ID NO: 8500 - DNA, 19 bp, H. sapiens
aaagtgctagggttacagg

SEQ ID NO: 8501 - DNA, 16 bp, H. sapiens
aaagtgctgaagaaaa

SEQ ID NO: 8502 - DNA, 16 bp, H. sapiens
aaagtgctgagactat

SEQ ID NO: 8503 - DNA, 16 bp, H. sapiens
aaagtgctgctccagt

SEQ ID NO: 8504 - DNA, 16 bp, H. sapiens
aaagtgctggaataca

SEQ ID NO: 8505 - DNA, 16 bp, H. sapiens
aaagtgctggaatttt

SEQ ID NO: 8506 - DNA, 16 bp, H. sapiens
aaagtgctgggatatt

SEQ ID NO: 8507 - DNA, 16 bp, H. sapiens
aaagtgctgggattgt

SEQ ID NO: 8508 - DNA, 16 bp, H. sapiens
aaagtgctggtatcac

SEQ ID NO: 8509 - DNA, 16 bp, H. sapiens
aaagtgctgtgataac

SEQ ID NO: 8510 - DNA, 16 bp, H. sapiens
aaagtgcttagaacag

SEQ ID NO: 8511 - DNA, 16 bp, H. sapiens
aaagtgcttagcacag

SEQ ID NO: 8512 - DNA, 16 bp, H. sapiens
aaagtgcttagcagag

SEQ ID NO: 8513 - DNA, 16 bp, H. sapiens
aaagtgcttggattag

SEQ ID NO: 8514 - DNA, 16 bp, H. sapiens
aaagtgctttataaat

SEQ ID NO: 8515 - DNA, 16 bp, H. sapiens
aaagtgctttgaaaat

SEQ ID NO: 8516 - DNA, 16 bp, H. sapiens
aaagtggaagcattcc

SEQ ID NO: 8517 - DNA, 16 bp, H. sapiens
aaagtggataaagagt

SEQ ID NO: 8518 - DNA, 16 bp, H. sapiens
aaagtggcatctcatt

SEQ ID NO: 8519 - DNA, 16 bp, H. sapiens
aaagtggctctcagca

SEQ ID NO: 8520 - DNA, 16 bp, H. sapiens
aaagtgggaccagggg

SEQ ID NO: 8521 - DNA, 20 bp, H. sapiens
aaagtgggaccagggggcca

SEQ ID NO: 8522 - DNA, 16 bp, H. sapiens
aaagtgggcaaaatat

SEQ ID NO: 8523 - DNA, 16 bp, H. sapiens
aaagtgggcaaaggcc

SEQ ID NO: 8524 - DNA, 16 bp, H. sapiens
aaagtgggcagaggac

SEQ ID NO: 8525 - DNA, 16 bp, H. sapiens
aaagtggggataatga

SEQ ID NO: 8526 - DNA, 16 bp, H. sapiens
aaagtggggtattgaa

SEQ ID NO: 8527 - DNA, 16 bp, H. sapiens
aaagtggggtgttgaa

SEQ ID NO: 8528 - DNA, 16 bp, H. sapiens
aaagtgggtgagggat

SEQ ID NO: 8529 - DNA, 20 bp, H. sapiens
aaagtgggtggatcacttga

SEQ ID NO: 8530 - DNA, 16 bp, H. sapiens
aaagtggtaaaagtat

SEQ ID NO: 8531 - DNA, 16 bp, H. sapiens
aaagtggtattttaaa

SEQ ID NO: 8532 - DNA, 16 bp, H. sapiens
aaagtggtgtctgaga

SEQ ID NO: 8533 - DNA, 16 bp, H. sapiens
aaagtggttaatttta

SEQ ID NO: 8534 - DNA, 16 bp, H. sapiens
aaagtggttgaaggat

SEQ ID NO: 8535 - DNA, 16 bp, H. sapiens
aaagtgtgaagacaag

SEQ ID NO: 8536 - DNA, 16 bp, H. sapiens
aaagtgtgagaaaata

SEQ ID NO: 8537 - DNA, 16 bp, H. sapiens
aaagtgtgcggcacct

SEQ ID NO: 8538 - DNA, 16 bp, H. sapiens
aaagtgtgggattata

SEQ ID NO: 8539 - DNA, 16 bp, H. sapiens
aaagtgtgtagcacct

SEQ ID NO: 8540 - DNA, 16 bp, H. sapiens
aaagtgtgtttggaaa

SEQ ID NO: 8541 - DNA, 16 bp, H. sapiens
aaagtgtgttttatca

SEQ ID NO: 8542 - DNA, 17 bp, H. sapiens
aaagtgttcggattaca

SEQ ID NO: 8543 - DNA, 16 bp, H. sapiens
aaagtgttgaaattat

SEQ ID NO: 8544 - DNA, 16 bp, H. sapiens
aaagtgttgaagaaaa

SEQ ID NO: 8545 - DNA, 16 bp, H. sapiens
aaagtgttggcaagaa

SEQ ID NO: 8546 - DNA, 16 bp, H. sapiens
aaagtgttgggattgt

SEQ ID NO: 8547 - DNA, 16 bp, H. sapiens
aaagtgtttaataaat

SEQ ID NO: 8548 - DNA, 16 bp, H. sapiens
aaagtgtttagaacag

SEQ ID NO: 8549 - DNA, 16 bp, H. sapiens
aaagtgtttccaatct

SEQ ID NO: 8550 - DNA, 16 bp, H. sapiens
aaagtgtttgcatttt

SEQ ID NO: 8551 - DNA, 16 bp, H. sapiens
aaagtgttttgaaatt

SEQ ID NO: 8552 - DNA, 16 bp, H. sapiens
aaagttaaaacatttt

SEQ ID NO: 8553 - DNA, 16 bp, H. sapiens
aaagttaaaactataa

SEQ ID NO: 8554 - DNA, 16 bp, H. sapiens
aaagttaaagtgtaga

SEQ ID NO: 8555 - DNA, 17 bp, H. sapiens
aaagttaatatcgttat

SEQ ID NO: 8556 - DNA, 16 bp, H. sapiens
aaagttaatattctta

SEQ ID NO: 8557 - DNA, 16 bp, H. sapiens
aaagttaattatttga

SEQ ID NO: 8558 - DNA, 16 bp, H. sapiens
aaagttactatttttc

SEQ ID NO: 8559 - DNA, 16 bp, H. sapiens
aaagttactttttaaa

SEQ ID NO: 8560 - DNA, 16 bp, H. sapiens
aaagttagtagaagga

SEQ ID NO: 8561 - DNA, 16 bp, H. sapiens
aaagttataaaaatca

SEQ ID NO: 8562 - DNA, 16 bp, H. sapiens
aaagttatatgtggat

SEQ ID NO: 8563 - DNA, 16 bp, H. sapiens
aaagttatattctttt

SEQ ID NO: 8564 - DNA, 16 bp, H. sapiens
aaagttatgtttaaaa

SEQ ID NO: 8565 - DNA, 16 bp, H. sapiens
aaagttattaaaattg

SEQ ID NO: 8566 - DNA, 16 bp, H. sapiens
aaagttattttgcttt

SEQ ID NO: 8567 - DNA, 16 bp, H. sapiens
aaagttcaaaaacagg

SEQ ID NO: 8568 - DNA, 16 bp, H. sapiens
aaagttcaacatcact

SEQ ID NO: 8569 - DNA, 16 bp, H. sapiens
aaagttcaagttcaaa

SEQ ID NO: 8570 - DNA, 16 bp, H. sapiens
aaagttcagaaagaaa

SEQ ID NO: 8571 - DNA, 16 bp, H. sapiens
aaagttcaggaccaga

SEQ ID NO: 8572 - DNA, 16 bp, H. sapiens
aaagttccaaaatgtt

SEQ ID NO: 8573 - DNA, 16 bp, H. sapiens
aaagttccagaaatct

SEQ ID NO: 8574 - DNA, 16 bp, H. sapiens
aaagttccttttaaaa

SEQ ID NO: 8575 - DNA, 16 bp, H. sapiens
aaagttctggaagaaa

SEQ ID NO: 8576 - DNA, 16 bp, H. sapiens
aaagttctgtagatgt

SEQ ID NO: 8577 - DNA, 16 bp, H. sapiens
aaagttcttaacattt

SEQ ID NO: 8578 - DNA, 16 bp, H. sapiens
aaagttctttatatat

SEQ ID NO: 8579 - DNA, 16 bp, H. sapiens
aaagttctttttcttt

SEQ ID NO: 8580 - DNA, 16 bp, H. sapiens
aaagttcttttttaaa

SEQ ID NO: 8581 - DNA, 16 bp, H. sapiens
aaagttcttttttatt

SEQ ID NO: 8582 - DNA, 16 bp, H. sapiens
aaagttgaaaactttt

SEQ ID NO: 8583 - DNA, 16 bp, H. sapiens
aaagttgaaatgtttt

SEQ ID NO: 8584 - DNA, 16 bp, H. sapiens
aaagttgaacaaattg

SEQ ID NO: 8585 - DNA, 16 bp, H. sapiens
aaagttgaaggactca

SEQ ID NO: 8586 - DNA, 16 bp, H. sapiens
aaagttgaattttaaa

SEQ ID NO: 8587 - DNA, 16 bp, H. sapiens
aaagttgatctcacag

SEQ ID NO: 8588 - DNA, 16 bp, H. sapiens
aaagttgcaaagacag

SEQ ID NO: 8589 - DNA, 16 bp, H. sapiens
aaagttgccatgaaca

SEQ ID NO: 8590 - DNA, 16 bp, H. sapiens
aaagttgtacatattt

SEQ ID NO: 8591 - DNA, 16 bp, H. sapiens
aaagttgtagaaaata

SEQ ID NO: 8592 - DNA, 17 bp, H. sapiens
aaagttgtcaagatgct

SEQ ID NO: 8593 - DNA, 16 bp, H. sapiens
aaagttgtttctttga

SEQ ID NO: 8594 - DNA, 16 bp, H. sapiens
aaagttgttttaaaaa

SEQ ID NO: 8595 - DNA, 16 bp, H. sapiens
aaagttgtttttaaaa

SEQ ID NO: 8596 - DNA, 16 bp, H. sapiens
aaagttgtttttgaaa

SEQ ID NO: 8597 - DNA, 16 bp, H. sapiens
aaagtttaaaaaatac

SEQ ID NO: 8598 - DNA, 16 bp, H. sapiens
aaagtttaaaaagtag

SEQ ID NO: 8599 - DNA, 16 bp, H. sapiens
aaagtttaaaacatta

SEQ ID NO: 8600 - DNA, 16 bp, H. sapiens
aaagtttaaatctgtg

SEQ ID NO: 8601 - DNA, 16 bp, H. sapiens
aaagtttaaatgtttt

SEQ ID NO: 8602 - DNA, 16 bp, H. sapiens
aaagtttacatggaga

SEQ ID NO: 8603 - DNA, 16 bp, H. sapiens
aaagtttacatttttt

SEQ ID NO: 8604 - DNA, 16 bp, H. sapiens
aaagtttactgaaaat

SEQ ID NO: 8605 - DNA, 16 bp, H. sapiens
aaagtttacttttaaa

SEQ ID NO: 8606 - DNA, 16 bp, H. sapiens
aaagtttacttttttt

SEQ ID NO: 8607 - DNA, 16 bp, H. sapiens
aaagtttagaattttt

SEQ ID NO: 8608 - DNA, 16 bp, H. sapiens
aaagtttagtttataa

SEQ ID NO: 8609 - DNA, 16 bp, H. sapiens
aaagtttattcaaaaa

SEQ ID NO: 8610 - DNA, 16 bp, H. sapiens
aaagtttattttctat

SEQ ID NO: 8611 - DNA, 16 bp, H. sapiens
aaagtttcaaaatatt

SEQ ID NO: 8612 - DNA, 16 bp, H. sapiens
aaagtttcacagatct

SEQ ID NO: 8613 - DNA, 16 bp, H. sapiens
aaagtttcagattttg

SEQ ID NO: 8614 - DNA, 16 bp, H. sapiens
aaagtttcaggataaa

SEQ ID NO: 8615 - DNA, 16 bp, H. sapiens
aaagtttcatctgaga

SEQ ID NO: 8616 - DNA, 16 bp, H. sapiens
aaagtttcatgaaaca

SEQ ID NO: 8617 - DNA, 16 bp, H. sapiens
aaagtttcatttcttt

SEQ ID NO: 8618 - DNA, 16 bp, H. sapiens
aaagtttcattttctt

SEQ ID NO: 8619 - DNA, 16 bp, H. sapiens
aaagtttctaaaataa

SEQ ID NO: 8620 - DNA, 16 bp, H. sapiens
aaagtttctcagaatg

SEQ ID NO: 8621 - DNA, 16 bp, H. sapiens
aaagtttctgctgaaa

SEQ ID NO: 8622 - DNA, 16 bp, H. sapiens
aaagtttctttaaaaa

SEQ ID NO: 8623 - DNA, 16 bp, H. sapiens
aaagtttcttttcttt

SEQ ID NO: 8624 - DNA, 16 bp, H. sapiens
aaagtttgaaaacaaa

SEQ ID NO: 8625 - DNA, 16 bp, H. sapiens
aaagtttgagaagcat

SEQ ID NO: 8626 - DNA, 16 bp, H. sapiens
aaagtttgctttttaa

SEQ ID NO: 8627 - DNA, 16 bp, H. sapiens
aaagtttggaaaattt

SEQ ID NO: 8628 - DNA, 16 bp, H. sapiens
aaagtttgggattaca

SEQ ID NO: 8629 - DNA, 16 bp, H. sapiens
aaagtttgtgaatttg

SEQ ID NO: 8630 - DNA, 16 bp, H. sapiens
aaagtttgtgcccttt

SEQ ID NO: 8631 - DNA, 16 bp, H. sapiens
aaagtttgtttgtttg

SEQ ID NO: 8632 - DNA, 16 bp, H. sapiens
aaagttttaaaaattg

SEQ ID NO: 8633 - DNA, 16 bp, H. sapiens
aaagttttaaagcttt

SEQ ID NO: 8634 - DNA, 16 bp, H. sapiens
aaagttttaactttta

SEQ ID NO: 8635 - DNA, 16 bp, H. sapiens
aaagttttaagttttc

SEQ ID NO: 8636 - DNA, 16 bp, H. sapiens
aaagttttacagtttt

SEQ ID NO: 8637 - DNA, 16 bp, H. sapiens
aaagttttatattttc

SEQ ID NO: 8638 - DNA, 16 bp, H. sapiens
aaagttttatctctgt

SEQ ID NO: 8639 - DNA, 16 bp, H. sapiens
aaagttttattctttt

SEQ ID NO: 8640 - DNA, 16 bp, H. sapiens
aaagttttattggaac

SEQ ID NO: 8641 - DNA, 16 bp, H. sapiens
aaagttttatttcaaa

SEQ ID NO: 8642 - DNA, 16 bp, H. sapiens
aaagttttcacttttt

SEQ ID NO: 8643 - DNA, 16 bp, H. sapiens
aaagttttcataataa

SEQ ID NO: 8644 - DNA, 16 bp, H. sapiens
aaagttttcattttca

SEQ ID NO: 8645 - DNA, 16 bp, H. sapiens
aaagttttctaaattt

SEQ ID NO: 8646 - DNA, 16 bp, H. sapiens
aaagttttctcctatt

SEQ ID NO: 8647 - DNA, 16 bp, H. sapiens
aaagttttctgctatt

SEQ ID NO: 8648 - DNA, 16 bp, H. sapiens
aaagttttcttcattt

SEQ ID NO: 8649 - DNA, 16 bp, H. sapiens
aaagttttctttgttt

SEQ ID NO: 8650 - DNA, 16 bp, H. sapiens
aaagttttcttttatt

SEQ ID NO: 8651 - DNA, 16 bp, H. sapiens
aaagttttgttgattt

SEQ ID NO: 8652 - DNA, 16 bp, H. sapiens
aaagtttttaaaaagt

SEQ ID NO: 8653 - DNA, 16 bp, H. sapiens
aaagtttttaaaatga

SEQ ID NO: 8654 - DNA, 16 bp, H. sapiens
aaagtttttatctttt

SEQ ID NO: 8655 - DNA, 16 bp, H. sapiens
aaagtttttcagaaaa

SEQ ID NO: 8656 - DNA, 16 bp, H. sapiens
aaagttttttcaaaaa

SEQ ID NO: 8657 - DNA, 16 bp, H. sapiens
aaagttttttctttaa

SEQ ID NO: 8658 - DNA, 16 bp, H. sapiens
aaagtttttttagaga

SEQ ID NO: 8659 - DNA, 16 bp, H. sapiens
aaagttttttttcctt

SEQ ID NO: 8660 - DNA, 16 bp, H. sapiens
aaagtttttttttcct

SEQ ID NO: 8661 - DNA, 16 bp, H. sapiens
aaataaaaaagactgt

SEQ ID NO: 8662 - DNA, 16 bp, H. sapiens
aaataaaaaagtattc

SEQ ID NO: 8663 - DNA, 16 bp, H. sapiens
aaataaaaaatgagct

SEQ ID NO: 8664 - DNA, 16 bp, H. sapiens
aaataaaaacagcttt

SEQ ID NO: 8665 - DNA, 16 bp, H. sapiens
aaataaaaacatctgt

SEQ ID NO: 8666 - DNA, 16 bp, H. sapiens
aaataaaaacatgcat

SEQ ID NO: 8667 - DNA, 16 bp, H. sapiens
aaataaaaactacagt

SEQ ID NO: 8668 - DNA, 16 bp, H. sapiens
aaataaaaacttgttt

SEQ ID NO: 8669 - DNA, 16 bp, H. sapiens
aaataaaaacttttgt

SEQ ID NO: 8670 - DNA, 16 bp, H. sapiens
aaataaaaagcagtga

SEQ ID NO: 8671 - DNA, 16 bp, H. sapiens
aaataaaaagcatcca

SEQ ID NO: 8672 - DNA, 16 bp, H. sapiens
aaataaaaagcattat

SEQ ID NO: 8673 - DNA, 16 bp, H. sapiens
aaataaaaagcattca

SEQ ID NO: 8674 - DNA, 16 bp, H. sapiens
aaataaaaagtatact

SEQ ID NO: 8675 - DNA, 16 bp, H. sapiens
aaataaaaagtcatga

SEQ ID NO: 8676 - DNA, 16 bp, H. sapiens
aaataaaaagtgctat

SEQ ID NO: 8677 - DNA, 16 bp, H. sapiens
aaataaaaagtgtttt

SEQ ID NO: 8678 - DNA, 16 bp, H. sapiens
aaataaaaagttggga

SEQ ID NO: 8679 - DNA, 16 bp, H. sapiens
aaataaaaagttgttt

SEQ ID NO: 8680 - DNA, 16 bp, H. sapiens
aaataaaaatagcatt

SEQ ID NO: 8681 - DNA, 16 bp, H. sapiens
aaataaaaatagctat

SEQ ID NO: 8682 - DNA, 16 bp, H. sapiens
aaataaaaatcacatg

SEQ ID NO: 8683 - DNA, 16 bp, H. sapiens
aaataaaaatcacctt

SEQ ID NO: 8684 - DNA, 16 bp, H. sapiens
aaataaaaatcatgat

SEQ ID NO: 8685 - DNA, 16 bp, H. sapiens
aaataaaaatctctgg

SEQ ID NO: 8686 - DNA, 16 bp, H. sapiens
aaataaaaatctgttt

SEQ ID NO: 8687 - DNA, 16 bp, H. sapiens
aaataaaaatgcaatt

SEQ ID NO: 8688 - DNA, 16 bp, H. sapiens
aaataaaaatgcttct

SEQ ID NO: 8689 - DNA, 16 bp, H. sapiens
aaataaaaatgtaact

SEQ ID NO: 8690 - DNA, 16 bp, H. sapiens
aaataaaaatgttctt

SEQ ID NO: 8691 - DNA, 16 bp, H. sapiens
aaataaaaatgtttca

SEQ ID NO: 8692 - DNA, 16 bp, H. sapiens
aaataaaaatgttttg

SEQ ID NO: 8693 - DNA, 16 bp, H. sapiens
aaataaaaattcaagt

SEQ ID NO: 8694 - DNA, 16 bp, H. sapiens
aaataaaaattggcat

SEQ ID NO: 8695 - DNA, 16 bp, H. sapiens
aaataaaacaggacac

SEQ ID NO: 8696 - DNA, 16 bp, H. sapiens
aaataaaacagggtga

SEQ ID NO: 8697 - DNA, 16 bp, H. sapiens
aaataaaacagttttt

SEQ ID NO: 8698 - DNA, 16 bp, H. sapiens
aaataaaacatctttt

SEQ ID NO: 8699 - DNA, 16 bp, H. sapiens
aaataaaacatgcaat

SEQ ID NO: 8700 - DNA, 16 bp, H. sapiens
aaataaaacatgttaa

SEQ ID NO: 8701 - DNA, 16 bp, H. sapiens
aaataaaacattcagt

SEQ ID NO: 8702 - DNA, 16 bp, H. sapiens
aaataaaacatttttc

SEQ ID NO: 8703 - DNA, 16 bp, H. sapiens
aaataaaaccaagtta

SEQ ID NO: 8704 - DNA, 16 bp, H. sapiens
aaataaaaccagtttt

SEQ ID NO: 8705 - DNA, 16 bp, H. sapiens
aaataaaacctcagct

SEQ ID NO: 8706 - DNA, 16 bp, H. sapiens
aaataaaaccttattt

SEQ ID NO: 8707 - DNA, 16 bp, H. sapiens
aaataaaactcatttt

SEQ ID NO: 8708 - DNA, 16 bp, H. sapiens
aaataaaactctaagc

SEQ ID NO: 8709 - DNA, 16 bp, H. sapiens
aaataaaactgaagtt

SEQ ID NO: 8710 - DNA, 16 bp, H. sapiens
aaataaaactgaatat

SEQ ID NO: 8711 - DNA, 16 bp, H. sapiens
aaataaaactgatttt

SEQ ID NO: 8712 - DNA, 16 bp, H. sapiens
aaataaaactggcttt

SEQ ID NO: 8713 - DNA, 16 bp, H. sapiens
aaataaaactgtaaat

SEQ ID NO: 8714 - DNA, 16 bp, H. sapiens
aaataaaactgtcttt

SEQ ID NO: 8715 - DNA, 16 bp, H. sapiens
aaataaaactgtttct

SEQ ID NO: 8716 - DNA, 16 bp, H. sapiens
aaataaaacttctttt

SEQ ID NO: 8717 - DNA, 16 bp, H. sapiens
aaataaaacttttaag

SEQ ID NO: 8718 - DNA, 16 bp, H. sapiens
aaataaaagaatgtgg

SEQ ID NO: 8719 - DNA, 16 bp, H. sapiens
aaataaaagaattttc

SEQ ID NO: 8720 - DNA, 16 bp, H. sapiens
aaataaaagacatttt

SEQ ID NO: 8721 - DNA, 16 bp, H. sapiens
aaataaaagattcatt

SEQ ID NO: 8722 - DNA, 16 bp, H. sapiens
aaataaaagattttct

SEQ ID NO: 8723 - DNA, 16 bp, H. sapiens
aaataaaagcatttaa

SEQ ID NO: 8724 - DNA, 16 bp, H. sapiens
aaataaaagcatttat

SEQ ID NO: 8725 - DNA, 16 bp, H. sapiens
aaataaaagctaattt

SEQ ID NO: 8726 - DNA, 16 bp, H. sapiens
aaataaaagctatata

SEQ ID NO: 8727 - DNA, 16 bp, H. sapiens
aaataaaaggaaattc

SEQ ID NO: 8728 - DNA, 16 bp, H. sapiens
aaataaaaggcatcca

SEQ ID NO: 8729 - DNA, 16 bp, H. sapiens
aaataaaaggcattat

SEQ ID NO: 8730 - DNA, 16 bp, H. sapiens
aaataaaaggcatttt

SEQ ID NO: 8731 - DNA, 16 bp, H. sapiens
aaataaaaggcttcca

SEQ ID NO: 8732 - DNA, 16 bp, H. sapiens
aaataaaaggtatcca

SEQ ID NO: 8733 - DNA, 16 bp, H. sapiens
aaataaaaggtattca

SEQ ID NO: 8734 - DNA, 16 bp, H. sapiens
aaataaaaggttattt

SEQ ID NO: 8735 - DNA, 16 bp, H. sapiens
aaataaaagtcattta

SEQ ID NO: 8736 - DNA, 16 bp, H. sapiens
aaataaaagttcattt

SEQ ID NO: 8737 - DNA, 16 bp, H. sapiens
aaataaaagtttacct

SEQ ID NO: 8738 - DNA, 16 bp, H. sapiens
aaataaaagttttcat

SEQ ID NO: 8739 - DNA, 16 bp, H. sapiens
aaataaaataaatggc

SEQ ID NO: 8740 - DNA, 16 bp, H. sapiens
aaataaaataactcag

SEQ ID NO: 8741 - DNA, 16 bp, H. sapiens
aaataaaataactcct

SEQ ID NO: 8742 - DNA, 16 bp, H. sapiens
aaataaaataagcctg

SEQ ID NO: 8743 - DNA, 16 bp, H. sapiens
aaataaaataattgct

SEQ ID NO: 8744 - DNA, 16 bp, H. sapiens
aaataaaatacacatg

SEQ ID NO: 8745 - DNA, 16 bp, H. sapiens
aaataaaatacttaag

SEQ ID NO: 8746 - DNA, 16 bp, H. sapiens
aaataaaatagtgttg

SEQ ID NO: 8747 - DNA, 16 bp, H. sapiens
aaataaaatataagct

SEQ ID NO: 8748 - DNA, 16 bp, H. sapiens
aaataaaatattctga

SEQ ID NO: 8749 - DNA, 16 bp, H. sapiens
aaataaaatcagaagt

SEQ ID NO: 8750 - DNA, 16 bp, H. sapiens
aaataaaatcagaggt

SEQ ID NO: 8751 - DNA, 16 bp, H. sapiens
aaataaaatcatgcat

SEQ ID NO: 8752 - DNA, 16 bp, H. sapiens
aaataaaatcatgtct

SEQ ID NO: 8753 - DNA, 16 bp, H. sapiens
aaataaaatcattttc

SEQ ID NO: 8754 - DNA, 16 bp, H. sapiens
aaataaaatcctttct

SEQ ID NO: 8755 - DNA, 16 bp, H. sapiens
aaataaaatctgaata

SEQ ID NO: 8756 - DNA, 16 bp, H. sapiens
aaataaaatctggagt

SEQ ID NO: 8757 - DNA, 16 bp, H. sapiens
aaataaaatctgtttt

SEQ ID NO: 8758 - DNA, 16 bp, H. sapiens
aaataaaatctttgca

SEQ ID NO: 8759 - DNA, 16 bp, H. sapiens
aaataaaatgaaactt

SEQ ID NO: 8760 - DNA, 16 bp, H. sapiens
aaataaaatgacatca

SEQ ID NO: 8761 - DNA, 16 bp, H. sapiens
aaataaaatgaggtat

SEQ ID NO: 8762 - DNA, 16 bp, H. sapiens
aaataaaatgcaagcc

SEQ ID NO: 8763 - DNA, 16 bp, H. sapiens
aaataaaatgcaagta

SEQ ID NO: 8764 - DNA, 16 bp, H. sapiens
aaataaaatgcagatg

SEQ ID NO: 8765 - DNA, 16 bp, H. sapiens
aaataaaatgctaata

SEQ ID NO: 8766 - DNA, 16 bp, H. sapiens
aaataaaatgctcaaa

SEQ ID NO: 8767 - DNA, 16 bp, H. sapiens
aaataaaatgcttttt

SEQ ID NO: 8768 - DNA, 16 bp, H. sapiens
aaataaaatggcaaag

SEQ ID NO: 8769 - DNA, 16 bp, H. sapiens
aaataaaatgtataac

SEQ ID NO: 8770 - DNA, 16 bp, H. sapiens
aaataaaatgtatcta

SEQ ID NO: 8771 - DNA, 16 bp, H. sapiens
aaataaaatgtcttta

SEQ ID NO: 8772 - DNA, 16 bp, H. sapiens
aaataaaatgtggtct

SEQ ID NO: 8773 - DNA, 16 bp, H. sapiens
aaataaaatgtgtcat

SEQ ID NO: 8774 - DNA, 16 bp, H. sapiens
aaataaaatgttctat

SEQ ID NO: 8775 - DNA, 16 bp, H. sapiens
aaataaaatgttctgt

SEQ ID NO: 8776 - DNA, 16 bp, H. sapiens
aaataaaatgttcttt

SEQ ID NO: 8777 - DNA, 16 bp, H. sapiens
aaataaaatgtttact

SEQ ID NO: 8778 - DNA, 16 bp, H. sapiens
aaataaaatgtttgtt

SEQ ID NO: 8779 - DNA, 16 bp, H. sapiens
aaataaaatgttttca

SEQ ID NO: 8780 - DNA, 16 bp, H. sapiens
aaataaaattacattg

SEQ ID NO: 8781 - DNA, 16 bp, H. sapiens
aaataaaattcagata

SEQ ID NO: 8782 - DNA, 16 bp, H. sapiens
aaataaaattctcatt

SEQ ID NO: 8783 - DNA, 16 bp, H. sapiens
aaataaaattctcttt

SEQ ID NO: 8784 - DNA, 16 bp, H. sapiens
aaataaaattctgctt

SEQ ID NO: 8785 - DNA, 16 bp, H. sapiens
aaataaaattctgtca

SEQ ID NO: 8786 - DNA, 16 bp, H. sapiens
aaataaaattctttca

SEQ ID NO: 8787 - DNA, 16 bp, H. sapiens
aaataaaattgacatt

SEQ ID NO: 8788 - DNA, 16 bp, H. sapiens
aaataaaattgcataa

SEQ ID NO: 8789 - DNA, 16 bp, H. sapiens
aaataaaattgtctct

SEQ ID NO: 8790 - DNA, 16 bp, H. sapiens
aaataaaattgtgtat

SEQ ID NO: 8791 - DNA, 16 bp, H. sapiens
aaataaaattgtttca

SEQ ID NO: 8792 - DNA, 16 bp, H. sapiens
aaataaaatttagctg

SEQ ID NO: 8793 - DNA, 16 bp, H. sapiens
aaataaaatttccttt

SEQ ID NO: 8794 - DNA, 16 bp, H. sapiens
aaataaaatttctgta

SEQ ID NO: 8795 - DNA, 16 bp, H. sapiens
aaataaaatttgaact

SEQ ID NO: 8796 - DNA, 16 bp, H. sapiens
aaataaaattttctca

SEQ ID NO: 8797 - DNA, 16 bp, H. sapiens
aaataaaattttgctt

SEQ ID NO: 8798 - DNA, 16 bp, H. sapiens
aaataaacaaatggga

SEQ ID NO: 8799 - DNA, 19 bp, H. sapiens
aaataaacacaatcagaaa

SEQ ID NO: 8800 - DNA, 16 bp, H. sapiens
aaataaacacaatgag

SEQ ID NO: 8801 - DNA, 16 bp, H. sapiens
aaataaacacatagat

SEQ ID NO: 8802 - DNA, 16 bp, H. sapiens
aaataaacactatttt

SEQ ID NO: 8803 - DNA, 16 bp, H. sapiens
aaataaacagattttt

SEQ ID NO: 8804 - DNA, 16 bp, H. sapiens
aaataaacaggctggg

SEQ ID NO: 8805 - DNA, 16 bp, H. sapiens
aaataaacataagtat

SEQ ID NO: 8806 - DNA, 27 bp, H. sapiens
aaataaacatacgtgtgcatgtgtctt

SEQ ID NO: 8807 - DNA, 16 bp, H. sapiens
aaataaacatctattt

SEQ ID NO: 8808 - DNA, 16 bp, H. sapiens
aaataaacatgaattt

SEQ ID NO: 8809 - DNA, 16 bp, H. sapiens
aaataaacatgcatat

SEQ ID NO: 8810 - DNA, 16 bp, H. sapiens
aaataaacatgtatta

SEQ ID NO: 8811 - DNA, 16 bp, H. sapiens
aaataaacatgtgaaa

SEQ ID NO: 8812 - DNA, 16 bp, H. sapiens
aaataaacattgaaat

SEQ ID NO: 8813 - DNA, 16 bp, H. sapiens
aaataaacatttctca

SEQ ID NO: 8814 - DNA, 16 bp, H. sapiens
aaataaaccctcatat

SEQ ID NO: 8815 - DNA, 16 bp, H. sapiens
aaataaacctaaaatg

SEQ ID NO: 8816 - DNA, 16 bp, H. sapiens
aaataaacctcttttt

SEQ ID NO: 8817 - DNA, 16 bp, H. sapiens
aaataaacctttgtta

SEQ ID NO: 8818 - DNA, 16 bp, H. sapiens
aaataaacctttttaa

SEQ ID NO: 8819 - DNA, 16 bp, H. sapiens
aaataaactagaagat

SEQ ID NO: 8820 - DNA, 16 bp, H. sapiens
aaataaactagagaat

SEQ ID NO: 8821 - DNA, 16 bp, H. sapiens
aaataaactatggtat

SEQ ID NO: 8822 - DNA, 16 bp, H. sapiens
aaataaactattagaa

SEQ ID NO: 8823 - DNA, 16 bp, H. sapiens
aaataaactcaaaatg

SEQ ID NO: 8824 - DNA, 16 bp, H. sapiens
aaataaactcattttt

SEQ ID NO: 8825 - DNA, 16 bp, H. sapiens
aaataaactgaaatat

SEQ ID NO: 8826 - DNA, 16 bp, H. sapiens
aaataaactggatttt

SEQ ID NO: 8827 - DNA, 16 bp, H. sapiens
aaataaactgtaattt

SEQ ID NO: 8828 - DNA, 16 bp, H. sapiens
aaataaacttagaaat

SEQ ID NO: 8829 - DNA, 16 bp, H. sapiens
aaataaacttatgaaa

SEQ ID NO: 8830 - DNA, 16 bp, H. sapiens
aaataaacttgaaaat

SEQ ID NO: 8831 - DNA, 16 bp, H. sapiens
aaataaacttgtaaat

SEQ ID NO: 8832 - DNA, 16 bp, H. sapiens
aaataaacttttattg

SEQ ID NO: 8833 - DNA, 16 bp, H. sapiens
aaataaacttttcatt

SEQ ID NO: 8834 - DNA, 16 bp, H. sapiens
aaataaagaaactttt

SEQ ID NO: 8835 - DNA, 16 bp, H. sapiens
aaataaagaacattta

SEQ ID NO: 8836 - DNA, 16 bp, H. sapiens
aaataaagaagctgaa

SEQ ID NO: 8837 - DNA, 16 bp, H. sapiens
aaataaagaatatctt

SEQ ID NO: 8838 - DNA, 16 bp, H. sapiens
aaataaagacattttt

SEQ ID NO: 8839 - DNA, 16 bp, H. sapiens
aaataaagactggaaa

SEQ ID NO: 8840 - DNA, 16 bp, H. sapiens
aaataaagaggctggg

SEQ ID NO: 8841 - DNA, 16 bp, H. sapiens
aaataaagaggttctt

SEQ ID NO: 8842 - DNA, 16 bp, H. sapiens
aaataaagatattttc

SEQ ID NO: 8843 - DNA, 16 bp, H. sapiens
aaataaagatgatttt

SEQ ID NO: 8844 - DNA, 16 bp, H. sapiens
aaataaagatgttatt

SEQ ID NO: 8845 - DNA, 16 bp, H. sapiens
aaataaagatttcttt

SEQ ID NO: 8846 - DNA, 16 bp, H. sapiens
aaataaagattttctt

SEQ ID NO: 8847 - DNA, 16 bp, H. sapiens
aaataaagcaaaacct

SEQ ID NO: 8848 - DNA, 16 bp, H. sapiens
aaataaagcacacaat

SEQ ID NO: 8849 - DNA, 16 bp, H. sapiens
aaataaagccattttt

SEQ ID NO: 8850 - DNA, 16 bp, H. sapiens
aaataaagctaattaa

SEQ ID NO: 8851 - DNA, 16 bp, H. sapiens
aaataaagctgtcttt

SEQ ID NO: 8852 - DNA, 16 bp, H. sapiens
aaataaagcttatttt

SEQ ID NO: 8853 - DNA, 16 bp, H. sapiens
aaataaagctttattg

SEQ ID NO: 8854 - DNA, 16 bp, H. sapiens
aaataaagctttattt

SEQ ID NO: 8855 - DNA, 16 bp, H. sapiens
aaataaagcttttaaa

SEQ ID NO: 8856 - DNA, 16 bp, H. sapiens
aaataaaggcagaaat

SEQ ID NO: 8857 - DNA, 16 bp, H. sapiens
aaataaaggcatatat

SEQ ID NO: 8858 - DNA, 16 bp, H. sapiens
aaataaaggccaggcg

SEQ ID NO: 8859 - DNA, 16 bp, H. sapiens
aaataaaggctattca

SEQ ID NO: 8860 - DNA, 16 bp, H. sapiens
aaataaagggacagaa

SEQ ID NO: 8861 - DNA, 16 bp, H. sapiens
aaataaagggcattca

SEQ ID NO: 8862 - DNA, 16 bp, H. sapiens
aaataaagggtatttg

SEQ ID NO: 8863 - DNA, 16 bp, H. sapiens
aaataaaggtgttttt

SEQ ID NO: 8864 - DNA, 16 bp, H. sapiens
aaataaagtaaatgtg

SEQ ID NO: 8865 - DNA, 16 bp, H. sapiens
aaataaagtacatttt

SEQ ID NO: 8866 - DNA, 16 bp, H. sapiens
aaataaagtagtattg

SEQ ID NO: 8867 - DNA, 16 bp, H. sapiens
aaataaagtattttga

SEQ ID NO: 8868 - DNA, 16 bp, H. sapiens
aaataaagtcaatttt

SEQ ID NO: 8869 - DNA, 16 bp, H. sapiens
aaataaagtcactttt

SEQ ID NO: 8870 - DNA, 16 bp, H. sapiens
aaataaagtctatttt

SEQ ID NO: 8871 - DNA, 16 bp, H. sapiens
aaataaagtgtattca

SEQ ID NO: 8872 - DNA, 16 bp, H. sapiens
aaataaagtgtgtgtg

SEQ ID NO: 8873 - DNA, 16 bp, H. sapiens
aaataaagttattttc

SEQ ID NO: 8874 - DNA, 16 bp, H. sapiens
aaataaagttcaaaat

SEQ ID NO: 8875 - DNA, 16 bp, H. sapiens
aaataaagttcatttt

SEQ ID NO: 8876 - DNA, 16 bp, H. sapiens
aaataaagtttaattg

SEQ ID NO: 8877 - DNA, 16 bp, H. sapiens
aaataaagtttactaa

SEQ ID NO: 8878 - DNA, 16 bp, H. sapiens
aaataaagtttctaaa

SEQ ID NO: 8879 - DNA, 16 bp, H. sapiens
aaataaagttttcttt

SEQ ID NO: 8880 - DNA, 16 bp, H. sapiens
aaataaataaacctga

SEQ ID NO: 8881 - DNA, 16 bp, H. sapiens
aaataaataaataggc

SEQ ID NO: 8882 - DNA, 16 bp, H. sapiens
aaataaataagatcag

SEQ ID NO: 8883 - DNA, 16 bp, H. sapiens
aaataaataagtgaca

SEQ ID NO: 8884 - DNA, 16 bp, H. sapiens
aaataaataatgactg

SEQ ID NO: 8885 - DNA, 16 bp, H. sapiens
aaataaatacaatgtt

SEQ ID NO: 8886 - DNA, 16 bp, H. sapiens
aaataaatacagatgt

SEQ ID NO: 8887 - DNA, 16 bp, H. sapiens
aaataaatacagtcat

SEQ ID NO: 8888 - DNA, 16 bp, H. sapiens
aaataaatacatgcta

SEQ ID NO: 8889 - DNA, 16 bp, H. sapiens
aaataaatacctattt

SEQ ID NO: 8890 - DNA, 16 bp, H. sapiens
aaataaatacttttca

SEQ ID NO: 8891 - DNA, 16 bp, H. sapiens
aaataaatagctatat

SEQ ID NO: 8892 - DNA, 16 bp, H. sapiens
aaataaatagctgggc

SEQ ID NO: 8893 - DNA, 16 bp, H. sapiens
aaataaatatatatgc

SEQ ID NO: 8894 - DNA, 16 bp, H. sapiens
aaataaatatctagaa

SEQ ID NO: 8895 - DNA, 16 bp, H. sapiens
aaataaatatgcacat

SEQ ID NO: 8896 - DNA, 16 bp, H. sapiens
aaataaatatgctaaa

SEQ ID NO: 8897 - DNA, 16 bp, H. sapiens
aaataaatatgtgtta

SEQ ID NO: 8898 - DNA, 16 bp, H. sapiens
aaataaatattcactt

SEQ ID NO: 8899 - DNA, 16 bp, H. sapiens
aaataaatattggcaa

SEQ ID NO: 8900 - DNA, 16 bp, H. sapiens
aaataaatcaaaatgg

SEQ ID NO: 8901 - DNA, 16 bp, H. sapiens
aaataaatcacagatg

SEQ ID NO: 8902 - DNA, 16 bp, H. sapiens
aaataaatcacatttt

SEQ ID NO: 8903 - DNA, 16 bp, H. sapiens
aaataaatcattcagt

SEQ ID NO: 8904 - DNA, 16 bp, H. sapiens
aaataaatgaatgaac

SEQ ID NO: 8905 - DNA, 16 bp, H. sapiens
aaataaatgaatgttt

SEQ ID NO: 8906 - DNA, 16 bp, H. sapiens
aaataaatgaattact

SEQ ID NO: 8907 - DNA, 16 bp, H. sapiens
aaataaatgagaacat

SEQ ID NO: 8908 - DNA, 16 bp, H. sapiens
aaataaatgagctatt

SEQ ID NO: 8909 - DNA, 16 bp, H. sapiens
aaataaatgcaaacac

SEQ ID NO: 8910 - DNA, 16 bp, H. sapiens
aaataaatgcattttt

SEQ ID NO: 8911 - DNA, 16 bp, H. sapiens
aaataaatgctcattt

SEQ ID NO: 8912 - DNA, 16 bp, H. sapiens
aaataaatgcttattt

SEQ ID NO: 8913 - DNA, 16 bp, H. sapiens
aaataaatggaaacac

SEQ ID NO: 8914 - DNA, 16 bp, H. sapiens
aaataaatggaacaga

SEQ ID NO: 8915 - DNA, 16 bp, H. sapiens
aaataaatggaagaac

SEQ ID NO: 8916 - DNA, 16 bp, H. sapiens
aaataaatggagatat

SEQ ID NO: 8917 - DNA, 16 bp, H. sapiens
aaataaatggatgaag

SEQ ID NO: 8918 - DNA, 16 bp, H. sapiens
aaataaatggatgagt

SEQ ID NO: 8919 - DNA, 16 bp, H. sapiens
aaataaatggcagaaa

SEQ ID NO: 8920 - DNA, 16 bp, H. sapiens
aaataaatggctgttg

SEQ ID NO: 8921 - DNA, 16 bp, H. sapiens
aaataaatgtacaata

SEQ ID NO: 8922 - DNA, 16 bp, H. sapiens
aaataaatgtacaatt

SEQ ID NO: 8923 - DNA, 16 bp, H. sapiens
aaataaatgtagcaaa

SEQ ID NO: 8924 - DNA, 16 bp, H. sapiens
aaataaatgtatttct

SEQ ID NO: 8925 - DNA, 16 bp, H. sapiens
aaataaatgtatttgt

SEQ ID NO: 8926 - DNA, 16 bp, H. sapiens
aaataaatgtctttat

SEQ ID NO: 8927 - DNA, 16 bp, H. sapiens
aaataaatgtgcattt

SEQ ID NO: 8928 - DNA, 16 bp, H. sapiens
aaataaatgtgtatat

SEQ ID NO: 8929 - DNA, 16 bp, H. sapiens
aaataaatgtgtattt

SEQ ID NO: 8930 - DNA, 16 bp, H. sapiens
aaataaatgtttaact

SEQ ID NO: 8931 - DNA, 16 bp, H. sapiens
aaataaatgtttcaaa

SEQ ID NO: 8932 - DNA, 16 bp, H. sapiens
aaataaatgtttgcaa

SEQ ID NO: 8933 - DNA, 16 bp, H. sapiens
aaataaatgttttcct

SEQ ID NO: 8934 - DNA, 16 bp, H. sapiens
aaataaattatatgca

SEQ ID NO: 8935 - DNA, 16 bp, H. sapiens
aaataaattatgtcat

SEQ ID NO: 8936 - DNA, 16 bp, H. sapiens
aaataaattatttctg

SEQ ID NO: 8937 - DNA, 16 bp, H. sapiens
aaataaattcacattt

SEQ ID NO: 8938 - DNA, 16 bp, H. sapiens
aaataaattcagtaaa

SEQ ID NO: 8939 - DNA, 16 bp, H. sapiens
aaataaattcctttct

SEQ ID NO: 8940 - DNA, 16 bp, H. sapiens
aaataaattgaaaact

SEQ ID NO: 8941 - DNA, 16 bp, H. sapiens
aaataaattgaatgtt

SEQ ID NO: 8942 - DNA, 16 bp, H. sapiens
aaataaattgcaaatt

SEQ ID NO: 8943 - DNA, 16 bp, H. sapiens
aaataaattgctttta

SEQ ID NO: 8944 - DNA, 16 bp, H. sapiens
aaataaattgttacaa

SEQ ID NO: 8945 - DNA, 16 bp, H. sapiens
aaataaatttcctttt

SEQ ID NO: 8946 - DNA, 16 bp, H. sapiens
aaataaatttctgttc

SEQ ID NO: 8947 - DNA, 16 bp, H. sapiens
aaataaatttcttttg

SEQ ID NO: 8948 - DNA, 16 bp, H. sapiens
aaataaatttgagaag

SEQ ID NO: 8949 - DNA, 16 bp, H. sapiens
aaataaatttgcttta

SEQ ID NO: 8950 - DNA, 16 bp, H. sapiens
aaataaatttgttttg

SEQ ID NO: 8951 - DNA, 16 bp, H. sapiens
aaataaattttagttg

SEQ ID NO: 8952 - DNA, 16 bp, H. sapiens
aaataaattttgcatt

SEQ ID NO: 8953 - DNA, 16 bp, H. sapiens
aaataacaatagcaac

SEQ ID NO: 8954 - DNA, 16 bp, H. sapiens
aaataacacaaatggg

SEQ ID NO: 8955 - DNA, 16 bp, H. sapiens
aaataacacacattta

SEQ ID NO: 8956 - DNA, 16 bp, H. sapiens
aaataacagtgaaagg

SEQ ID NO: 8957 - DNA, 16 bp, H. sapiens
aaataacagtggctta

SEQ ID NO: 8958 - DNA, 16 bp, H. sapiens
aaataacataagctat

SEQ ID NO: 8959 - DNA, 16 bp, H. sapiens
aaataacatatgtaaa

SEQ ID NO: 8960 - DNA, 16 bp, H. sapiens
aaataacatatttgaa

SEQ ID NO: 8961 - DNA, 16 bp, H. sapiens
aaataacattgaatta

SEQ ID NO: 8962 - DNA, 16 bp, H. sapiens
aaataacattgttttt

SEQ ID NO: 8963 - DNA, 16 bp, H. sapiens
aaataacatttgaaaa

SEQ ID NO: 8964 - DNA, 16 bp, H. sapiens
aaataacattttacca

SEQ ID NO: 8965 - DNA, 16 bp, H. sapiens
aaataacattttcttt

SEQ ID NO: 8966 - DNA, 16 bp, H. sapiens
aaataacattttttct

SEQ ID NO: 8967 - DNA, 17 bp, H. sapiens
aaataaccaagatcaga

SEQ ID NO: 8968 - DNA, 16 bp, H. sapiens
aaataaccaggaaaga

SEQ ID NO: 8969 - DNA, 16 bp, H. sapiens
aaataaccataaaagt

SEQ ID NO: 8970 - DNA, 16 bp, H. sapiens
aaataaccatgaaaat

SEQ ID NO: 8971 - DNA, 16 bp, H. sapiens
aaataaccattttaag

SEQ ID NO: 8972 - DNA, 16 bp, H. sapiens
aaataactattttctt

SEQ ID NO: 8973 - DNA, 16 bp, H. sapiens
aaataactcttagaaa

SEQ ID NO: 8974 - DNA, 16 bp, H. sapiens
aaataactcttatttt

SEQ ID NO: 8975 - DNA, 16 bp, H. sapiens
aaataactgaaatgaa

SEQ ID NO: 8976 - DNA, 16 bp, H. sapiens
aaataactgagactgg

SEQ ID NO: 8977 - DNA, 16 bp, H. sapiens
aaataactgttttaaa

SEQ ID NO: 8978 - DNA, 16 bp, H. sapiens
aaataacttaaaatag

SEQ ID NO: 8979 - DNA, 16 bp, H. sapiens
aaataacttaaatgtt

SEQ ID NO: 8980 - DNA, 16 bp, H. sapiens
aaataacttgctcaaa

SEQ ID NO: 8981 - DNA, 16 bp, H. sapiens
aaataacttgtttttt

SEQ ID NO: 8982 - DNA, 16 bp, H. sapiens
aaataactttgaaaaa

SEQ ID NO: 8983 - DNA, 16 bp, H. sapiens
aaataacttttttctc

SEQ ID NO: 8984 - DNA, 16 bp, H. sapiens
aaataactttttttca

SEQ ID NO: 8985 - DNA, 16 bp, H. sapiens
aaataagaaaagcttt

SEQ ID NO: 8986 - DNA, 16 bp, H. sapiens
aaataagaaaatgcat

SEQ ID NO: 8987 - DNA, 16 bp, H. sapiens
aaataagaaaatggca

SEQ ID NO: 8988 - DNA, 16 bp, H. sapiens
aaataagaaaatttca

SEQ ID NO: 8989 - DNA, 16 bp, H. sapiens
aaataagaaataatgc

SEQ ID NO: 8990 - DNA, 16 bp, H. sapiens
aaataagaaatactta

SEQ ID NO: 8991 - DNA, 16 bp, H. sapiens
aaataagaaatctttt

SEQ ID NO: 8992 - DNA, 16 bp, H. sapiens
aaataagaactttttt

SEQ ID NO: 8993 - DNA, 16 bp, H. sapiens
aaataagaatattgtg

SEQ ID NO: 8994 - DNA, 16 bp, H. sapiens
aaataagaattttctt

SEQ ID NO: 8995 - DNA, 16 bp, H. sapiens
aaataagacagacaag

SEQ ID NO: 8996 - DNA, 16 bp, H. sapiens
aaataagacagacaga

SEQ ID NO: 8997 - DNA, 16 bp, H. sapiens
aaataagacatgcaga

SEQ ID NO: 8998 - DNA, 16 bp, H. sapiens
aaataagactttaaaa

SEQ ID NO: 8999 - DNA, 16 bp, H. sapiens
aaataagagagatgta

SEQ ID NO: 9000 - DNA, 16 bp, H. sapiens
aaataagagccatcta

SEQ ID NO: 9001 - DNA, 16 bp, H. sapiens
aaataagatatttttc

SEQ ID NO: 9002 - DNA, 16 bp, H. sapiens
aaataagattattttc

SEQ ID NO: 9003 - DNA, 16 bp, H. sapiens
aaataagattctaaaa

SEQ ID NO: 9004 - DNA, 16 bp, H. sapiens
aaataagatttctttc

SEQ ID NO: 9005 - DNA, 16 bp, H. sapiens
aaataagcaagtcaca

SEQ ID NO: 9006 - DNA, 16 bp, H. sapiens
aaataagccaaatttc

SEQ ID NO: 9007 - DNA, 16 bp, H. sapiens
aaataagcctggcatg

SEQ ID NO: 9008 - DNA, 16 bp, H. sapiens
aaataagctttaaaat

SEQ ID NO: 9009 - DNA, 16 bp, H. sapiens
aaataaggaaatcaag

SEQ ID NO: 9010 - DNA, 16 bp, H. sapiens
aaataaggaaattgag

SEQ ID NO: 9011 - DNA, 16 bp, H. sapiens
aaataaggaatccttt

SEQ ID NO: 9012 - DNA, 16 bp, H. sapiens
aaataaggacattaaa

SEQ ID NO: 9013 - DNA, 16 bp, H. sapiens
aaataaggttttaatt

SEQ ID NO: 9014 - DNA, 16 bp, H. sapiens
aaataaggttttattt

SEQ ID NO: 9015 - DNA, 16 bp, H. sapiens
aaataagtagataagt

SEQ ID NO: 9016 - DNA, 16 bp, H. sapiens
aaataagtatttttca

SEQ ID NO: 9017 - DNA, 16 bp, H. sapiens
aaataagtatttttct

SEQ ID NO: 9018 - DNA, 16 bp, H. sapiens
aaataagtcaatcaca

SEQ ID NO: 9019 - DNA, 16 bp, H. sapiens
aaataagtcattattc

SEQ ID NO: 9020 - DNA, 16 bp, H. sapiens
aaataagtgaacaaat

SEQ ID NO: 9021 - DNA, 16 bp, H. sapiens
aaataagttatttact

SEQ ID NO: 9022 - DNA, 16 bp, H. sapiens
aaataagttatttagt

SEQ ID NO: 9023 - DNA, 16 bp, H. sapiens
aaataagttattttct

SEQ ID NO: 9024 - DNA, 16 bp, H. sapiens
aaataagtttaatgga

SEQ ID NO: 9025 - DNA, 16 bp, H. sapiens
aaataagtttcttttt

SEQ ID NO: 9026 - DNA, 16 bp, H. sapiens
aaataagttttacaaa

SEQ ID NO: 9027 - DNA, 16 bp, H. sapiens
aaataagttttttgaa

SEQ ID NO: 9028 - DNA, 16 bp, H. sapiens
aaataataaaagccat

SEQ ID NO: 9029 - DNA, 16 bp, H. sapiens
aaataataaaagctgt

SEQ ID NO: 9030 - DNA, 16 bp, H. sapiens
aaataataaagctgga

SEQ ID NO: 9031 - DNA, 16 bp, H. sapiens
aaataataaagtctat

SEQ ID NO: 9032 - DNA, 16 bp, H. sapiens
aaataataatgtaact

SEQ ID NO: 9033 - DNA, 16 bp, H. sapiens
aaataataatgtatgt

SEQ ID NO: 9034 - DNA, 16 bp, H. sapiens
aaataatacagataat

SEQ ID NO: 9035 - DNA, 16 bp, H. sapiens
aaataatacagatcag

SEQ ID NO: 9036 - DNA, 16 bp, H. sapiens
aaataatacagatttt

SEQ ID NO: 9037 - DNA, 16 bp, H. sapiens
aaataatactgatttt

SEQ ID NO: 9038 - DNA, 16 bp, H. sapiens
aaataatagaacaatt

SEQ ID NO: 9039 - DNA, 16 bp, H. sapiens
aaataatagaattgct

SEQ ID NO: 9040 - DNA, 16 bp, H. sapiens
aaataatagcaatgta

SEQ ID NO: 9041 - DNA, 16 bp, H. sapiens
aaataatagcacctac

SEQ ID NO: 9042 - DNA, 16 bp, H. sapiens
aaataatagccatcct

SEQ ID NO: 9043 - DNA, 16 bp, H. sapiens
aaataatagctaaaat

SEQ ID NO: 9044 - DNA, 16 bp, H. sapiens
aaataatatctttcaa

SEQ ID NO: 9045 - DNA, 16 bp, H. sapiens
aaataatatgatgtct

SEQ ID NO: 9046 - DNA, 16 bp, H. sapiens
aaataatatgtacaca

SEQ ID NO: 9047 - DNA, 16 bp, H. sapiens
aaataatattcatgaa

SEQ ID NO: 9048 - DNA, 16 bp, H. sapiens
aaataatattccattg

SEQ ID NO: 9049 - DNA, 16 bp, H. sapiens
aaataatattttccaa

SEQ ID NO: 9050 - DNA, 16 bp, H. sapiens
aaataatattttctct

SEQ ID NO: 9051 - DNA, 16 bp, H. sapiens
aaataatcaaaaggat

SEQ ID NO: 9052 - DNA, 16 bp, H. sapiens
aaataatcactttttt

SEQ ID NO: 9053 - DNA, 16 bp, H. sapiens
aaataatcagacaaat

SEQ ID NO: 9054 - DNA, 16 bp, H. sapiens
aaataatcagattttt

SEQ ID NO: 9055 - DNA, 16 bp, H. sapiens
aaataatcattttcat

SEQ ID NO: 9056 - DNA, 16 bp, H. sapiens
aaataatcctatcaaa

SEQ ID NO: 9057 - DNA, 16 bp, H. sapiens
aaataatctaatgaaa

SEQ ID NO: 9058 - DNA, 16 bp, H. sapiens
aaataatctctttaat

SEQ ID NO: 9059 - DNA, 16 bp, H. sapiens
aaataatctgtacaaa

SEQ ID NO: 9060 - DNA, 16 bp, H. sapiens
aaataatctttactgg

SEQ ID NO: 9061 - DNA, 16 bp, H. sapiens
aaataatgaaaacttt

SEQ ID NO: 9062 - DNA, 16 bp, H. sapiens
aaataatgacaattat

SEQ ID NO: 9063 - DNA, 16 bp, H. sapiens
aaataatgacatttta

SEQ ID NO: 9064 - DNA, 16 bp, H. sapiens
aaataatgactgaaaa

SEQ ID NO: 9065 - DNA, 16 bp, H. sapiens
aaataatgcaaaaatt

SEQ ID NO: 9066 - DNA, 16 bp, H. sapiens
aaataatgcaaggaaa

SEQ ID NO: 9067 - DNA, 16 bp, H. sapiens
aaataatgcatataat

SEQ ID NO: 9068 - DNA, 16 bp, H. sapiens
aaataatgcattttct

SEQ ID NO: 9069 - DNA, 16 bp, H. sapiens
aaataatgcctttttt

SEQ ID NO: 9070 - DNA, 16 bp, H. sapiens
aaataatgctgaaaaa

SEQ ID NO: 9071 - DNA, 16 bp, H. sapiens
aaataatggctgaaaa

SEQ ID NO: 9072 - DNA, 16 bp, H. sapiens
aaataatgggcaaaaa

SEQ ID NO: 9073 - DNA, 16 bp, H. sapiens
aaataatgtaaacatt

SEQ ID NO: 9074 - DNA, 16 bp, H. sapiens
aaataatgtagtttta

SEQ ID NO: 9075 - DNA, 16 bp, H. sapiens
aaataatgtcttattt

SEQ ID NO: 9076 - DNA, 16 bp, H. sapiens
aaataatgtgtatata

SEQ ID NO: 9077 - DNA, 16 bp, H. sapiens
aaataatgtgtgtgtg

SEQ ID NO: 9078 - DNA, 16 bp, H. sapiens
aaataatgttaacatt

SEQ ID NO: 9079 - DNA, 16 bp, H. sapiens
aaataatgttcttttt

SEQ ID NO: 9080 - DNA, 16 bp, H. sapiens
aaataatgttgatatt

SEQ ID NO: 9081 - DNA, 16 bp, H. sapiens
aaataatgtttcaatt

SEQ ID NO: 9082 - DNA, 16 bp, H. sapiens
aaataatgtttctttt

SEQ ID NO: 9083 - DNA, 16 bp, H. sapiens
aaataatgtttgcttt

SEQ ID NO: 9084 - DNA, 16 bp, H. sapiens
aaataatgttttcaaa

SEQ ID NO: 9085 - DNA, 16 bp, H. sapiens
aaataatgttttcaat

SEQ ID NO: 9086 - DNA, 16 bp, H. sapiens
aaataattaatgcaaa

SEQ ID NO: 9087 - DNA, 16 bp, H. sapiens
aaataattatttcaca

SEQ ID NO: 9088 - DNA, 16 bp, H. sapiens
aaataattatttccca

SEQ ID NO: 9089 - DNA, 16 bp, H. sapiens
aaataattatttggaa

SEQ ID NO: 9090 - DNA, 16 bp, H. sapiens
aaataattattttcca

SEQ ID NO: 9091 - DNA, 16 bp, H. sapiens
aaataattcagaaaca

SEQ ID NO: 9092 - DNA, 16 bp, H. sapiens
aaataattcagaagaa

SEQ ID NO: 9093 - DNA, 16 bp, H. sapiens
aaataattctcagcaa

SEQ ID NO: 9094 - DNA, 16 bp, H. sapiens
aaataattctgctttt

SEQ ID NO: 9095 - DNA, 16 bp, H. sapiens
aaataattgaaagtag

SEQ ID NO: 9096 - DNA, 16 bp, H. sapiens
aaataattgcaaaata

SEQ ID NO: 9097 - DNA, 16 bp, H. sapiens
aaataattgcaataaa

SEQ ID NO: 9098 - DNA, 16 bp, H. sapiens
aaataattggaaattt

SEQ ID NO: 9099 - DNA, 16 bp, H. sapiens
aaataattgtatttct

SEQ ID NO: 9100 - DNA, 16 bp, H. sapiens
aaataattgtgtatat

SEQ ID NO: 9101 - DNA, 16 bp, H. sapiens
aaataatttaaagaca

SEQ ID NO: 9102 - DNA, 16 bp, H. sapiens
aaataatttatgacca

SEQ ID NO: 9103 - DNA, 16 bp, H. sapiens
aaataatttattcaag

SEQ ID NO: 9104 - DNA, 16 bp, H. sapiens
aaataatttcaagaaa

SEQ ID NO: 9105 - DNA, 16 bp, H. sapiens
aaataatttcaagttt

SEQ ID NO: 9106 - DNA, 16 bp, H. sapiens
aaataatttcagtaaa

SEQ ID NO: 9107 - DNA, 16 bp, H. sapiens
aaataatttcagttat

SEQ ID NO: 9108 - DNA, 16 bp, H. sapiens
aaataatttcatagaa

SEQ ID NO: 9109 - DNA, 16 bp, H. sapiens
aaataatttccatatt

SEQ ID NO: 9110 - DNA, 16 bp, H. sapiens
aaataatttctggaaa

SEQ ID NO: 9111 - DNA, 16 bp, H. sapiens
aaataatttgaacaaa

SEQ ID NO: 9112 - DNA, 16 bp, H. sapiens
aaataatttgcttttt

SEQ ID NO: 9113 - DNA, 16 bp, H. sapiens
aaataatttggtaaat

SEQ ID NO: 9114 - DNA, 16 bp, H. sapiens
aaataatttgtttact

SEQ ID NO: 9115 - DNA, 16 bp, H. sapiens
aaataattttaaagtg

SEQ ID NO: 9116 - DNA, 16 bp, H. sapiens
aaataattttatctgt

SEQ ID NO: 9117 - DNA, 16 bp, H. sapiens
aaataattttatgcca

SEQ ID NO: 9118 - DNA, 16 bp, H. sapiens
aaataattttcaacac

SEQ ID NO: 9119 - DNA, 16 bp, H. sapiens
aaataattttcaagtt

SEQ ID NO: 9120 - DNA, 16 bp, H. sapiens
aaataattttcagaat

SEQ ID NO: 9121 - DNA, 16 bp, H. sapiens
aaataattttcatttc

SEQ ID NO: 9122 - DNA, 16 bp, H. sapiens
aaataattttccattt

SEQ ID NO: 9123 - DNA, 16 bp, H. sapiens
aaataattttcccaaa

SEQ ID NO: 9124 - DNA, 16 bp, H. sapiens
aaataattttggagaa

SEQ ID NO: 9125 - DNA, 16 bp, H. sapiens
aaataattttggcttt

SEQ ID NO: 9126 - DNA, 16 bp, H. sapiens
aaataattttgtcttt

SEQ ID NO: 9127 - DNA, 16 bp, H. sapiens
aaataatttttaaagg

SEQ ID NO: 9128 - DNA, 16 bp, H. sapiens
aaataatttttcctct

SEQ ID NO: 9129 - DNA, 16 bp, H. sapiens
aaataatttttgaaag

SEQ ID NO: 9130 - DNA, 16 bp, H. sapiens
aaatacaaaaaattgt

SEQ ID NO: 9131 - DNA, 16 bp, H. sapiens
aaatacaaaaaggtag

SEQ ID NO: 9132 - DNA, 16 bp, H. sapiens
aaatacaaaaattggt

SEQ ID NO: 9133 - DNA, 16 bp, H. sapiens
aaatacaaaagaattt

SEQ ID NO: 9134 - DNA, 16 bp, H. sapiens
aaatacaaaataagct

SEQ ID NO: 9135 - DNA, 16 bp, H. sapiens
aaatacaaaatattag

SEQ ID NO: 9136 - DNA, 16 bp, H. sapiens
aaatacaaaatgtttt

SEQ ID NO: 9137 - DNA, 16 bp, H. sapiens
aaatacaaagtaccat

SEQ ID NO: 9138 - DNA, 16 bp, H. sapiens
aaatacaaatgctttt

SEQ ID NO: 9139 - DNA, 16 bp, H. sapiens
aaatacaaatgtgaaa

SEQ ID NO: 9140 - DNA, 16 bp, H. sapiens
aaatacaataatagct

SEQ ID NO: 9141 - DNA, 16 bp, H. sapiens
aaatacaatgggaata

SEQ ID NO: 9142 - DNA, 16 bp, H. sapiens
aaatacaatggtggaa

SEQ ID NO: 9143 - DNA, 16 bp, H. sapiens
aaatacaatgtatttt

SEQ ID NO: 9144 - DNA, 16 bp, H. sapiens
aaatacaatttcattt

SEQ ID NO: 9145 - DNA, 16 bp, H. sapiens
aaatacaatttgaaat

SEQ ID NO: 9146 - DNA, 16 bp, H. sapiens
aaatacaatttgtaaa

SEQ ID NO: 9147 - DNA, 16 bp, H. sapiens
aaatacacaaaattag

SEQ ID NO: 9148 - DNA, 16 bp, H. sapiens
aaatacacaattattt

SEQ ID NO: 9149 - DNA, 16 bp, H. sapiens
aaatacacatgaaatt

SEQ ID NO: 9150 - DNA, 16 bp, H. sapiens
aaatacacatttactt

SEQ ID NO: 9151 - DNA, 16 bp, H. sapiens
aaatacacatttgaaa

SEQ ID NO: 9152 - DNA, 16 bp, H. sapiens
aaatacactttgaaaa

SEQ ID NO: 9153 - DNA, 16 bp, H. sapiens
aaatacagaacatttt

SEQ ID NO: 9154 - DNA, 16 bp, H. sapiens
aaatacagaatttcag

SEQ ID NO: 9155 - DNA, 16 bp, H. sapiens
aaatacagaattttaa

SEQ ID NO: 9156 - DNA, 16 bp, H. sapiens
aaatacagactttaaa

SEQ ID NO: 9157 - DNA, 18 bp, H. sapiens
aaatacagagaccaccac

SEQ ID NO: 9158 - DNA, 16 bp, H. sapiens
aaatacagatcaaaac

SEQ ID NO: 9159 - DNA, 16 bp, H. sapiens
aaatacagatgcaaaa

SEQ ID NO: 9160 - DNA, 16 bp, H. sapiens
aaatacagattcctag

SEQ ID NO: 9161 - DNA, 16 bp, H. sapiens
aaatacagatttttat

SEQ ID NO: 9162 - DNA, 16 bp, H. sapiens
aaatacagattttttt

SEQ ID NO: 9163 - DNA, 16 bp, H. sapiens
aaatacagcttttttt

SEQ ID NO: 9164 - DNA, 16 bp, H. sapiens
aaatacaggttttttt

SEQ ID NO: 9165 - DNA, 16 bp, H. sapiens
aaatacagtaaaattt

SEQ ID NO: 9166 - DNA, 16 bp, H. sapiens
aaatacagtagtcccc

SEQ ID NO: 9167 - DNA, 16 bp, H. sapiens
aaatacagtataaata

SEQ ID NO: 9168 - DNA, 16 bp, H. sapiens
aaatacagtcacatta

SEQ ID NO: 9169 - DNA, 16 bp, H. sapiens
aaatacagtcattcca

SEQ ID NO: 9170 - DNA, 16 bp, H. sapiens
aaatacagttacattg

SEQ ID NO: 9171 - DNA, 16 bp, H. sapiens
aaatacagttatttta

SEQ ID NO: 9172 - DNA, 16 bp, H. sapiens
aaatacagttgatcct

SEQ ID NO: 9173 - DNA, 16 bp, H. sapiens
aaatacagtttcaaaa

SEQ ID NO: 9174 - DNA, 16 bp, H. sapiens
aaatacagttttaaaa

SEQ ID NO: 9175 - DNA, 16 bp, H. sapiens
aaatacataaaatatg

SEQ ID NO: 9176 - DNA, 16 bp, H. sapiens
aaatacatacaatttt

SEQ ID NO: 9177 - DNA, 16 bp, H. sapiens
aaatacatacagccaa

SEQ ID NO: 9178 - DNA, 16 bp, H. sapiens
aaatacatacatgtat

SEQ ID NO: 9179 - DNA, 16 bp, H. sapiens
aaatacatacattttt

SEQ ID NO: 9180 - DNA, 16 bp, H. sapiens
aaatacatatgtattt

SEQ ID NO: 9181 - DNA, 16 bp, H. sapiens
aaatacatattatgaa

SEQ ID NO: 9182 - DNA, 16 bp, H. sapiens
aaatacatcattttat

SEQ ID NO: 9183 - DNA, 16 bp, H. sapiens
aaatacatccattcca

SEQ ID NO: 9184 - DNA, 16 bp, H. sapiens
aaatacatgaaaaatg

SEQ ID NO: 9185 - DNA, 16 bp, H. sapiens
aaatacatgaaattga

SEQ ID NO: 9186 - DNA, 16 bp, H. sapiens
aaatacatgaggcaaa

SEQ ID NO: 9187 - DNA, 16 bp, H. sapiens
aaatacatgataaatg

SEQ ID NO: 9188 - DNA, 16 bp, H. sapiens
aaatacatgcacacac

SEQ ID NO: 9189 - DNA, 16 bp, H. sapiens
aaatacatgcatttat

SEQ ID NO: 9190 - DNA, 16 bp, H. sapiens
aaatacatgtaagaaa

SEQ ID NO: 9191 - DNA, 16 bp, H. sapiens
aaatacatgtatatgt

SEQ ID NO: 9192 - DNA, 16 bp, H. sapiens
aaatacatgtatgttt

SEQ ID NO: 9193 - DNA, 16 bp, H. sapiens
aaatacatgtgtatat

SEQ ID NO: 9194 - DNA, 16 bp, H. sapiens
aaatacatgtttgttg

SEQ ID NO: 9195 - DNA, 16 bp, H. sapiens
aaatacattaagaaat

SEQ ID NO: 9196 - DNA, 16 bp, H. sapiens
aaatacattagaaaat

SEQ ID NO: 9197 - DNA, 16 bp, H. sapiens
aaatacattcaaaagc

SEQ ID NO: 9198 - DNA, 16 bp, H. sapiens
aaatacattgaaaaat

SEQ ID NO: 9199 - DNA, 16 bp, H. sapiens
aaatacattgaaaata

SEQ ID NO: 9200 - DNA, 16 bp, H. sapiens
aaatacattgaactga

SEQ ID NO: 9201 - DNA, 16 bp, H. sapiens
aaatacattgatattt

SEQ ID NO: 9202 - DNA, 16 bp, H. sapiens
aaatacattgattttt

SEQ ID NO: 9203 - DNA, 16 bp, H. sapiens
aaatacattgtgtttt

SEQ ID NO: 9204 - DNA, 16 bp, H. sapiens
aaatacatttactgtt

SEQ ID NO: 9205 - DNA, 16 bp, H. sapiens
aaatacatttcatttc

SEQ ID NO: 9206 - DNA, 16 bp, H. sapiens
aaatacatttccaaaa

SEQ ID NO: 9207 - DNA, 16 bp, H. sapiens
aaatacatttcttaaa

SEQ ID NO: 9208 - DNA, 16 bp, H. sapiens
aaatacatttcttaag

SEQ ID NO: 9209 - DNA, 16 bp, H. sapiens
aaatacatttctttga

SEQ ID NO: 9210 - DNA, 16 bp, H. sapiens
aaatacatttgaaaaa

SEQ ID NO: 9211 - DNA, 16 bp, H. sapiens
aaatacatttgaataa

SEQ ID NO: 9212 - DNA, 16 bp, H. sapiens
aaatacatttgcaaaa

SEQ ID NO: 9213 - DNA, 16 bp, H. sapiens
aaatacatttggaaaa

SEQ ID NO: 9214 - DNA, 16 bp, H. sapiens
aaatacatttgtttta

SEQ ID NO: 9215 - DNA, 16 bp, H. sapiens
aaatacattttatctt

SEQ ID NO: 9216 - DNA, 16 bp, H. sapiens
aaatacattttattga

SEQ ID NO: 9217 - DNA, 16 bp, H. sapiens
aaatacattttctaag

SEQ ID NO: 9218 - DNA, 16 bp, H. sapiens
aaatacattttctttg

SEQ ID NO: 9219 - DNA, 16 bp, H. sapiens
aaatacattttgtttt

SEQ ID NO: 9220 - DNA, 16 bp, H. sapiens
aaatacatttttctta

SEQ ID NO: 9221 - DNA, 16 bp, H. sapiens
aaatacatttttttca

SEQ ID NO: 9222 - DNA, 16 bp, H. sapiens
aaataccactctttgt

SEQ ID NO: 9223 - DNA, 16 bp, H. sapiens
aaataccatcttacac

SEQ ID NO: 9224 - DNA, 16 bp, H. sapiens
aaataccatgccattt

SEQ ID NO: 9225 - DNA, 16 bp, H. sapiens
aaataccatggcaaca

SEQ ID NO: 9226 - DNA, 16 bp, H. sapiens
aaataccatttcatat

SEQ ID NO: 9227 - DNA, 16 bp, H. sapiens
aaataccctgatttga

SEQ ID NO: 9228 - DNA, 16 bp, H. sapiens
aaatacctaaaaatgt

SEQ ID NO: 9229 - DNA, 16 bp, H. sapiens
aaatacctaggaaata

SEQ ID NO: 9230 - DNA, 16 bp, H. sapiens
aaatacctaggaagac

SEQ ID NO: 9231 - DNA, 16 bp, H. sapiens
aaatacctaggtataa

SEQ ID NO: 9232 - DNA, 16 bp, H. sapiens
aaatacctcatgttct

SEQ ID NO: 9233 - DNA, 16 bp, H. sapiens
aaataccttaaaatgt

SEQ ID NO: 9234 - DNA, 16 bp, H. sapiens
aaatactaaaaatcag

SEQ ID NO: 9235 - DNA, 16 bp, H. sapiens
aaatactaaacatttt

SEQ ID NO: 9236 - DNA, 16 bp, H. sapiens
aaatactaaaggaaat

SEQ ID NO: 9237 - DNA, 16 bp, H. sapiens
aaatactaaatcattt

SEQ ID NO: 9238 - DNA, 16 bp, H. sapiens
aaatactaatattttc

SEQ ID NO: 9239 - DNA, 16 bp, H. sapiens
aaatactaattcaatt

SEQ ID NO: 9240 - DNA, 16 bp, H. sapiens
aaatactacacaagaa

SEQ ID NO: 9241 - DNA, 16 bp, H. sapiens
aaatactacatcattt

SEQ ID NO: 9242 - DNA, 16 bp, H. sapiens
aaatactatgaacaat

SEQ ID NO: 9243 - DNA, 16 bp, H. sapiens
aaatactatgtatttt

SEQ ID NO: 9244 - DNA, 16 bp, H. sapiens
aaatactcatttttca

SEQ ID NO: 9245 - DNA, 16 bp, H. sapiens
aaatactctttctttt

SEQ ID NO: 9246 - DNA, 16 bp, H. sapiens
aaatactctttttgta

SEQ ID NO: 9247 - DNA, 16 bp, H. sapiens
aaatactctttttgtg

SEQ ID NO: 9248 - DNA, 16 bp, H. sapiens
aaatactgaaagaaat

SEQ ID NO: 9249 - DNA, 16 bp, H. sapiens
aaatactgaaatactt

SEQ ID NO: 9250 - DNA, 16 bp, H. sapiens
aaatactgaaatatta

SEQ ID NO: 9251 - DNA, 16 bp, H. sapiens
aaatactgaatgttct

SEQ ID NO: 9252 - DNA, 16 bp, H. sapiens
aaatactgaattttat

SEQ ID NO: 9253 - DNA, 16 bp, H. sapiens
aaatactgatttaaaa

SEQ ID NO: 9254 - DNA, 16 bp, H. sapiens
aaatactgattttctt

SEQ ID NO: 9255 - DNA, 16 bp, H. sapiens
aaatactgcatcttct

SEQ ID NO: 9256 - DNA, 16 bp, H. sapiens
aaatactgcatgatct

SEQ ID NO: 9257 - DNA, 16 bp, H. sapiens
aaatactggaagaaaa

SEQ ID NO: 9258 - DNA, 16 bp, H. sapiens
aaatactggcaaagca

SEQ ID NO: 9259 - DNA, 16 bp, H. sapiens
aaatactggcaaatca

SEQ ID NO: 9260 - DNA, 16 bp, H. sapiens
aaatactgtcatttgc

SEQ ID NO: 9261 - DNA, 16 bp, H. sapiens
aaatacttaaaatgta

SEQ ID NO: 9262 - DNA, 16 bp, H. sapiens
aaatacttaaggataa

SEQ ID NO: 9263 - DNA, 16 bp, H. sapiens
aaatacttacattttt

SEQ ID NO: 9264 - DNA, 16 bp, H. sapiens
aaatacttagaaatga

SEQ ID NO: 9265 - DNA, 16 bp, H. sapiens
aaatacttagaagaaa

SEQ ID NO: 9266 - DNA, 16 bp, H. sapiens
aaatacttagagacaa

SEQ ID NO: 9267 - DNA, 16 bp, H. sapiens
aaatacttagatattt

SEQ ID NO: 9268 - DNA, 16 bp, H. sapiens
aaatacttagcacagt

SEQ ID NO: 9269 - DNA, 16 bp, H. sapiens
aaatacttatacactg

SEQ ID NO: 9270 - DNA, 16 bp, H. sapiens
aaatacttcagaaaat

SEQ ID NO: 9271 - DNA, 16 bp, H. sapiens
aaatacttcattttct

SEQ ID NO: 9272 - DNA, 16 bp, H. sapiens
aaatacttccatttct

SEQ ID NO: 9273 - DNA, 16 bp, H. sapiens
aaatacttcttaaaat

SEQ ID NO: 9274 - DNA, 16 bp, H. sapiens
aaatacttctttttaa

SEQ ID NO: 9275 - DNA, 16 bp, H. sapiens
aaatacttgaaaaaat

SEQ ID NO: 9276 - DNA, 16 bp, H. sapiens
aaatacttgaagagcc

SEQ ID NO: 9277 - DNA, 16 bp, H. sapiens
aaatacttgatttttt

SEQ ID NO: 9278 - DNA, 16 bp, H. sapiens
aaatacttgctgaatt

SEQ ID NO: 9279 - DNA, 16 bp, H. sapiens
aaatacttgttaaata

SEQ ID NO: 9280 - DNA, 16 bp, H. sapiens
aaatactttatcagaa

SEQ ID NO: 9281 - DNA, 16 bp, H. sapiens
aaatactttcatttaa

SEQ ID NO: 9282 - DNA, 16 bp, H. sapiens
aaatactttcatttat

SEQ ID NO: 9283 - DNA, 16 bp, H. sapiens
aaatactttgaagaaa

SEQ ID NO: 9284 - DNA, 16 bp, H. sapiens
aaatacttttaagaaa

SEQ ID NO: 9285 - DNA, 16 bp, H. sapiens
aaatacttttacattt

SEQ ID NO: 9286 - DNA, 16 bp, H. sapiens
aaatacttttctttaa

SEQ ID NO: 9287 - DNA, 16 bp, H. sapiens
aaatacttttctttct

SEQ ID NO: 9288 - DNA, 16 bp, H. sapiens
aaatacttttgaaaac

SEQ ID NO: 9289 - DNA, 16 bp, H. sapiens
aaatacttttgaaaat

SEQ ID NO: 9290 - DNA, 16 bp, H. sapiens
aaatagaaaaatgttc

SEQ ID NO: 9291 - DNA, 16 bp, H. sapiens
aaatagaaaacttgaa

SEQ ID NO: 9292 - DNA, 16 bp, H. sapiens
aaatagaaaagcatat

SEQ ID NO: 9293 - DNA, 16 bp, H. sapiens
aaatagaaaatccaga

SEQ ID NO: 9294 - DNA, 16 bp, H. sapiens
aaatagaaaatgtctt

SEQ ID NO: 9295 - DNA, 16 bp, H. sapiens
aaatagaaacattttt

SEQ ID NO: 9296 - DNA, 16 bp, H. sapiens
aaatagaaagtctgaa

SEQ ID NO: 9297 - DNA, 16 bp, H. sapiens
aaatagaaatatttct

SEQ ID NO: 9298 - DNA, 16 bp, H. sapiens
aaatagaaatgatttt

SEQ ID NO: 9299 - DNA, 16 bp, H. sapiens
aaatagaaatgctttt

SEQ ID NO: 9300 - DNA, 16 bp, H. sapiens
aaatagaaatgtattt

SEQ ID NO: 9301 - DNA, 16 bp, H. sapiens
aaatagaagaaaattc

SEQ ID NO: 9302 - DNA, 16 bp, H. sapiens
aaatagaagagaactt

SEQ ID NO: 9303 - DNA, 16 bp, H. sapiens
aaatagaagctggagg

SEQ ID NO: 9304 - DNA, 16 bp, H. sapiens
aaatagaatatttcta

SEQ ID NO: 9305 - DNA, 16 bp, H. sapiens
aaatagaattagaagt

SEQ ID NO: 9306 - DNA, 16 bp, H. sapiens
aaatagaattcagcaa

SEQ ID NO: 9307 - DNA, 16 bp, H. sapiens
aaatagacacacacac

SEQ ID NO: 9308 - DNA, 16 bp, H. sapiens
aaatagacacatagac

SEQ ID NO: 9309 - DNA, 16 bp, H. sapiens
aaatagaccaataaca

SEQ ID NO: 9310 - DNA, 16 bp, H. sapiens
aaatagaccaatggaa

SEQ ID NO: 9311 - DNA, 16 bp, H. sapiens
aaatagaccccaatat

SEQ ID NO: 9312 - DNA, 16 bp, H. sapiens
aaatagactaagataa

SEQ ID NO: 9313 - DNA, 16 bp, H. sapiens
aaatagactacaaatc

SEQ ID NO: 9314 - DNA, 16 bp, H. sapiens
aaatagactagaaaat

SEQ ID NO: 9315 - DNA, 16 bp, H. sapiens
aaatagacttaacaga

SEQ ID NO: 9316 - DNA, 16 bp, H. sapiens
aaatagacttttaaaa

SEQ ID NO: 9317 - DNA, 16 bp, H. sapiens
aaatagagacacaaga

SEQ ID NO: 9318 - DNA, 16 bp, H. sapiens
aaatagagatgaggtc

SEQ ID NO: 9319 - DNA, 16 bp, H. sapiens
aaatagaggcacagag

SEQ ID NO: 9320 - DNA, 16 bp, H. sapiens
aaatagatattttaag

SEQ ID NO: 9321 - DNA, 16 bp, H. sapiens
aaatagatgaagcaaa

SEQ ID NO: 9322 - DNA, 16 bp, H. sapiens
aaatagatgattctga

SEQ ID NO: 9323 - DNA, 16 bp, H. sapiens
aaatagatgttttaaa

SEQ ID NO: 9324 - DNA, 16 bp, H. sapiens
aaatagatttcagagc

SEQ ID NO: 9325 - DNA, 16 bp, H. sapiens
aaatagatttcatttt

SEQ ID NO: 9326 - DNA, 16 bp, H. sapiens
aaatagattttaaatg

SEQ ID NO: 9327 - DNA, 16 bp, H. sapiens
aaatagatttttcttt

SEQ ID NO: 9328 - DNA, 16 bp, H. sapiens
aaatagcatattttaa

SEQ ID NO: 9329 - DNA, 16 bp, H. sapiens
aaatagcattttcttt

SEQ ID NO: 9330 - DNA, 16 bp, H. sapiens
aaatagccaaaaagta

SEQ ID NO: 9331 - DNA, 16 bp, H. sapiens
aaatagccaaagccat

SEQ ID NO: 9332 - DNA, 16 bp, H. sapiens
aaatagccagctgtgg

SEQ ID NO: 9333 - DNA, 16 bp, H. sapiens
aaatagcctcaaaaga

SEQ ID NO: 9334 - DNA, 16 bp, H. sapiens
aaatagctaaaaattt

SEQ ID NO: 9335 - DNA, 16 bp, H. sapiens
aaatagctacattaat

SEQ ID NO: 9336 - DNA, 16 bp, H. sapiens
aaatagctagaagaga

SEQ ID NO: 9337 - DNA, 16 bp, H. sapiens
aaatagctattattat

SEQ ID NO: 9338 - DNA, 16 bp, H. sapiens
aaatagctttaaaatg

SEQ ID NO: 9339 - DNA, 16 bp, H. sapiens
aaatagctttgttttt

SEQ ID NO: 9340 - DNA, 16 bp, H. sapiens
aaatagctttttctag

SEQ ID NO: 9341 - DNA, 16 bp, H. sapiens
aaataggaaaacagga

SEQ ID NO: 9342 - DNA, 16 bp, H. sapiens
aaataggaaagctttt

SEQ ID NO: 9343 - DNA, 16 bp, H. sapiens
aaataggaaatctgaa

SEQ ID NO: 9344 - DNA, 16 bp, H. sapiens
aaataggaataatttt

SEQ ID NO: 9345 - DNA, 16 bp, H. sapiens
aaataggaatggtttt

SEQ ID NO: 9346 - DNA, 16 bp, H. sapiens
aaataggatttttaaa

SEQ ID NO: 9347 - DNA, 16 bp, H. sapiens
aaataggcactcaata

SEQ ID NO: 9348 - DNA, 16 bp, H. sapiens
aaatagtaaaatacat

SEQ ID NO: 9349 - DNA, 16 bp, H. sapiens
aaatagtaatacaaat

SEQ ID NO: 9350 - DNA, 16 bp, H. sapiens
aaatagtagagtgagt

SEQ ID NO: 9351 - DNA, 16 bp, H. sapiens
aaatagtagctgaaaa

SEQ ID NO: 9352 - DNA, 16 bp, H. sapiens
aaatagtatacattgt

SEQ ID NO: 9353 - DNA, 16 bp, H. sapiens
aaatagtattgggaaa

SEQ ID NO: 9354 - DNA, 16 bp, H. sapiens
aaatagtctatatttt

SEQ ID NO: 9355 - DNA, 16 bp, H. sapiens
aaatagttactatttt

SEQ ID NO: 9356 - DNA, 16 bp, H. sapiens
aaatagttcagaaaaa

SEQ ID NO: 9357 - DNA, 16 bp, H. sapiens
aaatagttgggattac

SEQ ID NO: 9358 - DNA, 16 bp, H. sapiens
aaatagttgtttttaa

SEQ ID NO: 9359 - DNA, 16 bp, H. sapiens
aaatagtttacaaatt

SEQ ID NO: 9360 - DNA, 16 bp, H. sapiens
aaatagtttcaaaatt

SEQ ID NO: 9361 - DNA, 16 bp, H. sapiens
aaatagtttcagtagg

SEQ ID NO: 9362 - DNA, 16 bp, H. sapiens
aaatagttttccaaag

SEQ ID NO: 9363 - DNA, 16 bp, H. sapiens
aaatataaaaactgtt

SEQ ID NO: 9364 - DNA, 16 bp, H. sapiens
aaatataaaaatagcc

SEQ ID NO: 9365 - DNA, 16 bp, H. sapiens
aaatataaaaattggc

SEQ ID NO: 9366 - DNA, 16 bp, H. sapiens
aaatataaaacactgt

SEQ ID NO: 9367 - DNA, 16 bp, H. sapiens
aaatataaaacattag

SEQ ID NO: 9368 - DNA, 16 bp, H. sapiens
aaatataaaatgccaa

SEQ ID NO: 9369 - DNA, 16 bp, H. sapiens
aaatataaacttgaaa

SEQ ID NO: 9370 - DNA, 16 bp, H. sapiens
aaatataaagctatat

SEQ ID NO: 9371 - DNA, 16 bp, H. sapiens
aaatataaatactgta

SEQ ID NO: 9372 - DNA, 16 bp, H. sapiens
aaatataaatggattt

SEQ ID NO: 9373 - DNA, 16 bp, H. sapiens
aaatataaatgggcta

SEQ ID NO: 9374 - DNA, 16 bp, H. sapiens
aaatataacaaaatgt

SEQ ID NO: 9375 - DNA, 16 bp, H. sapiens
aaatataacacatttt

SEQ ID NO: 9376 - DNA, 16 bp, H. sapiens
aaatataactgtaaaa

SEQ ID NO: 9377 - DNA, 16 bp, H. sapiens
aaatataatacagata

SEQ ID NO: 9378 - DNA, 16 bp, H. sapiens
aaatataatcagaaat

SEQ ID NO: 9379 - DNA, 16 bp, H. sapiens
aaatataatgtatcaa

SEQ ID NO: 9380 - DNA, 16 bp, H. sapiens
aaatataatttttctc

SEQ ID NO: 9381 - DNA, 16 bp, H. sapiens
aaatatacaaacatgt

SEQ ID NO: 9382 - DNA, 16 bp, H. sapiens
aaatatacaaatgttt

SEQ ID NO: 9383 - DNA, 16 bp, H. sapiens
aaatatacaattcagt

SEQ ID NO: 9384 - DNA, 16 bp, H. sapiens
aaatatacacatacat

SEQ ID NO: 9385 - DNA, 16 bp, H. sapiens
aaatatacactatttt

SEQ ID NO: 9386 - DNA, 16 bp, H. sapiens
aaatatacatacttat

SEQ ID NO: 9387 - DNA, 16 bp, H. sapiens
aaatatacatgaaata

SEQ ID NO: 9388 - DNA, 16 bp, H. sapiens
aaatatacatgtgaaa

SEQ ID NO: 9389 - DNA, 16 bp, H. sapiens
aaatatacatgtttat

SEQ ID NO: 9390 - DNA, 16 bp, H. sapiens
aaatatacatttttca

SEQ ID NO: 9391 - DNA, 16 bp, H. sapiens
aaatataccattttaa

SEQ ID NO: 9392 - DNA, 16 bp, H. sapiens
aaatatacctttgcag

SEQ ID NO: 9393 - DNA, 16 bp, H. sapiens
aaatatagaaaatcat

SEQ ID NO: 9394 - DNA, 16 bp, H. sapiens
aaatatagaatacatt

SEQ ID NO: 9395 - DNA, 16 bp, H. sapiens
aaatatagaatatttc

SEQ ID NO: 9396 - DNA, 16 bp, H. sapiens
aaatatagacaaatat

SEQ ID NO: 9397 - DNA, 16 bp, H. sapiens
aaatatagacagatga

SEQ ID NO: 9398 - DNA, 16 bp, H. sapiens
aaatatagtatataca

SEQ ID NO: 9399 - DNA, 16 bp, H. sapiens
aaatatagtcatgtgt

SEQ ID NO: 9400 - DNA, 16 bp, H. sapiens
aaatatataaaaggca

SEQ ID NO: 9401 - DNA, 16 bp, H. sapiens
aaatatataaagcttt

SEQ ID NO: 9402 - DNA, 16 bp, H. sapiens
aaatatatacacaccc

SEQ ID NO: 9403 - DNA, 16 bp, H. sapiens
aaatatatacagtaaa

SEQ ID NO: 9404 - DNA, 16 bp, H. sapiens
aaatatatacgtatat

SEQ ID NO: 9405 - DNA, 16 bp, H. sapiens
aaatatatagtcaaat

SEQ ID NO: 9406 - DNA, 16 bp, H. sapiens
aaatatatagtgtata

SEQ ID NO: 9407 - DNA, 16 bp, H. sapiens
aaatatatatacttgt

SEQ ID NO: 9408 - DNA, 16 bp, H. sapiens
aaatatatatccagaa

SEQ ID NO: 9409 - DNA, 16 bp, H. sapiens
aaatatatatccattt

SEQ ID NO: 9410 - DNA, 16 bp, H. sapiens
aaatatatatgtatgt

SEQ ID NO: 9411 - DNA, 16 bp, H. sapiens
aaatatatatgtcaaa

SEQ ID NO: 9412 - DNA, 16 bp, H. sapiens
aaatatatattcacct

SEQ ID NO: 9413 - DNA, 16 bp, H. sapiens
aaatatatattgctat

SEQ ID NO: 9414 - DNA, 16 bp, H. sapiens
aaatatatattgtatg

SEQ ID NO: 9415 - DNA, 16 bp, H. sapiens
aaatatatatttggtc

SEQ ID NO: 9416 - DNA, 16 bp, H. sapiens
aaatatatcctgaatc

SEQ ID NO: 9417 - DNA, 16 bp, H. sapiens
aaatatatgaagcaaa

SEQ ID NO: 9418 - DNA, 16 bp, H. sapiens
aaatatatgacatata

SEQ ID NO: 9419 - DNA, 16 bp, H. sapiens
aaatatatgcaaataa

SEQ ID NO: 9420 - DNA, 16 bp, H. sapiens
aaatatatgcaactat

SEQ ID NO: 9421 - DNA, 16 bp, H. sapiens
aaatatatgcacatat

SEQ ID NO: 9422 - DNA, 16 bp, H. sapiens
aaatatatgcatattt

SEQ ID NO: 9423 - DNA, 16 bp, H. sapiens
aaatatatgccaacaa

SEQ ID NO: 9424 - DNA, 16 bp, H. sapiens
aaatatatgcttttta

SEQ ID NO: 9425 - DNA, 16 bp, H. sapiens
aaatatatggaggaaa

SEQ ID NO: 9426 - DNA, 16 bp, H. sapiens
aaatatatgtactttt

SEQ ID NO: 9427 - DNA, 16 bp, H. sapiens
aaatatatgtagatat

SEQ ID NO: 9428 - DNA, 16 bp, H. sapiens
aaatatatgtatatgc

SEQ ID NO: 9429 - DNA, 17 bp, H. sapiens
aaatatatgtgcaccca

SEQ ID NO: 9430 - DNA, 16 bp, H. sapiens
aaatatatgtgtatat

SEQ ID NO: 9431 - DNA, 16 bp, H. sapiens
aaatatatgtgtattt

SEQ ID NO: 9432 - DNA, 16 bp, H. sapiens
aaatatatgtgtttta

SEQ ID NO: 9433 - DNA, 16 bp, H. sapiens
aaatatatgttaaatg

SEQ ID NO: 9434 - DNA, 16 bp, H. sapiens
aaatatatgttaattg

SEQ ID NO: 9435 - DNA, 16 bp, H. sapiens
aaatatatgttttcaa

SEQ ID NO: 9436 - DNA, 16 bp, H. sapiens
aaatatattacaaagg

SEQ ID NO: 9437 - DNA, 16 bp, H. sapiens
aaatatattacagaaa

SEQ ID NO: 9438 - DNA, 16 bp, H. sapiens
aaatatattcacaatg

SEQ ID NO: 9439 - DNA, 16 bp, H. sapiens
aaatatattccatgct

SEQ ID NO: 9440 - DNA, 16 bp, H. sapiens
aaatatattgaatgta

SEQ ID NO: 9441 - DNA, 16 bp, H. sapiens
aaatatattgcaaaaa

SEQ ID NO: 9442 - DNA, 16 bp, H. sapiens
aaatatattgcatttt

SEQ ID NO: 9443 - DNA, 16 bp, H. sapiens
aaatatatttcataag

SEQ ID NO: 9444 - DNA, 16 bp, H. sapiens
aaatatatttcatgca

SEQ ID NO: 9445 - DNA, 16 bp, H. sapiens
aaatatatttcattca

SEQ ID NO: 9446 - DNA, 16 bp, H. sapiens
aaatatatttcctgaa

SEQ ID NO: 9447 - DNA, 16 bp, H. sapiens
aaatatatttctcttc

SEQ ID NO: 9448 - DNA, 16 bp, H. sapiens
aaatatatttctgaat

SEQ ID NO: 9449 - DNA, 16 bp, H. sapiens
aaatatatttcttact

SEQ ID NO: 9450 - DNA, 16 bp, H. sapiens
aaatatatttcttcat

SEQ ID NO: 9451 - DNA, 16 bp, H. sapiens
aaatatatttgaaact

SEQ ID NO: 9452 - DNA, 16 bp, H. sapiens
aaatatatttgatgtt

SEQ ID NO: 9453 - DNA, 16 bp, H. sapiens
aaatatatttgcatat

SEQ ID NO: 9454 - DNA, 16 bp, H. sapiens
aaatatatttgcatgt

SEQ ID NO: 9455 - DNA, 16 bp, H. sapiens
aaatatatttggaata

SEQ ID NO: 9456 - DNA, 16 bp, H. sapiens
aaatatattttcactg

SEQ ID NO: 9457 - DNA, 16 bp, H. sapiens
aaatatattttctagt

SEQ ID NO: 9458 - DNA, 16 bp, H. sapiens
aaatatattttgtgta

SEQ ID NO: 9459 - DNA, 16 bp, H. sapiens
aaatatattttgtgtg

SEQ ID NO: 9460 - DNA, 16 bp, H. sapiens
aaatatatttttggaa

SEQ ID NO: 9461 - DNA, 16 bp, H. sapiens
aaatatcaaaatttgg

SEQ ID NO: 9462 - DNA, 16 bp, H. sapiens
aaatatcaatgaaatt

SEQ ID NO: 9463 - DNA, 16 bp, H. sapiens
aaatatcactttcttt

SEQ ID NO: 9464 - DNA, 16 bp, H. sapiens
aaatatcagaatttta

SEQ ID NO: 9465 - DNA, 16 bp, H. sapiens
aaatatcagagaattt

SEQ ID NO: 9466 - DNA, 16 bp, H. sapiens
aaatatcagttttatt

SEQ ID NO: 9467 - DNA, 16 bp, H. sapiens
aaatatcataaactga

SEQ ID NO: 9468 - DNA, 16 bp, H. sapiens
aaatatcatgaaaatg

SEQ ID NO: 9469 - DNA, 16 bp, H. sapiens
aaatatcatttgacct

SEQ ID NO: 9470 - DNA, 16 bp, H. sapiens
aaatatccagaacagg

SEQ ID NO: 9471 - DNA, 16 bp, H. sapiens
aaatatcccattgcag

SEQ ID NO: 9472 - DNA, 16 bp, H. sapiens
aaatatccctttgaag

SEQ ID NO: 9473 - DNA, 16 bp, H. sapiens
aaatatcctgcttcaa

SEQ ID NO: 9474 - DNA, 16 bp, H. sapiens
aaatatctagatattt

SEQ ID NO: 9475 - DNA, 16 bp, H. sapiens
aaatatctagcagaga

SEQ ID NO: 9476 - DNA, 16 bp, H. sapiens
aaatatctctaaatat

SEQ ID NO: 9477 - DNA, 16 bp, H. sapiens
aaatatctctagacat

SEQ ID NO: 9478 - DNA, 16 bp, H. sapiens
aaatatctcttcaagt

SEQ ID NO: 9479 - DNA, 16 bp, H. sapiens
aaatatctctttgaaa

SEQ ID NO: 9480 - DNA, 16 bp, H. sapiens
aaatatctgaaaatgt

SEQ ID NO: 9481 - DNA, 16 bp, H. sapiens
aaatatctgaaataaa

SEQ ID NO: 9482 - DNA, 16 bp, H. sapiens
aaatatctgcaaatca

SEQ ID NO: 9483 - DNA, 16 bp, H. sapiens
aaatatctgctttatt

SEQ ID NO: 9484 - DNA, 16 bp, H. sapiens
aaatatctgctttcct

SEQ ID NO: 9485 - DNA, 16 bp, H. sapiens
aaatatctggaaaaaa

SEQ ID NO: 9486 - DNA, 16 bp, H. sapiens
aaatatctggaagaaa

SEQ ID NO: 9487 - DNA, 16 bp, H. sapiens
aaatatctgtatctat

SEQ ID NO: 9488 - DNA, 16 bp, H. sapiens
aaatatctgttgaata

SEQ ID NO: 9489 - DNA, 16 bp, H. sapiens
aaatatctgtttaata

SEQ ID NO: 9490 - DNA, 16 bp, H. sapiens
aaatatctgttttctt

SEQ ID NO: 9491 - DNA, 16 bp, H. sapiens
aaatatcttcaaaatt

SEQ ID NO: 9492 - DNA, 16 bp, H. sapiens
aaatatcttcagagaa

SEQ ID NO: 9493 - DNA, 16 bp, H. sapiens
aaatatcttcatagaa

SEQ ID NO: 9494 - DNA, 16 bp, H. sapiens
aaatatcttgaaacaa

SEQ ID NO: 9495 - DNA, 16 bp, H. sapiens
aaatatctttcaaata

SEQ ID NO: 9496 - DNA, 16 bp, H. sapiens
aaatatctttcaataa

SEQ ID NO: 9497 - DNA, 16 bp, H. sapiens
aaatatctttctatat

SEQ ID NO: 9498 - DNA, 16 bp, H. sapiens
aaatatctttgaaaga

SEQ ID NO: 9499 - DNA, 16 bp, H. sapiens
aaatatctttgtgtgt

SEQ ID NO: 9500 - DNA, 16 bp, H. sapiens
aaatatcttttccttt

SEQ ID NO: 9501 - DNA, 16 bp, H. sapiens
aaatatcttttttgtt

SEQ ID NO: 9502 - DNA, 16 bp, H. sapiens
aaatatgaaaacatga

SEQ ID NO: 9503 - DNA, 16 bp, H. sapiens
aaatatgaaacatttt

SEQ ID NO: 9504 - DNA, 16 bp, H. sapiens
aaatatgaaatccaaa

SEQ ID NO: 9505 - DNA, 16 bp, H. sapiens
aaatatgaaatgctta

SEQ ID NO: 9506 - DNA, 16 bp, H. sapiens
aaatatgaaatgtttt

SEQ ID NO: 9507 - DNA, 16 bp, H. sapiens
aaatatgaagaatgtg

SEQ ID NO: 9508 - DNA, 16 bp, H. sapiens
aaatatgaataaacta

SEQ ID NO: 9509 - DNA, 16 bp, H. sapiens
aaatatgaatatgttt

SEQ ID NO: 9510 - DNA, 16 bp, H. sapiens
aaatatgaatgaacaa

SEQ ID NO: 9511 - DNA, 16 bp, H. sapiens
aaatatgaatgtgaaa

SEQ ID NO: 9512 - DNA, 16 bp, H. sapiens
aaatatgacaaaaatg

SEQ ID NO: 9513 - DNA, 16 bp, H. sapiens
aaatatgacaatccta

SEQ ID NO: 9514 - DNA, 16 bp, H. sapiens
aaatatgacattttat

SEQ ID NO: 9515 - DNA, 16 bp, H. sapiens
aaatatgagactatgt

SEQ ID NO: 9516 - DNA, 16 bp, H. sapiens
aaatatgatgtatttt

SEQ ID NO: 9517 - DNA, 16 bp, H. sapiens
aaatatgatttgcaaa

SEQ ID NO: 9518 - DNA, 16 bp, H. sapiens
aaatatgcaagaaatt

SEQ ID NO: 9519 - DNA, 16 bp, H. sapiens
aaatatgcaataaatt

SEQ ID NO: 9520 - DNA, 16 bp, H. sapiens
aaatatgcaattaaaa

SEQ ID NO: 9521 - DNA, 16 bp, H. sapiens
aaatatgcacatacat

SEQ ID NO: 9522 - DNA, 16 bp, H. sapiens
aaatatgcacatttat

SEQ ID NO: 9523 - DNA, 16 bp, H. sapiens
aaatatgcagaaatta

SEQ ID NO: 9524 - DNA, 16 bp, H. sapiens
aaatatgcatgcatgt

SEQ ID NO: 9525 - DNA, 16 bp, H. sapiens
aaatatgcattatttt

SEQ ID NO: 9526 - DNA, 16 bp, H. sapiens
aaatatgcatttaatt

SEQ ID NO: 9527 - DNA, 16 bp, H. sapiens
aaatatgcctttaaaa

SEQ ID NO: 9528 - DNA, 16 bp, H. sapiens
aaatatgctattattt

SEQ ID NO: 9529 - DNA, 16 bp, H. sapiens
aaatatgctcatcatc

SEQ ID NO: 9530 - DNA, 16 bp, H. sapiens
aaatatgctttaaaaa

SEQ ID NO: 9531 - DNA, 16 bp, H. sapiens
aaatatggaaacaaat

SEQ ID NO: 9532 - DNA, 16 bp, H. sapiens
aaatatggaaactgag

SEQ ID NO: 9533 - DNA, 16 bp, H. sapiens
aaatatggaagaaatg

SEQ ID NO: 9534 - DNA, 16 bp, H. sapiens
aaatatggaatatttt

SEQ ID NO: 9535 - DNA, 16 bp, H. sapiens
aaatatggattaaaag

SEQ ID NO: 9536 - DNA, 16 bp, H. sapiens
aaatatggcaaaatgt

SEQ ID NO: 9537 - DNA, 16 bp, H. sapiens
aaatatgggaaaattt

SEQ ID NO: 9538 - DNA, 28 bp, H. sapiens
aaatatgggactatgtgaaaacaccaaa

SEQ ID NO: 9539 - DNA, 16 bp, H. sapiens
aaatatggtagatatt

SEQ ID NO: 9540 - DNA, 16 bp, H. sapiens
aaatatggtgaaaccc

SEQ ID NO: 9541 - DNA, 16 bp, H. sapiens
aaatatgtaaaactat

SEQ ID NO: 9542 - DNA, 16 bp, H. sapiens
aaatatgtaaatatgt

SEQ ID NO: 9543 - DNA, 16 bp, H. sapiens
aaatatgtaaattatg

SEQ ID NO: 9544 - DNA, 16 bp, H. sapiens
aaatatgtaaatttca

SEQ ID NO: 9545 - DNA, 16 bp, H. sapiens
aaatatgtaatctttt

SEQ ID NO: 9546 - DNA, 16 bp, H. sapiens
aaatatgtaatttcat

SEQ ID NO: 9547 - DNA, 16 bp, H. sapiens
aaatatgtacaaatat

SEQ ID NO: 9548 - DNA, 16 bp, H. sapiens
aaatatgtacatatgt

SEQ ID NO: 9549 - DNA, 16 bp, H. sapiens
aaatatgtactatata

SEQ ID NO: 9550 - DNA, 16 bp, H. sapiens
aaatatgtataaatgt

SEQ ID NO: 9551 - DNA, 16 bp, H. sapiens
aaatatgtatgatttt

SEQ ID NO: 9552 - DNA, 16 bp, H. sapiens
aaatatgtatgtatgt

SEQ ID NO: 9553 - DNA, 16 bp, H. sapiens
aaatatgtattgagta

SEQ ID NO: 9554 - DNA, 16 bp, H. sapiens
aaatatgtatttaaca

SEQ ID NO: 9555 - DNA, 16 bp, H. sapiens
aaatatgtatttcata

SEQ ID NO: 9556 - DNA, 16 bp, H. sapiens
aaatatgtattttaag

SEQ ID NO: 9557 - DNA, 16 bp, H. sapiens
aaatatgtcaaaaaat

SEQ ID NO: 9558 - DNA, 16 bp, H. sapiens
aaatatgtcaaaatgt

SEQ ID NO: 9559 - DNA, 16 bp, H. sapiens
aaatatgtcagtttta

SEQ ID NO: 9560 - DNA, 16 bp, H. sapiens
aaatatgtcattttaa

SEQ ID NO: 9561 - DNA, 16 bp, H. sapiens
aaatatgtcttatttt

SEQ ID NO: 9562 - DNA, 16 bp, H. sapiens
aaatatgtgaaatttt

SEQ ID NO: 9563 - DNA, 16 bp, H. sapiens
aaatatgtgaatttat

SEQ ID NO: 9564 - DNA, 16 bp, H. sapiens
aaatatgtgatatata

SEQ ID NO: 9565 - DNA, 16 bp, H. sapiens
aaatatgtgcacatat

SEQ ID NO: 9566 - DNA, 16 bp, H. sapiens
aaatatgtgcatatat

SEQ ID NO: 9567 - DNA, 16 bp, H. sapiens
aaatatgtgtgtaaaa

SEQ ID NO: 9568 - DNA, 16 bp, H. sapiens
aaatatgtgtgtgtgt

SEQ ID NO: 9569 - DNA, 16 bp, H. sapiens
aaatatgtgtgttaaa

SEQ ID NO: 9570 - DNA, 16 bp, H. sapiens
aaatatgtgtgttttt

SEQ ID NO: 9571 - DNA, 16 bp, H. sapiens
aaatatgtgttaaatt

SEQ ID NO: 9572 - DNA, 16 bp, H. sapiens
aaatatgtgttgattg

SEQ ID NO: 9573 - DNA, 16 bp, H. sapiens
aaatatgtgttgtttt

SEQ ID NO: 9574 - DNA, 16 bp, H. sapiens
aaatatgttaaatgta

SEQ ID NO: 9575 - DNA, 16 bp, H. sapiens
aaatatgttcaacatt

SEQ ID NO: 9576 - DNA, 16 bp, H. sapiens
aaatatgttcattttt

SEQ ID NO: 9577 - DNA, 16 bp, H. sapiens
aaatatgtttaaaaac

SEQ ID NO: 9578 - DNA, 16 bp, H. sapiens
aaatatgtttacattt

SEQ ID NO: 9579 - DNA, 16 bp, H. sapiens
aaatatgtttactttt

SEQ ID NO: 9580 - DNA, 16 bp, H. sapiens
aaatatgtttatgtat

SEQ ID NO: 9581 - DNA, 16 bp, H. sapiens
aaatatgtttccattt

SEQ ID NO: 9582 - DNA, 16 bp, H. sapiens
aaatatgtttctattt

SEQ ID NO: 9583 - DNA, 16 bp, H. sapiens
aaatatgtttgtaaat

SEQ ID NO: 9584 - DNA, 16 bp, H. sapiens
aaatatgttttcaaaa

SEQ ID NO: 9585 - DNA, 16 bp, H. sapiens
aaatatgttttcttat

SEQ ID NO: 9586 - DNA, 16 bp, H. sapiens
aaatatgttttgaatt

SEQ ID NO: 9587 - DNA, 16 bp, H. sapiens
aaatatgtttttgaga

SEQ ID NO: 9588 - DNA, 16 bp, H. sapiens
aaatattaaaacagta

SEQ ID NO: 9589 - DNA, 16 bp, H. sapiens
aaatattaaacacaga

SEQ ID NO: 9590 - DNA, 16 bp, H. sapiens
aaatattaaacatttc

SEQ ID NO: 9591 - DNA, 16 bp, H. sapiens
aaatattaaagctcca

SEQ ID NO: 9592 - DNA, 16 bp, H. sapiens
aaatattaaatgcaaa

SEQ ID NO: 9593 - DNA, 16 bp, H. sapiens
aaatattaacaaactg

SEQ ID NO: 9594 - DNA, 16 bp, H. sapiens
aaatattaacagtaat

SEQ ID NO: 9595 - DNA, 16 bp, H. sapiens
aaatattaacagtatt

SEQ ID NO: 9596 - DNA, 16 bp, H. sapiens
aaatattaataaacag

SEQ ID NO: 9597 - DNA, 16 bp, H. sapiens
aaatattaatgacatt

SEQ ID NO: 9598 - DNA, 16 bp, H. sapiens
aaatattaatttggaa

SEQ ID NO: 9599 - DNA, 16 bp, H. sapiens
aaatattacaaatgaa

SEQ ID NO: 9600 - DNA, 16 bp, H. sapiens
aaatattacagagaaa

SEQ ID NO: 9601 - DNA, 16 bp, H. sapiens
aaatattacatgtttt

SEQ ID NO: 9602 - DNA, 16 bp, H. sapiens
aaatattacctcattt

SEQ ID NO: 9603 - DNA, 16 bp, H. sapiens
aaatattagcaaaatg

SEQ ID NO: 9604 - DNA, 16 bp, H. sapiens
aaatattagcaatttt

SEQ ID NO: 9605 - DNA, 16 bp, H. sapiens
aaatattagctattat

SEQ ID NO: 9606 - DNA, 16 bp, H. sapiens
aaatattagctgggcg

SEQ ID NO: 9607 - DNA, 16 bp, H. sapiens
aaatattagttctttt

SEQ ID NO: 9608 - DNA, 16 bp, H. sapiens
aaatattagttgaatg

SEQ ID NO: 9609 - DNA, 16 bp, H. sapiens
aaatattataaatcag

SEQ ID NO: 9610 - DNA, 16 bp, H. sapiens
aaatattatctcattt

SEQ ID NO: 9611 - DNA, 16 bp, H. sapiens
aaatattatgtatcaa

SEQ ID NO: 9612 - DNA, 16 bp, H. sapiens
aaatattatgtatctt

SEQ ID NO: 9613 - DNA, 16 bp, H. sapiens
aaatattattattcct

SEQ ID NO: 9614 - DNA, 16 bp, H. sapiens
aaatattattcaacca

SEQ ID NO: 9615 - DNA, 16 bp, H. sapiens
aaatattattcagtaa

SEQ ID NO: 9616 - DNA, 16 bp, H. sapiens
aaatattatttcaaca

SEQ ID NO: 9617 - DNA, 16 bp, H. sapiens
aaatattatttcctaa

SEQ ID NO: 9618 - DNA, 16 bp, H. sapiens
aaatattatttcttgt

SEQ ID NO: 9619 - DNA, 16 bp, H. sapiens
aaatattcaaaaatga

SEQ ID NO: 9620 - DNA, 16 bp, H. sapiens
aaatattcaaagagat

SEQ ID NO: 9621 - DNA, 16 bp, H. sapiens
aaatattcaaatgaat

SEQ ID NO: 9622 - DNA, 16 bp, H. sapiens
aaatattcaacaaatg

SEQ ID NO: 9623 - DNA, 16 bp, H. sapiens
aaatattcaactttta

SEQ ID NO: 9624 - DNA, 16 bp, H. sapiens
aaatattcaagaaaat

SEQ ID NO: 9625 - DNA, 16 bp, H. sapiens
aaatattcaagaaaca

SEQ ID NO: 9626 - DNA, 16 bp, H. sapiens
aaatattcaagaaatt

SEQ ID NO: 9627 - DNA, 16 bp, H. sapiens
aaatattcaataagaa

SEQ ID NO: 9628 - DNA, 16 bp, H. sapiens
aaatattcactttatt

SEQ ID NO: 9629 - DNA, 16 bp, H. sapiens
aaatattcagaaaaat

SEQ ID NO: 9630 - DNA, 16 bp, H. sapiens
aaatattcagaaaata

SEQ ID NO: 9631 - DNA, 16 bp, H. sapiens
aaatattcagaaatat

SEQ ID NO: 9632 - DNA, 16 bp, H. sapiens
aaatattcagaatatt

SEQ ID NO: 9633 - DNA, 16 bp, H. sapiens
aaatattcaggaaaat

SEQ ID NO: 9634 - DNA, 16 bp, H. sapiens
aaatattcatattcat

SEQ ID NO: 9635 - DNA, 16 bp, H. sapiens
aaatattcatgatatt

SEQ ID NO: 9636 - DNA, 16 bp, H. sapiens
aaatattccaaaagaa

SEQ ID NO: 9637 - DNA, 16 bp, H. sapiens
aaatattccaaaatcc

SEQ ID NO: 9638 - DNA, 16 bp, H. sapiens
aaatattccaatattc

SEQ ID NO: 9639 - DNA, 16 bp, H. sapiens
aaatattccacttaaa

SEQ ID NO: 9640 - DNA, 16 bp, H. sapiens
aaatattccagaaaaa

SEQ ID NO: 9641 - DNA, 16 bp, H. sapiens
aaatattcctgatgaa

SEQ ID NO: 9642 - DNA, 16 bp, H. sapiens
aaatattcctttttct

SEQ ID NO: 9643 - DNA, 16 bp, H. sapiens
aaatattctaaaatgt

SEQ ID NO: 9644 - DNA, 16 bp, H. sapiens
aaatattctagaagaa

SEQ ID NO: 9645 - DNA, 16 bp, H. sapiens
aaatattctatatttg

SEQ ID NO: 9646 - DNA, 16 bp, H. sapiens
aaatattctctaattt

SEQ ID NO: 9647 - DNA, 16 bp, H. sapiens
aaatattctcttaaaa

SEQ ID NO: 9648 - DNA, 16 bp, H. sapiens
aaatattctggatatt

SEQ ID NO: 9649 - DNA, 16 bp, H. sapiens
aaatattctgtatttt

SEQ ID NO: 9650 - DNA, 16 bp, H. sapiens
aaatattctgtgtttt

SEQ ID NO: 9651 - DNA, 16 bp, H. sapiens
aaatattctgtttctt

SEQ ID NO: 9652 - DNA, 16 bp, H. sapiens
aaatattctttgtaaa

SEQ ID NO: 9653 - DNA, 16 bp, H. sapiens
aaatattgaaaatgtt

SEQ ID NO: 9654 - DNA, 16 bp, H. sapiens
aaatattgacaaataa

SEQ ID NO: 9655 - DNA, 16 bp, H. sapiens
aaatattgacacattt

SEQ ID NO: 9656 - DNA, 16 bp, H. sapiens
aaatattgacttttta

SEQ ID NO: 9657 - DNA, 16 bp, H. sapiens
aaatattgagtgccta

SEQ ID NO: 9658 - DNA, 16 bp, H. sapiens
aaatattgatgtattt

SEQ ID NO: 9659 - DNA, 16 bp, H. sapiens
aaatattgcaaaaatt

SEQ ID NO: 9660 - DNA, 16 bp, H. sapiens
aaatattgcaagaatt

SEQ ID NO: 9661 - DNA, 16 bp, H. sapiens
aaatattgcattttct

SEQ ID NO: 9662 - DNA, 16 bp, H. sapiens
aaatattgctgtctga

SEQ ID NO: 9663 - DNA, 16 bp, H. sapiens
aaatattggaaaggaa

SEQ ID NO: 9664 - DNA, 16 bp, H. sapiens
aaatattggtgaggat

SEQ ID NO: 9665 - DNA, 16 bp, H. sapiens
aaatattggttgaatg

SEQ ID NO: 9666 - DNA, 16 bp, H. sapiens
aaatattgtatgattt

SEQ ID NO: 9667 - DNA, 16 bp, H. sapiens
aaatattgtctttaaa

SEQ ID NO: 9668 - DNA, 16 bp, H. sapiens
aaatattgttaactat

SEQ ID NO: 9669 - DNA, 16 bp, H. sapiens
aaatattgttatgtat

SEQ ID NO: 9670 - DNA, 16 bp, H. sapiens
aaatattgttttcaaa

SEQ ID NO: 9671 - DNA, 16 bp, H. sapiens
aaatatttaaagcaaa

SEQ ID NO: 9672 - DNA, 16 bp, H. sapiens
aaatatttaaagtgtt

SEQ ID NO: 9673 - DNA, 16 bp, H. sapiens
aaatatttaaatgagt

SEQ ID NO: 9674 - DNA, 16 bp, H. sapiens
aaatatttaaatgtct

SEQ ID NO: 9675 - DNA, 16 bp, H. sapiens
aaatatttaaccccaa

SEQ ID NO: 9676 - DNA, 16 bp, H. sapiens
aaatatttaactcttt

SEQ ID NO: 9677 - DNA, 16 bp, H. sapiens
aaatatttaagcaaat

SEQ ID NO: 9678 - DNA, 16 bp, H. sapiens
aaatatttaaggaaga

SEQ ID NO: 9679 - DNA, 16 bp, H. sapiens
aaatatttaatgaatg

SEQ ID NO: 9680 - DNA, 16 bp, H. sapiens
aaatatttacaaaatg

SEQ ID NO: 9681 - DNA, 16 bp, H. sapiens
aaatatttacaaagca

SEQ ID NO: 9682 - DNA, 16 bp, H. sapiens
aaatatttacaaagta

SEQ ID NO: 9683 - DNA, 16 bp, H. sapiens
aaatatttactatctg

SEQ ID NO: 9684 - DNA, 16 bp, H. sapiens
aaatatttactctttg

SEQ ID NO: 9685 - DNA, 16 bp, H. sapiens
aaatatttactgtctg

SEQ ID NO: 9686 - DNA, 16 bp, H. sapiens
aaatatttagatgtaa

SEQ ID NO: 9687 - DNA, 16 bp, H. sapiens
aaatatttagcaaata

SEQ ID NO: 9688 - DNA, 16 bp, H. sapiens
aaatatttaggctaaa

SEQ ID NO: 9689 - DNA, 16 bp, H. sapiens
aaatatttatatgcat

SEQ ID NO: 9690 - DNA, 16 bp, H. sapiens
aaatatttatattcct

SEQ ID NO: 9691 - DNA, 16 bp, H. sapiens
aaatatttatgaagca

SEQ ID NO: 9692 - DNA, 16 bp, H. sapiens
aaatatttatgaagta

SEQ ID NO: 9693 - DNA, 16 bp, H. sapiens
aaatatttatgctttt

SEQ ID NO: 9694 - DNA, 16 bp, H. sapiens
aaatatttatgtagaa

SEQ ID NO: 9695 - DNA, 16 bp, H. sapiens
aaatatttatgtttct

SEQ ID NO: 9696 - DNA, 16 bp, H. sapiens
aaatatttattaagtg

SEQ ID NO: 9697 - DNA, 16 bp, H. sapiens
aaatatttattgagcc

SEQ ID NO: 9698 - DNA, 16 bp, H. sapiens
aaatatttattgagct

SEQ ID NO: 9699 - DNA, 16 bp, H. sapiens
aaatatttattgagtg

SEQ ID NO: 9700 - DNA, 16 bp, H. sapiens
aaatatttattggatg

SEQ ID NO: 9701 - DNA, 16 bp, H. sapiens
aaatatttcaatgtaa

SEQ ID NO: 9702 - DNA, 16 bp, H. sapiens
aaatatttcacatata

SEQ ID NO: 9703 - DNA, 16 bp, H. sapiens
aaatatttcacatatt

SEQ ID NO: 9704 - DNA, 16 bp, H. sapiens
aaatatttcacatttt

SEQ ID NO: 9705 - DNA, 16 bp, H. sapiens
aaatatttcagaaaat

SEQ ID NO: 9706 - DNA, 16 bp, H. sapiens
aaatatttcagacata

SEQ ID NO: 9707 - DNA, 16 bp, H. sapiens
aaatatttcagagaaa

SEQ ID NO: 9708 - DNA, 16 bp, H. sapiens
aaatatttcagataaa

SEQ ID NO: 9709 - DNA, 16 bp, H. sapiens
aaatatttcagcatat

SEQ ID NO: 9710 - DNA, 16 bp, H. sapiens
aaatatttcaggaaga

SEQ ID NO: 9711 - DNA, 16 bp, H. sapiens
aaatatttcaggcttt

SEQ ID NO: 9712 - DNA, 16 bp, H. sapiens
aaatatttcagtaaaa

SEQ ID NO: 9713 - DNA, 16 bp, H. sapiens
aaatatttcatgttct

SEQ ID NO: 9714 - DNA, 16 bp, H. sapiens
aaatatttcattagaa

SEQ ID NO: 9715 - DNA, 16 bp, H. sapiens
aaatatttcatttgat

SEQ ID NO: 9716 - DNA, 16 bp, H. sapiens
aaatatttcattttgt

SEQ ID NO: 9717 - DNA, 16 bp, H. sapiens
aaatatttccaaatat

SEQ ID NO: 9718 - DNA, 16 bp, H. sapiens
aaatatttccaaattt

SEQ ID NO: 9719 - DNA, 16 bp, H. sapiens
aaatatttccagaatt

SEQ ID NO: 9720 - DNA, 16 bp, H. sapiens
aaatatttccatatgt

SEQ ID NO: 9721 - DNA, 16 bp, H. sapiens
aaatatttccattaaa

SEQ ID NO: 9722 - DNA, 16 bp, H. sapiens
aaatatttcccttaaa

SEQ ID NO: 9723 - DNA, 16 bp, H. sapiens
aaatatttcctaaata

SEQ ID NO: 9724 - DNA, 16 bp, H. sapiens
aaatatttcctcctct

SEQ ID NO: 9725 - DNA, 16 bp, H. sapiens
aaatatttcctctaca

SEQ ID NO: 9726 - DNA, 16 bp, H. sapiens
aaatatttcctcttct

SEQ ID NO: 9727 - DNA, 16 bp, H. sapiens
aaatatttcctgaaat

SEQ ID NO: 9728 - DNA, 16 bp, H. sapiens
aaatatttctaaagca

SEQ ID NO: 9729 - DNA, 16 bp, H. sapiens
aaatatttctattgta

SEQ ID NO: 9730 - DNA, 16 bp, H. sapiens
aaatatttctgaaata

SEQ ID NO: 9731 - DNA, 16 bp, H. sapiens
aaatatttctttaaga

SEQ ID NO: 9732 - DNA, 16 bp, H. sapiens
aaatatttctttcaat

SEQ ID NO: 9733 - DNA, 16 bp, H. sapiens
aaatatttctttgttt

SEQ ID NO: 9734 - DNA, 16 bp, H. sapiens
aaatatttgaaaacat

SEQ ID NO: 9735 - DNA, 16 bp, H. sapiens
aaatatttgaaaacca

SEQ ID NO: 9736 - DNA, 16 bp, H. sapiens
aaatatttgaaaacta

SEQ ID NO: 9737 - DNA, 16 bp, H. sapiens
aaatatttgaaatgta

SEQ ID NO: 9738 - DNA, 16 bp, H. sapiens
aaatatttgaaggtat

SEQ ID NO: 9739 - DNA, 16 bp, H. sapiens
aaatatttgaatttgt

SEQ ID NO: 9740 - DNA, 16 bp, H. sapiens
aaatatttgagaacat

SEQ ID NO: 9741 - DNA, 16 bp, H. sapiens
aaatatttgagaatat

SEQ ID NO: 9742 - DNA, 16 bp, H. sapiens
aaatatttgaggattt

SEQ ID NO: 9743 - DNA, 16 bp, H. sapiens
aaatatttgagtattt

SEQ ID NO: 9744 - DNA, 16 bp, H. sapiens
aaatatttgattttct

SEQ ID NO: 9745 - DNA, 16 bp, H. sapiens
aaatatttgcaaacaa

SEQ ID NO: 9746 - DNA, 16 bp, H. sapiens
aaatatttgcaaatca

SEQ ID NO: 9747 - DNA, 16 bp, H. sapiens
aaatatttgcaagaaa

SEQ ID NO: 9748 - DNA, 16 bp, H. sapiens
aaatatttgcaatcca

SEQ ID NO: 9749 - DNA, 16 bp, H. sapiens
aaatatttgcataatt

SEQ ID NO: 9750 - DNA, 16 bp, H. sapiens
aaatatttgcatatat

SEQ ID NO: 9751 - DNA, 16 bp, H. sapiens
aaatatttgcatattt

SEQ ID NO: 9752 - DNA, 16 bp, H. sapiens
aaatatttgccatttt

SEQ ID NO: 9753 - DNA, 16 bp, H. sapiens
aaatatttgctaaata

SEQ ID NO: 9754 - DNA, 16 bp, H. sapiens
aaatatttgctaattt

SEQ ID NO: 9755 - DNA, 16 bp, H. sapiens
aaatatttgctatctg

SEQ ID NO: 9756 - DNA, 16 bp, H. sapiens
aaatatttgctcaata

SEQ ID NO: 9757 - DNA, 16 bp, H. sapiens
aaatatttgctgaaca

SEQ ID NO: 9758 - DNA, 16 bp, H. sapiens
aaatatttgctgaatg

SEQ ID NO: 9759 - DNA, 16 bp, H. sapiens
aaatatttgctgagtg

SEQ ID NO: 9760 - DNA, 16 bp, H. sapiens
aaatatttgcttattt

SEQ ID NO: 9761 - DNA, 16 bp, H. sapiens
aaatatttgcttctaa

SEQ ID NO: 9762 - DNA, 16 bp, H. sapiens
aaatatttggaaacaa

SEQ ID NO: 9763 - DNA, 16 bp, H. sapiens
aaatatttggaaatta

SEQ ID NO: 9764 - DNA, 16 bp, H. sapiens
aaatatttggagagat

SEQ ID NO: 9765 - DNA, 16 bp, H. sapiens
aaatatttggagattt

SEQ ID NO: 9766 - DNA, 16 bp, H. sapiens
aaatatttggggtttt

SEQ ID NO: 9767 - DNA, 16 bp, H. sapiens
aaatatttggtcattt

SEQ ID NO: 9768 - DNA, 16 bp, H. sapiens
aaatatttgtaaaaca

SEQ ID NO: 9769 - DNA, 16 bp, H. sapiens
aaatatttgtaaagtg

SEQ ID NO: 9770 - DNA, 16 bp, H. sapiens
aaatatttgtaattgt

SEQ ID NO: 9771 - DNA, 16 bp, H. sapiens
aaatatttgtacaaaa

SEQ ID NO: 9772 - DNA, 16 bp, H. sapiens
aaatatttgtatatgt

SEQ ID NO: 9773 - DNA, 16 bp, H. sapiens
aaatatttgtatcatt

SEQ ID NO: 9774 - DNA, 16 bp, H. sapiens
aaatatttgtcttctc

SEQ ID NO: 9775 - DNA, 16 bp, H. sapiens
aaatatttgtctttat

SEQ ID NO: 9776 - DNA, 16 bp, H. sapiens
aaatatttgtctttta

SEQ ID NO: 9777 - DNA, 16 bp, H. sapiens
aaatatttgtgaaatg

SEQ ID NO: 9778 - DNA, 16 bp, H. sapiens
aaatatttgttacata

SEQ ID NO: 9779 - DNA, 16 bp, H. sapiens
aaatatttgttagaaa

SEQ ID NO: 9780 - DNA, 16 bp, H. sapiens
aaatatttgttcaatt

SEQ ID NO: 9781 - DNA, 16 bp, H. sapiens
aaatatttgttgagta

SEQ ID NO: 9782 - DNA, 16 bp, H. sapiens
aaatatttgttgatgg

SEQ ID NO: 9783 - DNA, 16 bp, H. sapiens
aaatatttgtttagta

SEQ ID NO: 9784 - DNA, 16 bp, H. sapiens
aaatatttgtttcttt

SEQ ID NO: 9785 - DNA, 16 bp, H. sapiens
aaatattttaaagttg

SEQ ID NO: 9786 - DNA, 16 bp, H. sapiens
aaatattttaagagta

SEQ ID NO: 9787 - DNA, 16 bp, H. sapiens
aaatattttaaggtaa

SEQ ID NO: 9788 - DNA, 16 bp, H. sapiens
aaatattttacagttt

SEQ ID NO: 9789 - DNA, 16 bp, H. sapiens
aaatattttaccccaa

SEQ ID NO: 9790 - DNA, 16 bp, H. sapiens
aaatattttagaaatg

SEQ ID NO: 9791 - DNA, 16 bp, H. sapiens
aaatattttagaactt

SEQ ID NO: 9792 - DNA, 16 bp, H. sapiens
aaatattttaggcatt

SEQ ID NO: 9793 - DNA, 16 bp, H. sapiens
aaatattttaggcttt

SEQ ID NO: 9794 - DNA, 16 bp, H. sapiens
aaatattttatactgt

SEQ ID NO: 9795 - DNA, 16 bp, H. sapiens
aaatattttatggaat

SEQ ID NO: 9796 - DNA, 16 bp, H. sapiens
aaatattttatgtaca

SEQ ID NO: 9797 - DNA, 16 bp, H. sapiens
aaatattttcaaactt

SEQ ID NO: 9798 - DNA, 16 bp, H. sapiens
aaatattttcaacttt

SEQ ID NO: 9799 - DNA, 16 bp, H. sapiens
aaatattttcaagaaa

SEQ ID NO: 9800 - DNA, 16 bp, H. sapiens
aaatattttcaagata

SEQ ID NO: 9801 - DNA, 16 bp, H. sapiens
aaatattttcaagcca

SEQ ID NO: 9802 - DNA, 16 bp, H. sapiens
aaatattttcaagttt

SEQ ID NO: 9803 - DNA, 16 bp, H. sapiens
aaatattttcaatgaa

SEQ ID NO: 9804 - DNA, 16 bp, H. sapiens
aaatattttcagcaaa

SEQ ID NO: 9805 - DNA, 16 bp, H. sapiens
aaatattttcagtatt

SEQ ID NO: 9806 - DNA, 16 bp, H. sapiens
aaatattttcagtttt

SEQ ID NO: 9807 - DNA, 16 bp, H. sapiens
aaatattttcataact

SEQ ID NO: 9808 - DNA, 16 bp, H. sapiens
aaatattttcatacat

SEQ ID NO: 9809 - DNA, 16 bp, H. sapiens
aaatattttcatatca

SEQ ID NO: 9810 - DNA, 16 bp, H. sapiens
aaatattttcatatgg

SEQ ID NO: 9811 - DNA, 16 bp, H. sapiens
aaatattttcatcacc

SEQ ID NO: 9812 - DNA, 16 bp, H. sapiens
aaatattttccaaaca

SEQ ID NO: 9813 - DNA, 16 bp, H. sapiens
aaatattttcctaata

SEQ ID NO: 9814 - DNA, 16 bp, H. sapiens
aaatattttcctataa

SEQ ID NO: 9815 - DNA, 16 bp, H. sapiens
aaatattttcctatat

SEQ ID NO: 9816 - DNA, 16 bp, H. sapiens
aaatattttcctgaat

SEQ ID NO: 9817 - DNA, 16 bp, H. sapiens
aaatattttcctttgt

SEQ ID NO: 9818 - DNA, 16 bp, H. sapiens
aaatattttctaagtt

SEQ ID NO: 9819 - DNA, 16 bp, H. sapiens
aaatattttctaggaa

SEQ ID NO: 9820 - DNA, 16 bp, H. sapiens
aaatattttctcagaa

SEQ ID NO: 9821 - DNA, 16 bp, H. sapiens
aaatattttctccatt

SEQ ID NO: 9822 - DNA, 16 bp, H. sapiens
aaatattttctctcag

SEQ ID NO: 9823 - DNA, 16 bp, H. sapiens
aaatattttctctcat

SEQ ID NO: 9824 - DNA, 16 bp, H. sapiens
aaatattttctctcct

SEQ ID NO: 9825 - DNA, 16 bp, H. sapiens
aaatattttctgaaat

SEQ ID NO: 9826 - DNA, 16 bp, H. sapiens
aaatattttctgattt

SEQ ID NO: 9827 - DNA, 16 bp, H. sapiens
aaatattttctgtttt

SEQ ID NO: 9828 - DNA, 16 bp, H. sapiens
aaatattttcttcctg

SEQ ID NO: 9829 - DNA, 16 bp, H. sapiens
aaatattttcttcctt

SEQ ID NO: 9830 - DNA, 16 bp, H. sapiens
aaatattttctttcct

SEQ ID NO: 9831 - DNA, 16 bp, H. sapiens
aaatattttgaaatga

SEQ ID NO: 9832 - DNA, 16 bp, H. sapiens
aaatattttgaatatc

SEQ ID NO: 9833 - DNA, 16 bp, H. sapiens
aaatattttgaatgaa

SEQ ID NO: 9834 - DNA, 16 bp, H. sapiens
aaatattttgagcttt

SEQ ID NO: 9835 - DNA, 16 bp, H. sapiens
aaatattttgctaaat

SEQ ID NO: 9836 - DNA, 16 bp, H. sapiens
aaatattttgctttct

SEQ ID NO: 9837 - DNA, 16 bp, H. sapiens
aaatattttgcttttt

SEQ ID NO: 9838 - DNA, 16 bp, H. sapiens
aaatattttggaaaga

SEQ ID NO: 9839 - DNA, 16 bp, H. sapiens
aaatattttggaaata

SEQ ID NO: 9840 - DNA, 16 bp, H. sapiens
aaatattttggaaatg

SEQ ID NO: 9841 - DNA, 16 bp, H. sapiens
aaatattttggaagat

SEQ ID NO: 9842 - DNA, 16 bp, H. sapiens
aaatattttggacttt

SEQ ID NO: 9843 - DNA, 16 bp, H. sapiens
aaatattttgggcttt

SEQ ID NO: 9844 - DNA, 16 bp, H. sapiens
aaatattttgtaaaag

SEQ ID NO: 9845 - DNA, 16 bp, H. sapiens
aaatattttgtacaga

SEQ ID NO: 9846 - DNA, 16 bp, H. sapiens
aaatattttgtctttt

SEQ ID NO: 9847 - DNA, 16 bp, H. sapiens
aaatattttgttctat

SEQ ID NO: 9848 - DNA, 16 bp, H. sapiens
aaatattttgttcttt

SEQ ID NO: 9849 - DNA, 16 bp, H. sapiens
aaatattttgtttctc

SEQ ID NO: 9850 - DNA, 16 bp, H. sapiens
aaatatttttaaagtg

SEQ ID NO: 9851 - DNA, 16 bp, H. sapiens
aaatatttttaactgt

SEQ ID NO: 9852 - DNA, 16 bp, H. sapiens
aaatatttttactggt

SEQ ID NO: 9853 - DNA, 16 bp, H. sapiens
aaatatttttagaagt

SEQ ID NO: 9854 - DNA, 16 bp, H. sapiens
aaatatttttagagaa

SEQ ID NO: 9855 - DNA, 16 bp, H. sapiens
aaatatttttatcatc

SEQ ID NO: 9856 - DNA, 16 bp, H. sapiens
aaatatttttcagtgt

SEQ ID NO: 9857 - DNA, 16 bp, H. sapiens
aaatatttttccccat

SEQ ID NO: 9858 - DNA, 16 bp, H. sapiens
aaatatttttcctcct

SEQ ID NO: 9859 - DNA, 16 bp, H. sapiens
aaatatttttccttaa

SEQ ID NO: 9860 - DNA, 16 bp, H. sapiens
aaatatttttctccat

SEQ ID NO: 9861 - DNA, 16 bp, H. sapiens
aaatatttttctgact

SEQ ID NO: 9862 - DNA, 16 bp, H. sapiens
aaatatttttctgcca

SEQ ID NO: 9863 - DNA, 16 bp, H. sapiens
aaatatttttcttcct

SEQ ID NO: 9864 - DNA, 16 bp, H. sapiens
aaatatttttctttga

SEQ ID NO: 9865 - DNA, 16 bp, H. sapiens
aaatatttttgaaaag

SEQ ID NO: 9866 - DNA, 16 bp, H. sapiens
aaatatttttgagaaa

SEQ ID NO: 9867 - DNA, 16 bp, H. sapiens
aaatatttttgtacaa

SEQ ID NO: 9868 - DNA, 16 bp, H. sapiens
aaatatttttgtacat

SEQ ID NO: 9869 - DNA, 16 bp, H. sapiens
aaatatttttgtgcat

SEQ ID NO: 9870 - DNA, 16 bp, H. sapiens
aaatatttttgtgctt

SEQ ID NO: 9871 - DNA, 16 bp, H. sapiens
aaatattttttctctg

SEQ ID NO: 9872 - DNA, 16 bp, H. sapiens
aaatatttttttcaga

SEQ ID NO: 9873 - DNA, 16 bp, H. sapiens
aaatcaaaaatgcaat

SEQ ID NO: 9874 - DNA, 16 bp, H. sapiens
aaatcaaaaccacagc

SEQ ID NO: 9875 - DNA, 16 bp, H. sapiens
aaatcaaaaccgcaat

SEQ ID NO: 9876 - DNA, 16 bp, H. sapiens
aaatcaaaagaaatgt

SEQ ID NO: 9877 - DNA, 16 bp, H. sapiens
aaatcaaaagaatatt

SEQ ID NO: 9878 - DNA, 16 bp, H. sapiens
aaatcaaaagctagtt

SEQ ID NO: 9879 - DNA, 16 bp, H. sapiens
aaatcaaaataaattg

SEQ ID NO: 9880 - DNA, 16 bp, H. sapiens
aaatcaaaatcaccat

SEQ ID NO: 9881 - DNA, 16 bp, H. sapiens
aaatcaaaatcctgaa

SEQ ID NO: 9882 - DNA, 16 bp, H. sapiens
aaatcaaaatgataat

SEQ ID NO: 9883 - DNA, 16 bp, H. sapiens
aaatcaaacaatgtaa

SEQ ID NO: 9884 - DNA, 16 bp, H. sapiens
aaatcaaaccacaatg

SEQ ID NO: 9885 - DNA, 16 bp, H. sapiens
aaatcaaagaagaact

SEQ ID NO: 9886 - DNA, 16 bp, H. sapiens
aaatcaaagaatatct

SEQ ID NO: 9887 - DNA, 16 bp, H. sapiens
aaatcaaagaatattt

SEQ ID NO: 9888 - DNA, 16 bp, H. sapiens
aaatcaaagatgaaga

SEQ ID NO: 9889 - DNA, 16 bp, H. sapiens
aaatcaaagatttaaa

SEQ ID NO: 9890 - DNA, 16 bp, H. sapiens
aaatcaaagttttaaa

SEQ ID NO: 9891 - DNA, 16 bp, H. sapiens
aaatcaaatcattttt

SEQ ID NO: 9892 - DNA, 16 bp, H. sapiens
aaatcaaatgaaaatg

SEQ ID NO: 9893 - DNA, 16 bp, H. sapiens
aaatcaaatggaaatg

SEQ ID NO: 9894 - DNA, 16 bp, H. sapiens
aaatcaaatgtaattt

SEQ ID NO: 9895 - DNA, 16 bp, H. sapiens
aaatcaacagaataat

SEQ ID NO: 9896 - DNA, 30 bp, H. sapiens
aaatcaacagaatatacattcttctcagca

SEQ ID NO: 9897 - DNA, 17 bp, H. sapiens
aaatcaactcaagatgt

SEQ ID NO: 9898 - DNA, 16 bp, H. sapiens
aaatcaactctctcaa

SEQ ID NO: 9899 - DNA, 16 bp, H. sapiens
aaatcaagaaaactat

SEQ ID NO: 9900 - DNA, 16 bp, H. sapiens
aaatcaagaaatgtaa

SEQ ID NO: 9901 - DNA, 16 bp, H. sapiens
aaatcaagaagaatta

SEQ ID NO: 9902 - DNA, 16 bp, H. sapiens
aaatcaagaagctctt

SEQ ID NO: 9903 - DNA, 16 bp, H. sapiens
aaatcaagaaggtaat

SEQ ID NO: 9904 - DNA, 16 bp, H. sapiens
aaatcaagaatgtaat

SEQ ID NO: 9905 - DNA, 16 bp, H. sapiens
aaatcaagctgcaagc

SEQ ID NO: 9906 - DNA, 16 bp, H. sapiens
aaatcaaggaaacatg

SEQ ID NO: 9907 - DNA, 16 bp, H. sapiens
aaatcaaggatgtgga

SEQ ID NO: 9908 - DNA, 16 bp, H. sapiens
aaatcaagtaaaaatt

SEQ ID NO: 9909 - DNA, 16 bp, H. sapiens
aaatcaataaatgcaa

SEQ ID NO: 9910 - DNA, 33 bp, H. sapiens
aaatcaataaatgtaatccagcatataaacaga

SEQ ID NO: 9911 - DNA, 16 bp, H. sapiens
aaatcaatacatgtaa

SEQ ID NO: 9912 - DNA, 16 bp, H. sapiens
aaatcaatattttgaa

SEQ ID NO: 9913 - DNA, 16 bp, H. sapiens
aaatcaatcaatgtga

SEQ ID NO: 9914 - DNA, 16 bp, H. sapiens
aaatcaatgaaacaga

SEQ ID NO: 9915 - DNA, 16 bp, H. sapiens
aaatcaatgaaactga

SEQ ID NO: 9916 - DNA, 16 bp, H. sapiens
aaatcaatggaaaaat

SEQ ID NO: 9917 - DNA, 16 bp, H. sapiens
aaatcaattaaaaatg

SEQ ID NO: 9918 - DNA, 16 bp, H. sapiens
aaatcaattaatgtaa

SEQ ID NO: 9919 - DNA, 16 bp, H. sapiens
aaatcaattgcaacaa

SEQ ID NO: 9920 - DNA, 16 bp, H. sapiens
aaatcaatttagtggg

SEQ ID NO: 9921 - DNA, 16 bp, H. sapiens
aaatcaatttctgttg

SEQ ID NO: 9922 - DNA, 16 bp, H. sapiens
aaatcacaaaggaaat

SEQ ID NO: 9923 - DNA, 18 bp, H. sapiens
aaatcacaacaaactgtc

SEQ ID NO: 9924 - DNA, 16 bp, H. sapiens
aaatcacaagaatatt

SEQ ID NO: 9925 - DNA, 16 bp, H. sapiens
aaatcacaggcattct

SEQ ID NO: 9926 - DNA, 16 bp, H. sapiens
aaatcacatattttat

SEQ ID NO: 9927 - DNA, 16 bp, H. sapiens
aaatcacatctctact

SEQ ID NO: 9928 - DNA, 17 bp, H. sapiens
aaatcacatgatcatct

SEQ ID NO: 9929 - DNA, 16 bp, H. sapiens
aaatcacatggtgaga

SEQ ID NO: 9930 - DNA, 16 bp, H. sapiens
aaatcacatttatttt

SEQ ID NO: 9931 - DNA, 16 bp, H. sapiens
aaatcacatttcaaca

SEQ ID NO: 9932 - DNA, 16 bp, H. sapiens
aaatcacatttttttc

SEQ ID NO: 9933 - DNA, 16 bp, H. sapiens
aaatcaccaaatattt

SEQ ID NO: 9934 - DNA, 17 bp, H. sapiens
aaatcaccactaaagaa

SEQ ID NO: 9935 - DNA, 16 bp, H. sapiens
aaatcacctcccacca

SEQ ID NO: 9936 - DNA, 16 bp, H. sapiens
aaatcacctggagagc

SEQ ID NO: 9937 - DNA, 16 bp, H. sapiens
aaatcactaagccaaa

SEQ ID NO: 9938 - DNA, 16 bp, H. sapiens
aaatcactgagaaaaa

SEQ ID NO: 9939 - DNA, 16 bp, H. sapiens
aaatcactgtacaaaa

SEQ ID NO: 9940 - DNA, 16 bp, H. sapiens
aaatcacttgaatcca

SEQ ID NO: 9941 - DNA, 16 bp, H. sapiens
aaatcacttgcccaaa

SEQ ID NO: 9942 - DNA, 16 bp, H. sapiens
aaatcactttgaaaaa

SEQ ID NO: 9943 - DNA, 16 bp, H. sapiens
aaatcagaaaatattt

SEQ ID NO: 9944 - DNA, 16 bp, H. sapiens
aaatcagaaaattaat

SEQ ID NO: 9945 - DNA, 16 bp, H. sapiens
aaatcagaaacttttt

SEQ ID NO: 9946 - DNA, 16 bp, H. sapiens
aaatcagaaagtatga

SEQ ID NO: 9947 - DNA, 16 bp, H. sapiens
aaatcagaaatatttt

SEQ ID NO: 9948 - DNA, 16 bp, H. sapiens
aaatcagaaatgaaat

SEQ ID NO: 9949 - DNA, 16 bp, H. sapiens
aaatcagaaatgagaa

SEQ ID NO: 9950 - DNA, 16 bp, H. sapiens
aaatcagaactcagga

SEQ ID NO: 9951 - DNA, 16 bp, H. sapiens
aaatcagaagcattta

SEQ ID NO: 9952 - DNA, 16 bp, H. sapiens
aaatcagaataaatat

SEQ ID NO: 9953 - DNA, 16 bp, H. sapiens
aaatcagaatggaaaa

SEQ ID NO: 9954 - DNA, 16 bp, H. sapiens
aaatcagaatttctag

SEQ ID NO: 9955 - DNA, 16 bp, H. sapiens
aaatcagaattttttt

SEQ ID NO: 9956 - DNA, 16 bp, H. sapiens
aaatcagacaccgcct

SEQ ID NO: 9957 - DNA, 16 bp, H. sapiens
aaatcagacatgaaaa

SEQ ID NO: 9958 - DNA, 16 bp, H. sapiens
aaatcagagcatctct

SEQ ID NO: 9959 - DNA, 16 bp, H. sapiens
aaatcagagttgtgtg

SEQ ID NO: 9960 - DNA, 16 bp, H. sapiens
aaatcagattttttaa

SEQ ID NO: 9961 - DNA, 16 bp, H. sapiens
aaatcagcaaagggaa

SEQ ID NO: 9962 - DNA, 16 bp, H. sapiens
aaatcagcaagaagaa

SEQ ID NO: 9963 - DNA, 16 bp, H. sapiens
aaatcagcaagagaaa

SEQ ID NO: 9964 - DNA, 16 bp, H. sapiens
aaatcagcaaggatat

SEQ ID NO: 9965 - DNA, 16 bp, H. sapiens
aaatcagccaaaggaa

SEQ ID NO: 9966 - DNA, 16 bp, H. sapiens
aaatcagccagtcaca

SEQ ID NO: 9967 - DNA, 16 bp, H. sapiens
aaatcagccggacatg

SEQ ID NO: 9968 - DNA, 16 bp, H. sapiens
aaatcagcctggccaa

SEQ ID NO: 9969 - DNA, 16 bp, H. sapiens
aaatcagctgtgaatc

SEQ ID NO: 9970 - DNA, 16 bp, H. sapiens
aaatcaggaagaaaca

SEQ ID NO: 9971 - DNA, 16 bp, H. sapiens
aaatcaggaaggaaaa

SEQ ID NO: 9972 - DNA, 16 bp, H. sapiens
aaatcaggaagtatga

SEQ ID NO: 9973 - DNA, 16 bp, H. sapiens
aaatcaggcttttaaa

SEQ ID NO: 9974 - DNA, 16 bp, H. sapiens
aaatcagggtaactgg

SEQ ID NO: 9975 - DNA, 16 bp, H. sapiens
aaatcaggtagtgtga

SEQ ID NO: 9976 - DNA, 16 bp, H. sapiens
aaatcagtaagcaaaa

SEQ ID NO: 9977 - DNA, 16 bp, H. sapiens
aaatcagtaatgtttc

SEQ ID NO: 9978 - DNA, 16 bp, H. sapiens
aaatcagtattcaaaa

SEQ ID NO: 9979 - DNA, 16 bp, H. sapiens
aaatcagtatttaaaa

SEQ ID NO: 9980 - DNA, 16 bp, H. sapiens
aaatcagtattttgaa

SEQ ID NO: 9981 - DNA, 16 bp, H. sapiens
aaatcagtatttttaa

SEQ ID NO: 9982 - DNA, 16 bp, H. sapiens
aaatcagtgagaaaaa

SEQ ID NO: 9983 - DNA, 16 bp, H. sapiens
aaatcagtgggaaaaa

SEQ ID NO: 9984 - DNA, 16 bp, H. sapiens
aaatcagtgtttctca

SEQ ID NO: 9985 - DNA, 16 bp, H. sapiens
aaatcagtttctcaaa

SEQ ID NO: 9986 - DNA, 16 bp, H. sapiens
aaatcagtttctcaga

SEQ ID NO: 9987 - DNA, 16 bp, H. sapiens
aaatcagtttttaaaa

SEQ ID NO: 9988 - DNA, 16 bp, H. sapiens
aaatcataaaagcaag

SEQ ID NO: 9989 - DNA, 16 bp, H. sapiens
aaatcatagaaacaga

SEQ ID NO: 9990 - DNA, 16 bp, H. sapiens
aaatcatattttatac

SEQ ID NO: 9991 - DNA, 16 bp, H. sapiens
aaatcatcacaaaggt

SEQ ID NO: 9992 - DNA, 16 bp, H. sapiens
aaatcatcacatttta

SEQ ID NO: 9993 - DNA, 16 bp, H. sapiens
aaatcatcattctgag

SEQ ID NO: 9994 - DNA, 16 bp, H. sapiens
aaatcatctctagatg

SEQ ID NO: 9995 - DNA, 16 bp, H. sapiens
aaatcatctgtcttct

SEQ ID NO: 9996 - DNA, 16 bp, H. sapiens
aaatcatgaatgaact

SEQ ID NO: 9997 - DNA, 16 bp, H. sapiens
aaatcatgaatgagct

SEQ ID NO: 9998 - DNA, 33 bp, H. sapiens
aaatcatgagtgaactcccattcacaattgcta

SEQ ID NO: 9999 - DNA, 49 bp, H. sapiens
aaatcatgagtgaactcccattcacaattgcttcaaagagaatcaaata

SEQ ID NO: 10000 - DNA, 16 bp, H. sapiens
aaatcatgcagtatgt

SEQ ID NO: 10001 - DNA, 16 bp, H. sapiens
aaatcatgtatttatt

SEQ ID NO: 10002 - DNA, 16 bp, H. sapiens
aaatcatgtcttttgc

SEQ ID NO: 10003 - DNA, 16 bp, H. sapiens
aaatcattcaagaaaa

SEQ ID NO: 10004 - DNA, 16 bp, H. sapiens
aaatcattcaagagca

SEQ ID NO: 10005 - DNA, 16 bp, H. sapiens
aaatcattcattttct

SEQ ID NO: 10006 - DNA, 16 bp, H. sapiens
aaatcattccatgctc

SEQ ID NO: 10007 - DNA, 16 bp, H. sapiens
aaatcattcttttaaa

SEQ ID NO: 10008 - DNA, 16 bp, H. sapiens
aaatcattgtatcaaa

SEQ ID NO: 10009 - DNA, 16 bp, H. sapiens
aaatcatttaaaatgt

SEQ ID NO: 10010 - DNA, 16 bp, H. sapiens
aaatcatttaaggaaa

SEQ ID NO: 10011 - DNA, 16 bp, H. sapiens
aaatcatttagaaaaa

SEQ ID NO: 10012 - DNA, 16 bp, H. sapiens
aaatcatttatctgat

SEQ ID NO: 10013 - DNA, 16 bp, H. sapiens
aaatcatttattttcc

SEQ ID NO: 10014 - DNA, 16 bp, H. sapiens
aaatcatttctctttt

SEQ ID NO: 10015 - DNA, 16 bp, H. sapiens
aaatcatttgaaattt

SEQ ID NO: 10016 - DNA, 16 bp, H. sapiens
aaatcatttgacaaaa

SEQ ID NO: 10017 - DNA, 16 bp, H. sapiens
aaatcattttacttta

SEQ ID NO: 10018 - DNA, 16 bp, H. sapiens
aaatcattttatgaaa

SEQ ID NO: 10019 - DNA, 16 bp, H. sapiens
aaatcattttatgaag

SEQ ID NO: 10020 - DNA, 16 bp, H. sapiens
aaatcattttgaaaat

SEQ ID NO: 10021 - DNA, 16 bp, H. sapiens
aaatcattttgatttt

SEQ ID NO: 10022 - DNA, 16 bp, H. sapiens
aaatcattttggaaat

SEQ ID NO: 10023 - DNA, 16 bp, H. sapiens
aaatcatttttaaaag

SEQ ID NO: 10024 - DNA, 16 bp, H. sapiens
aaatccaaaacacttc

SEQ ID NO: 10025 - DNA, 16 bp, H. sapiens
aaatccaaaacatgaa

SEQ ID NO: 10026 - DNA, 16 bp, H. sapiens
aaatccaaaatcttta

SEQ ID NO: 10027 - DNA, 16 bp, H. sapiens
aaatccaaagcctgaa

SEQ ID NO: 10028 - DNA, 16 bp, H. sapiens
aaatccaaatactgca

SEQ ID NO: 10029 - DNA, 16 bp, H. sapiens
aaatccaacaatatat

SEQ ID NO: 10030 - DNA, 16 bp, H. sapiens
aaatccaacatctctt

SEQ ID NO: 10031 - DNA, 16 bp, H. sapiens
aaatccaagaaactca

SEQ ID NO: 10032 - DNA, 16 bp, H. sapiens
aaatccaagaagatga

SEQ ID NO: 10033 - DNA, 16 bp, H. sapiens
aaatccacagaatgta

SEQ ID NO: 10034 - DNA, 17 bp, H. sapiens
aaatccacagccaacat

SEQ ID NO: 10035 - DNA, 16 bp, H. sapiens
aaatccacatgtaact

SEQ ID NO: 10036 - DNA, 16 bp, H. sapiens
aaatccacccacctca

SEQ ID NO: 10037 - DNA, 16 bp, H. sapiens
aaatccagcaacacat

SEQ ID NO: 10038 - DNA, 16 bp, H. sapiens
aaatccaggagctgtt

SEQ ID NO: 10039 - DNA, 16 bp, H. sapiens
aaatccaggctgaggt

SEQ ID NO: 10040 - DNA, 16 bp, H. sapiens
aaatccaggttgaggt

SEQ ID NO: 10041 - DNA, 16 bp, H. sapiens
aaatccagtgtttctt

SEQ ID NO: 10042 - DNA, 16 bp, H. sapiens
aaatccatagggcagg

SEQ ID NO: 10043 - DNA, 16 bp, H. sapiens
aaatccatgaagatga

SEQ ID NO: 10044 - DNA, 16 bp, H. sapiens
aaatccatggctgggc

SEQ ID NO: 10045 - DNA, 16 bp, H. sapiens
aaatcccaaaatattt

SEQ ID NO: 10046 - DNA, 16 bp, H. sapiens
aaatcccacatgttct

SEQ ID NO: 10047 - DNA, 16 bp, H. sapiens
aaatcccagcactctg

SEQ ID NO: 10048 - DNA, 19 bp, H. sapiens
aaatcccagcactttggga

SEQ ID NO: 10049 - DNA, 16 bp, H. sapiens
aaatcccagccctgcc

SEQ ID NO: 10050 - DNA, 16 bp, H. sapiens
aaatcccagctactcg

SEQ ID NO: 10051 - DNA, 18 bp, H. sapiens
aaatcccatctctactaa

SEQ ID NO: 10052 - DNA, 16 bp, H. sapiens
aaatccccaaatactt

SEQ ID NO: 10053 - DNA, 20 bp, H. sapiens
aaatcccgtctttactaaaa

SEQ ID NO: 10054 - DNA, 16 bp, H. sapiens
aaatccctaaggatcc

SEQ ID NO: 10055 - DNA, 16 bp, H. sapiens
aaatccctcagctttt

SEQ ID NO: 10056 - DNA, 16 bp, H. sapiens
aaatccctgtcctgtt

SEQ ID NO: 10057 - DNA, 16 bp, H. sapiens
aaatcccttggaattt

SEQ ID NO: 10058 - DNA, 16 bp, H. sapiens
aaatcctagaaaatgt

SEQ ID NO: 10059 - DNA, 16 bp, H. sapiens
aaatcctagatggcat

SEQ ID NO: 10060 - DNA, 16 bp, H. sapiens
aaatcctagcactttg

SEQ ID NO: 10061 - DNA, 16 bp, H. sapiens
aaatcctagggccctt

SEQ ID NO: 10062 - DNA, 16 bp, H. sapiens
aaatcctcaaaagcaa

SEQ ID NO: 10063 - DNA, 16 bp, H. sapiens
aaatcctcaatacaat

SEQ ID NO: 10064 - DNA, 16 bp, H. sapiens
aaatcctcagagaggt

SEQ ID NO: 10065 - DNA, 16 bp, H. sapiens
aaatcctcccagtggg

SEQ ID NO: 10066 - DNA, 16 bp, H. sapiens
aaatcctggaaataca

SEQ ID NO: 10067 - DNA, 16 bp, H. sapiens
aaatcctggcctcaag

SEQ ID NO: 10068 - DNA, 16 bp, H. sapiens
aaatcctgggctcaag

SEQ ID NO: 10069 - DNA, 16 bp, H. sapiens
aaatcctgtctctact

SEQ ID NO: 10070 - DNA, 16 bp, H. sapiens
aaatccttcatccaga

SEQ ID NO: 10071 - DNA, 16 bp, H. sapiens
aaatccttgagcttga

SEQ ID NO: 10072 - DNA, 16 bp, H. sapiens
aaatcctttatcagat

SEQ ID NO: 10073 - DNA, 16 bp, H. sapiens
aaatctaaaactgttt

SEQ ID NO: 10074 - DNA, 16 bp, H. sapiens
aaatctaaaggaaatg

SEQ ID NO: 10075 - DNA, 16 bp, H. sapiens
aaatctaacaaaagat

SEQ ID NO: 10076 - DNA, 16 bp, H. sapiens
aaatctaatgcctgat

SEQ ID NO: 10077 - DNA, 16 bp, H. sapiens
aaatctacacacacac

SEQ ID NO: 10078 - DNA, 16 bp, H. sapiens
aaatctacagagacaa

SEQ ID NO: 10079 - DNA, 22 bp, H. sapiens
aaatctacgtctgattggtgta

SEQ ID NO: 10080 - DNA, 16 bp, H. sapiens
aaatctagaaaatatt

SEQ ID NO: 10081 - DNA, 16 bp, H. sapiens
aaatctagaaatatat

SEQ ID NO: 10082 - DNA, 16 bp, H. sapiens
aaatctagaagaaata

SEQ ID NO: 10083 - DNA, 16 bp, H. sapiens
aaatctagagatctaa

SEQ ID NO: 10084 - DNA, 16 bp, H. sapiens
aaatctagtagaaatg

SEQ ID NO: 10085 - DNA, 16 bp, H. sapiens
aaatctataaaacttt

SEQ ID NO: 10086 - DNA, 16 bp, H. sapiens
aaatctatagacagaa

SEQ ID NO: 10087 - DNA, 16 bp, H. sapiens
aaatctatagataaca

SEQ ID NO: 10088 - DNA, 16 bp, H. sapiens
aaatctatcagattaa

SEQ ID NO: 10089 - DNA, 16 bp, H. sapiens
aaatctatgaaaataa

SEQ ID NO: 10090 - DNA, 16 bp, H. sapiens
aaatctatgaaaatat

SEQ ID NO: 10091 - DNA, 16 bp, H. sapiens
aaatctatgaattatt

SEQ ID NO: 10092 - DNA, 16 bp, H. sapiens
aaatctattattttag

SEQ ID NO: 10093 - DNA, 16 bp, H. sapiens
aaatctatttgacaaa

SEQ ID NO: 10094 - DNA, 16 bp, H. sapiens
aaatctattttatctg

SEQ ID NO: 10095 - DNA, 16 bp, H. sapiens
aaatctatttttgttt

SEQ ID NO: 10096 - DNA, 16 bp, H. sapiens
aaatctcaactttaat

SEQ ID NO: 10097 - DNA, 16 bp, H. sapiens
aaatctcaagaaaaat

SEQ ID NO: 10098 - DNA, 17 bp, H. sapiens
aaatctcaccttgaatt

SEQ ID NO: 10099 - DNA, 16 bp, H. sapiens
aaatctcactctgtca

SEQ ID NO: 10100 - DNA, 16 bp, H. sapiens
aaatctcagaaatcat

SEQ ID NO: 10101 - DNA, 16 bp, H. sapiens
aaatctcagaaatctg

SEQ ID NO: 10102 - DNA, 16 bp, H. sapiens
aaatctcagttctgcc

SEQ ID NO: 10103 - DNA, 16 bp, H. sapiens
aaatctcagttcttga

SEQ ID NO: 10104 - DNA, 16 bp, H. sapiens
aaatctcatatcaaat

SEQ ID NO: 10105 - DNA, 17 bp, H. sapiens
aaatctcatcttgaatt

SEQ ID NO: 10106 - DNA, 21 bp, H. sapiens
aaatctcatcttgaattgtag

SEQ ID NO: 10107 - DNA, 16 bp, H. sapiens
aaatctcatgatgaaa

SEQ ID NO: 10108 - DNA, 16 bp, H. sapiens
aaatctcatgttaaat

SEQ ID NO: 10109 - DNA, 16 bp, H. sapiens
aaatctcatgttgaaa

SEQ ID NO: 10110 - DNA, 17 bp, H. sapiens
aaatctcatgttgaact

SEQ ID NO: 10111 - DNA, 16 bp, H. sapiens
aaatctcattaatttt

SEQ ID NO: 10112 - DNA, 16 bp, H. sapiens
aaatctccaaaataat

SEQ ID NO: 10113 - DNA, 16 bp, H. sapiens
aaatctccaaaatgat

SEQ ID NO: 10114 - DNA, 16 bp, H. sapiens
aaatctccaaatattt

SEQ ID NO: 10115 - DNA, 16 bp, H. sapiens
aaatctccaagaaaca

SEQ ID NO: 10116 - DNA, 16 bp, H. sapiens
aaatctctagaagaaa

SEQ ID NO: 10117 - DNA, 16 bp, H. sapiens
aaatctctaggaagtt

SEQ ID NO: 10118 - DNA, 16 bp, H. sapiens
aaatctctattttaaa

SEQ ID NO: 10119 - DNA, 16 bp, H. sapiens
aaatctctcaaaacca

SEQ ID NO: 10120 - DNA, 16 bp, H. sapiens
aaatctctcatttttt

SEQ ID NO: 10121 - DNA, 16 bp, H. sapiens
aaatctctccctatcc

SEQ ID NO: 10122 - DNA, 16 bp, H. sapiens
aaatctctccctctct

SEQ ID NO: 10123 - DNA, 16 bp, H. sapiens
aaatctctgcagactt

SEQ ID NO: 10124 - DNA, 16 bp, H. sapiens
aaatctctgtaccttc

SEQ ID NO: 10125 - DNA, 16 bp, H. sapiens
aaatctctgtccaatc

SEQ ID NO: 10126 - DNA, 16 bp, H. sapiens
aaatctcttaatatat

SEQ ID NO: 10127 - DNA, 16 bp, H. sapiens
aaatctcttaatattt

SEQ ID NO: 10128 - DNA, 16 bp, H. sapiens
aaatctgaaaatccaa

SEQ ID NO: 10129 - DNA, 16 bp, H. sapiens
aaatctgaaacagaaa

SEQ ID NO: 10130 - DNA, 16 bp, H. sapiens
aaatctgaaataaaat

SEQ ID NO: 10131 - DNA, 16 bp, H. sapiens
aaatctgaaatatttt

SEQ ID NO: 10132 - DNA, 16 bp, H. sapiens
aaatctgaaatgtttt

SEQ ID NO: 10133 - DNA, 16 bp, H. sapiens
aaatctgaaattattt

SEQ ID NO: 10134 - DNA, 16 bp, H. sapiens
aaatctgaaattcaaa

SEQ ID NO: 10135 - DNA, 16 bp, H. sapiens
aaatctgaaatttgaa

SEQ ID NO: 10136 - DNA, 16 bp, H. sapiens
aaatctgaacaacagc

SEQ ID NO: 10137 - DNA, 16 bp, H. sapiens
aaatctgaagaagaaa

SEQ ID NO: 10138 - DNA, 16 bp, H. sapiens
aaatctgagaaatcac

SEQ ID NO: 10139 - DNA, 16 bp, H. sapiens
aaatctgatgttgaat

SEQ ID NO: 10140 - DNA, 16 bp, H. sapiens
aaatctgcacagcaaa

SEQ ID NO: 10141 - DNA, 16 bp, H. sapiens
aaatctgcattttaaa

SEQ ID NO: 10142 - DNA, 16 bp, H. sapiens
aaatctgcctttgaat

SEQ ID NO: 10143 - DNA, 16 bp, H. sapiens
aaatctgctgtcattc

SEQ ID NO: 10144 - DNA, 16 bp, H. sapiens
aaatctgctgttgagc

SEQ ID NO: 10145 - DNA, 16 bp, H. sapiens
aaatctgctttttaaa

SEQ ID NO: 10146 - DNA, 16 bp, H. sapiens
aaatctggagaaagaa

SEQ ID NO: 10147 - DNA, 23 bp, H. sapiens
aaatctggccataaactggcccc

SEQ ID NO: 10148 - DNA, 16 bp, H. sapiens
aaatctgggtttgaat

SEQ ID NO: 10149 - DNA, 19 bp, H. sapiens
aaatctggtaagcggcctc

SEQ ID NO: 10150 - DNA, 16 bp, H. sapiens
aaatctgtaagacata

SEQ ID NO: 10151 - DNA, 16 bp, H. sapiens
aaatctgtaatttgaa

SEQ ID NO: 10152 - DNA, 16 bp, H. sapiens
aaatctgtatatattt

SEQ ID NO: 10153 - DNA, 16 bp, H. sapiens
aaatctgtatcagtca

SEQ ID NO: 10154 - DNA, 16 bp, H. sapiens
aaatctgtatttgttt

SEQ ID NO: 10155 - DNA, 16 bp, H. sapiens
aaatctgtgaagaaag

SEQ ID NO: 10156 - DNA, 16 bp, H. sapiens
aaatctgtttccttgc

SEQ ID NO: 10157 - DNA, 16 bp, H. sapiens
aaatctgttttcaaaa

SEQ ID NO: 10158 - DNA, 16 bp, H. sapiens
aaatctgttttgcttt

SEQ ID NO: 10159 - DNA, 16 bp, H. sapiens
aaatctgttttgtcag

SEQ ID NO: 10160 - DNA, 16 bp, H. sapiens
aaatctgttttttctt

SEQ ID NO: 10161 - DNA, 16 bp, H. sapiens
aaatctgtttttttaa

SEQ ID NO: 10162 - DNA, 16 bp, H. sapiens
aaatcttaaaattctt

SEQ ID NO: 10163 - DNA, 16 bp, H. sapiens
aaatcttaaagctcaa

SEQ ID NO: 10164 - DNA, 16 bp, H. sapiens
aaatcttaacattttg

SEQ ID NO: 10165 - DNA, 27 bp, H. sapiens
aaatcttaaccctgtcacttgggttaa

SEQ ID NO: 10166 - DNA, 16 bp, H. sapiens
aaatcttaagtgtata

SEQ ID NO: 10167 - DNA, 16 bp, H. sapiens
aaatcttacaactcaa

SEQ ID NO: 10168 - DNA, 16 bp, H. sapiens
aaatcttagcaagcat

SEQ ID NO: 10169 - DNA, 16 bp, H. sapiens
aaatcttagtggctta

SEQ ID NO: 10170 - DNA, 16 bp, H. sapiens
aaatcttattttgaat

SEQ ID NO: 10171 - DNA, 16 bp, H. sapiens
aaatcttcaaactgct

SEQ ID NO: 10172 - DNA, 16 bp, H. sapiens
aaatcttcaacaaaat

SEQ ID NO: 10173 - DNA, 16 bp, H. sapiens
aaatcttcattttaaa

SEQ ID NO: 10174 - DNA, 16 bp, H. sapiens
aaatcttcatttttaa

SEQ ID NO: 10175 - DNA, 16 bp, H. sapiens
aaatcttctaagattg

SEQ ID NO: 10176 - DNA, 16 bp, H. sapiens
aaatcttctctttaaa

SEQ ID NO: 10177 - DNA, 16 bp, H. sapiens
aaatcttcttctacca

SEQ ID NO: 10178 - DNA, 16 bp, H. sapiens
aaatcttcttggtgtt

SEQ ID NO: 10179 - DNA, 16 bp, H. sapiens
aaatcttgaaaatatt

SEQ ID NO: 10180 - DNA, 16 bp, H. sapiens
aaatcttgccatttgt

SEQ ID NO: 10181 - DNA, 16 bp, H. sapiens
aaatcttggccattgt

SEQ ID NO: 10182 - DNA, 16 bp, H. sapiens
aaatcttgtgattttt

SEQ ID NO: 10183 - DNA, 16 bp, H. sapiens
aaatctttaaggaaaa

SEQ ID NO: 10184 - DNA, 16 bp, H. sapiens
aaatctttattgaatg

SEQ ID NO: 10185 - DNA, 16 bp, H. sapiens
aaatctttatttacaa

SEQ ID NO: 10186 - DNA, 16 bp, H. sapiens
aaatctttcaaaaatt

SEQ ID NO: 10187 - DNA, 16 bp, H. sapiens
aaatctttcagaaaat

SEQ ID NO: 10188 - DNA, 16 bp, H. sapiens
aaatctttcctcttct

SEQ ID NO: 10189 - DNA, 16 bp, H. sapiens
aaatctttcttcagtt

SEQ ID NO: 10190 - DNA, 16 bp, H. sapiens
aaatctttcttttcct

SEQ ID NO: 10191 - DNA, 16 bp, H. sapiens
aaatctttgacaaaat

SEQ ID NO: 10192 - DNA, 16 bp, H. sapiens
aaatctttgccaggtc

SEQ ID NO: 10193 - DNA, 16 bp, H. sapiens
aaatctttgctattgt

SEQ ID NO: 10194 - DNA, 16 bp, H. sapiens
aaatctttgtttttaa

SEQ ID NO: 10195 - DNA, 16 bp, H. sapiens
aaatcttttcaaaaat

SEQ ID NO: 10196 - DNA, 16 bp, H. sapiens
aaatcttttccatttt

SEQ ID NO: 10197 - DNA, 16 bp, H. sapiens
aaatcttttcttctag

SEQ ID NO: 10198 - DNA, 16 bp, H. sapiens
aaatcttttgtgaaag

SEQ ID NO: 10199 - DNA, 16 bp, H. sapiens
aaatcttttgtttttc

SEQ ID NO: 10200 - DNA, 16 bp, H. sapiens
aaatgaaaaagcttct

SEQ ID NO: 10201 - DNA, 16 bp, H. sapiens
aaatgaaaaataggca

SEQ ID NO: 10202 - DNA, 16 bp, H. sapiens
aaatgaaaaatttcaa

SEQ ID NO: 10203 - DNA, 16 bp, H. sapiens
aaatgaaaacaattct

SEQ ID NO: 10204 - DNA, 16 bp, H. sapiens
aaatgaaaacaattta

SEQ ID NO: 10205 - DNA, 16 bp, H. sapiens
aaatgaaaacaatttt

SEQ ID NO: 10206 - DNA, 16 bp, H. sapiens
aaatgaaaacagattc

SEQ ID NO: 10207 - DNA, 16 bp, H. sapiens
aaatgaaaacatgttt

SEQ ID NO: 10208 - DNA, 16 bp, H. sapiens
aaatgaaaactcagaa

SEQ ID NO: 10209 - DNA, 16 bp, H. sapiens
aaatgaaaactgaaga

SEQ ID NO: 10210 - DNA, 16 bp, H. sapiens
aaatgaaaactgcaat

SEQ ID NO: 10211 - DNA, 16 bp, H. sapiens
aaatgaaaactttgat

SEQ ID NO: 10212 - DNA, 16 bp, H. sapiens
aaatgaaaacttttgt

SEQ ID NO: 10213 - DNA, 16 bp, H. sapiens
aaatgaaaagaaactg

SEQ ID NO: 10214 - DNA, 16 bp, H. sapiens
aaatgaaaagcaattt

SEQ ID NO: 10215 - DNA, 16 bp, H. sapiens
aaatgaaaagcatttg

SEQ ID NO: 10216 - DNA, 16 bp, H. sapiens
aaatgaaaagtatttt

SEQ ID NO: 10217 - DNA, 16 bp, H. sapiens
aaatgaaaagttattt

SEQ ID NO: 10218 - DNA, 16 bp, H. sapiens
aaatgaaaagttgttt

SEQ ID NO: 10219 - DNA, 16 bp, H. sapiens
aaatgaaaatacagga

SEQ ID NO: 10220 - DNA, 16 bp, H. sapiens
aaatgaaaatacatcc

SEQ ID NO: 10221 - DNA, 16 bp, H. sapiens
aaatgaaaatactttt

SEQ ID NO: 10222 - DNA, 16 bp, H. sapiens
aaatgaaaatatgcaa

SEQ ID NO: 10223 - DNA, 16 bp, H. sapiens
aaatgaaaatattcat

SEQ ID NO: 10224 - DNA, 16 bp, H. sapiens
aaatgaaaatattctt

SEQ ID NO: 10225 - DNA, 16 bp, H. sapiens
aaatgaaaatattttc

SEQ ID NO: 10226 - DNA, 16 bp, H. sapiens
aaatgaaaatcaaatg

SEQ ID NO: 10227 - DNA, 16 bp, H. sapiens
aaatgaaaatcaattt

SEQ ID NO: 10228 - DNA, 16 bp, H. sapiens
aaatgaaaatcagaag

SEQ ID NO: 10229 - DNA, 16 bp, H. sapiens
aaatgaaaatccaaac

SEQ ID NO: 10230 - DNA, 16 bp, H. sapiens
aaatgaaaatgacaat

SEQ ID NO: 10231 - DNA, 16 bp, H. sapiens
aaatgaaaatgatttt

SEQ ID NO: 10232 - DNA, 16 bp, H. sapiens
aaatgaaaatgcattt

SEQ ID NO: 10233 - DNA, 16 bp, H. sapiens
aaatgaaaatgctaag

SEQ ID NO: 10234 - DNA, 16 bp, H. sapiens
aaatgaaaatggaaac

SEQ ID NO: 10235 - DNA, 16 bp, H. sapiens
aaatgaaaatgtcaaa

SEQ ID NO: 10236 - DNA, 16 bp, H. sapiens
aaatgaaaatgtttca

SEQ ID NO: 10237 - DNA, 16 bp, H. sapiens
aaatgaaaattaagac

SEQ ID NO: 10238 - DNA, 16 bp, H. sapiens
aaatgaaaattatttc

SEQ ID NO: 10239 - DNA, 16 bp, H. sapiens
aaatgaaaattcaaat

SEQ ID NO: 10240 - DNA, 16 bp, H. sapiens
aaatgaaaattctaaa

SEQ ID NO: 10241 - DNA, 16 bp, H. sapiens
aaatgaaaatttcaaa

SEQ ID NO: 10242 - DNA, 16 bp, H. sapiens
aaatgaaaatttgaga

SEQ ID NO: 10243 - DNA, 16 bp, H. sapiens
aaatgaaacaaatatg

SEQ ID NO: 10244 - DNA, 16 bp, H. sapiens
aaatgaaacaactgaa

SEQ ID NO: 10245 - DNA, 16 bp, H. sapiens
aaatgaaacaatattt

SEQ ID NO: 10246 - DNA, 16 bp, H. sapiens
aaatgaaacagatgaa

SEQ ID NO: 10247 - DNA, 16 bp, H. sapiens
aaatgaaacatctttt

SEQ ID NO: 10248 - DNA, 16 bp, H. sapiens
aaatgaaacatttaaa

SEQ ID NO: 10249 - DNA, 16 bp, H. sapiens
aaatgaaaccaatttt

SEQ ID NO: 10250 - DNA, 16 bp, H. sapiens
aaatgaaactgaaaca

SEQ ID NO: 10251 - DNA, 16 bp, H. sapiens
aaatgaaactgtcttt

SEQ ID NO: 10252 - DNA, 16 bp, H. sapiens
aaatgaaacttttttc

SEQ ID NO: 10253 - DNA, 16 bp, H. sapiens
aaatgaaagaagactg

SEQ ID NO: 10254 - DNA, 16 bp, H. sapiens
aaatgaaagagcttct

SEQ ID NO: 10255 - DNA, 16 bp, H. sapiens
aaatgaaagcacagag

SEQ ID NO: 10256 - DNA, 16 bp, H. sapiens
aaatgaaagctataaa

SEQ ID NO: 10257 - DNA, 16 bp, H. sapiens
aaatgaaagtcaaaat

SEQ ID NO: 10258 - DNA, 16 bp, H. sapiens
aaatgaaagtggaaat

SEQ ID NO: 10259 - DNA, 16 bp, H. sapiens
aaatgaaagttacaaa

SEQ ID NO: 10260 - DNA, 16 bp, H. sapiens
aaatgaaataaaacct

SEQ ID NO: 10261 - DNA, 16 bp, H. sapiens
aaatgaaataaaccag

SEQ ID NO: 10262 - DNA, 16 bp, H. sapiens
aaatgaaataacattt

SEQ ID NO: 10263 - DNA, 16 bp, H. sapiens
aaatgaaataatgcat

SEQ ID NO: 10264 - DNA, 16 bp, H. sapiens
aaatgaaataatgtac

SEQ ID NO: 10265 - DNA, 16 bp, H. sapiens
aaatgaaatactgtat

SEQ ID NO: 10266 - DNA, 16 bp, H. sapiens
aaatgaaatatctcta

SEQ ID NO: 10267 - DNA, 16 bp, H. sapiens
aaatgaaatattttac

SEQ ID NO: 10268 - DNA, 16 bp, H. sapiens
aaatgaaatcatgtca

SEQ ID NO: 10269 - DNA, 16 bp, H. sapiens
aaatgaaatcattttt

SEQ ID NO: 10270 - DNA, 16 bp, H. sapiens
aaatgaaatctatttt

SEQ ID NO: 10271 - DNA, 16 bp, H. sapiens
aaatgaaatctttaaa

SEQ ID NO: 10272 - DNA, 16 bp, H. sapiens
aaatgaaatgaaatca

SEQ ID NO: 10273 - DNA, 16 bp, H. sapiens
aaatgaaatgaacaat

SEQ ID NO: 10274 - DNA, 16 bp, H. sapiens
aaatgaaatgaagttt

SEQ ID NO: 10275 - DNA, 16 bp, H. sapiens
aaatgaaatgacaaat

SEQ ID NO: 10276 - DNA, 16 bp, H. sapiens
aaatgaaatgatcaaa

SEQ ID NO: 10277 - DNA, 16 bp, H. sapiens
aaatgaaatgattttt

SEQ ID NO: 10278 - DNA, 16 bp, H. sapiens
aaatgaaatgctaaaa

SEQ ID NO: 10279 - DNA, 16 bp, H. sapiens
aaatgaaatggaaaac

SEQ ID NO: 10280 - DNA, 16 bp, H. sapiens
aaatgaaatggaaatt

SEQ ID NO: 10281 - DNA, 16 bp, H. sapiens
aaatgaaatgtgttat

SEQ ID NO: 10282 - DNA, 16 bp, H. sapiens
aaatgaaatgttttta

SEQ ID NO: 10283 - DNA, 16 bp, H. sapiens
aaatgaaattatttct

SEQ ID NO: 10284 - DNA, 16 bp, H. sapiens
aaatgaaattcagaaa

SEQ ID NO: 10285 - DNA, 16 bp, H. sapiens
aaatgaaattgtattt

SEQ ID NO: 10286 - DNA, 16 bp, H. sapiens
aaatgaaatttcattt

SEQ ID NO: 10287 - DNA, 16 bp, H. sapiens
aaatgaaatttggaaa

SEQ ID NO: 10288 - DNA, 16 bp, H. sapiens
aaatgaaattttcaaa

SEQ ID NO: 10289 - DNA, 16 bp, H. sapiens
aaatgaacaaaacctc

SEQ ID NO: 10290 - DNA, 16 bp, H. sapiens
aaatgaacaaaagatt

SEQ ID NO: 10291 - DNA, 16 bp, H. sapiens
aaatgaacaaaattat

SEQ ID NO: 10292 - DNA, 16 bp, H. sapiens
aaatgaacaaaggaat

SEQ ID NO: 10293 - DNA, 16 bp, H. sapiens
aaatgaacaattaaat

SEQ ID NO: 10294 - DNA, 16 bp, H. sapiens
aaatgaacacaaaatt

SEQ ID NO: 10295 - DNA, 16 bp, H. sapiens
aaatgaacactggctt

SEQ ID NO: 10296 - DNA, 16 bp, H. sapiens
aaatgaacatttaaaa

SEQ ID NO: 10297 - DNA, 16 bp, H. sapiens
aaatgaacattttcta

SEQ ID NO: 10298 - DNA, 16 bp, H. sapiens
aaatgaacctttaaaa

SEQ ID NO: 10299 - DNA, 16 bp, H. sapiens
aaatgaactcatcctt

SEQ ID NO: 10300 - DNA, 16 bp, H. sapiens
aaatgaactgaaaaat

SEQ ID NO: 10301 - DNA, 16 bp, H. sapiens
aaatgaagaaaactga

SEQ ID NO: 10302 - DNA, 16 bp, H. sapiens
aaatgaagaaacattc

SEQ ID NO: 10303 - DNA, 16 bp, H. sapiens
aaatgaagaaattcag

SEQ ID NO: 10304 - DNA, 16 bp, H. sapiens
aaatgaagaacacaat

SEQ ID NO: 10305 - DNA, 16 bp, H. sapiens
aaatgaagaacttatt

SEQ ID NO: 10306 - DNA, 16 bp, H. sapiens
aaatgaagaagaaact

SEQ ID NO: 10307 - DNA, 16 bp, H. sapiens
aaatgaagaagtcaaa

SEQ ID NO: 10308 - DNA, 16 bp, H. sapiens
aaatgaagaagttatt

SEQ ID NO: 10309 - DNA, 16 bp, H. sapiens
aaatgaagaatgtgtt

SEQ ID NO: 10310 - DNA, 16 bp, H. sapiens
aaatgaagacagagaa

SEQ ID NO: 10311 - DNA, 16 bp, H. sapiens
aaatgaagactgagaa

SEQ ID NO: 10312 - DNA, 16 bp, H. sapiens
aaatgaagacttaaaa

SEQ ID NO: 10313 - DNA, 16 bp, H. sapiens
aaatgaagactttaaa

SEQ ID NO: 10314 - DNA, 16 bp, H. sapiens
aaatgaagagcaaagt

SEQ ID NO: 10315 - DNA, 16 bp, H. sapiens
aaatgaagataatgat

SEQ ID NO: 10316 - DNA, 16 bp, H. sapiens
aaatgaagatgttctt

SEQ ID NO: 10317 - DNA, 16 bp, H. sapiens
aaatgaagattataga

SEQ ID NO: 10318 - DNA, 16 bp, H. sapiens
aaatgaagattatttt

SEQ ID NO: 10319 - DNA, 16 bp, H. sapiens
aaatgaagatttatat

SEQ ID NO: 10320 - DNA, 16 bp, H. sapiens
aaatgaagatttggaa

SEQ ID NO: 10321 - DNA, 16 bp, H. sapiens
aaatgaagattttatt

SEQ ID NO: 10322 - DNA, 16 bp, H. sapiens
aaatgaagattttctt

SEQ ID NO: 10323 - DNA, 16 bp, H. sapiens
aaatgaagcaaatgaa

SEQ ID NO: 10324 - DNA, 16 bp, H. sapiens
aaatgaagcaagaagt

SEQ ID NO: 10325 - DNA, 16 bp, H. sapiens
aaatgaagccagtcag

SEQ ID NO: 10326 - DNA, 16 bp, H. sapiens
aaatgaagctgagacc

SEQ ID NO: 10327 - DNA, 16 bp, H. sapiens
aaatgaaggaaaaact

SEQ ID NO: 10328 - DNA, 16 bp, H. sapiens
aaatgaaggaaaagca

SEQ ID NO: 10329 - DNA, 16 bp, H. sapiens
aaatgaaggaaatcct

SEQ ID NO: 10330 - DNA, 16 bp, H. sapiens
aaatgaaggaaattct

SEQ ID NO: 10331 - DNA, 16 bp, H. sapiens
aaatgaaggcaaaaat

SEQ ID NO: 10332 - DNA, 25 bp, H. sapiens
aaatgaaggcagaaataaagatgct

SEQ ID NO: 10333 - DNA, 36 bp, H. sapiens
aaatgaaggcagaaataaagatgttctttgaaacca

SEQ ID NO: 10334 - DNA, 30 bp, H. sapiens
aaatgaaggcagaaatacagatgttctttg

SEQ ID NO: 10335 - DNA, 16 bp, H. sapiens
aaatgaaggcagagat

SEQ ID NO: 10336 - DNA, 16 bp, H. sapiens
aaatgaagtatttttt

SEQ ID NO: 10337 - DNA, 16 bp, H. sapiens
aaatgaagtgtgaaga

SEQ ID NO: 10338 - DNA, 16 bp, H. sapiens
aaatgaagttattaat

SEQ ID NO: 10339 - DNA, 16 bp, H. sapiens
aaatgaagttgatttt

SEQ ID NO: 10340 - DNA, 16 bp, H. sapiens
aaatgaagttttagaa

SEQ ID NO: 10341 - DNA, 16 bp, H. sapiens
aaatgaagtttttaaa

SEQ ID NO: 10342 - DNA, 16 bp, H. sapiens
aaatgaataaacaagt

SEQ ID NO: 10343 - DNA, 16 bp, H. sapiens
aaatgaataaatacat

SEQ ID NO: 10344 - DNA, 16 bp, H. sapiens
aaatgaataaatggct

SEQ ID NO: 10345 - DNA, 16 bp, H. sapiens
aaatgaataaattcct

SEQ ID NO: 10346 - DNA, 16 bp, H. sapiens
aaatgaatacaacaga

SEQ ID NO: 10347 - DNA, 16 bp, H. sapiens
aaatgaatacataaat

SEQ ID NO: 10348 - DNA, 16 bp, H. sapiens
aaatgaatacatatat

SEQ ID NO: 10349 - DNA, 16 bp, H. sapiens
aaatgaatacattatt

SEQ ID NO: 10350 - DNA, 16 bp, H. sapiens
aaatgaatacattttg

SEQ ID NO: 10351 - DNA, 16 bp, H. sapiens
aaatgaatatactttt

SEQ ID NO: 10352 - DNA, 16 bp, H. sapiens
aaatgaatatattttc

SEQ ID NO: 10353 - DNA, 16 bp, H. sapiens
aaatgaatatgtgaaa

SEQ ID NO: 10354 - DNA, 16 bp, H. sapiens
aaatgaatattgaatt

SEQ ID NO: 10355 - DNA, 16 bp, H. sapiens
aaatgaatatttatgt

SEQ ID NO: 10356 - DNA, 16 bp, H. sapiens
aaatgaatatttcatt

SEQ ID NO: 10357 - DNA, 16 bp, H. sapiens
aaatgaatatttgtat

SEQ ID NO: 10358 - DNA, 16 bp, H. sapiens
aaatgaatattttgat

SEQ ID NO: 10359 - DNA, 16 bp, H. sapiens
aaatgaatcaaagacc

SEQ ID NO: 10360 - DNA, 16 bp, H. sapiens
aaatgaatcagaaaca

SEQ ID NO: 10361 - DNA, 16 bp, H. sapiens
aaatgaatcatttaaa

SEQ ID NO: 10362 - DNA, 16 bp, H. sapiens
aaatgaatccacatat

SEQ ID NO: 10363 - DNA, 16 bp, H. sapiens
aaatgaatccagcagc

SEQ ID NO: 10364 - DNA, 16 bp, H. sapiens
aaatgaatctttaaaa

SEQ ID NO: 10365 - DNA, 16 bp, H. sapiens
aaatgaatgaactact

SEQ ID NO: 10366 - DNA, 16 bp, H. sapiens
aaatgaatgaagtgaa

SEQ ID NO: 10367 - DNA, 16 bp, H. sapiens
aaatgaatgaatacag

SEQ ID NO: 10368 - DNA, 16 bp, H. sapiens
aaatgaatgaatggtt

SEQ ID NO: 10369 - DNA, 16 bp, H. sapiens
aaatgaatgaatttta

SEQ ID NO: 10370 - DNA, 16 bp, H. sapiens
aaatgaatgacagaaa

SEQ ID NO: 10371 - DNA, 16 bp, H. sapiens
aaatgaatgacagcaa

SEQ ID NO: 10372 - DNA, 16 bp, H. sapiens
aaatgaatgagataat

SEQ ID NO: 10373 - DNA, 16 bp, H. sapiens
aaatgaatgagcaaat

SEQ ID NO: 10374 - DNA, 16 bp, H. sapiens
aaatgaatgagtgtgg

SEQ ID NO: 10375 - DNA, 16 bp, H. sapiens
aaatgaatgattttta

SEQ ID NO: 10376 - DNA, 16 bp, H. sapiens
aaatgaatgcatttta

SEQ ID NO: 10377 - DNA, 16 bp, H. sapiens
aaatgaatgcattttt

SEQ ID NO: 10378 - DNA, 16 bp, H. sapiens
aaatgaatggaatgaa

SEQ ID NO: 10379 - DNA, 16 bp, H. sapiens
aaatgaatgtaatgaa

SEQ ID NO: 10380 - DNA, 16 bp, H. sapiens
aaatgaatgttgtttt

SEQ ID NO: 10381 - DNA, 16 bp, H. sapiens
aaatgaatgtttttct

SEQ ID NO: 10382 - DNA, 16 bp, H. sapiens
aaatgaattaaatact

SEQ ID NO: 10383 - DNA, 16 bp, H. sapiens
aaatgaattcagtgaa

SEQ ID NO: 10384 - DNA, 16 bp, H. sapiens
aaatgaattctgccaa

SEQ ID NO: 10385 - DNA, 16 bp, H. sapiens
aaatgaatttatttct

SEQ ID NO: 10386 - DNA, 16 bp, H. sapiens
aaatgaatttcaaaca

SEQ ID NO: 10387 - DNA, 16 bp, H. sapiens
aaatgaatttctgttc

SEQ ID NO: 10388 - DNA, 16 bp, H. sapiens
aaatgaatttggaaat

SEQ ID NO: 10389 - DNA, 16 bp, H. sapiens
aaatgaattttttttc

SEQ ID NO: 10390 - DNA, 16 bp, H. sapiens
aaatgacaaaagggac

SEQ ID NO: 10391 - DNA, 16 bp, H. sapiens
aaatgacaaaatattg

SEQ ID NO: 10392 - DNA, 16 bp, H. sapiens
aaatgacaaaggagac

SEQ ID NO: 10393 - DNA, 16 bp, H. sapiens
aaatgacaaattatat

SEQ ID NO: 10394 - DNA, 16 bp, H. sapiens
aaatgacaagaaagga

SEQ ID NO: 10395 - DNA, 16 bp, H. sapiens
aaatgacaagatttcc

SEQ ID NO: 10396 - DNA, 16 bp, H. sapiens
aaatgacaatgataat

SEQ ID NO: 10397 - DNA, 16 bp, H. sapiens
aaatgacaatggaaac

SEQ ID NO: 10398 - DNA, 16 bp, H. sapiens
aaatgacacatttttt

SEQ ID NO: 10399 - DNA, 16 bp, H. sapiens
aaatgacactttaaaa

SEQ ID NO: 10400 - DNA, 16 bp, H. sapiens
aaatgacagaaacaga

SEQ ID NO: 10401 - DNA, 16 bp, H. sapiens
aaatgacagaaaccca

SEQ ID NO: 10402 - DNA, 16 bp, H. sapiens
aaatgacagaagtagg

SEQ ID NO: 10403 - DNA, 16 bp, H. sapiens
aaatgacagagaaaga

SEQ ID NO: 10404 - DNA, 16 bp, H. sapiens
aaatgacataaaaatg

SEQ ID NO: 10405 - DNA, 16 bp, H. sapiens
aaatgacataatattt

SEQ ID NO: 10406 - DNA, 16 bp, H. sapiens
aaatgacatgatggag

SEQ ID NO: 10407 - DNA, 16 bp, H. sapiens
aaatgacattaaaaat

SEQ ID NO: 10408 - DNA, 16 bp, H. sapiens
aaatgacattaagaaa

SEQ ID NO: 10409 - DNA, 16 bp, H. sapiens
aaatgacattattaaa

SEQ ID NO: 10410 - DNA, 16 bp, H. sapiens
aaatgacatttaattt

SEQ ID NO: 10411 - DNA, 16 bp, H. sapiens
aaatgacatttctgtt

SEQ ID NO: 10412 - DNA, 16 bp, H. sapiens
aaatgacatttttaga

SEQ ID NO: 10413 - DNA, 16 bp, H. sapiens
aaatgacatttttata

SEQ ID NO: 10414 - DNA, 16 bp, H. sapiens
aaatgaccaaactgcc

SEQ ID NO: 10415 - DNA, 16 bp, H. sapiens
aaatgaccagatctca

SEQ ID NO: 10416 - DNA, 16 bp, H. sapiens
aaatgactaaaatttt

SEQ ID NO: 10417 - DNA, 16 bp, H. sapiens
aaatgactaaatattt

SEQ ID NO: 10418 - DNA, 16 bp, H. sapiens
aaatgactatatttta

SEQ ID NO: 10419 - DNA, 16 bp, H. sapiens
aaatgactcagaaaaa

SEQ ID NO: 10420 - DNA, 16 bp, H. sapiens
aaatgactgcagtggc

SEQ ID NO: 10421 - DNA, 16 bp, H. sapiens
aaatgactgtttccaa

SEQ ID NO: 10422 - DNA, 16 bp, H. sapiens
aaatgactgttttttt

SEQ ID NO: 10423 - DNA, 16 bp, H. sapiens
aaatgacttaaagatg

SEQ ID NO: 10424 - DNA, 16 bp, H. sapiens
aaatgacttaaagtat

SEQ ID NO: 10425 - DNA, 16 bp, H. sapiens
aaatgacttgaaagaa

SEQ ID NO: 10426 - DNA, 16 bp, H. sapiens
aaatgacttgcccagg

SEQ ID NO: 10427 - DNA, 16 bp, H. sapiens
aaatgacttggccaag

SEQ ID NO: 10428 - DNA, 16 bp, H. sapiens
aaatgacttgtctaag

SEQ ID NO: 10429 - DNA, 16 bp, H. sapiens
aaatgactttagtaaa

SEQ ID NO: 10430 - DNA, 16 bp, H. sapiens
aaatgactttatttct

SEQ ID NO: 10431 - DNA, 16 bp, H. sapiens
aaatgactttggaact

SEQ ID NO: 10432 - DNA, 16 bp, H. sapiens
aaatgactttgtaact

SEQ ID NO: 10433 - DNA, 16 bp, H. sapiens
aaatgacttttattta

SEQ ID NO: 10434 - DNA, 16 bp, H. sapiens
aaatgactttttaatt

SEQ ID NO: 10435 - DNA, 16 bp, H. sapiens
aaatgagaaaaatcag

SEQ ID NO: 10436 - DNA, 16 bp, H. sapiens
aaatgagaaaacaatt

SEQ ID NO: 10437 - DNA, 16 bp, H. sapiens
aaatgagaaaacacag

SEQ ID NO: 10438 - DNA, 16 bp, H. sapiens
aaatgagaaaacatgt

SEQ ID NO: 10439 - DNA, 16 bp, H. sapiens
aaatgagaaaacattt

SEQ ID NO: 10440 - DNA, 16 bp, H. sapiens
aaatgagaaaactgag

SEQ ID NO: 10441 - DNA, 16 bp, H. sapiens
aaatgagaaaatgtat

SEQ ID NO: 10442 - DNA, 16 bp, H. sapiens
aaatgagaaacatttt

SEQ ID NO: 10443 - DNA, 16 bp, H. sapiens
aaatgagaaagaacca

SEQ ID NO: 10444 - DNA, 16 bp, H. sapiens
aaatgagaaatgtgtt

SEQ ID NO: 10445 - DNA, 16 bp, H. sapiens
aaatgagaaatgttta

SEQ ID NO: 10446 - DNA, 16 bp, H. sapiens
aaatgagaaattttta

SEQ ID NO: 10447 - DNA, 16 bp, H. sapiens
aaatgagaaggaagca

SEQ ID NO: 10448 - DNA, 16 bp, H. sapiens
aaatgagaatactaat

SEQ ID NO: 10449 - DNA, 16 bp, H. sapiens
aaatgagaatattttc

SEQ ID NO: 10450 - DNA, 16 bp, H. sapiens
aaatgagaatggaaac

SEQ ID NO: 10451 - DNA, 16 bp, H. sapiens
aaatgagaattattta

SEQ ID NO: 10452 - DNA, 16 bp, H. sapiens
aaatgagaatttttaa

SEQ ID NO: 10453 - DNA, 16 bp, H. sapiens
aaatgagacaatgcat

SEQ ID NO: 10454 - DNA, 16 bp, H. sapiens
aaatgagacagacagc

SEQ ID NO: 10455 - DNA, 16 bp, H. sapiens
aaatgagagactgagt

SEQ ID NO: 10456 - DNA, 16 bp, H. sapiens
aaatgagataattcag

SEQ ID NO: 10457 - DNA, 16 bp, H. sapiens
aaatgagatactgtat

SEQ ID NO: 10458 - DNA, 16 bp, H. sapiens
aaatgagatcatgtgg

SEQ ID NO: 10459 - DNA, 16 bp, H. sapiens
aaatgagatcatgtgt

SEQ ID NO: 10460 - DNA, 18 bp, H. sapiens
aaatgagatctaattaaa

SEQ ID NO: 10461 - DNA, 16 bp, H. sapiens
aaatgagatgatgaat

SEQ ID NO: 10462 - DNA, 16 bp, H. sapiens
aaatgagattatatat

SEQ ID NO: 10463 - DNA, 16 bp, H. sapiens
aaatgagattttatta

SEQ ID NO: 10464 - DNA, 16 bp, H. sapiens
aaatgagccagatgtg

SEQ ID NO: 10465 - DNA, 16 bp, H. sapiens
aaatgagctaatgtat

SEQ ID NO: 10466 - DNA, 16 bp, H. sapiens
aaatgaggaaaccaag

SEQ ID NO: 10467 - DNA, 16 bp, H. sapiens
aaatgaggaaaccgag

SEQ ID NO: 10468 - DNA, 16 bp, H. sapiens
aaatgaggaaactgag

SEQ ID NO: 10469 - DNA, 16 bp, H. sapiens
aaatgaggaaattgag

SEQ ID NO: 10470 - DNA, 16 bp, H. sapiens
aaatgaggaagctgaa

SEQ ID NO: 10471 - DNA, 16 bp, H. sapiens
aaatgaggacaataat

SEQ ID NO: 10472 - DNA, 16 bp, H. sapiens
aaatgaggaggattac

SEQ ID NO: 10473 - DNA, 16 bp, H. sapiens
aaatgaggagttattg

SEQ ID NO: 10474 - DNA, 16 bp, H. sapiens
aaatgaggataataat

SEQ ID NO: 10475 - DNA, 16 bp, H. sapiens
aaatgaggatgatgat

SEQ ID NO: 10476 - DNA, 16 bp, H. sapiens
aaatgaggattaaaat

SEQ ID NO: 10477 - DNA, 16 bp, H. sapiens
aaatgaggcccagaaa

SEQ ID NO: 10478 - DNA, 16 bp, H. sapiens
aaatgaggctgggcac

SEQ ID NO: 10479 - DNA, 16 bp, H. sapiens
aaatgaggtatccatc

SEQ ID NO: 10480 - DNA, 16 bp, H. sapiens
aaatgaggtcttgctg

SEQ ID NO: 10481 - DNA, 16 bp, H. sapiens
aaatgagtaagtgaat

SEQ ID NO: 10482 - DNA, 16 bp, H. sapiens
aaatgagtatttcttt

SEQ ID NO: 10483 - DNA, 16 bp, H. sapiens
aaatgagtgaaatgaa

SEQ ID NO: 10484 - DNA, 16 bp, H. sapiens
aaatgagtgtggctgt

SEQ ID NO: 10485 - DNA, 16 bp, H. sapiens
aaatgagttaacattt

SEQ ID NO: 10486 - DNA, 16 bp, H. sapiens
aaatgagttaatgaat

SEQ ID NO: 10487 - DNA, 16 bp, H. sapiens
aaatgagttgaaaatt

SEQ ID NO: 10488 - DNA, 16 bp, H. sapiens
aaatgagtttttcttt

SEQ ID NO: 10489 - DNA, 16 bp, H. sapiens
aaatgataaaacattt

SEQ ID NO: 10490 - DNA, 16 bp, H. sapiens
aaatgataaaatttca

SEQ ID NO: 10491 - DNA, 16 bp, H. sapiens
aaatgataaacactca

SEQ ID NO: 10492 - DNA, 16 bp, H. sapiens
aaatgataaaggagat

SEQ ID NO: 10493 - DNA, 16 bp, H. sapiens
aaatgataaaggattt

SEQ ID NO: 10494 - DNA, 16 bp, H. sapiens
aaatgataacaaactg

SEQ ID NO: 10495 - DNA, 16 bp, H. sapiens
aaatgataacagccct

SEQ ID NO: 10496 - DNA, 16 bp, H. sapiens
aaatgataagaactta

SEQ ID NO: 10497 - DNA, 16 bp, H. sapiens
aaatgatacaaatgaa

SEQ ID NO: 10498 - DNA, 16 bp, H. sapiens
aaatgatacagctgct

SEQ ID NO: 10499 - DNA, 16 bp, H. sapiens
aaatgatacctcattg

SEQ ID NO: 10500 - DNA, 16 bp, H. sapiens
aaatgatactaatttt

SEQ ID NO: 10501 - DNA, 16 bp, H. sapiens
aaatgatatttcaaga

SEQ ID NO: 10502 - DNA, 16 bp, H. sapiens
aaatgatcaagaaaat

SEQ ID NO: 10503 - DNA, 16 bp, H. sapiens
aaatgatcagaaatga

SEQ ID NO: 10504 - DNA, 21 bp, H. sapiens
aaatgatccacccacctcagc

SEQ ID NO: 10505 - DNA, 16 bp, H. sapiens
aaatgatccgcctgct

SEQ ID NO: 10506 - DNA, 16 bp, H. sapiens
aaatgatgaaaacata

SEQ ID NO: 10507 - DNA, 16 bp, H. sapiens
aaatgatgacatgaaa

SEQ ID NO: 10508 - DNA, 16 bp, H. sapiens
aaatgatgacttaatg

SEQ ID NO: 10509 - DNA, 16 bp, H. sapiens
aaatgatgagagattt

SEQ ID NO: 10510 - DNA, 17 bp, H. sapiens
aaatgatgagttaatgt

SEQ ID NO: 10511 - DNA, 16 bp, H. sapiens
aaatgatgataatgat

SEQ ID NO: 10512 - DNA, 16 bp, H. sapiens
aaatgatgatgatgat

SEQ ID NO: 10513 - DNA, 16 bp, H. sapiens
aaatgatgcaataaaa

SEQ ID NO: 10514 - DNA, 16 bp, H. sapiens
aaatgatgcatatttt

SEQ ID NO: 10515 - DNA, 16 bp, H. sapiens
aaatgatgctagaaaa

SEQ ID NO: 10516 - DNA, 16 bp, H. sapiens
aaatgatgctggaaaa

SEQ ID NO: 10517 - DNA, 16 bp, H. sapiens
aaatgatggagaaatt

SEQ ID NO: 10518 - DNA, 16 bp, H. sapiens
aaatgatggtaactga

SEQ ID NO: 10519 - DNA, 16 bp, H. sapiens
aaatgatgtattttaa

SEQ ID NO: 10520 - DNA, 16 bp, H. sapiens
aaatgatgttagacaa

SEQ ID NO: 10521 - DNA, 16 bp, H. sapiens
aaatgatgttttgaaa

SEQ ID NO: 10522 - DNA, 16 bp, H. sapiens
aaatgatgtttttaaa

SEQ ID NO: 10523 - DNA, 16 bp, H. sapiens
aaatgattaaaatgtt

SEQ ID NO: 10524 - DNA, 16 bp, H. sapiens
aaatgattaacaaaat

SEQ ID NO: 10525 - DNA, 16 bp, H. sapiens
aaatgattataaatca

SEQ ID NO: 10526 - DNA, 16 bp, H. sapiens
aaatgattatttttca

SEQ ID NO: 10527 - DNA, 17 bp, H. sapiens
aaatgattctcgtgcct

SEQ ID NO: 10528 - DNA, 16 bp, H. sapiens
aaatgattctttttct

SEQ ID NO: 10529 - DNA, 16 bp, H. sapiens
aaatgatttaaaacaa

SEQ ID NO: 10530 - DNA, 16 bp, H. sapiens
aaatgatttcagcaaa

SEQ ID NO: 10531 - DNA, 16 bp, H. sapiens
aaatgatttccatttt

SEQ ID NO: 10532 - DNA, 16 bp, H. sapiens
aaatgatttcttaaaa

SEQ ID NO: 10533 - DNA, 16 bp, H. sapiens
aaatgatttcttattt

SEQ ID NO: 10534 - DNA, 16 bp, H. sapiens
aaatgatttgaaaact

SEQ ID NO: 10535 - DNA, 16 bp, H. sapiens
aaatgatttgcttttt

SEQ ID NO: 10536 - DNA, 16 bp, H. sapiens
aaatgattttaaaagt

SEQ ID NO: 10537 - DNA, 16 bp, H. sapiens
aaatgattttcaaaat

SEQ ID NO: 10538 - DNA, 16 bp, H. sapiens
aaatgattttcccttt

SEQ ID NO: 10539 - DNA, 16 bp, H. sapiens
aaatgattttcctttt

SEQ ID NO: 10540 - DNA, 16 bp, H. sapiens
aaatgattttctttct

SEQ ID NO: 10541 - DNA, 16 bp, H. sapiens
aaatgattttgggaaa

SEQ ID NO: 10542 - DNA, 16 bp, H. sapiens
aaatgatttttcaaaa

SEQ ID NO: 10543 - DNA, 16 bp, H. sapiens
aaatgatttttctaaa

SEQ ID NO: 10544 - DNA, 16 bp, H. sapiens
aaatgatttttcttca

SEQ ID NO: 10545 - DNA, 16 bp, H. sapiens
aaatgattttttttct

SEQ ID NO: 10546 - DNA, 16 bp, H. sapiens
aaatgcaaaaaatgtg

SEQ ID NO: 10547 - DNA, 16 bp, H. sapiens
aaatgcaaaaactgaa

SEQ ID NO: 10548 - DNA, 16 bp, H. sapiens
aaatgcaaaaatattc

SEQ ID NO: 10549 - DNA, 16 bp, H. sapiens
aaatgcaaaagttagc

SEQ ID NO: 10550 - DNA, 16 bp, H. sapiens
aaatgcaaaatataat

SEQ ID NO: 10551 - DNA, 16 bp, H. sapiens
aaatgcaaaatattaa

SEQ ID NO: 10552 - DNA, 16 bp, H. sapiens
aaatgcaaacatttta

SEQ ID NO: 10553 - DNA, 16 bp, H. sapiens
aaatgcaaaccaaacc

SEQ ID NO: 10554 - DNA, 16 bp, H. sapiens
aaatgcaaaccaaagc

SEQ ID NO: 10555 - DNA, 16 bp, H. sapiens
aaatgcaaactgaaac

SEQ ID NO: 10556 - DNA, 16 bp, H. sapiens
aaatgcaaaggaagaa

SEQ ID NO: 10557 - DNA, 16 bp, H. sapiens
aaatgcaaaggatcat

SEQ ID NO: 10558 - DNA, 16 bp, H. sapiens
aaatgcaaataaaact

SEQ ID NO: 10559 - DNA, 16 bp, H. sapiens
aaatgcaaataaagac

SEQ ID NO: 10560 - DNA, 16 bp, H. sapiens
aaatgcaaataatgtt

SEQ ID NO: 10561 - DNA, 16 bp, H. sapiens
aaatgcaaatatgtat

SEQ ID NO: 10562 - DNA, 16 bp, H. sapiens
aaatgcaaatatttta

SEQ ID NO: 10563 - DNA, 16 bp, H. sapiens
aaatgcaaatcaaaac

SEQ ID NO: 10564 - DNA, 16 bp, H. sapiens
aaatgcaaatgcaaat

SEQ ID NO: 10565 - DNA, 16 bp, H. sapiens
aaatgcaaatgtgaaa

SEQ ID NO: 10566 - DNA, 16 bp, H. sapiens
aaatgcaaattctcag

SEQ ID NO: 10567 - DNA, 16 bp, H. sapiens
aaatgcaaattgaaac

SEQ ID NO: 10568 - DNA, 16 bp, H. sapiens
aaatgcaacagaaaca

SEQ ID NO: 10569 - DNA, 16 bp, H. sapiens
aaatgcaacttttttt

SEQ ID NO: 10570 - DNA, 16 bp, H. sapiens
aaatgcaagaaatgaa

SEQ ID NO: 10571 - DNA, 16 bp, H. sapiens
aaatgcaagaagaaat

SEQ ID NO: 10572 - DNA, 16 bp, H. sapiens
aaatgcaagtcaaaac

SEQ ID NO: 10573 - DNA, 16 bp, H. sapiens
aaatgcaagtttttta

SEQ ID NO: 10574 - DNA, 16 bp, H. sapiens
aaatgcaataaaaatt

SEQ ID NO: 10575 - DNA, 16 bp, H. sapiens
aaatgcaataaaatca

SEQ ID NO: 10576 - DNA, 16 bp, H. sapiens
aaatgcaatacccaat

SEQ ID NO: 10577 - DNA, 16 bp, H. sapiens
aaatgcaatatctgtg

SEQ ID NO: 10578 - DNA, 16 bp, H. sapiens
aaatgcaatcccattt

SEQ ID NO: 10579 - DNA, 16 bp, H. sapiens
aaatgcaattattatt

SEQ ID NO: 10580 - DNA, 16 bp, H. sapiens
aaatgcaattcatttt

SEQ ID NO: 10581 - DNA, 16 bp, H. sapiens
aaatgcaatttaaaat

SEQ ID NO: 10582 - DNA, 16 bp, H. sapiens
aaatgcaattttaaaa

SEQ ID NO: 10583 - DNA, 16 bp, H. sapiens
aaatgcaatttttata

SEQ ID NO: 10584 - DNA, 16 bp, H. sapiens
aaatgcacacaaatgt

SEQ ID NO: 10585 - DNA, 16 bp, H. sapiens
aaatgcacacaagaga

SEQ ID NO: 10586 - DNA, 16 bp, H. sapiens
aaatgcacagattcct

SEQ ID NO: 10587 - DNA, 16 bp, H. sapiens
aaatgcacatggaaca

SEQ ID NO: 10588 - DNA, 16 bp, H. sapiens
aaatgcacattcctgg

SEQ ID NO: 10589 - DNA, 16 bp, H. sapiens
aaatgcaccaatcagc

SEQ ID NO: 10590 - DNA, 16 bp, H. sapiens
aaatgcaccaatctgc

SEQ ID NO: 10591 - DNA, 16 bp, H. sapiens
aaatgcaccagtcagt

SEQ ID NO: 10592 - DNA, 16 bp, H. sapiens
aaatgcagaaaaggcc

SEQ ID NO: 10593 - DNA, 16 bp, H. sapiens
aaatgcagaaacattt

SEQ ID NO: 10594 - DNA, 16 bp, H. sapiens
aaatgcagaaactcag

SEQ ID NO: 10595 - DNA, 17 bp, H. sapiens
aaatgcagaaatcacct

SEQ ID NO: 10596 - DNA, 16 bp, H. sapiens
aaatgcagaaattatt

SEQ ID NO: 10597 - DNA, 16 bp, H. sapiens
aaatgcagaagaaatg

SEQ ID NO: 10598 - DNA, 16 bp, H. sapiens
aaatgcagaatatcag

SEQ ID NO: 10599 - DNA, 16 bp, H. sapiens
aaatgcagaatctctg

SEQ ID NO: 10600 - DNA, 16 bp, H. sapiens
aaatgcagagaagaaa

SEQ ID NO: 10601 - DNA, 16 bp, H. sapiens
aaatgcagaggaaaaa

SEQ ID NO: 10602 - DNA, 16 bp, H. sapiens
aaatgcagatcaaaac

SEQ ID NO: 10603 - DNA, 16 bp, H. sapiens
aaatgcagattcccag

SEQ ID NO: 10604 - DNA, 16 bp, H. sapiens
aaatgcagattctcag

SEQ ID NO: 10605 - DNA, 16 bp, H. sapiens
aaatgcagattctgac

SEQ ID NO: 10606 - DNA, 16 bp, H. sapiens
aaatgcaggaaaaaat

SEQ ID NO: 10607 - DNA, 16 bp, H. sapiens
aaatgcaggctgggca

SEQ ID NO: 10608 - DNA, 16 bp, H. sapiens
aaatgcagggcccctt

SEQ ID NO: 10609 - DNA, 16 bp, H. sapiens
aaatgcaggggaaaaa

SEQ ID NO: 10610 - DNA, 16 bp, H. sapiens
aaatgcagtaaaaaca

SEQ ID NO: 10611 - DNA, 16 bp, H. sapiens
aaatgcagtggaaagt

SEQ ID NO: 10612 - DNA, 16 bp, H. sapiens
aaatgcagtttttttt

SEQ ID NO: 10613 - DNA, 16 bp, H. sapiens
aaatgcataaaatatt

SEQ ID NO: 10614 - DNA, 16 bp, H. sapiens
aaatgcataaaatgaa

SEQ ID NO: 10615 - DNA, 16 bp, H. sapiens
aaatgcatagaaaaag

SEQ ID NO: 10616 - DNA, 16 bp, H. sapiens
aaatgcatatatattt

SEQ ID NO: 10617 - DNA, 16 bp, H. sapiens
aaatgcatatattaat

SEQ ID NO: 10618 - DNA, 16 bp, H. sapiens
aaatgcatatctaatt

SEQ ID NO: 10619 - DNA, 16 bp, H. sapiens
aaatgcatatgtatat

SEQ ID NO: 10620 - DNA, 16 bp, H. sapiens
aaatgcatattaaaac

SEQ ID NO: 10621 - DNA, 16 bp, H. sapiens
aaatgcatattaaata

SEQ ID NO: 10622 - DNA, 16 bp, H. sapiens
aaatgcatattgcaaa

SEQ ID NO: 10623 - DNA, 16 bp, H. sapiens
aaatgcatatttttaa

SEQ ID NO: 10624 - DNA, 16 bp, H. sapiens
aaatgcatcctaagcc

SEQ ID NO: 10625 - DNA, 16 bp, H. sapiens
aaatgcatgaaaagat

SEQ ID NO: 10626 - DNA, 16 bp, H. sapiens
aaatgcatgtattttt

SEQ ID NO: 10627 - DNA, 16 bp, H. sapiens
aaatgcatgtttttaa

SEQ ID NO: 10628 - DNA, 16 bp, H. sapiens
aaatgcattatatttt

SEQ ID NO: 10629 - DNA, 16 bp, H. sapiens
aaatgcatttaatacc

SEQ ID NO: 10630 - DNA, 16 bp, H. sapiens
aaatgcatttatttta

SEQ ID NO: 10631 - DNA, 16 bp, H. sapiens
aaatgcatttcctttt

SEQ ID NO: 10632 - DNA, 16 bp, H. sapiens
aaatgcatttcttttt

SEQ ID NO: 10633 - DNA, 16 bp, H. sapiens
aaatgcatttgtaatt

SEQ ID NO: 10634 - DNA, 16 bp, H. sapiens
aaatgcattttaaaaa

SEQ ID NO: 10635 - DNA, 16 bp, H. sapiens
aaatgcattttatgta

SEQ ID NO: 10636 - DNA, 16 bp, H. sapiens
aaatgcattttatttt

SEQ ID NO: 10637 - DNA, 16 bp, H. sapiens
aaatgcattttgaaat

SEQ ID NO: 10638 - DNA, 16 bp, H. sapiens
aaatgcattttgaagt

SEQ ID NO: 10639 - DNA, 16 bp, H. sapiens
aaatgcattttgctaa

SEQ ID NO: 10640 - DNA, 16 bp, H. sapiens
aaatgcatttttaaaa

SEQ ID NO: 10641 - DNA, 16 bp, H. sapiens
aaatgcatttttagaa

SEQ ID NO: 10642 - DNA, 16 bp, H. sapiens
aaatgcatttttattt

SEQ ID NO: 10643 - DNA, 16 bp, H. sapiens
aaatgcatttttgaaa

SEQ ID NO: 10644 - DNA, 16 bp, H. sapiens
aaatgcattttttaaa

SEQ ID NO: 10645 - DNA, 16 bp, H. sapiens
aaatgccaaaaaatta

SEQ ID NO: 10646 - DNA, 16 bp, H. sapiens
aaatgccaagagaaaa

SEQ ID NO: 10647 - DNA, 16 bp, H. sapiens
aaatgccaattccagt

SEQ ID NO: 10648 - DNA, 16 bp, H. sapiens
aaatgccacctcctca

SEQ ID NO: 10649 - DNA, 16 bp, H. sapiens
aaatgccacctcctgg

SEQ ID NO: 10650 - DNA, 16 bp, H. sapiens
aaatgccacttttaaa

SEQ ID NO: 10651 - DNA, 21 bp, H. sapiens
aaatgccagacgcttataaaa

SEQ ID NO: 10652 - DNA, 16 bp, H. sapiens
aaatgccattggaatt

SEQ ID NO: 10653 - DNA, 16 bp, H. sapiens
aaatgccattttaaaa

SEQ ID NO: 10654 - DNA, 16 bp, H. sapiens
aaatgcccaattaaaa

SEQ ID NO: 10655 - DNA, 16 bp, H. sapiens
aaatgcccatcaaaga

SEQ ID NO: 10656 - DNA, 16 bp, H. sapiens
aaatgcccatcagcag

SEQ ID NO: 10657 - DNA, 16 bp, H. sapiens
aaatgcccatcagtga

SEQ ID NO: 10658 - DNA, 16 bp, H. sapiens
aaatgcctactgtgtg

SEQ ID NO: 10659 - DNA, 16 bp, H. sapiens
aaatgcctcactttct

SEQ ID NO: 10660 - DNA, 16 bp, H. sapiens
aaatgcctccagatat

SEQ ID NO: 10661 - DNA, 16 bp, H. sapiens
aaatgcctctgacact

SEQ ID NO: 10662 - DNA, 16 bp, H. sapiens
aaatgcctggcacata

SEQ ID NO: 10663 - DNA, 16 bp, H. sapiens
aaatgccttattttat

SEQ ID NO: 10664 - DNA, 16 bp, H. sapiens
aaatgcctttaaaaaa

SEQ ID NO: 10665 - DNA, 16 bp, H. sapiens
aaatgcctttaaaaat

SEQ ID NO: 10666 - DNA, 16 bp, H. sapiens
aaatgcctttttctcc

SEQ ID NO: 10667 - DNA, 16 bp, H. sapiens
aaatgcctttttctct

SEQ ID NO: 10668 - DNA, 16 bp, H. sapiens
aaatgcctttttttaa

SEQ ID NO: 10669 - DNA, 16 bp, H. sapiens
aaatgcctttttttcc

SEQ ID NO: 10670 - DNA, 16 bp, H. sapiens
aaatgctaaaaatgga

SEQ ID NO: 10671 - DNA, 16 bp, H. sapiens
aaatgctaaaagaagt

SEQ ID NO: 10672 - DNA, 16 bp, H. sapiens
aaatgctaaaataaat

SEQ ID NO: 10673 - DNA, 16 bp, H. sapiens
aaatgctaaggtgaaa

SEQ ID NO: 10674 - DNA, 16 bp, H. sapiens
aaatgctaatataaaa

SEQ ID NO: 10675 - DNA, 16 bp, H. sapiens
aaatgctaatattttt

SEQ ID NO: 10676 - DNA, 16 bp, H. sapiens
aaatgctaatctcttt

SEQ ID NO: 10677 - DNA, 16 bp, H. sapiens
aaatgctaatttaaaa

SEQ ID NO: 10678 - DNA, 16 bp, H. sapiens
aaatgctacagaaaaa

SEQ ID NO: 10679 - DNA, 16 bp, H. sapiens
aaatgctacagagaaa

SEQ ID NO: 10680 - DNA, 16 bp, H. sapiens
aaatgctactattttt

SEQ ID NO: 10681 - DNA, 16 bp, H. sapiens
aaatgctactgaattt

SEQ ID NO: 10682 - DNA, 16 bp, H. sapiens
aaatgctactgctttt

SEQ ID NO: 10683 - DNA, 16 bp, H. sapiens
aaatgctactggtttt

SEQ ID NO: 10684 - DNA, 16 bp, H. sapiens
aaatgctagaagaaaa

SEQ ID NO: 10685 - DNA, 16 bp, H. sapiens
aaatgctagctattat

SEQ ID NO: 10686 - DNA, 16 bp, H. sapiens
aaatgctataaaaatt

SEQ ID NO: 10687 - DNA, 16 bp, H. sapiens
aaatgctataaatatt

SEQ ID NO: 10688 - DNA, 16 bp, H. sapiens
aaatgctatagaaaaa

SEQ ID NO: 10689 - DNA, 16 bp, H. sapiens
aaatgctatcaaatgg

SEQ ID NO: 10690 - DNA, 16 bp, H. sapiens
aaatgctatcaagcag

SEQ ID NO: 10691 - DNA, 16 bp, H. sapiens
aaatgctatctcattg

SEQ ID NO: 10692 - DNA, 16 bp, H. sapiens
aaatgctatctttttt

SEQ ID NO: 10693 - DNA, 16 bp, H. sapiens
aaatgctatgaaaaaa

SEQ ID NO: 10694 - DNA, 16 bp, H. sapiens
aaatgctatgaagaaa

SEQ ID NO: 10695 - DNA, 16 bp, H. sapiens
aaatgctatgattttt

SEQ ID NO: 10696 - DNA, 16 bp, H. sapiens
aaatgctatggaaata

SEQ ID NO: 10697 - DNA, 16 bp, H. sapiens
aaatgctatgtaaatg

SEQ ID NO: 10698 - DNA, 16 bp, H. sapiens
aaatgctatttaaata

SEQ ID NO: 10699 - DNA, 16 bp, H. sapiens
aaatgctatttatttt

SEQ ID NO: 10700 - DNA, 16 bp, H. sapiens
aaatgctcattttaaa

SEQ ID NO: 10701 - DNA, 16 bp, H. sapiens
aaatgctccaaaatct

SEQ ID NO: 10702 - DNA, 16 bp, H. sapiens
aaatgctgaaaaaata

SEQ ID NO: 10703 - DNA, 16 bp, H. sapiens
aaatgctgaaaagaaa

SEQ ID NO: 10704 - DNA, 16 bp, H. sapiens
aaatgctgaaaatatt

SEQ ID NO: 10705 - DNA, 16 bp, H. sapiens
aaatgctgaaagaaaa

SEQ ID NO: 10706 - DNA, 16 bp, H. sapiens
aaatgctgaagaaaaa

SEQ ID NO: 10707 - DNA, 16 bp, H. sapiens
aaatgctgacaaggat

SEQ ID NO: 10708 - DNA, 16 bp, H. sapiens
aaatgctgacagattt

SEQ ID NO: 10709 - DNA, 16 bp, H. sapiens
aaatgctgagaaattt

SEQ ID NO: 10710 - DNA, 16 bp, H. sapiens
aaatgctgagagaaaa

SEQ ID NO: 10711 - DNA, 16 bp, H. sapiens
aaatgctgagagatat

SEQ ID NO: 10712 - DNA, 16 bp, H. sapiens
aaatgctgccagtctt

SEQ ID NO: 10713 - DNA, 16 bp, H. sapiens
aaatgctggcagggat

SEQ ID NO: 10714 - DNA, 16 bp, H. sapiens
aaatgctggcattaca

SEQ ID NO: 10715 - DNA, 16 bp, H. sapiens
aaatgctggggttata

SEQ ID NO: 10716 - DNA, 17 bp, H. sapiens
aaatgctggtatatcca

SEQ ID NO: 10717 - DNA, 16 bp, H. sapiens
aaatgctgtagtattt

SEQ ID NO: 10718 - DNA, 16 bp, H. sapiens
aaatgctgtgattata

SEQ ID NO: 10719 - DNA, 16 bp, H. sapiens
aaatgctgtgctggga

SEQ ID NO: 10720 - DNA, 16 bp, H. sapiens
aaatgctgttaattta

SEQ ID NO: 10721 - DNA, 16 bp, H. sapiens
aaatgcttaataaatg

SEQ ID NO: 10722 - DNA, 16 bp, H. sapiens
aaatgcttacatttta

SEQ ID NO: 10723 - DNA, 16 bp, H. sapiens
aaatgcttaggaccag

SEQ ID NO: 10724 - DNA, 16 bp, H. sapiens
aaatgcttataaaata

SEQ ID NO: 10725 - DNA, 16 bp, H. sapiens
aaatgcttatgatata

SEQ ID NO: 10726 - DNA, 16 bp, H. sapiens
aaatgcttattaaata

SEQ ID NO: 10727 - DNA, 16 bp, H. sapiens
aaatgcttattaaatg

SEQ ID NO: 10728 - DNA, 16 bp, H. sapiens
aaatgcttattaaatt

SEQ ID NO: 10729 - DNA, 16 bp, H. sapiens
aaatgcttattttatt

SEQ ID NO: 10730 - DNA, 16 bp, H. sapiens
aaatgcttatttttaa

SEQ ID NO: 10731 - DNA, 16 bp, H. sapiens
aaatgcttcaaaatcc

SEQ ID NO: 10732 - DNA, 16 bp, H. sapiens
aaatgcttcaaagaga

SEQ ID NO: 10733 - DNA, 16 bp, H. sapiens
aaatgcttcctctgtg

SEQ ID NO: 10734 - DNA, 16 bp, H. sapiens
aaatgcttgagttgat

SEQ ID NO: 10735 - DNA, 16 bp, H. sapiens
aaatgcttggaaccag

SEQ ID NO: 10736 - DNA, 16 bp, H. sapiens
aaatgcttgggaccag

SEQ ID NO: 10737 - DNA, 16 bp, H. sapiens
aaatgcttgttaaatg

SEQ ID NO: 10738 - DNA, 16 bp, H. sapiens
aaatgctttaaaaatt

SEQ ID NO: 10739 - DNA, 16 bp, H. sapiens
aaatgctttaaaatat

SEQ ID NO: 10740 - DNA, 16 bp, H. sapiens
aaatgctttatatatt

SEQ ID NO: 10741 - DNA, 16 bp, H. sapiens
aaatgctttattattt

SEQ ID NO: 10742 - DNA, 16 bp, H. sapiens
aaatgctttcagaaaa

SEQ ID NO: 10743 - DNA, 16 bp, H. sapiens
aaatgctttcatttct

SEQ ID NO: 10744 - DNA, 16 bp, H. sapiens
aaatgctttgaaaaaa

SEQ ID NO: 10745 - DNA, 16 bp, H. sapiens
aaatgctttgaagaaa

SEQ ID NO: 10746 - DNA, 16 bp, H. sapiens
aaatgcttttaaaaat

SEQ ID NO: 10747 - DNA, 16 bp, H. sapiens
aaatgcttttaaaatg

SEQ ID NO: 10748 - DNA, 16 bp, H. sapiens
aaatgcttttagaaaa

SEQ ID NO: 10749 - DNA, 16 bp, H. sapiens
aaatgcttttagagaa

SEQ ID NO: 10750 - DNA, 16 bp, H. sapiens
aaatgcttttcaaatt

SEQ ID NO: 10751 - DNA, 16 bp, H. sapiens
aaatgcttttcagcat

SEQ ID NO: 10752 - DNA, 16 bp, H. sapiens
aaatgcttttctgaaa

SEQ ID NO: 10753 - DNA, 16 bp, H. sapiens
aaatgcttttggaaaa

SEQ ID NO: 10754 - DNA, 16 bp, H. sapiens
aaatgcttttgtaaaa

SEQ ID NO: 10755 - DNA, 16 bp, H. sapiens
aaatgctttttaaaaa

SEQ ID NO: 10756 - DNA, 16 bp, H. sapiens
aaatgctttttcatca

SEQ ID NO: 10757 - DNA, 16 bp, H. sapiens
aaatgctttttgtgca

SEQ ID NO: 10758 - DNA, 16 bp, H. sapiens
aaatgcttttttcttt

SEQ ID NO: 10759 - DNA, 16 bp, H. sapiens
aaatgctttttttgtt

SEQ ID NO: 10760 - DNA, 16 bp, H. sapiens
aaatggaaaaacatcc

SEQ ID NO: 10761 - DNA, 16 bp, H. sapiens
aaatggaaaaacattt

SEQ ID NO: 10762 - DNA, 16 bp, H. sapiens
aaatggaaaaactgag

SEQ ID NO: 10763 - DNA, 16 bp, H. sapiens
aaatggaaaaatgtct

SEQ ID NO: 10764 - DNA, 16 bp, H. sapiens
aaatggaaaacaatta

SEQ ID NO: 10765 - DNA, 16 bp, H. sapiens
aaatggaaaacagcaa

SEQ ID NO: 10766 - DNA, 16 bp, H. sapiens
aaatggaaaacatatt

SEQ ID NO: 10767 - DNA, 16 bp, H. sapiens
aaatggaaaaggcaaa

SEQ ID NO: 10768 - DNA, 16 bp, H. sapiens
aaatggaaaataagca

SEQ ID NO: 10769 - DNA, 16 bp, H. sapiens
aaatggaaaatcattt

SEQ ID NO: 10770 - DNA, 16 bp, H. sapiens
aaatggaaaattattc

SEQ ID NO: 10771 - DNA, 16 bp, H. sapiens
aaatggaaacaaatat

SEQ ID NO: 10772 - DNA, 16 bp, H. sapiens
aaatggaaacaataat

SEQ ID NO: 10773 - DNA, 16 bp, H. sapiens
aaatggaaacattaaa

SEQ ID NO: 10774 - DNA, 16 bp, H. sapiens
aaatggaaactaaaag

SEQ ID NO: 10775 - DNA, 16 bp, H. sapiens
aaatggaaactcagaa

SEQ ID NO: 10776 - DNA, 16 bp, H. sapiens
aaatggaaacttaaaa

SEQ ID NO: 10777 - DNA, 16 bp, H. sapiens
aaatggaaacttattt

SEQ ID NO: 10778 - DNA, 16 bp, H. sapiens
aaatggaaagacagaa

SEQ ID NO: 10779 - DNA, 16 bp, H. sapiens
aaatggaaagagaatt

SEQ ID NO: 10780 - DNA, 16 bp, H. sapiens
aaatggaaagatatat

SEQ ID NO: 10781 - DNA, 16 bp, H. sapiens
aaatggaaagcagaaa

SEQ ID NO: 10782 - DNA, 16 bp, H. sapiens
aaatggaaagcctttc

SEQ ID NO: 10783 - DNA, 16 bp, H. sapiens
aaatggaaataatagt

SEQ ID NO: 10784 - DNA, 16 bp, H. sapiens
aaatggaaataatatc

SEQ ID NO: 10785 - DNA, 16 bp, H. sapiens
aaatggaaataatggt

SEQ ID NO: 10786 - DNA, 16 bp, H. sapiens
aaatggaaatcaaaac

SEQ ID NO: 10787 - DNA, 16 bp, H. sapiens
aaatggaaatcataac

SEQ ID NO: 10788 - DNA, 16 bp, H. sapiens
aaatggaaatgacaga

SEQ ID NO: 10789 - DNA, 16 bp, H. sapiens
aaatggaaatgatttt

SEQ ID NO: 10790 - DNA, 16 bp, H. sapiens
aaatggaaatgctatt

SEQ ID NO: 10791 - DNA, 16 bp, H. sapiens
aaatggaaatggaatt

SEQ ID NO: 10792 - DNA, 16 bp, H. sapiens
aaatggaaattaattt

SEQ ID NO: 10793 - DNA, 16 bp, H. sapiens
aaatggaagaagaaac

SEQ ID NO: 10794 - DNA, 16 bp, H. sapiens
aaatggaagaattttt

SEQ ID NO: 10795 - DNA, 16 bp, H. sapiens
aaatggaagcagaaaa

SEQ ID NO: 10796 - DNA, 16 bp, H. sapiens
aaatggaagccaaaag

SEQ ID NO: 10797 - DNA, 16 bp, H. sapiens
aaatggaagtggatca

SEQ ID NO: 10798 - DNA, 16 bp, H. sapiens
aaatggaatagaattg

SEQ ID NO: 10799 - DNA, 16 bp, H. sapiens
aaatggaatatttaat

SEQ ID NO: 10800 - DNA, 16 bp, H. sapiens
aaatggaatcatacag

SEQ ID NO: 10801 - DNA, 16 bp, H. sapiens
aaatggaatcatacca

SEQ ID NO: 10802 - DNA, 16 bp, H. sapiens
aaatggaatcatatca

SEQ ID NO: 10803 - DNA, 16 bp, H. sapiens
aaatggaatgaacaaa

SEQ ID NO: 10804 - DNA, 16 bp, H. sapiens
aaatggaatgctttta

SEQ ID NO: 10805 - DNA, 16 bp, H. sapiens
aaatggaattatatga

SEQ ID NO: 10806 - DNA, 16 bp, H. sapiens
aaatggaattgctttt

SEQ ID NO: 10807 - DNA, 16 bp, H. sapiens
aaatggaatttgaaat

SEQ ID NO: 10808 - DNA, 16 bp, H. sapiens
aaatggaatttttaat

SEQ ID NO: 10809 - DNA, 16 bp, H. sapiens
aaatggaatttttttc

SEQ ID NO: 10810 - DNA, 16 bp, H. sapiens
aaatggacaaaatatt

SEQ ID NO: 10811 - DNA, 16 bp, H. sapiens
aaatggacaaatggat

SEQ ID NO: 10812 - DNA, 16 bp, H. sapiens
aaatggacaaatggca

SEQ ID NO: 10813 - DNA, 16 bp, H. sapiens
aaatggacacattcct

SEQ ID NO: 10814 - DNA, 16 bp, H. sapiens
aaatggaccaattcct

SEQ ID NO: 10815 - DNA, 16 bp, H. sapiens
aaatggacctaatgga

SEQ ID NO: 10816 - DNA, 16 bp, H. sapiens
aaatggactaagataa

SEQ ID NO: 10817 - DNA, 16 bp, H. sapiens
aaatggacttaacaga

SEQ ID NO: 10818 - DNA, 16 bp, H. sapiens
aaatggagaaaacaga

SEQ ID NO: 10819 - DNA, 16 bp, H. sapiens
aaatggagaaacaaag

SEQ ID NO: 10820 - DNA, 16 bp, H. sapiens
aaatggagaaactgaa

SEQ ID NO: 10821 - DNA, 16 bp, H. sapiens
aaatggagaaactgag

SEQ ID NO: 10822 - DNA, 16 bp, H. sapiens
aaatggagaaataatt

SEQ ID NO: 10823 - DNA, 16 bp, H. sapiens
aaatggagaaatatat

SEQ ID NO: 10824 - DNA, 16 bp, H. sapiens
aaatggagaaattcct

SEQ ID NO: 10825 - DNA, 16 bp, H. sapiens
aaatggagaaattggc

SEQ ID NO: 10826 - DNA, 16 bp, H. sapiens
aaatggagaacaaatt

SEQ ID NO: 10827 - DNA, 16 bp, H. sapiens
aaatggagacccagag

SEQ ID NO: 10828 - DNA, 16 bp, H. sapiens
aaatggagagaaactg

SEQ ID NO: 10829 - DNA, 16 bp, H. sapiens
aaatggagagtgactg

SEQ ID NO: 10830 - DNA, 16 bp, H. sapiens
aaatggagataatttt

SEQ ID NO: 10831 - DNA, 16 bp, H. sapiens
aaatggagatcataat

SEQ ID NO: 10832 - DNA, 16 bp, H. sapiens
aaatggagatttggac

SEQ ID NO: 10833 - DNA, 16 bp, H. sapiens
aaatggagcaggccaa

SEQ ID NO: 10834 - DNA, 16 bp, H. sapiens
aaatggaggcccagag

SEQ ID NO: 10835 - DNA, 16 bp, H. sapiens
aaatggaggttgcagt

SEQ ID NO: 10836 - DNA, 16 bp, H. sapiens
aaatggataaacagaa

SEQ ID NO: 10837 - DNA, 16 bp, H. sapiens
aaatggataaattatt

SEQ ID NO: 10838 - DNA, 16 bp, H. sapiens
aaatggatatttggaa

SEQ ID NO: 10839 - DNA, 16 bp, H. sapiens
aaatggatattttctt

SEQ ID NO: 10840 - DNA, 16 bp, H. sapiens
aaatggatcaaagatt

SEQ ID NO: 10841 - DNA, 16 bp, H. sapiens
aaatggatcaattcct

SEQ ID NO: 10842 - DNA, 16 bp, H. sapiens
aaatggatgaaatgaa

SEQ ID NO: 10843 - DNA, 16 bp, H. sapiens
aaatggatgttgtttt

SEQ ID NO: 10844 - DNA, 16 bp, H. sapiens
aaatggattaaagaca

SEQ ID NO: 10845 - DNA, 16 bp, H. sapiens
aaatggattaatgcca

SEQ ID NO: 10846 - DNA, 16 bp, H. sapiens
aaatggattattttct

SEQ ID NO: 10847 - DNA, 16 bp, H. sapiens
aaatggatttagccat

SEQ ID NO: 10848 - DNA, 16 bp, H. sapiens
aaatggattttaaaat

SEQ ID NO: 10849 - DNA, 16 bp, H. sapiens
aaatggcaaaacccca

SEQ ID NO: 10850 - DNA, 16 bp, H. sapiens
aaatggcaaaagtcac

SEQ ID NO: 10851 - DNA, 16 bp, H. sapiens
aaatggcaaacagata

SEQ ID NO: 10852 - DNA, 16 bp, H. sapiens
aaatggcaaatatttt

SEQ ID NO: 10853 - DNA, 16 bp, H. sapiens
aaatggcaatgcagat

SEQ ID NO: 10854 - DNA, 16 bp, H. sapiens
aaatggcacagctgct

SEQ ID NO: 10855 - DNA, 16 bp, H. sapiens
aaatggcagatctact

SEQ ID NO: 10856 - DNA, 16 bp, H. sapiens
aaatggcagctccatc

SEQ ID NO: 10857 - DNA, 16 bp, H. sapiens
aaatggcaggatttta

SEQ ID NO: 10858 - DNA, 16 bp, H. sapiens
aaatggcatgatcttg

SEQ ID NO: 10859 - DNA, 16 bp, H. sapiens
aaatggcatttaaaaa

SEQ ID NO: 10860 - DNA, 16 bp, H. sapiens
aaatggccaaaaagca

SEQ ID NO: 10861 - DNA, 16 bp, H. sapiens
aaatggccaatgagca

SEQ ID NO: 10862 - DNA, 16 bp, H. sapiens
aaatggccacactgct

SEQ ID NO: 10863 - DNA, 16 bp, H. sapiens
aaatggccagtaaata

SEQ ID NO: 10864 - DNA, 16 bp, H. sapiens
aaatggccatcaatga

SEQ ID NO: 10865 - DNA, 16 bp, H. sapiens
aaatggcctaaatgcc

SEQ ID NO: 10866 - DNA, 16 bp, H. sapiens
aaatggctaacaggta

SEQ ID NO: 10867 - DNA, 16 bp, H. sapiens
aaatggctcatgcctg

SEQ ID NO: 10868 - DNA, 16 bp, H. sapiens
aaatggctgattccag

SEQ ID NO: 10869 - DNA, 16 bp, H. sapiens
aaatggctggtccttg

SEQ ID NO: 10870 - DNA, 16 bp, H. sapiens
aaatggcttttatcca

SEQ ID NO: 10871 - DNA, 16 bp, H. sapiens
aaatgggaaaaagatt

SEQ ID NO: 10872 - DNA, 16 bp, H. sapiens
aaatgggaaaaagctg

SEQ ID NO: 10873 - DNA, 16 bp, H. sapiens
aaatgggaaaatgtta

SEQ ID NO: 10874 - DNA, 16 bp, H. sapiens
aaatgggaaaggattc

SEQ ID NO: 10875 - DNA, 16 bp, H. sapiens
aaatgggaaaggttcc

SEQ ID NO: 10876 - DNA, 16 bp, H. sapiens
aaatgggaacaataaa

SEQ ID NO: 10877 - DNA, 16 bp, H. sapiens
aaatgggaacactttt

SEQ ID NO: 10878 - DNA, 16 bp, H. sapiens
aaatgggaataatatc

SEQ ID NO: 10879 - DNA, 16 bp, H. sapiens
aaatgggaatatttat

SEQ ID NO: 10880 - DNA, 16 bp, H. sapiens
aaatgggacaaataga

SEQ ID NO: 10881 - DNA, 16 bp, H. sapiens
aaatgggacaaattgg

SEQ ID NO: 10882 - DNA, 16 bp, H. sapiens
aaatgggacctaatta

SEQ ID NO: 10883 - DNA, 16 bp, H. sapiens
aaatgggagaatattt

SEQ ID NO: 10884 - DNA, 16 bp, H. sapiens
aaatgggagaatttgg

SEQ ID NO: 10885 - DNA, 16 bp, H. sapiens
aaatgggagacaattt

SEQ ID NO: 10886 - DNA, 16 bp, H. sapiens
aaatgggataaaatat

SEQ ID NO: 10887 - DNA, 16 bp, H. sapiens
aaatgggatattattt

SEQ ID NO: 10888 - DNA, 16 bp, H. sapiens
aaatgggattatatta

SEQ ID NO: 10889 - DNA, 16 bp, H. sapiens
aaatgggatttcatca

SEQ ID NO: 10890 - DNA, 16 bp, H. sapiens
aaatgggcaaagaacc

SEQ ID NO: 10891 - DNA, 22 bp, H. sapiens
aaatgggctaaatgctccaatt

SEQ ID NO: 10892 - DNA, 16 bp, H. sapiens
aaatggggaaaaactg

SEQ ID NO: 10893 - DNA, 16 bp, H. sapiens
aaatggggataataac

SEQ ID NO: 10894 - DNA, 16 bp, H. sapiens
aaatggggataatggt

SEQ ID NO: 10895 - DNA, 16 bp, H. sapiens
aaatggggatgacaat

SEQ ID NO: 10896 - DNA, 16 bp, H. sapiens
aaatggggcaaaatgt

SEQ ID NO: 10897 - DNA, 16 bp, H. sapiens
aaatgggggaaaattt

SEQ ID NO: 10898 - DNA, 16 bp, H. sapiens
aaatggggtatccacc

SEQ ID NO: 10899 - DNA, 16 bp, H. sapiens
aaatggggttaataac

SEQ ID NO: 10900 - DNA, 16 bp, H. sapiens
aaatgggtaaaggaca

SEQ ID NO: 10901 - DNA, 16 bp, H. sapiens
aaatgggtgtaataat

SEQ ID NO: 10902 - DNA, 16 bp, H. sapiens
aaatgggtttttcttt

SEQ ID NO: 10903 - DNA, 16 bp, H. sapiens
aaatggtaaaggggat

SEQ ID NO: 10904 - DNA, 16 bp, H. sapiens
aaatggtaaattgtat

SEQ ID NO: 10905 - DNA, 16 bp, H. sapiens
aaatggtacagccact

SEQ ID NO: 10906 - DNA, 16 bp, H. sapiens
aaatggtattggaaca

SEQ ID NO: 10907 - DNA, 16 bp, H. sapiens
aaatggtatttagaaa

SEQ ID NO: 10908 - DNA, 18 bp, H. sapiens
aaatggtatttccagttc

SEQ ID NO: 10909 - DNA, 16 bp, H. sapiens
aaatggtctaaataca

SEQ ID NO: 10910 - DNA, 16 bp, H. sapiens
aaatggtctcactctg

SEQ ID NO: 10911 - DNA, 16 bp, H. sapiens
aaatggtgagattaca

SEQ ID NO: 10912 - DNA, 16 bp, H. sapiens
aaatggtgatttaaaa

SEQ ID NO: 10913 - DNA, 16 bp, H. sapiens
aaatggtgattttttt

SEQ ID NO: 10914 - DNA, 16 bp, H. sapiens
aaatggtgcagccact

SEQ ID NO: 10915 - DNA, 16 bp, H. sapiens
aaatggtgctaagata

SEQ ID NO: 10916 - DNA, 17 bp, H. sapiens
aaatggtgctggcaaaa

SEQ ID NO: 10917 - DNA, 19 bp, H. sapiens
aaatggtgctgggaaaacg

SEQ ID NO: 10918 - DNA, 61 bp, H. sapiens
aaatggtgctgggaaaactggctagccatatgtagaaagctgaaactggatcccttcctta

SEQ ID NO: 10919 - DNA, 55 bp, H. sapiens
aaatggtgctgggaaaactggctagccatatgtaggaagctgaaactggatccct

SEQ ID NO: 10920 - DNA, 18 bp, H. sapiens
aaatggtgctgggaaaat

SEQ ID NO: 10921 - DNA, 16 bp, H. sapiens
aaatggtgtagcattt

SEQ ID NO: 10922 - DNA, 18 bp, H. sapiens
aaatggtgtgaacccagg

SEQ ID NO: 10923 - DNA, 16 bp, H. sapiens
aaatggtgttggaaaa

SEQ ID NO: 10924 - DNA, 16 bp, H. sapiens
aaatggtgtttggctt

SEQ ID NO: 10925 - DNA, 16 bp, H. sapiens
aaatggttaaacatag

SEQ ID NO: 10926 - DNA, 16 bp, H. sapiens
aaatggttctgaatca

SEQ ID NO: 10927 - DNA, 16 bp, H. sapiens
aaatggttctggaaaa

SEQ ID NO: 10928 - DNA, 16 bp, H. sapiens
aaatggttctgggaaa

SEQ ID NO: 10929 - DNA, 16 bp, H. sapiens
aaatggttgaaatggt

SEQ ID NO: 10930 - DNA, 16 bp, H. sapiens
aaatggttgcattctt

SEQ ID NO: 10931 - DNA, 16 bp, H. sapiens
aaatggttgcattttt

SEQ ID NO: 10932 - DNA, 16 bp, H. sapiens
aaatggtttggctgtg

SEQ ID NO: 10933 - DNA, 16 bp, H. sapiens
aaatggttttgttttg

SEQ ID NO: 10934 - DNA, 16 bp, H. sapiens
aaatggtttttatcca

SEQ ID NO: 10935 - DNA, 16 bp, H. sapiens
aaatgtaaaaactgtt

SEQ ID NO: 10936 - DNA, 16 bp, H. sapiens
aaatgtaaaaattaac

SEQ ID NO: 10937 - DNA, 16 bp, H. sapiens
aaatgtaaaacaatgt

SEQ ID NO: 10938 - DNA, 16 bp, H. sapiens
aaatgtaaaacttgaa

SEQ ID NO: 10939 - DNA, 16 bp, H. sapiens
aaatgtaaaacttttg

SEQ ID NO: 10940 - DNA, 16 bp, H. sapiens
aaatgtaaaatatcta

SEQ ID NO: 10941 - DNA, 16 bp, H. sapiens
aaatgtaaaatctgaa

SEQ ID NO: 10942 - DNA, 16 bp, H. sapiens
aaatgtaaaatgcaca

SEQ ID NO: 10943 - DNA, 16 bp, H. sapiens
aaatgtaaaatgtgaa

SEQ ID NO: 10944 - DNA, 16 bp, H. sapiens
aaatgtaaaattcagt

SEQ ID NO: 10945 - DNA, 16 bp, H. sapiens
aaatgtaaacaaaagt

SEQ ID NO: 10946 - DNA, 16 bp, H. sapiens
aaatgtaaacaaacat

SEQ ID NO: 10947 - DNA, 16 bp, H. sapiens
aaatgtaaacaaatat

SEQ ID NO: 10948 - DNA, 16 bp, H. sapiens
aaatgtaaaccaaaag

SEQ ID NO: 10949 - DNA, 16 bp, H. sapiens
aaatgtaaactaaaat

SEQ ID NO: 10950 - DNA, 16 bp, H. sapiens
aaatgtaaactttaaa

SEQ ID NO: 10951 - DNA, 16 bp, H. sapiens
aaatgtaaagaatgtg

SEQ ID NO: 10952 - DNA, 16 bp, H. sapiens
aaatgtaaatatgtat

SEQ ID NO: 10953 - DNA, 16 bp, H. sapiens
aaatgtaaatattcct

SEQ ID NO: 10954 - DNA, 16 bp, H. sapiens
aaatgtaaatcctaaa

SEQ ID NO: 10955 - DNA, 16 bp, H. sapiens
aaatgtaaatgcatat

SEQ ID NO: 10956 - DNA, 16 bp, H. sapiens
aaatgtaaatgttatt

SEQ ID NO: 10957 - DNA, 16 bp, H. sapiens
aaatgtaacaatgtat

SEQ ID NO: 10958 - DNA, 16 bp, H. sapiens
aaatgtaacattcaaa

SEQ ID NO: 10959 - DNA, 16 bp, H. sapiens
aaatgtaacattttaa

SEQ ID NO: 10960 - DNA, 16 bp, H. sapiens
aaatgtaactaaaaat

SEQ ID NO: 10961 - DNA, 16 bp, H. sapiens
aaatgtaacttttaaa

SEQ ID NO: 10962 - DNA, 16 bp, H. sapiens
aaatgtaactttttaa

SEQ ID NO: 10963 - DNA, 16 bp, H. sapiens
aaatgtaagacttaaa

SEQ ID NO: 10964 - DNA, 16 bp, H. sapiens
aaatgtaaggtattat

SEQ ID NO: 10965 - DNA, 16 bp, H. sapiens
aaatgtaagttttatt

SEQ ID NO: 10966 - DNA, 16 bp, H. sapiens
aaatgtaataaataca

SEQ ID NO: 10967 - DNA, 16 bp, H. sapiens
aaatgtaatattcttt

SEQ ID NO: 10968 - DNA, 16 bp, H. sapiens
aaatgtaatgcagcat

SEQ ID NO: 10969 - DNA, 16 bp, H. sapiens
aaatgtaatgcatttg

SEQ ID NO: 10970 - DNA, 16 bp, H. sapiens
aaatgtaatgttttta

SEQ ID NO: 10971 - DNA, 16 bp, H. sapiens
aaatgtaattcataaa

SEQ ID NO: 10972 - DNA, 16 bp, H. sapiens
aaatgtaattctaaaa

SEQ ID NO: 10973 - DNA, 16 bp, H. sapiens
aaatgtaattgatttt

SEQ ID NO: 10974 - DNA, 16 bp, H. sapiens
aaatgtaattgccatt

SEQ ID NO: 10975 - DNA, 16 bp, H. sapiens
aaatgtaattttatgt

SEQ ID NO: 10976 - DNA, 16 bp, H. sapiens
aaatgtaattttcaaa

SEQ ID NO: 10977 - DNA, 16 bp, H. sapiens
aaatgtaattttgaat

SEQ ID NO: 10978 - DNA, 16 bp, H. sapiens
aaatgtacaaaaatgt

SEQ ID NO: 10979 - DNA, 16 bp, H. sapiens
aaatgtacaattaaat

SEQ ID NO: 10980 - DNA, 16 bp, H. sapiens
aaatgtacaattaagt

SEQ ID NO: 10981 - DNA, 16 bp, H. sapiens
aaatgtacaattcagt

SEQ ID NO: 10982 - DNA, 16 bp, H. sapiens
aaatgtacacaataaa

SEQ ID NO: 10983 - DNA, 16 bp, H. sapiens
aaatgtacataacata

SEQ ID NO: 10984 - DNA, 16 bp, H. sapiens
aaatgtacataataaa

SEQ ID NO: 10985 - DNA, 16 bp, H. sapiens
aaatgtacatatatat

SEQ ID NO: 10986 - DNA, 16 bp, H. sapiens
aaatgtacatattcaa

SEQ ID NO: 10987 - DNA, 16 bp, H. sapiens
aaatgtacttatttat

SEQ ID NO: 10988 - DNA, 16 bp, H. sapiens
aaatgtacttatttgg

SEQ ID NO: 10989 - DNA, 16 bp, H. sapiens
aaatgtactttttaaa

SEQ ID NO: 10990 - DNA, 16 bp, H. sapiens
aaatgtagaaaatttt

SEQ ID NO: 10991 - DNA, 16 bp, H. sapiens
aaatgtagagaaaatg

SEQ ID NO: 10992 - DNA, 16 bp, H. sapiens
aaatgtagagttttta

SEQ ID NO: 10993 - DNA, 16 bp, H. sapiens
aaatgtagatttactg

SEQ ID NO: 10994 - DNA, 16 bp, H. sapiens
aaatgtataaatttca

SEQ ID NO: 10995 - DNA, 16 bp, H. sapiens
aaatgtataattacat

SEQ ID NO: 10996 - DNA, 16 bp, H. sapiens
aaatgtatacagtttt

SEQ ID NO: 10997 - DNA, 16 bp, H. sapiens
aaatgtatatgctttt

SEQ ID NO: 10998 - DNA, 16 bp, H. sapiens
aaatgtatattactaa

SEQ ID NO: 10999 - DNA, 16 bp, H. sapiens
aaatgtatattctttt

SEQ ID NO: 11000 - DNA, 16 bp, H. sapiens
aaatgtatattgtaaa

SEQ ID NO: 11001 - DNA, 16 bp, H. sapiens
aaatgtatatttgtat

SEQ ID NO: 11002 - DNA, 16 bp, H. sapiens
aaatgtatattttgct

SEQ ID NO: 11003 - DNA, 16 bp, H. sapiens
aaatgtatcaaaataa

SEQ ID NO: 11004 - DNA, 16 bp, H. sapiens
aaatgtatccatttta

SEQ ID NO: 11005 - DNA, 16 bp, H. sapiens
aaatgtatcttttaaa

SEQ ID NO: 11006 - DNA, 16 bp, H. sapiens
aaatgtatgaaacaac

SEQ ID NO: 11007 - DNA, 16 bp, H. sapiens
aaatgtatgaagcaaa

SEQ ID NO: 11008 - DNA, 16 bp, H. sapiens
aaatgtatgcatttat

SEQ ID NO: 11009 - DNA, 16 bp, H. sapiens
aaatgtatgtaaatat

SEQ ID NO: 11010 - DNA, 16 bp, H. sapiens
aaatgtatgtatattt

SEQ ID NO: 11011 - DNA, 16 bp, H. sapiens
aaatgtatgtatgtat

SEQ ID NO: 11012 - DNA, 16 bp, H. sapiens
aaatgtatgtgtgcat

SEQ ID NO: 11013 - DNA, 16 bp, H. sapiens
aaatgtatgtgttttt

SEQ ID NO: 11014 - DNA, 16 bp, H. sapiens
aaatgtatgttttaat

SEQ ID NO: 11015 - DNA, 16 bp, H. sapiens
aaatgtatgttttcaa

SEQ ID NO: 11016 - DNA, 16 bp, H. sapiens
aaatgtattaaacatt

SEQ ID NO: 11017 - DNA, 16 bp, H. sapiens
aaatgtattacataaa

SEQ ID NO: 11018 - DNA, 16 bp, H. sapiens
aaatgtattcatttgt

SEQ ID NO: 11019 - DNA, 16 bp, H. sapiens
aaatgtattccttttt

SEQ ID NO: 11020 - DNA, 16 bp, H. sapiens
aaatgtattctttttt

SEQ ID NO: 11021 - DNA, 16 bp, H. sapiens
aaatgtattgagattt

SEQ ID NO: 11022 - DNA, 16 bp, H. sapiens
aaatgtatttaaaaca

SEQ ID NO: 11023 - DNA, 16 bp, H. sapiens
aaatgtatttactatt

SEQ ID NO: 11024 - DNA, 16 bp, H. sapiens
aaatgtatttattttc

SEQ ID NO: 11025 - DNA, 16 bp, H. sapiens
aaatgtatttcatatt

SEQ ID NO: 11026 - DNA, 16 bp, H. sapiens
aaatgtatttctaata

SEQ ID NO: 11027 - DNA, 16 bp, H. sapiens
aaatgtatttctgaaa

SEQ ID NO: 11028 - DNA, 16 bp, H. sapiens
aaatgtatttctttct

SEQ ID NO: 11029 - DNA, 16 bp, H. sapiens
aaatgtatttgaaatg

SEQ ID NO: 11030 - DNA, 16 bp, H. sapiens
aaatgtatttgcaaat

SEQ ID NO: 11031 - DNA, 16 bp, H. sapiens
aaatgtatttgtttca

SEQ ID NO: 11032 - DNA, 16 bp, H. sapiens
aaatgtattttccttt

SEQ ID NO: 11033 - DNA, 16 bp, H. sapiens
aaatgtattttctcat

SEQ ID NO: 11034 - DNA, 16 bp, H. sapiens
aaatgtattttgaaaa

SEQ ID NO: 11035 - DNA, 16 bp, H. sapiens
aaatgtattttgcaaa

SEQ ID NO: 11036 - DNA, 16 bp, H. sapiens
aaatgtatttttacat

SEQ ID NO: 11037 - DNA, 16 bp, H. sapiens
aaatgtatttttatga

SEQ ID NO: 11038 - DNA, 16 bp, H. sapiens
aaatgtatttttcaaa

SEQ ID NO: 11039 - DNA, 16 bp, H. sapiens
aaatgtatttttcatt

SEQ ID NO: 11040 - DNA, 16 bp, H. sapiens
aaatgtattttttctt

SEQ ID NO: 11041 - DNA, 16 bp, H. sapiens
aaatgtcaaaaatata

SEQ ID NO: 11042 - DNA, 16 bp, H. sapiens
aaatgtcaacatttta

SEQ ID NO: 11043 - DNA, 16 bp, H. sapiens
aaatgtcaagaatgtg

SEQ ID NO: 11044 - DNA, 16 bp, H. sapiens
aaatgtcaataaatat

SEQ ID NO: 11045 - DNA, 16 bp, H. sapiens
aaatgtcacctcttca

SEQ ID NO: 11046 - DNA, 16 bp, H. sapiens
aaatgtcacttcctca

SEQ ID NO: 11047 - DNA, 16 bp, H. sapiens
aaatgtcactttatca

SEQ ID NO: 11048 - DNA, 16 bp, H. sapiens
aaatgtcactttctca

SEQ ID NO: 11049 - DNA, 16 bp, H. sapiens
aaatgtcagaagaaaa

SEQ ID NO: 11050 - DNA, 16 bp, H. sapiens
aaatgtcatccaagag

SEQ ID NO: 11051 - DNA, 16 bp, H. sapiens
aaatgtcatgattttt

SEQ ID NO: 11052 - DNA, 16 bp, H. sapiens
aaatgtcattatgtag

SEQ ID NO: 11053 - DNA, 16 bp, H. sapiens
aaatgtcatttaaaaa

SEQ ID NO: 11054 - DNA, 16 bp, H. sapiens
aaatgtcattttgttt

SEQ ID NO: 11055 - DNA, 16 bp, H. sapiens
aaatgtcatttttttc

SEQ ID NO: 11056 - DNA, 16 bp, H. sapiens
aaatgtccaataagca

SEQ ID NO: 11057 - DNA, 16 bp, H. sapiens
aaatgtccatcagtgt

SEQ ID NO: 11058 - DNA, 16 bp, H. sapiens
aaatgtccattaatga

SEQ ID NO: 11059 - DNA, 16 bp, H. sapiens
aaatgtccctgtttga

SEQ ID NO: 11060 - DNA, 16 bp, H. sapiens
aaatgtctacaaatgt

SEQ ID NO: 11061 - DNA, 16 bp, H. sapiens
aaatgtctattttaat

SEQ ID NO: 11062 - DNA, 16 bp, H. sapiens
aaatgtctccagaaat

SEQ ID NO: 11063 - DNA, 16 bp, H. sapiens
aaatgtctctgcatca

SEQ ID NO: 11064 - DNA, 16 bp, H. sapiens
aaatgtctctgtgtca

SEQ ID NO: 11065 - DNA, 16 bp, H. sapiens
aaatgtctgattttaa

SEQ ID NO: 11066 - DNA, 16 bp, H. sapiens
aaatgtctgtttatat

SEQ ID NO: 11067 - DNA, 16 bp, H. sapiens
aaatgtctgtttttat

SEQ ID NO: 11068 - DNA, 16 bp, H. sapiens
aaatgtctgtttttct

SEQ ID NO: 11069 - DNA, 16 bp, H. sapiens
aaatgtcttaaaatat

SEQ ID NO: 11070 - DNA, 16 bp, H. sapiens
aaatgtcttcagacat

SEQ ID NO: 11071 - DNA, 16 bp, H. sapiens
aaatgtcttcatttta

SEQ ID NO: 11072 - DNA, 16 bp, H. sapiens
aaatgtcttcattttt

SEQ ID NO: 11073 - DNA, 16 bp, H. sapiens
aaatgtcttcttaaaa

SEQ ID NO: 11074 - DNA, 16 bp, H. sapiens
aaatgtcttctttatt

SEQ ID NO: 11075 - DNA, 16 bp, H. sapiens
aaatgtctttatttta

SEQ ID NO: 11076 - DNA, 16 bp, H. sapiens
aaatgtctttggaatt

SEQ ID NO: 11077 - DNA, 16 bp, H. sapiens
aaatgtcttttatttt

SEQ ID NO: 11078 - DNA, 16 bp, H. sapiens
aaatgtcttttcaaaa

SEQ ID NO: 11079 - DNA, 16 bp, H. sapiens
aaatgtcttttgaaaa

SEQ ID NO: 11080 - DNA, 17 bp, H. sapiens
aaatgtctttttaaaaa

SEQ ID NO: 11081 - DNA, 16 bp, H. sapiens
aaatgtgaaaacagaa

SEQ ID NO: 11082 - DNA, 16 bp, H. sapiens
aaatgtgaaaactgaa

SEQ ID NO: 11083 - DNA, 16 bp, H. sapiens
aaatgtgaaaatattt

SEQ ID NO: 11084 - DNA, 16 bp, H. sapiens
aaatgtgaaaatgtga

SEQ ID NO: 11085 - DNA, 16 bp, H. sapiens
aaatgtgaaacccaaa

SEQ ID NO: 11086 - DNA, 16 bp, H. sapiens
aaatgtgaaattatat

SEQ ID NO: 11087 - DNA, 16 bp, H. sapiens
aaatgtgaacatttat

SEQ ID NO: 11088 - DNA, 16 bp, H. sapiens
aaatgtgaacatttta

SEQ ID NO: 11089 - DNA, 16 bp, H. sapiens
aaatgtgaagaatgtg

SEQ ID NO: 11090 - DNA, 16 bp, H. sapiens
aaatgtgaatatttaa

SEQ ID NO: 11091 - DNA, 16 bp, H. sapiens
aaatgtgaatgaaata

SEQ ID NO: 11092 - DNA, 16 bp, H. sapiens
aaatgtgaatgtattt

SEQ ID NO: 11093 - DNA, 16 bp, H. sapiens
aaatgtgaatgtgaaa

SEQ ID NO: 11094 - DNA, 16 bp, H. sapiens
aaatgtgaatttcaga

SEQ ID NO: 11095 - DNA, 16 bp, H. sapiens
aaatgtgacccccagt

SEQ ID NO: 11096 - DNA, 16 bp, H. sapiens
aaatgtgagaaaaaca

SEQ ID NO: 11097 - DNA, 16 bp, H. sapiens
aaatgtgagattaaaa

SEQ ID NO: 11098 - DNA, 16 bp, H. sapiens
aaatgtgaggtcagag

SEQ ID NO: 11099 - DNA, 16 bp, H. sapiens
aaatgtgatatatgca

SEQ ID NO: 11100 - DNA, 16 bp, H. sapiens
aaatgtgattatatat

SEQ ID NO: 11101 - DNA, 16 bp, H. sapiens
aaatgtgattatttta

SEQ ID NO: 11102 - DNA, 16 bp, H. sapiens
aaatgtgattgtattt

SEQ ID NO: 11103 - DNA, 16 bp, H. sapiens
aaatgtgattttatta

SEQ ID NO: 11104 - DNA, 16 bp, H. sapiens
aaatgtgatttttctt

SEQ ID NO: 11105 - DNA, 16 bp, H. sapiens
aaatgtgcaaaataaa

SEQ ID NO: 11106 - DNA, 16 bp, H. sapiens
aaatgtgcatttttct

SEQ ID NO: 11107 - DNA, 16 bp, H. sapiens
aaatgtgctatataca

SEQ ID NO: 11108 - DNA, 16 bp, H. sapiens
aaatgtgctttatttt

SEQ ID NO: 11109 - DNA, 16 bp, H. sapiens
aaatgtggaaaaacat

SEQ ID NO: 11110 - DNA, 16 bp, H. sapiens
aaatgtggaaaagttt

SEQ ID NO: 11111 - DNA, 16 bp, H. sapiens
aaatgtggaaaataca

SEQ ID NO: 11112 - DNA, 16 bp, H. sapiens
aaatgtggaaaatttt

SEQ ID NO: 11113 - DNA, 16 bp, H. sapiens
aaatgtggaaatgaaa

SEQ ID NO: 11114 - DNA, 16 bp, H. sapiens
aaatgtggaattgact

SEQ ID NO: 11115 - DNA, 16 bp, H. sapiens
aaatgtggacacagac

SEQ ID NO: 11116 - DNA, 16 bp, H. sapiens
aaatgtggagaaactg

SEQ ID NO: 11117 - DNA, 16 bp, H. sapiens
aaatgtggagttggag

SEQ ID NO: 11118 - DNA, 16 bp, H. sapiens
aaatgtggataaaaat

SEQ ID NO: 11119 - DNA, 16 bp, H. sapiens
aaatgtggataataac

SEQ ID NO: 11120 - DNA, 16 bp, H. sapiens
aaatgtggattttaaa

SEQ ID NO: 11121 - DNA, 16 bp, H. sapiens
aaatgtggcatacaca

SEQ ID NO: 11122 - DNA, 16 bp, H. sapiens
aaatgtggctggtgca

SEQ ID NO: 11123 - DNA, 16 bp, H. sapiens
aaatgtgggaaatttt

SEQ ID NO: 11124 - DNA, 16 bp, H. sapiens
aaatgtggggttgaag

SEQ ID NO: 11125 - DNA, 16 bp, H. sapiens
aaatgtggtgtgtgtg

SEQ ID NO: 11126 - DNA, 16 bp, H. sapiens
aaatgtggttttattt

SEQ ID NO: 11127 - DNA, 16 bp, H. sapiens
aaatgtgtaaatatat

SEQ ID NO: 11128 - DNA, 16 bp, H. sapiens
aaatgtgtacatgtgt

SEQ ID NO: 11129 - DNA, 16 bp, H. sapiens
aaatgtgtagatttat

SEQ ID NO: 11130 - DNA, 16 bp, H. sapiens
aaatgtgtataaatat

SEQ ID NO: 11131 - DNA, 16 bp, H. sapiens
aaatgtgtatgtataa

SEQ ID NO: 11132 - DNA, 16 bp, H. sapiens
aaatgtgtattttaaa

SEQ ID NO: 11133 - DNA, 17 bp, H. sapiens
aaatgtgtcattaggca

SEQ ID NO: 11134 - DNA, 16 bp, H. sapiens
aaatgtgtctggaatt

SEQ ID NO: 11135 - DNA, 16 bp, H. sapiens
aaatgtgtcttttatt

SEQ ID NO: 11136 - DNA, 16 bp, H. sapiens
aaatgtgtgaatttat

SEQ ID NO: 11137 - DNA, 16 bp, H. sapiens
aaatgtgtgtatacat

SEQ ID NO: 11138 - DNA, 16 bp, H. sapiens
aaatgtgtgtgttttt

SEQ ID NO: 11139 - DNA, 16 bp, H. sapiens
aaatgtgtgttgaatt

SEQ ID NO: 11140 - DNA, 16 bp, H. sapiens
aaatgtgttaagactt

SEQ ID NO: 11141 - DNA, 16 bp, H. sapiens
aaatgtgttcatttat

SEQ ID NO: 11142 - DNA, 16 bp, H. sapiens
aaatgtgttccctttt

SEQ ID NO: 11143 - DNA, 16 bp, H. sapiens
aaatgtgtttatttct

SEQ ID NO: 11144 - DNA, 16 bp, H. sapiens
aaatgtgtttctttaa

SEQ ID NO: 11145 - DNA, 16 bp, H. sapiens
aaatgtgtttctttct

SEQ ID NO: 11146 - DNA, 16 bp, H. sapiens
aaatgtgtttgagttc

SEQ ID NO: 11147 - DNA, 16 bp, H. sapiens
aaatgtgttttatgaa

SEQ ID NO: 11148 - DNA, 16 bp, H. sapiens
aaatgtgttttcttta

SEQ ID NO: 11149 - DNA, 16 bp, H. sapiens
aaatgtgttttgaaat

SEQ ID NO: 11150 - DNA, 16 bp, H. sapiens
aaatgtgtttttaaaa

SEQ ID NO: 11151 - DNA, 16 bp, H. sapiens
aaatgtgtttttcttc

SEQ ID NO: 11152 - DNA, 16 bp, H. sapiens
aaatgtgttttttaaa

SEQ ID NO: 11153 - DNA, 16 bp, H. sapiens
aaatgttaaaatgtga

SEQ ID NO: 11154 - DNA, 16 bp, H. sapiens
aaatgttaaacaaaat

SEQ ID NO: 11155 - DNA, 16 bp, H. sapiens
aaatgttaacatttaa

SEQ ID NO: 11156 - DNA, 16 bp, H. sapiens
aaatgttaacatttta

SEQ ID NO: 11157 - DNA, 16 bp, H. sapiens
aaatgttaactatcat

SEQ ID NO: 11158 - DNA, 16 bp, H. sapiens
aaatgttaactattgt

SEQ ID NO: 11159 - DNA, 16 bp, H. sapiens
aaatgttaatacattt

SEQ ID NO: 11160 - DNA, 16 bp, H. sapiens
aaatgttaatacttta

SEQ ID NO: 11161 - DNA, 16 bp, H. sapiens
aaatgttaatatttga

SEQ ID NO: 11162 - DNA, 16 bp, H. sapiens
aaatgttaatgatttt

SEQ ID NO: 11163 - DNA, 16 bp, H. sapiens
aaatgttaattttctt

SEQ ID NO: 11164 - DNA, 16 bp, H. sapiens
aaatgttactgaattt

SEQ ID NO: 11165 - DNA, 16 bp, H. sapiens
aaatgttactttttaa

SEQ ID NO: 11166 - DNA, 16 bp, H. sapiens
aaatgttagatatttt

SEQ ID NO: 11167 - DNA, 16 bp, H. sapiens
aaatgttagccaggca

SEQ ID NO: 11168 - DNA, 16 bp, H. sapiens
aaatgttagttattat

SEQ ID NO: 11169 - DNA, 16 bp, H. sapiens
aaatgttagttttaaa

SEQ ID NO: 11170 - DNA, 16 bp, H. sapiens
aaatgttataaaacaa

SEQ ID NO: 11171 - DNA, 16 bp, H. sapiens
aaatgttataattgtg

SEQ ID NO: 11172 - DNA, 16 bp, H. sapiens
aaatgttatccaggag

SEQ ID NO: 11173 - DNA, 16 bp, H. sapiens
aaatgttatctattat

SEQ ID NO: 11174 - DNA, 16 bp, H. sapiens
aaatgttatgcaaata

SEQ ID NO: 11175 - DNA, 16 bp, H. sapiens
aaatgttatgttatat

SEQ ID NO: 11176 - DNA, 16 bp, H. sapiens
aaatgttattgaaaat

SEQ ID NO: 11177 - DNA, 16 bp, H. sapiens
aaatgttattttctaa

SEQ ID NO: 11178 - DNA, 16 bp, H. sapiens
aaatgttattttctga

SEQ ID NO: 11179 - DNA, 16 bp, H. sapiens
aaatgttcaaatattt

SEQ ID NO: 11180 - DNA, 16 bp, H. sapiens
aaatgttcacagcagc

SEQ ID NO: 11181 - DNA, 16 bp, H. sapiens
aaatgttcacatttta

SEQ ID NO: 11182 - DNA, 16 bp, H. sapiens
aaatgttcactttaaa

SEQ ID NO: 11183 - DNA, 16 bp, H. sapiens
aaatgttcagttttaa

SEQ ID NO: 11184 - DNA, 16 bp, H. sapiens
aaatgttcatattatt

SEQ ID NO: 11185 - DNA, 16 bp, H. sapiens
aaatgttcattattat

SEQ ID NO: 11186 - DNA, 16 bp, H. sapiens
aaatgttcattgttta

SEQ ID NO: 11187 - DNA, 16 bp, H. sapiens
aaatgttcatttattt

SEQ ID NO: 11188 - DNA, 16 bp, H. sapiens
aaatgttcattttttt

SEQ ID NO: 11189 - DNA, 16 bp, H. sapiens
aaatgttccaaaatta

SEQ ID NO: 11190 - DNA, 16 bp, H. sapiens
aaatgttccatgtgca

SEQ ID NO: 11191 - DNA, 16 bp, H. sapiens
aaatgttccctggggg

SEQ ID NO: 11192 - DNA, 16 bp, H. sapiens
aaatgttccttctaac

SEQ ID NO: 11193 - DNA, 16 bp, H. sapiens
aaatgttctatatctg

SEQ ID NO: 11194 - DNA, 16 bp, H. sapiens
aaatgttctcactgca

SEQ ID NO: 11195 - DNA, 16 bp, H. sapiens
aaatgttctgaaactg

SEQ ID NO: 11196 - DNA, 16 bp, H. sapiens
aaatgttctgaaataa

SEQ ID NO: 11197 - DNA, 16 bp, H. sapiens
aaatgttctgaaattt

SEQ ID NO: 11198 - DNA, 16 bp, H. sapiens
aaatgttctggaatta

SEQ ID NO: 11199 - DNA, 16 bp, H. sapiens
aaatgttctgtgtctg

SEQ ID NO: 11200 - DNA, 16 bp, H. sapiens
aaatgttcttaaaaat

SEQ ID NO: 11201 - DNA, 16 bp, H. sapiens
aaatgttcttaatttt

SEQ ID NO: 11202 - DNA, 16 bp, H. sapiens
aaatgttctttgtttt

SEQ ID NO: 11203 - DNA, 16 bp, H. sapiens
aaatgttcttttaaaa

SEQ ID NO: 11204 - DNA, 16 bp, H. sapiens
aaatgttctttttaaa

SEQ ID NO: 11205 - DNA, 16 bp, H. sapiens
aaatgttgaaaaattt

SEQ ID NO: 11206 - DNA, 16 bp, H. sapiens
aaatgttgaaagcttt

SEQ ID NO: 11207 - DNA, 16 bp, H. sapiens
aaatgttgatacattt

SEQ ID NO: 11208 - DNA, 16 bp, H. sapiens
aaatgttgatattttg

SEQ ID NO: 11209 - DNA, 16 bp, H. sapiens
aaatgttgatttttct

SEQ ID NO: 11210 - DNA, 16 bp, H. sapiens
aaatgttgctgcttga

SEQ ID NO: 11211 - DNA, 16 bp, H. sapiens
aaatgttggctgggca

SEQ ID NO: 11212 - DNA, 16 bp, H. sapiens
aaatgttgggaaaaat

SEQ ID NO: 11213 - DNA, 16 bp, H. sapiens
aaatgttgttatgtgg

SEQ ID NO: 11214 - DNA, 16 bp, H. sapiens
aaatgtttaaaaatac

SEQ ID NO: 11215 - DNA, 16 bp, H. sapiens
aaatgtttaaaaatgt

SEQ ID NO: 11216 - DNA, 16 bp, H. sapiens
aaatgtttaaaaattc

SEQ ID NO: 11217 - DNA, 16 bp, H. sapiens
aaatgtttaaaacaat

SEQ ID NO: 11218 - DNA, 16 bp, H. sapiens
aaatgtttaaaacatt

SEQ ID NO: 11219 - DNA, 16 bp, H. sapiens
aaatgtttaaaagatg

SEQ ID NO: 11220 - DNA, 16 bp, H. sapiens
aaatgtttaaaatatg

SEQ ID NO: 11221 - DNA, 16 bp, H. sapiens
aaatgtttaaaattgt

SEQ ID NO: 11222 - DNA, 16 bp, H. sapiens
aaatgtttaaacattt

SEQ ID NO: 11223 - DNA, 16 bp, H. sapiens
aaatgtttaaagtgat

SEQ ID NO: 11224 - DNA, 16 bp, H. sapiens
aaatgtttaaatatct

SEQ ID NO: 11225 - DNA, 16 bp, H. sapiens
aaatgtttaaatatgt

SEQ ID NO: 11226 - DNA, 16 bp, H. sapiens
aaatgtttaagagaat

SEQ ID NO: 11227 - DNA, 16 bp, H. sapiens
aaatgtttaattcatt

SEQ ID NO: 11228 - DNA, 16 bp, H. sapiens
aaatgtttaattttga

SEQ ID NO: 11229 - DNA, 16 bp, H. sapiens
aaatgtttacaatttt

SEQ ID NO: 11230 - DNA, 16 bp, H. sapiens
aaatgtttacatattt

SEQ ID NO: 11231 - DNA, 16 bp, H. sapiens
aaatgtttacattttt

SEQ ID NO: 11232 - DNA, 16 bp, H. sapiens
aaatgtttactgtttt

SEQ ID NO: 11233 - DNA, 16 bp, H. sapiens
aaatgtttacttttat

SEQ ID NO: 11234 - DNA, 16 bp, H. sapiens
aaatgtttagaaaaca

SEQ ID NO: 11235 - DNA, 16 bp, H. sapiens
aaatgtttagaaatat

SEQ ID NO: 11236 - DNA, 16 bp, H. sapiens
aaatgtttagaagaat

SEQ ID NO: 11237 - DNA, 16 bp, H. sapiens
aaatgtttagtaattt

SEQ ID NO: 11238 - DNA, 16 bp, H. sapiens
aaatgtttataacagc

SEQ ID NO: 11239 - DNA, 16 bp, H. sapiens
aaatgtttatacattt

SEQ ID NO: 11240 - DNA, 16 bp, H. sapiens
aaatgtttatcatttt

SEQ ID NO: 11241 - DNA, 16 bp, H. sapiens
aaatgtttatggaaat

SEQ ID NO: 11242 - DNA, 16 bp, H. sapiens
aaatgtttatgttttc

SEQ ID NO: 11243 - DNA, 16 bp, H. sapiens
aaatgtttattcaatt

SEQ ID NO: 11244 - DNA, 16 bp, H. sapiens
aaatgtttattcatat

SEQ ID NO: 11245 - DNA, 16 bp, H. sapiens
aaatgtttattgttgt

SEQ ID NO: 11246 - DNA, 16 bp, H. sapiens
aaatgtttatttagca

SEQ ID NO: 11247 - DNA, 16 bp, H. sapiens
aaatgtttatttcaca

SEQ ID NO: 11248 - DNA, 16 bp, H. sapiens
aaatgtttatttcaga

SEQ ID NO: 11249 - DNA, 16 bp, H. sapiens
aaatgtttatttcttt

SEQ ID NO: 11250 - DNA, 16 bp, H. sapiens
aaatgtttattttgaa

SEQ ID NO: 11251 - DNA, 16 bp, H. sapiens
aaatgtttcaaataat

SEQ ID NO: 11252 - DNA, 16 bp, H. sapiens
aaatgtttcaaattaa

SEQ ID NO: 11253 - DNA, 16 bp, H. sapiens
aaatgtttcagtaaaa

SEQ ID NO: 11254 - DNA, 16 bp, H. sapiens
aaatgtttcattttct

SEQ ID NO: 11255 - DNA, 16 bp, H. sapiens
aaatgtttccattttt

SEQ ID NO: 11256 - DNA, 16 bp, H. sapiens
aaatgtttctaagaaa

SEQ ID NO: 11257 - DNA, 16 bp, H. sapiens
aaatgtttctcttatt

SEQ ID NO: 11258 - DNA, 16 bp, H. sapiens
aaatgtttctgaaaat

SEQ ID NO: 11259 - DNA, 16 bp, H. sapiens
aaatgtttctgcacag

SEQ ID NO: 11260 - DNA, 16 bp, H. sapiens
aaatgtttcttaaatg

SEQ ID NO: 11261 - DNA, 16 bp, H. sapiens
aaatgtttctttcaga

SEQ ID NO: 11262 - DNA, 16 bp, H. sapiens
aaatgtttctttctct

SEQ ID NO: 11263 - DNA, 16 bp, H. sapiens
aaatgtttgaaaatga

SEQ ID NO: 11264 - DNA, 16 bp, H. sapiens
aaatgtttgaaatgtt

SEQ ID NO: 11265 - DNA, 16 bp, H. sapiens
aaatgtttgaatttta

SEQ ID NO: 11266 - DNA, 16 bp, H. sapiens
aaatgtttgataaaat

SEQ ID NO: 11267 - DNA, 16 bp, H. sapiens
aaatgtttgatgtgat

SEQ ID NO: 11268 - DNA, 16 bp, H. sapiens
aaatgtttgcattatt

SEQ ID NO: 11269 - DNA, 16 bp, H. sapiens
aaatgtttgcatttct

SEQ ID NO: 11270 - DNA, 16 bp, H. sapiens
aaatgtttgctgaaca

SEQ ID NO: 11271 - DNA, 16 bp, H. sapiens
aaatgtttgctgaact

SEQ ID NO: 11272 - DNA, 16 bp, H. sapiens
aaatgtttgctgagtg

SEQ ID NO: 11273 - DNA, 16 bp, H. sapiens
aaatgtttgctgttta

SEQ ID NO: 11274 - DNA, 16 bp, H. sapiens
aaatgtttgctttata

SEQ ID NO: 11275 - DNA, 16 bp, H. sapiens
aaatgtttgcttttat

SEQ ID NO: 11276 - DNA, 16 bp, H. sapiens
aaatgtttggaaaaca

SEQ ID NO: 11277 - DNA, 16 bp, H. sapiens
aaatgtttggaaaatt

SEQ ID NO: 11278 - DNA, 16 bp, H. sapiens
aaatgtttgtaaatca

SEQ ID NO: 11279 - DNA, 16 bp, H. sapiens
aaatgtttgtgaaatt

SEQ ID NO: 11280 - DNA, 16 bp, H. sapiens
aaatgtttgtgtttat

SEQ ID NO: 11281 - DNA, 16 bp, H. sapiens
aaatgtttgttctttt

SEQ ID NO: 11282 - DNA, 16 bp, H. sapiens
aaatgtttgttgaatt

SEQ ID NO: 11283 - DNA, 16 bp, H. sapiens
aaatgtttgtttataa

SEQ ID NO: 11284 - DNA, 16 bp, H. sapiens
aaatgtttgttttcta

SEQ ID NO: 11285 - DNA, 16 bp, H. sapiens
aaatgttttaaaactg

SEQ ID NO: 11286 - DNA, 16 bp, H. sapiens
aaatgttttaaaattg

SEQ ID NO: 11287 - DNA, 16 bp, H. sapiens
aaatgttttaaagttt

SEQ ID NO: 11288 - DNA, 16 bp, H. sapiens
aaatgttttaaatggt

SEQ ID NO: 11289 - DNA, 16 bp, H. sapiens
aaatgttttaagcaaa

SEQ ID NO: 11290 - DNA, 16 bp, H. sapiens
aaatgttttaattgta

SEQ ID NO: 11291 - DNA, 16 bp, H. sapiens
aaatgttttaatttct

SEQ ID NO: 11292 - DNA, 16 bp, H. sapiens
aaatgttttaccagct

SEQ ID NO: 11293 - DNA, 16 bp, H. sapiens
aaatgttttactcttt

SEQ ID NO: 11294 - DNA, 16 bp, H. sapiens
aaatgttttacttatt

SEQ ID NO: 11295 - DNA, 16 bp, H. sapiens
aaatgttttacttttc

SEQ ID NO: 11296 - DNA, 16 bp, H. sapiens
aaatgttttatatcat

SEQ ID NO: 11297 - DNA, 16 bp, H. sapiens
aaatgttttcaaaatt

SEQ ID NO: 11298 - DNA, 16 bp, H. sapiens
aaatgttttcactttt

SEQ ID NO: 11299 - DNA, 16 bp, H. sapiens
aaatgttttcaggaaa

SEQ ID NO: 11300 - DNA, 16 bp, H. sapiens
aaatgttttcataaaa

SEQ ID NO: 11301 - DNA, 16 bp, H. sapiens
aaatgttttcatcaaa

SEQ ID NO: 11302 - DNA, 16 bp, H. sapiens
aaatgttttcattttc

SEQ ID NO: 11303 - DNA, 16 bp, H. sapiens
aaatgttttccaaata

SEQ ID NO: 11304 - DNA, 16 bp, H. sapiens
aaatgttttccagagt

SEQ ID NO: 11305 - DNA, 16 bp, H. sapiens
aaatgttttccccaaa

SEQ ID NO: 11306 - DNA, 16 bp, H. sapiens
aaatgttttctacttt

SEQ ID NO: 11307 - DNA, 16 bp, H. sapiens
aaatgttttctagttt

SEQ ID NO: 11308 - DNA, 16 bp, H. sapiens
aaatgttttctatttt

SEQ ID NO: 11309 - DNA, 16 bp, H. sapiens
aaatgttttctcatat

SEQ ID NO: 11310 - DNA, 16 bp, H. sapiens
aaatgttttctgaaga

SEQ ID NO: 11311 - DNA, 16 bp, H. sapiens
aaatgttttctgtctt

SEQ ID NO: 11312 - DNA, 16 bp, H. sapiens
aaatgttttcttacat

SEQ ID NO: 11313 - DNA, 16 bp, H. sapiens
aaatgttttcttctat

SEQ ID NO: 11314 - DNA, 16 bp, H. sapiens
aaatgttttctttttc

SEQ ID NO: 11315 - DNA, 16 bp, H. sapiens
aaatgttttctttttg

SEQ ID NO: 11316 - DNA, 16 bp, H. sapiens
aaatgttttgaaaatg

SEQ ID NO: 11317 - DNA, 16 bp, H. sapiens
aaatgttttgaaatat

SEQ ID NO: 11318 - DNA, 16 bp, H. sapiens
aaatgttttgaaatga

SEQ ID NO: 11319 - DNA, 16 bp, H. sapiens
aaatgttttgagaaaa

SEQ ID NO: 11320 - DNA, 16 bp, H. sapiens
aaatgttttgatacag

SEQ ID NO: 11321 - DNA, 16 bp, H. sapiens
aaatgttttgcaatgt

SEQ ID NO: 11322 - DNA, 16 bp, H. sapiens
aaatgttttgctgctt

SEQ ID NO: 11323 - DNA, 16 bp, H. sapiens
aaatgttttggaacca

SEQ ID NO: 11324 - DNA, 16 bp, H. sapiens
aaatgttttggaatta

SEQ ID NO: 11325 - DNA, 16 bp, H. sapiens
aaatgttttggtttcc

SEQ ID NO: 11326 - DNA, 16 bp, H. sapiens
aaatgttttgtaaaat

SEQ ID NO: 11327 - DNA, 16 bp, H. sapiens
aaatgttttgtctttt

SEQ ID NO: 11328 - DNA, 16 bp, H. sapiens
aaatgtttttaaaaca

SEQ ID NO: 11329 - DNA, 16 bp, H. sapiens
aaatgtttttaaaatg

SEQ ID NO: 11330 - DNA, 16 bp, H. sapiens
aaatgtttttaaagac

SEQ ID NO: 11331 - DNA, 16 bp, H. sapiens
aaatgtttttaaagat

SEQ ID NO: 11332 - DNA, 16 bp, H. sapiens
aaatgtttttaacaaa

SEQ ID NO: 11333 - DNA, 16 bp, H. sapiens
aaatgtttttaatgac

SEQ ID NO: 11334 - DNA, 16 bp, H. sapiens
aaatgtttttcaaaat

SEQ ID NO: 11335 - DNA, 16 bp, H. sapiens
aaatgtttttcaaagt

SEQ ID NO: 11336 - DNA, 16 bp, H. sapiens
aaatgtttttcatttc

SEQ ID NO: 11337 - DNA, 16 bp, H. sapiens
aaatgtttttcatttt

SEQ ID NO: 11338 - DNA, 16 bp, H. sapiens
aaatgtttttctaaaa

SEQ ID NO: 11339 - DNA, 16 bp, H. sapiens
aaatgtttttctgttt

SEQ ID NO: 11340 - DNA, 16 bp, H. sapiens
aaatgttttttaaagt

SEQ ID NO: 11341 - DNA, 16 bp, H. sapiens
aaatgttttttatctt

SEQ ID NO: 11342 - DNA, 16 bp, H. sapiens
aaatgttttttctgta

SEQ ID NO: 11343 - DNA, 16 bp, H. sapiens
aaatgttttttgagca

SEQ ID NO: 11344 - DNA, 16 bp, H. sapiens
aaatgtttttttaaag

SEQ ID NO: 11345 - DNA, 16 bp, H. sapiens
aaatgtttttttgaaa

SEQ ID NO: 11346 - DNA, 16 bp, H. sapiens
aaattaaaaaattgca

SEQ ID NO: 11347 - DNA, 16 bp, H. sapiens
aaattaaaaagtctga

SEQ ID NO: 11348 - DNA, 16 bp, H. sapiens
aaattaaaaatagcac

SEQ ID NO: 11349 - DNA, 16 bp, H. sapiens
aaattaaaaatagcca

SEQ ID NO: 11350 - DNA, 16 bp, H. sapiens
aaattaaaaatggaca

SEQ ID NO: 11351 - DNA, 16 bp, H. sapiens
aaattaaaaatgggca

SEQ ID NO: 11352 - DNA, 16 bp, H. sapiens
aaattaaaacaacagt

SEQ ID NO: 11353 - DNA, 16 bp, H. sapiens
aaattaaaacaattga

SEQ ID NO: 11354 - DNA, 16 bp, H. sapiens
aaattaaaacacagca

SEQ ID NO: 11355 - DNA, 16 bp, H. sapiens
aaattaaaacattttg

SEQ ID NO: 11356 - DNA, 16 bp, H. sapiens
aaattaaaactagaac

SEQ ID NO: 11357 - DNA, 16 bp, H. sapiens
aaattaaaacttttct

SEQ ID NO: 11358 - DNA, 16 bp, H. sapiens
aaattaaaaggcaaat

SEQ ID NO: 11359 - DNA, 16 bp, H. sapiens
aaattaaaagtgattt

SEQ ID NO: 11360 - DNA, 16 bp, H. sapiens
aaattaaaagttgttt

SEQ ID NO: 11361 - DNA, 16 bp, H. sapiens
aaattaaaatatgctt

SEQ ID NO: 11362 - DNA, 16 bp, H. sapiens
aaattaaaatcagaat

SEQ ID NO: 11363 - DNA, 16 bp, H. sapiens
aaattaaaatcttttg

SEQ ID NO: 11364 - DNA, 16 bp, H. sapiens
aaattaaaatgttaca

SEQ ID NO: 11365 - DNA, 24 bp, H. sapiens
aaattaaaattgctaatgaagttt

SEQ ID NO: 11366 - DNA, 16 bp, H. sapiens
aaattaaacccaaagt

SEQ ID NO: 11367 - DNA, 16 bp, H. sapiens
aaattaaacttgtttt

SEQ ID NO: 11368 - DNA, 16 bp, H. sapiens
aaattaaagaagacac

SEQ ID NO: 11369 - DNA, 16 bp, H. sapiens
aaattaaagcaacaat

SEQ ID NO: 11370 - DNA, 16 bp, H. sapiens
aaattaaagcaattaa

SEQ ID NO: 11371 - DNA, 16 bp, H. sapiens
aaattaaagcagaaat

SEQ ID NO: 11372 - DNA, 16 bp, H. sapiens
aaattaaagccataat

SEQ ID NO: 11373 - DNA, 16 bp, H. sapiens
aaattaaagtttatca

SEQ ID NO: 11374 - DNA, 16 bp, H. sapiens
aaattaaagttttaga

SEQ ID NO: 11375 - DNA, 16 bp, H. sapiens
aaattaaatatgcaaa

SEQ ID NO: 11376 - DNA, 16 bp, H. sapiens
aaattaaatgttcaaa

SEQ ID NO: 11377 - DNA, 16 bp, H. sapiens
aaattaaatttggcct

SEQ ID NO: 11378 - DNA, 16 bp, H. sapiens
aaattaacaaatgttt

SEQ ID NO: 11379 - DNA, 16 bp, H. sapiens
aaattaacataaaatg

SEQ ID NO: 11380 - DNA, 16 bp, H. sapiens
aaattaacatttcttt

SEQ ID NO: 11381 - DNA, 16 bp, H. sapiens
aaattaaccaaaggct

SEQ ID NO: 11382 - DNA, 16 bp, H. sapiens
aaattaactcaaaaga

SEQ ID NO: 11383 - DNA, 16 bp, H. sapiens
aaattaacttgtaaat

SEQ ID NO: 11384 - DNA, 16 bp, H. sapiens
aaattaagaaaatgac

SEQ ID NO: 11385 - DNA, 16 bp, H. sapiens
aaattaagaaacaatt

SEQ ID NO: 11386 - DNA, 16 bp, H. sapiens
aaattaagaaatacat

SEQ ID NO: 11387 - DNA, 16 bp, H. sapiens
aaattaagacatttca

SEQ ID NO: 11388 - DNA, 16 bp, H. sapiens
aaattaagatttttga

SEQ ID NO: 11389 - DNA, 16 bp, H. sapiens
aaattaagcaaaatat

SEQ ID NO: 11390 - DNA, 16 bp, H. sapiens
aaattaagcagaagaa

SEQ ID NO: 11391 - DNA, 16 bp, H. sapiens
aaattaaggacatttt

SEQ ID NO: 11392 - DNA, 16 bp, H. sapiens
aaattaaggcaaaata

SEQ ID NO: 11393 - DNA, 16 bp, H. sapiens
aaattaaggctgggca

SEQ ID NO: 11394 - DNA, 16 bp, H. sapiens
aaattaaggttcagag

SEQ ID NO: 11395 - DNA, 16 bp, H. sapiens
aaattaagtgacttgc

SEQ ID NO: 11396 - DNA, 16 bp, H. sapiens
aaattaataaatccag

SEQ ID NO: 11397 - DNA, 27 bp, H. sapiens
aaattaatataactgcagaccaacttt

SEQ ID NO: 11398 - DNA, 16 bp, H. sapiens
aaattaatcaatgtaa

SEQ ID NO: 11399 - DNA, 16 bp, H. sapiens
aaattaatctattcat

SEQ ID NO: 11400 - DNA, 16 bp, H. sapiens
aaattaatgaaactga

SEQ ID NO: 11401 - DNA, 16 bp, H. sapiens
aaattaatgaaagaca

SEQ ID NO: 11402 - DNA, 16 bp, H. sapiens
aaattaatgagaacaa

SEQ ID NO: 11403 - DNA, 16 bp, H. sapiens
aaattaatgcagaaat

SEQ ID NO: 11404 - DNA, 16 bp, H. sapiens
aaattaatgctgaaaa

SEQ ID NO: 11405 - DNA, 16 bp, H. sapiens
aaattaattcaagaaa

SEQ ID NO: 11406 - DNA, 16 bp, H. sapiens
aaattaatttcatctt

SEQ ID NO: 11407 - DNA, 16 bp, H. sapiens
aaattaattttctgaa

SEQ ID NO: 11408 - DNA, 16 bp, H. sapiens
aaattaattttgtttc

SEQ ID NO: 11409 - DNA, 16 bp, H. sapiens
aaattacaaaaagtag

SEQ ID NO: 11410 - DNA, 16 bp, H. sapiens
aaattacaaatatgtg

SEQ ID NO: 11411 - DNA, 16 bp, H. sapiens
aaattacacagtttca

SEQ ID NO: 11412 - DNA, 16 bp, H. sapiens
aaattacagaaatgga

SEQ ID NO: 11413 - DNA, 16 bp, H. sapiens
aaattacagaaattta

SEQ ID NO: 11414 - DNA, 16 bp, H. sapiens
aaattacagaatttta

SEQ ID NO: 11415 - DNA, 16 bp, H. sapiens
aaattacaggatctca

SEQ ID NO: 11416 - DNA, 16 bp, H. sapiens
aaattacagttttatt

SEQ ID NO: 11417 - DNA, 16 bp, H. sapiens
aaattacatgacaaaa

SEQ ID NO: 11418 - DNA, 16 bp, H. sapiens
aaattacattaaatgt

SEQ ID NO: 11419 - DNA, 16 bp, H. sapiens
aaattacattattttc

SEQ ID NO: 11420 - DNA, 16 bp, H. sapiens
aaattacatttttaca

SEQ ID NO: 11421 - DNA, 16 bp, H. sapiens
aaattaccataaactg

SEQ ID NO: 11422 - DNA, 16 bp, H. sapiens
aaattaccatttcagt

SEQ ID NO: 11423 - DNA, 16 bp, H. sapiens
aaattactaagaggaa

SEQ ID NO: 11424 - DNA, 16 bp, H. sapiens
aaattactataaactt

SEQ ID NO: 11425 - DNA, 16 bp, H. sapiens
aaattactgtttcaat

SEQ ID NO: 11426 - DNA, 16 bp, H. sapiens
aaattacttaacctct

SEQ ID NO: 11427 - DNA, 16 bp, H. sapiens
aaattacttaagaaaa

SEQ ID NO: 11428 - DNA, 16 bp, H. sapiens
aaattacttagcctct

SEQ ID NO: 11429 - DNA, 16 bp, H. sapiens
aaattacttcacctct

SEQ ID NO: 11430 - DNA, 16 bp, H. sapiens
aaattacttcatctct

SEQ ID NO: 11431 - DNA, 16 bp, H. sapiens
aaattacttggaaata

SEQ ID NO: 11432 - DNA, 16 bp, H. sapiens
aaattactttcaggct

SEQ ID NO: 11433 - DNA, 16 bp, H. sapiens
aaattacttttctgtt

SEQ ID NO: 11434 - DNA, 16 bp, H. sapiens
aaattacttttggcag

SEQ ID NO: 11435 - DNA, 16 bp, H. sapiens
aaattagaaaactgaa

SEQ ID NO: 11436 - DNA, 16 bp, H. sapiens
aaattagaaaatacat

SEQ ID NO: 11437 - DNA, 16 bp, H. sapiens
aaattagaaaatctga

SEQ ID NO: 11438 - DNA, 16 bp, H. sapiens
aaattagaaagaaact

SEQ ID NO: 11439 - DNA, 16 bp, H. sapiens
aaattagaaatatctt

SEQ ID NO: 11440 - DNA, 16 bp, H. sapiens
aaattagaagtcagga

SEQ ID NO: 11441 - DNA, 16 bp, H. sapiens
aaattagaagttattt

SEQ ID NO: 11442 - DNA, 16 bp, H. sapiens
aaattagaatttctgg

SEQ ID NO: 11443 - DNA, 16 bp, H. sapiens
aaattagcagggagtg

SEQ ID NO: 11444 - DNA, 16 bp, H. sapiens
aaattagcatttaaaa

SEQ ID NO: 11445 - DNA, 16 bp, H. sapiens
aaattagcatttaaat

SEQ ID NO: 11446 - DNA, 16 bp, H. sapiens
aaattagccaagcgtg

SEQ ID NO: 11447 - DNA, 16 bp, H. sapiens
aaattagccagacaca

SEQ ID NO: 11448 - DNA, 18 bp, H. sapiens
aaattagccaggcatggc

SEQ ID NO: 11449 - DNA, 18 bp, H. sapiens
aaattagccaggcgtggt

SEQ ID NO: 11450 - DNA, 16 bp, H. sapiens
aaattagccaggggtg

SEQ ID NO: 11451 - DNA, 16 bp, H. sapiens
aaattagccagggtgg

SEQ ID NO: 11452 - DNA, 16 bp, H. sapiens
aaattagccagggttg

SEQ ID NO: 11453 - DNA, 16 bp, H. sapiens
aaattagccaggtggc

SEQ ID NO: 11454 - DNA, 16 bp, H. sapiens
aaattagcccaatgtg

SEQ ID NO: 11455 - DNA, 16 bp, H. sapiens
aaattagccgagcgtg

SEQ ID NO: 11456 - DNA, 20 bp, H. sapiens
aaattagccggatgtggtgg

SEQ ID NO: 11457 - DNA, 16 bp, H. sapiens
aaattagccgggactg

SEQ ID NO: 11458 - DNA, 17 bp, H. sapiens
aaattagccgggcatgc

SEQ ID NO: 11459 - DNA, 19 bp, H. sapiens
aaattagccgggcatggta

SEQ ID NO: 11460 - DNA, 18 bp, H. sapiens
aaattagccgggtatggc

SEQ ID NO: 11461 - DNA, 20 bp, H. sapiens
aaattagccgggtgcggtgg

SEQ ID NO: 11462 - DNA, 18 bp, H. sapiens
aaattagccgggtgtggc

SEQ ID NO: 11463 - DNA, 20 bp, H. sapiens
aaattagccgggtgtggtga

SEQ ID NO: 11464 - DNA, 22 bp, H. sapiens
aaattagccgggtgtggtggca

SEQ ID NO: 11465 - DNA, 20 bp, H. sapiens
aaattagcctagcgtggtgg

SEQ ID NO: 11466 - DNA, 16 bp, H. sapiens
aaattagcctgatgtg

SEQ ID NO: 11467 - DNA, 16 bp, H. sapiens
aaattagctaggcatt

SEQ ID NO: 11468 - DNA, 16 bp, H. sapiens
aaattagctgcgcgtg

SEQ ID NO: 11469 - DNA, 16 bp, H. sapiens
aaattagctggacatg

SEQ ID NO: 11470 - DNA, 18 bp, H. sapiens
aaattagctgggcatgac

SEQ ID NO: 11471 - DNA, 16 bp, H. sapiens
aaattagctgggtatg

SEQ ID NO: 11472 - DNA, 16 bp, H. sapiens
aaattagctgggtgcg

SEQ ID NO: 11473 - DNA, 16 bp, H. sapiens
aaattagctgggtgtc

SEQ ID NO: 11474 - DNA, 16 bp, H. sapiens
aaattagctgggtgtg

SEQ ID NO: 11475 - DNA, 16 bp, H. sapiens
aaattagcttggtatg

SEQ ID NO: 11476 - DNA, 16 bp, H. sapiens
aaattaggaaaatttt

SEQ ID NO: 11477 - DNA, 16 bp, H. sapiens
aaattaggattgcaac

SEQ ID NO: 11478 - DNA, 16 bp, H. sapiens
aaattagggaagctgt

SEQ ID NO: 11479 - DNA, 16 bp, H. sapiens
aaattagggctgggcg

SEQ ID NO: 11480 - DNA, 19 bp, H. sapiens
aaattaggtactgatggga

SEQ ID NO: 11481 - DNA, 16 bp, H. sapiens
aaattaggtataaaag

SEQ ID NO: 11482 - DNA, 16 bp, H. sapiens
aaattaggtatggatg

SEQ ID NO: 11483 - DNA, 16 bp, H. sapiens
aaattaggtcaattaa

SEQ ID NO: 11484 - DNA, 16 bp, H. sapiens
aaattaggtgggtgtg

SEQ ID NO: 11485 - DNA, 16 bp, H. sapiens
aaattagtaaagccat

SEQ ID NO: 11486 - DNA, 16 bp, H. sapiens
aaattagtacatttta

SEQ ID NO: 11487 - DNA, 16 bp, H. sapiens
aaattagtcagacatg

SEQ ID NO: 11488 - DNA, 16 bp, H. sapiens
aaattagtcggacatg

SEQ ID NO: 11489 - DNA, 18 bp, H. sapiens
aaattagtcgggcatgat

SEQ ID NO: 11490 - DNA, 16 bp, H. sapiens
aaattagtcgggtgtg

SEQ ID NO: 11491 - DNA, 16 bp, H. sapiens
aaattagttacttcca

SEQ ID NO: 11492 - DNA, 16 bp, H. sapiens
aaattagttgaagaaa

SEQ ID NO: 11493 - DNA, 16 bp, H. sapiens
aaattagtttcattat

SEQ ID NO: 11494 - DNA, 16 bp, H. sapiens
aaattataaaactgaa

SEQ ID NO: 11495 - DNA, 16 bp, H. sapiens
aaattataaaatctgt

SEQ ID NO: 11496 - DNA, 16 bp, H. sapiens
aaattataaatcattc

SEQ ID NO: 11497 - DNA, 16 bp, H. sapiens
aaattataaatctaga

SEQ ID NO: 11498 - DNA, 16 bp, H. sapiens
aaattataaatgcaaa

SEQ ID NO: 11499 - DNA, 16 bp, H. sapiens
aaattataacaccatc

SEQ ID NO: 11500 - DNA, 16 bp, H. sapiens
aaattatactttcagt

SEQ ID NO: 11501 - DNA, 16 bp, H. sapiens
aaattatactttgaca

SEQ ID NO: 11502 - DNA, 16 bp, H. sapiens
aaattatatacatgta

SEQ ID NO: 11503 - DNA, 16 bp, H. sapiens
aaattatatcaagtat

SEQ ID NO: 11504 - DNA, 16 bp, H. sapiens
aaattatatctgaata

SEQ ID NO: 11505 - DNA, 16 bp, H. sapiens
aaattatatgaaaaca

SEQ ID NO: 11506 - DNA, 16 bp, H. sapiens
aaattatcaaaagtca

SEQ ID NO: 11507 - DNA, 16 bp, H. sapiens
aaattatcaaagaaat

SEQ ID NO: 11508 - DNA, 16 bp, H. sapiens
aaattatcagaagaaa

SEQ ID NO: 11509 - DNA, 16 bp, H. sapiens
aaattatcattgtttg

SEQ ID NO: 11510 - DNA, 16 bp, H. sapiens
aaattatcatttgaaa

SEQ ID NO: 11511 - DNA, 16 bp, H. sapiens
aaattatccagatgtg

SEQ ID NO: 11512 - DNA, 16 bp, H. sapiens
aaattatccattctca

SEQ ID NO: 11513 - DNA, 16 bp, H. sapiens
aaattatccatttcct

SEQ ID NO: 11514 - DNA, 16 bp, H. sapiens
aaattatccttcagaa

SEQ ID NO: 11515 - DNA, 16 bp, H. sapiens
aaattatctctagatt

SEQ ID NO: 11516 - DNA, 16 bp, H. sapiens
aaattatctgaaaaat

SEQ ID NO: 11517 - DNA, 16 bp, H. sapiens
aaattatctgggcata

SEQ ID NO: 11518 - DNA, 16 bp, H. sapiens
aaattatcttcaaaat

SEQ ID NO: 11519 - DNA, 16 bp, H. sapiens
aaattatcttcaattt

SEQ ID NO: 11520 - DNA, 16 bp, H. sapiens
aaattatctttttttg

SEQ ID NO: 11521 - DNA, 16 bp, H. sapiens
aaattatgaaagtatt

SEQ ID NO: 11522 - DNA, 16 bp, H. sapiens
aaattatgaaattatg

SEQ ID NO: 11523 - DNA, 16 bp, H. sapiens
aaattatgaactattt

SEQ ID NO: 11524 - DNA, 16 bp, H. sapiens
aaattatgaataaaac

SEQ ID NO: 11525 - DNA, 16 bp, H. sapiens
aaattatgacaaactg

SEQ ID NO: 11526 - DNA, 16 bp, H. sapiens
aaattatggtaatttt

SEQ ID NO: 11527 - DNA, 16 bp, H. sapiens
aaattatgttgaattt

SEQ ID NO: 11528 - DNA, 16 bp, H. sapiens
aaattatgtttcaaaa

SEQ ID NO: 11529 - DNA, 16 bp, H. sapiens
aaattatgtttcaaat

SEQ ID NO: 11530 - DNA, 16 bp, H. sapiens
aaattatgtttcagaa

SEQ ID NO: 11531 - DNA, 16 bp, H. sapiens
aaattatgttttcatt

SEQ ID NO: 11532 - DNA, 16 bp, H. sapiens
aaattatgttttctga

SEQ ID NO: 11533 - DNA, 16 bp, H. sapiens
aaattatgttttcttt

SEQ ID NO: 11534 - DNA, 16 bp, H. sapiens
aaattatgtttttctt

SEQ ID NO: 11535 - DNA, 16 bp, H. sapiens
aaattattaagcattt

SEQ ID NO: 11536 - DNA, 16 bp, H. sapiens
aaattattacaaaaag

SEQ ID NO: 11537 - DNA, 16 bp, H. sapiens
aaattattagctgggc

SEQ ID NO: 11538 - DNA, 16 bp, H. sapiens
aaattattattttggg

SEQ ID NO: 11539 - DNA, 16 bp, H. sapiens
aaattattcacatttt

SEQ ID NO: 11540 - DNA, 16 bp, H. sapiens
aaattattccaaaatt

SEQ ID NO: 11541 - DNA, 16 bp, H. sapiens
aaattattccaatcaa

SEQ ID NO: 11542 - DNA, 16 bp, H. sapiens
aaattattcctgtttt

SEQ ID NO: 11543 - DNA, 16 bp, H. sapiens
aaattattctcaaaat

SEQ ID NO: 11544 - DNA, 16 bp, H. sapiens
aaattattctgaaaaa

SEQ ID NO: 11545 - DNA, 16 bp, H. sapiens
aaattattcttcaaaa

SEQ ID NO: 11546 - DNA, 16 bp, H. sapiens
aaattattcttcataa

SEQ ID NO: 11547 - DNA, 16 bp, H. sapiens
aaattattgagatttt

SEQ ID NO: 11548 - DNA, 16 bp, H. sapiens
aaattattgtacattt

SEQ ID NO: 11549 - DNA, 16 bp, H. sapiens
aaattatttaaaactg

SEQ ID NO: 11550 - DNA, 16 bp, H. sapiens
aaattatttaacctct

SEQ ID NO: 11551 - DNA, 16 bp, H. sapiens
aaattatttaggtaga

SEQ ID NO: 11552 - DNA, 16 bp, H. sapiens
aaattatttcaaccat

SEQ ID NO: 11553 - DNA, 16 bp, H. sapiens
aaattatttcacttat

SEQ ID NO: 11554 - DNA, 16 bp, H. sapiens
aaattatttcagaaaa

SEQ ID NO: 11555 - DNA, 16 bp, H. sapiens
aaattatttcagtttt

SEQ ID NO: 11556 - DNA, 16 bp, H. sapiens
aaattatttcccactg

SEQ ID NO: 11557 - DNA, 16 bp, H. sapiens
aaattatttccttctt

SEQ ID NO: 11558 - DNA, 16 bp, H. sapiens
aaattatttctgaaaa

SEQ ID NO: 11559 - DNA, 16 bp, H. sapiens
aaattatttcttcaaa

SEQ ID NO: 11560 - DNA, 16 bp, H. sapiens
aaattatttcttcaat

SEQ ID NO: 11561 - DNA, 16 bp, H. sapiens
aaattatttgaaacaa

SEQ ID NO: 11562 - DNA, 16 bp, H. sapiens
aaattatttgaagtga

SEQ ID NO: 11563 - DNA, 16 bp, H. sapiens
aaattatttgcaaaat

SEQ ID NO: 11564 - DNA, 16 bp, H. sapiens
aaattatttgctgttt

SEQ ID NO: 11565 - DNA, 16 bp, H. sapiens
aaattatttgggaaaa

SEQ ID NO: 11566 - DNA, 16 bp, H. sapiens
aaattatttgtaaaga

SEQ ID NO: 11567 - DNA, 16 bp, H. sapiens
aaattatttgtaattc

SEQ ID NO: 11568 - DNA, 16 bp, H. sapiens
aaattatttgtagaga

SEQ ID NO: 11569 - DNA, 16 bp, H. sapiens
aaattattttaaactg

SEQ ID NO: 11570 - DNA, 16 bp, H. sapiens
aaattattttcaacct

SEQ ID NO: 11571 - DNA, 16 bp, H. sapiens
aaattattttcacaaa

SEQ ID NO: 11572 - DNA, 16 bp, H. sapiens
aaattattttccaatt

SEQ ID NO: 11573 - DNA, 16 bp, H. sapiens
aaattattttcctttc

SEQ ID NO: 11574 - DNA, 16 bp, H. sapiens
aaattattttctgcat

SEQ ID NO: 11575 - DNA, 16 bp, H. sapiens
aaattattttgctttt

SEQ ID NO: 11576 - DNA, 16 bp, H. sapiens
aaattattttgtgaat

SEQ ID NO: 11577 - DNA, 16 bp, H. sapiens
aaattatttttagaga

SEQ ID NO: 11578 - DNA, 16 bp, H. sapiens
aaattatttttagctt

SEQ ID NO: 11579 - DNA, 16 bp, H. sapiens
aaattatttttatcag

SEQ ID NO: 11580 - DNA, 16 bp, H. sapiens
aaattatttttctctg

SEQ ID NO: 11581 - DNA, 16 bp, H. sapiens
aaattatttttgaatg

SEQ ID NO: 11582 - DNA, 16 bp, H. sapiens
aaattatttttggaaa

SEQ ID NO: 11583 - DNA, 16 bp, H. sapiens
aaattatttttggaat

SEQ ID NO: 11584 - DNA, 16 bp, H. sapiens
aaattatttttgtgca

SEQ ID NO: 11585 - DNA, 16 bp, H. sapiens
aaattatttttgttct

SEQ ID NO: 11586 - DNA, 16 bp, H. sapiens
aaattcaaaacaatga

SEQ ID NO: 11587 - DNA, 16 bp, H. sapiens
aaattcaaaacaattg

SEQ ID NO: 11588 - DNA, 16 bp, H. sapiens
aaattcaaaatgattt

SEQ ID NO: 11589 - DNA, 16 bp, H. sapiens
aaattcaaaccatatc

SEQ ID NO: 11590 - DNA, 17 bp, H. sapiens
aaattcaaagtgccatt

SEQ ID NO: 11591 - DNA, 16 bp, H. sapiens
aaattcaaataaagtc

SEQ ID NO: 11592 - DNA, 16 bp, H. sapiens
aaattcaaatatgtat

SEQ ID NO: 11593 - DNA, 16 bp, H. sapiens
aaattcaaatgaattt

SEQ ID NO: 11594 - DNA, 16 bp, H. sapiens
aaattcaaatgtcagt

SEQ ID NO: 11595 - DNA, 16 bp, H. sapiens
aaattcaaattcaact

SEQ ID NO: 11596 - DNA, 16 bp, H. sapiens
aaattcaacacttgac

SEQ ID NO: 11597 - DNA, 16 bp, H. sapiens
aaattcaacagaactg

SEQ ID NO: 11598 - DNA, 16 bp, H. sapiens
aaattcaacagccatt

SEQ ID NO: 11599 - DNA, 16 bp, H. sapiens
aaattcaacattttta

SEQ ID NO: 11600 - DNA, 16 bp, H. sapiens
aaattcaagaaaaatt

SEQ ID NO: 11601 - DNA, 16 bp, H. sapiens
aaattcaagattttaa

SEQ ID NO: 11602 - DNA, 16 bp, H. sapiens
aaattcaatgaaattc

SEQ ID NO: 11603 - DNA, 16 bp, H. sapiens
aaattcaatgagataa

SEQ ID NO: 11604 - DNA, 22 bp, H. sapiens
aaattcaatggaatgtcatcct

SEQ ID NO: 11605 - DNA, 16 bp, H. sapiens
aaattcaatggagaaa

SEQ ID NO: 11606 - DNA, 16 bp, H. sapiens
aaattcacaaaaatgt

SEQ ID NO: 11607 - DNA, 16 bp, H. sapiens
aaattcacaaatacat

SEQ ID NO: 11608 - DNA, 16 bp, H. sapiens
aaattcacaattttaa

SEQ ID NO: 11609 - DNA, 24 bp, H. sapiens
aaattcacacataacgatattaac

SEQ ID NO: 11610 - DNA, 16 bp, H. sapiens
aaattcacacataaga

SEQ ID NO: 11611 - DNA, 16 bp, H. sapiens
aaattcacacatcaca

SEQ ID NO: 11612 - DNA, 16 bp, H. sapiens
aaattcacagaaaata

SEQ ID NO: 11613 - DNA, 16 bp, H. sapiens
aaattcacagagacag

SEQ ID NO: 11614 - DNA, 16 bp, H. sapiens
aaattcacataacata

SEQ ID NO: 11615 - DNA, 16 bp, H. sapiens
aaattcacatataatt

SEQ ID NO: 11616 - DNA, 16 bp, H. sapiens
aaattcacccctgata

SEQ ID NO: 11617 - DNA, 16 bp, H. sapiens
aaattcaccttttaaa

SEQ ID NO: 11618 - DNA, 16 bp, H. sapiens
aaattcacttatgttt

SEQ ID NO: 11619 - DNA, 16 bp, H. sapiens
aaattcacttttcttt

SEQ ID NO: 11620 - DNA, 16 bp, H. sapiens
aaattcagaaaaattt

SEQ ID NO: 11621 - DNA, 16 bp, H. sapiens
aaattcagaaaattca

SEQ ID NO: 11622 - DNA, 16 bp, H. sapiens
aaattcagaaataaag

SEQ ID NO: 11623 - DNA, 16 bp, H. sapiens
aaattcagaagaaaat

SEQ ID NO: 11624 - DNA, 16 bp, H. sapiens
aaattcagaaggaaat

SEQ ID NO: 11625 - DNA, 16 bp, H. sapiens
aaattcagaataaatt

SEQ ID NO: 11626 - DNA, 16 bp, H. sapiens
aaattcagaatttaaa

SEQ ID NO: 11627 - DNA, 16 bp, H. sapiens
aaattcagaattttat

SEQ ID NO: 11628 - DNA, 16 bp, H. sapiens
aaattcagagaaaata

SEQ ID NO: 11629 - DNA, 16 bp, H. sapiens
aaattcagagagaaaa

SEQ ID NO: 11630 - DNA, 16 bp, H. sapiens
aaattcagagagacag

SEQ ID NO: 11631 - DNA, 16 bp, H. sapiens
aaattcagatgttgaa

SEQ ID NO: 11632 - DNA, 16 bp, H. sapiens
aaattcagattttctt

SEQ ID NO: 11633 - DNA, 16 bp, H. sapiens
aaattcagcaaagtct

SEQ ID NO: 11634 - DNA, 16 bp, H. sapiens
aaattcagcaaatatt

SEQ ID NO: 11635 - DNA, 16 bp, H. sapiens
aaattcagcaatgaag

SEQ ID NO: 11636 - DNA, 16 bp, H. sapiens
aaattcaggaaacttt

SEQ ID NO: 11637 - DNA, 16 bp, H. sapiens
aaattcaggaaatgaa

SEQ ID NO: 11638 - DNA, 16 bp, H. sapiens
aaattcaggaaatgta

SEQ ID NO: 11639 - DNA, 16 bp, H. sapiens
aaattcaggaaattta

SEQ ID NO: 11640 - DNA, 16 bp, H. sapiens
aaattcagggaaaaaa

SEQ ID NO: 11641 - DNA, 16 bp, H. sapiens
aaattcagggaataca

SEQ ID NO: 11642 - DNA, 16 bp, H. sapiens
aaattcagtatttctt

SEQ ID NO: 11643 - DNA, 16 bp, H. sapiens
aaattcagttccttgg

SEQ ID NO: 11644 - DNA, 16 bp, H. sapiens
aaattcagtttaaaaa

SEQ ID NO: 11645 - DNA, 16 bp, H. sapiens
aaattcagttttatat

SEQ ID NO: 11646 - DNA, 16 bp, H. sapiens
aaattcatagaaaata

SEQ ID NO: 11647 - DNA, 16 bp, H. sapiens
aaattcatatggaaga

SEQ ID NO: 11648 - DNA, 16 bp, H. sapiens
aaattcatatgttgaa

SEQ ID NO: 11649 - DNA, 16 bp, H. sapiens
aaattcatgaagaaat

SEQ ID NO: 11650 - DNA, 16 bp, H. sapiens
aaattcatgtattgaa

SEQ ID NO: 11651 - DNA, 16 bp, H. sapiens
aaattcatgtttttct

SEQ ID NO: 11652 - DNA, 16 bp, H. sapiens
aaattcattaaaatgt

SEQ ID NO: 11653 - DNA, 16 bp, H. sapiens
aaattcattaaagaaa

SEQ ID NO: 11654 - DNA, 16 bp, H. sapiens
aaattcatttatttca

SEQ ID NO: 11655 - DNA, 16 bp, H. sapiens
aaattcatttcagcat

SEQ ID NO: 11656 - DNA, 16 bp, H. sapiens
aaattcatttgcaaat

SEQ ID NO: 11657 - DNA, 16 bp, H. sapiens
aaattcatttgtgttt

SEQ ID NO: 11658 - DNA, 16 bp, H. sapiens
aaattcattttaagaa

SEQ ID NO: 11659 - DNA, 16 bp, H. sapiens
aaattcattttacaaa

SEQ ID NO: 11660 - DNA, 16 bp, H. sapiens
aaattccaaaacacat

SEQ ID NO: 11661 - DNA, 16 bp, H. sapiens
aaattccaaattttta

SEQ ID NO: 11662 - DNA, 17 bp, H. sapiens
aaattccaaccaagaat

SEQ ID NO: 11663 - DNA, 16 bp, H. sapiens
aaattccaccaaacat

SEQ ID NO: 11664 - DNA, 16 bp, H. sapiens
aaattccagaaagaaa

SEQ ID NO: 11665 - DNA, 16 bp, H. sapiens
aaattccagcctggca

SEQ ID NO: 11666 - DNA, 16 bp, H. sapiens
aaattccaggccaggc

SEQ ID NO: 11667 - DNA, 16 bp, H. sapiens
aaattccatttacaat

SEQ ID NO: 11668 - DNA, 16 bp, H. sapiens
aaattccattttgaaa

SEQ ID NO: 11669 - DNA, 16 bp, H. sapiens
aaattccatttttaaa

SEQ ID NO: 11670 - DNA, 16 bp, H. sapiens
aaattccatttttctc

SEQ ID NO: 11671 - DNA, 16 bp, H. sapiens
aaattcccaaatacat

SEQ ID NO: 11672 - DNA, 16 bp, H. sapiens
aaattccccaacctag

SEQ ID NO: 11673 - DNA, 16 bp, H. sapiens
aaattcctaaaatatt

SEQ ID NO: 11674 - DNA, 16 bp, H. sapiens
aaattcctatgttaaa

SEQ ID NO: 11675 - DNA, 16 bp, H. sapiens
aaattcctatttaaaa

SEQ ID NO: 11676 - DNA, 16 bp, H. sapiens
aaattcctctctttat

SEQ ID NO: 11677 - DNA, 16 bp, H. sapiens
aaattcctctgtgctc

SEQ ID NO: 11678 - DNA, 16 bp, H. sapiens
aaattcctgaaaatat

SEQ ID NO: 11679 - DNA, 16 bp, H. sapiens
aaattcctgagttcaa

SEQ ID NO: 11680 - DNA, 16 bp, H. sapiens
aaattcctgggttcaa

SEQ ID NO: 11681 - DNA, 16 bp, H. sapiens
aaattcctgttccctg

SEQ ID NO: 11682 - DNA, 16 bp, H. sapiens
aaattccttaaaatat

SEQ ID NO: 11683 - DNA, 16 bp, H. sapiens
aaattccttaacttct

SEQ ID NO: 11684 - DNA, 16 bp, H. sapiens
aaattccttctcctgg

SEQ ID NO: 11685 - DNA, 16 bp, H. sapiens
aaattccttgagggca

SEQ ID NO: 11686 - DNA, 16 bp, H. sapiens
aaattccttgtgggcc

SEQ ID NO: 11687 - DNA, 16 bp, H. sapiens
aaattcctttctcatt

SEQ ID NO: 11688 - DNA, 16 bp, H. sapiens
aaattccttttccttt

SEQ ID NO: 11689 - DNA, 16 bp, H. sapiens
aaattctaaagaaaat

SEQ ID NO: 11690 - DNA, 16 bp, H. sapiens
aaattctaagaataaa

SEQ ID NO: 11691 - DNA, 16 bp, H. sapiens
aaattctaaggaatct

SEQ ID NO: 11692 - DNA, 16 bp, H. sapiens
aaattctaatttaact

SEQ ID NO: 11693 - DNA, 16 bp, H. sapiens
aaattctagaagacaa

SEQ ID NO: 11694 - DNA, 16 bp, H. sapiens
aaattctagaattgaa

SEQ ID NO: 11695 - DNA, 16 bp, H. sapiens
aaattctataaagaaa

SEQ ID NO: 11696 - DNA, 16 bp, H. sapiens
aaattctcaaagaaaa

SEQ ID NO: 11697 - DNA, 16 bp, H. sapiens
aaattctcaaagaaat

SEQ ID NO: 11698 - DNA, 16 bp, H. sapiens
aaattctcaacaaact

SEQ ID NO: 11699 - DNA, 16 bp, H. sapiens
aaattctcaacagaat

SEQ ID NO: 11700 - DNA, 16 bp, H. sapiens
aaattctcaatgaaat

SEQ ID NO: 11701 - DNA, 16 bp, H. sapiens
aaattctcagaaaaat

SEQ ID NO: 11702 - DNA, 16 bp, H. sapiens
aaattctcagaaaaca

SEQ ID NO: 11703 - DNA, 16 bp, H. sapiens
aaattctcagaagaaa

SEQ ID NO: 11704 - DNA, 16 bp, H. sapiens
aaattctcaggcccca

SEQ ID NO: 11705 - DNA, 16 bp, H. sapiens
aaattctcagtcatta

SEQ ID NO: 11706 - DNA, 16 bp, H. sapiens
aaattctcatcagatg

SEQ ID NO: 11707 - DNA, 16 bp, H. sapiens
aaattctcatttaaat

SEQ ID NO: 11708 - DNA, 16 bp, H. sapiens
aaattctccagtgaaa

SEQ ID NO: 11709 - DNA, 16 bp, H. sapiens
aaattctccttaaaaa

SEQ ID NO: 11710 - DNA, 16 bp, H. sapiens
aaattctctcagtttt

SEQ ID NO: 11711 - DNA, 16 bp, H. sapiens
aaattctcttcatttt

SEQ ID NO: 11712 - DNA, 16 bp, H. sapiens
aaattctcttttattg

SEQ ID NO: 11713 - DNA, 16 bp, H. sapiens
aaattctcttttttgg

SEQ ID NO: 11714 - DNA, 16 bp, H. sapiens
aaattctgaaataaaa

SEQ ID NO: 11715 - DNA, 16 bp, H. sapiens
aaattctgaagaaaaa

SEQ ID NO: 11716 - DNA, 16 bp, H. sapiens
aaattctgaagttaaa

SEQ ID NO: 11717 - DNA, 16 bp, H. sapiens
aaattctgaataaaat

SEQ ID NO: 11718 - DNA, 16 bp, H. sapiens
aaattctgacacattc

SEQ ID NO: 11719 - DNA, 16 bp, H. sapiens
aaattctgagaaaaat

SEQ ID NO: 11720 - DNA, 16 bp, H. sapiens
aaattctgagagaaaa

SEQ ID NO: 11721 - DNA, 16 bp, H. sapiens
aaattctgagatttta

SEQ ID NO: 11722 - DNA, 16 bp, H. sapiens
aaattctgatacatgc

SEQ ID NO: 11723 - DNA, 16 bp, H. sapiens
aaattctgattttaaa

SEQ ID NO: 11724 - DNA, 16 bp, H. sapiens
aaattctggaaagaaa

SEQ ID NO: 11725 - DNA, 16 bp, H. sapiens
aaattctggaattaca

SEQ ID NO: 11726 - DNA, 16 bp, H. sapiens
aaattctggaattgaa

SEQ ID NO: 11727 - DNA, 16 bp, H. sapiens
aaattctggagaaaat

SEQ ID NO: 11728 - DNA, 16 bp, H. sapiens
aaattctgggattaca

SEQ ID NO: 11729 - DNA, 16 bp, H. sapiens
aaattctgtatttatt

SEQ ID NO: 11730 - DNA, 16 bp, H. sapiens
aaattctgtattttta

SEQ ID NO: 11731 - DNA, 16 bp, H. sapiens
aaattctgtctcaaaa

SEQ ID NO: 11732 - DNA, 16 bp, H. sapiens
aaattctgttttaaat

SEQ ID NO: 11733 - DNA, 16 bp, H. sapiens
aaattctgttttatct

SEQ ID NO: 11734 - DNA, 16 bp, H. sapiens
aaattctgtttttcta

SEQ ID NO: 11735 - DNA, 16 bp, H. sapiens
aaattcttaaaatgaa

SEQ ID NO: 11736 - DNA, 16 bp, H. sapiens
aaattcttaatcattt

SEQ ID NO: 11737 - DNA, 16 bp, H. sapiens
aaattcttaggaaaaa

SEQ ID NO: 11738 - DNA, 16 bp, H. sapiens
aaattcttatccattc

SEQ ID NO: 11739 - DNA, 18 bp, H. sapiens
aaattcttatctctgtat

SEQ ID NO: 11740 - DNA, 16 bp, H. sapiens
aaattcttatgttgaa

SEQ ID NO: 11741 - DNA, 16 bp, H. sapiens
aaattcttatttttgt

SEQ ID NO: 11742 - DNA, 16 bp, H. sapiens
aaattcttcaacaaaa

SEQ ID NO: 11743 - DNA, 16 bp, H. sapiens
aaattcttcccttccc

SEQ ID NO: 11744 - DNA, 16 bp, H. sapiens
aaattcttcctctttt

SEQ ID NO: 11745 - DNA, 16 bp, H. sapiens
aaattcttctctgccc

SEQ ID NO: 11746 - DNA, 16 bp, H. sapiens
aaattcttctctttgt

SEQ ID NO: 11747 - DNA, 16 bp, H. sapiens
aaattcttgaaaatat

SEQ ID NO: 11748 - DNA, 16 bp, H. sapiens
aaattcttgaagtgag

SEQ ID NO: 11749 - DNA, 16 bp, H. sapiens
aaattcttggaaatat

SEQ ID NO: 11750 - DNA, 16 bp, H. sapiens
aaattcttggctggta

SEQ ID NO: 11751 - DNA, 16 bp, H. sapiens
aaattcttgtttggaa

SEQ ID NO: 11752 - DNA, 16 bp, H. sapiens
aaattctttacagaaa

SEQ ID NO: 11753 - DNA, 16 bp, H. sapiens
aaattctttcagattt

SEQ ID NO: 11754 - DNA, 16 bp, H. sapiens
aaattctttccaaatt

SEQ ID NO: 11755 - DNA, 16 bp, H. sapiens
aaattctttgaaacca

SEQ ID NO: 11756 - DNA, 16 bp, H. sapiens
aaattctttgacactc

SEQ ID NO: 11757 - DNA, 16 bp, H. sapiens
aaattctttgccaaag

SEQ ID NO: 11758 - DNA, 16 bp, H. sapiens
aaattctttgtaaatt

SEQ ID NO: 11759 - DNA, 16 bp, H. sapiens
aaattcttttccttaa

SEQ ID NO: 11760 - DNA, 16 bp, H. sapiens
aaattcttttggattt

SEQ ID NO: 11761 - DNA, 16 bp, H. sapiens
aaattgaaaaacattc

SEQ ID NO: 11762 - DNA, 16 bp, H. sapiens
aaattgaaaaatattc

SEQ ID NO: 11763 - DNA, 16 bp, H. sapiens
aaattgaaaacctgaa

SEQ ID NO: 11764 - DNA, 16 bp, H. sapiens
aaattgaaaaccttct

SEQ ID NO: 11765 - DNA, 16 bp, H. sapiens
aaattgaaaactttta

SEQ ID NO: 11766 - DNA, 16 bp, H. sapiens
aaattgaaaacttttt

SEQ ID NO: 11767 - DNA, 16 bp, H. sapiens
aaattgaaaatctgaa

SEQ ID NO: 11768 - DNA, 16 bp, H. sapiens
aaattgaaaattcagt

SEQ ID NO: 11769 - DNA, 16 bp, H. sapiens
aaattgaaacaaatga

SEQ ID NO: 11770 - DNA, 16 bp, H. sapiens
aaattgaaacaggaaa

SEQ ID NO: 11771 - DNA, 16 bp, H. sapiens
aaattgaaactctgta

SEQ ID NO: 11772 - DNA, 16 bp, H. sapiens
aaattgaaagaatttt

SEQ ID NO: 11773 - DNA, 16 bp, H. sapiens
aaattgaaagcttttt

SEQ ID NO: 11774 - DNA, 16 bp, H. sapiens
aaattgaaagtagttt

SEQ ID NO: 11775 - DNA, 16 bp, H. sapiens
aaattgaaatcctgaa

SEQ ID NO: 11776 - DNA, 16 bp, H. sapiens
aaattgaaatggaaga

SEQ ID NO: 11777 - DNA, 16 bp, H. sapiens
aaattgaacaattttt

SEQ ID NO: 11778 - DNA, 16 bp, H. sapiens
aaattgaacatttaaa

SEQ ID NO: 11779 - DNA, 16 bp, H. sapiens
aaattgaacattttat

SEQ ID NO: 11780 - DNA, 16 bp, H. sapiens
aaattgaagacataaa

SEQ ID NO: 11781 - DNA, 16 bp, H. sapiens
aaattgaagatttgtg

SEQ ID NO: 11782 - DNA, 16 bp, H. sapiens
aaattgaagcagtaat

SEQ ID NO: 11783 - DNA, 16 bp, H. sapiens
aaattgaaggagaaat

SEQ ID NO: 11784 - DNA, 16 bp, H. sapiens
aaattgaagtgaaatt

SEQ ID NO: 11785 - DNA, 16 bp, H. sapiens
aaattgaatcagtagt

SEQ ID NO: 11786 - DNA, 16 bp, H. sapiens
aaattgaattgttttc

SEQ ID NO: 11787 - DNA, 16 bp, H. sapiens
aaattgacaaaataat

SEQ ID NO: 11788 - DNA, 16 bp, H. sapiens
aaattgacaaatgggg

SEQ ID NO: 11789 - DNA, 16 bp, H. sapiens
aaattgacaagctgat

SEQ ID NO: 11790 - DNA, 16 bp, H. sapiens
aaattgacatatttta

SEQ ID NO: 11791 - DNA, 16 bp, H. sapiens
aaattgacccttctgg

SEQ ID NO: 11792 - DNA, 16 bp, H. sapiens
aaattgactgagactt

SEQ ID NO: 11793 - DNA, 16 bp, H. sapiens
aaattgacttaaaaat

SEQ ID NO: 11794 - DNA, 16 bp, H. sapiens
aaattgagaaaacaat

SEQ ID NO: 11795 - DNA, 16 bp, H. sapiens
aaattgagattcagag

SEQ ID NO: 11796 - DNA, 16 bp, H. sapiens
aaattgagcagaaaat

SEQ ID NO: 11797 - DNA, 16 bp, H. sapiens
aaattgaggcacagaa

SEQ ID NO: 11798 - DNA, 16 bp, H. sapiens
aaattgataaattctt

SEQ ID NO: 11799 - DNA, 16 bp, H. sapiens
aaattgataaattgta

SEQ ID NO: 11800 - DNA, 16 bp, H. sapiens
aaattgatagcactaa

SEQ ID NO: 11801 - DNA, 16 bp, H. sapiens
aaattgatatgttgaa

SEQ ID NO: 11802 - DNA, 16 bp, H. sapiens
aaattgatcaagcaga

SEQ ID NO: 11803 - DNA, 16 bp, H. sapiens
aaattgatcatttaaa

SEQ ID NO: 11804 - DNA, 16 bp, H. sapiens
aaattgattaaaatgt

SEQ ID NO: 11805 - DNA, 16 bp, H. sapiens
aaattgattattttct

SEQ ID NO: 11806 - DNA, 16 bp, H. sapiens
aaattgattctttgaa

SEQ ID NO: 11807 - DNA, 16 bp, H. sapiens
aaattgatttcatgac

SEQ ID NO: 11808 - DNA, 16 bp, H. sapiens
aaattgattttcattt

SEQ ID NO: 11809 - DNA, 16 bp, H. sapiens
aaattgattttctttt

SEQ ID NO: 11810 - DNA, 16 bp, H. sapiens
aaattgattttgaaaa

SEQ ID NO: 11811 - DNA, 16 bp, H. sapiens
aaattgcaaagaaaat

SEQ ID NO: 11812 - DNA, 16 bp, H. sapiens
aaattgcatgttgcag

SEQ ID NO: 11813 - DNA, 16 bp, H. sapiens
aaattgcattttaatt

SEQ ID NO: 11814 - DNA, 16 bp, H. sapiens
aaattgcattttgttt

SEQ ID NO: 11815 - DNA, 16 bp, H. sapiens
aaattgccaaaacaaa

SEQ ID NO: 11816 - DNA, 16 bp, H. sapiens
aaattgccacagtcac

SEQ ID NO: 11817 - DNA, 17 bp, H. sapiens
aaattgccttgctgaga

SEQ ID NO: 11818 - DNA, 16 bp, H. sapiens
aaattgctaagagatt

SEQ ID NO: 11819 - DNA, 16 bp, H. sapiens
aaattgctgagattat

SEQ ID NO: 11820 - DNA, 17 bp, H. sapiens
aaattgctggaattaca

SEQ ID NO: 11821 - DNA, 16 bp, H. sapiens
aaattgcttaacttct

SEQ ID NO: 11822 - DNA, 16 bp, H. sapiens
aaattgcttctggtgg

SEQ ID NO: 11823 - DNA, 16 bp, H. sapiens
aaattgcttgagcctg

SEQ ID NO: 11824 - DNA, 16 bp, H. sapiens
aaattgctttgtgatg

SEQ ID NO: 11825 - DNA, 16 bp, H. sapiens
aaattgcttttatttt

SEQ ID NO: 11826 - DNA, 16 bp, H. sapiens
aaattgcttttgaaaa

SEQ ID NO: 11827 - DNA, 16 bp, H. sapiens
aaattggaaaatatag

SEQ ID NO: 11828 - DNA, 16 bp, H. sapiens
aaattggaaaatctgg

SEQ ID NO: 11829 - DNA, 16 bp, H. sapiens
aaattggaaatcacca

SEQ ID NO: 11830 - DNA, 16 bp, H. sapiens
aaattggaactcttgt

SEQ ID NO: 11831 - DNA, 16 bp, H. sapiens
aaattggaatttgaaa

SEQ ID NO: 11832 - DNA, 16 bp, H. sapiens
aaattggacttcacct

SEQ ID NO: 11833 - DNA, 16 bp, H. sapiens
aaattggacttcatca

SEQ ID NO: 11834 - DNA, 16 bp, H. sapiens
aaattggagaaaattt

SEQ ID NO: 11835 - DNA, 16 bp, H. sapiens
aaattggataaggagt

SEQ ID NO: 11836 - DNA, 16 bp, H. sapiens
aaattggcaaatattt

SEQ ID NO: 11837 - DNA, 16 bp, H. sapiens
aaattggcacagccat

SEQ ID NO: 11838 - DNA, 16 bp, H. sapiens
aaattggccagaagcc

SEQ ID NO: 11839 - DNA, 16 bp, H. sapiens
aaattggcctaaacaa

SEQ ID NO: 11840 - DNA, 16 bp, H. sapiens
aaattgggcaaaggat

SEQ ID NO: 11841 - DNA, 16 bp, H. sapiens
aaattggtatttttct

SEQ ID NO: 11842 - DNA, 16 bp, H. sapiens
aaattggtcaaaacaa

SEQ ID NO: 11843 - DNA, 16 bp, H. sapiens
aaattggtttcattct

SEQ ID NO: 11844 - DNA, 16 bp, H. sapiens
aaattgtaaaactact

SEQ ID NO: 11845 - DNA, 16 bp, H. sapiens
aaattgtaaaatacat

SEQ ID NO: 11846 - DNA, 16 bp, H. sapiens
aaattgtaaaatgtta

SEQ ID NO: 11847 - DNA, 16 bp, H. sapiens
aaattgtaaattgaca

SEQ ID NO: 11848 - DNA, 16 bp, H. sapiens
aaattgtactttttaa

SEQ ID NO: 11849 - DNA, 16 bp, H. sapiens
aaattgtagcaataat

SEQ ID NO: 11850 - DNA, 16 bp, H. sapiens
aaattgtagttttaaa

SEQ ID NO: 11851 - DNA, 16 bp, H. sapiens
aaattgtatacatttt

SEQ ID NO: 11852 - DNA, 16 bp, H. sapiens
aaattgtatatattgt

SEQ ID NO: 11853 - DNA, 16 bp, H. sapiens
aaattgtatatgttta

SEQ ID NO: 11854 - DNA, 16 bp, H. sapiens
aaattgtatgcaaaat

SEQ ID NO: 11855 - DNA, 16 bp, H. sapiens
aaattgtatttactta

SEQ ID NO: 11856 - DNA, 16 bp, H. sapiens
aaattgtatttcaaaa

SEQ ID NO: 11857 - DNA, 16 bp, H. sapiens
aaattgtcaaggtcat

SEQ ID NO: 11858 - DNA, 16 bp, H. sapiens
aaattgtcattatttt

SEQ ID NO: 11859 - DNA, 16 bp, H. sapiens
aaattgtcatttttgt

SEQ ID NO: 11860 - DNA, 16 bp, H. sapiens
aaattgtccctttttg

SEQ ID NO: 11861 - DNA, 16 bp, H. sapiens
aaattgtctctatttt

SEQ ID NO: 11862 - DNA, 16 bp, H. sapiens
aaattgtcttccaaaa

SEQ ID NO: 11863 - DNA, 16 bp, H. sapiens
aaattgtcttctacaa

SEQ ID NO: 11864 - DNA, 16 bp, H. sapiens
aaattgtctttaaaaa

SEQ ID NO: 11865 - DNA, 16 bp, H. sapiens
aaattgtctttttttg

SEQ ID NO: 11866 - DNA, 16 bp, H. sapiens
aaattgtgaagaagga

SEQ ID NO: 11867 - DNA, 16 bp, H. sapiens
aaattgtgagggaggt

SEQ ID NO: 11868 - DNA, 16 bp, H. sapiens
aaattgtgatattttg

SEQ ID NO: 11869 - DNA, 16 bp, H. sapiens
aaattgtgattttaaa

SEQ ID NO: 11870 - DNA, 16 bp, H. sapiens
aaattgtgctttaaaa

SEQ ID NO: 11871 - DNA, 16 bp, H. sapiens
aaattgtgtatattca

SEQ ID NO: 11872 - DNA, 16 bp, H. sapiens
aaattgtgttaaaata

SEQ ID NO: 11873 - DNA, 16 bp, H. sapiens
aaattgttacatttta

SEQ ID NO: 11874 - DNA, 16 bp, H. sapiens
aaattgttatatctac

SEQ ID NO: 11875 - DNA, 16 bp, H. sapiens
aaattgttcaaaaata

SEQ ID NO: 11876 - DNA, 16 bp, H. sapiens
aaattgttcctctttg

SEQ ID NO: 11877 - DNA, 16 bp, H. sapiens
aaattgttctttattt

SEQ ID NO: 11878 - DNA, 16 bp, H. sapiens
aaattgttgggattat

SEQ ID NO: 11879 - DNA, 16 bp, H. sapiens
aaattgtttagaattt

SEQ ID NO: 11880 - DNA, 16 bp, H. sapiens
aaattgtttatagaga

SEQ ID NO: 11881 - DNA, 16 bp, H. sapiens
aaattgtttcttcttt

SEQ ID NO: 11882 - DNA, 16 bp, H. sapiens
aaattgttttagaaaa

SEQ ID NO: 11883 - DNA, 16 bp, H. sapiens
aaattgttttatcttt

SEQ ID NO: 11884 - DNA, 16 bp, H. sapiens
aaattgttttatttct

SEQ ID NO: 11885 - DNA, 16 bp, H. sapiens
aaattgttttcaaaga

SEQ ID NO: 11886 - DNA, 16 bp, H. sapiens
aaattgttttctatat

SEQ ID NO: 11887 - DNA, 16 bp, H. sapiens
aaattgttttctcatt

SEQ ID NO: 11888 - DNA, 16 bp, H. sapiens
aaattgttttctgaaa

SEQ ID NO: 11889 - DNA, 16 bp, H. sapiens
aaattgttttcttaat

SEQ ID NO: 11890 - DNA, 16 bp, H. sapiens
aaattgttttgaaaaa

SEQ ID NO: 11891 - DNA, 16 bp, H. sapiens
aaattgttttgtaaaa

SEQ ID NO: 11892 - DNA, 16 bp, H. sapiens
aaattgtttttacttt

SEQ ID NO: 11893 - DNA, 16 bp, H. sapiens
aaattgtttttgcttt

SEQ ID NO: 11894 - DNA, 16 bp, H. sapiens
aaatttaaaaacactg

SEQ ID NO: 11895 - DNA, 16 bp, H. sapiens
aaatttaaaaagcagt

SEQ ID NO: 11896 - DNA, 16 bp, H. sapiens
aaatttaaaaattcag

SEQ ID NO: 11897 - DNA, 16 bp, H. sapiens
aaatttaaaacaatga

SEQ ID NO: 11898 - DNA, 16 bp, H. sapiens
aaatttaaaacacagt

SEQ ID NO: 11899 - DNA, 16 bp, H. sapiens
aaatttaaaaccattt

SEQ ID NO: 11900 - DNA, 16 bp, H. sapiens
aaatttaaaactttgt

SEQ ID NO: 11901 - DNA, 16 bp, H. sapiens
aaatttaaaagttttg

SEQ ID NO: 11902 - DNA, 16 bp, H. sapiens
aaatttaaaatcactt

SEQ ID NO: 11903 - DNA, 16 bp, H. sapiens
aaatttaaaatgcatt

SEQ ID NO: 11904 - DNA, 16 bp, H. sapiens
aaatttaaacaaagag

SEQ ID NO: 11905 - DNA, 16 bp, H. sapiens
aaatttaaacagtaaa

SEQ ID NO: 11906 - DNA, 16 bp, H. sapiens
aaatttaaacagtttt

SEQ ID NO: 11907 - DNA, 16 bp, H. sapiens
aaatttaaagacaaat

SEQ ID NO: 11908 - DNA, 16 bp, H. sapiens
aaatttaaagtgctac

SEQ ID NO: 11909 - DNA, 16 bp, H. sapiens
aaatttaaagtgtttt

SEQ ID NO: 11910 - DNA, 16 bp, H. sapiens
aaatttaaagttttct

SEQ ID NO: 11911 - DNA, 16 bp, H. sapiens
aaatttaaatagctac

SEQ ID NO: 11912 - DNA, 16 bp, H. sapiens
aaatttaaatgcaaat

SEQ ID NO: 11913 - DNA, 16 bp, H. sapiens
aaatttaaatgtatgt

SEQ ID NO: 11914 - DNA, 16 bp, H. sapiens
aaatttaaatttcaga

SEQ ID NO: 11915 - DNA, 16 bp, H. sapiens
aaatttaagaaaatca

SEQ ID NO: 11916 - DNA, 16 bp, H. sapiens
aaatttaagtttcaaa

SEQ ID NO: 11917 - DNA, 16 bp, H. sapiens
aaatttacaaggaaaa

SEQ ID NO: 11918 - DNA, 16 bp, H. sapiens
aaatttacagaaaagt

SEQ ID NO: 11919 - DNA, 17 bp, H. sapiens
aaatttacagcactaaa

SEQ ID NO: 11920 - DNA, 16 bp, H. sapiens
aaatttacataaatgt

SEQ ID NO: 11921 - DNA, 16 bp, H. sapiens
aaatttacatgaaaaa

SEQ ID NO: 11922 - DNA, 16 bp, H. sapiens
aaatttaccatcttaa

SEQ ID NO: 11923 - DNA, 16 bp, H. sapiens
aaatttacctacagcc

SEQ ID NO: 11924 - DNA, 16 bp, H. sapiens
aaatttacctgtagcc

SEQ ID NO: 11925 - DNA, 16 bp, H. sapiens
aaatttacctttctct

SEQ ID NO: 11926 - DNA, 16 bp, H. sapiens
aaatttactgaattta

SEQ ID NO: 11927 - DNA, 16 bp, H. sapiens
aaatttactgtcttaa

SEQ ID NO: 11928 - DNA, 16 bp, H. sapiens
aaatttacttaaaatg

SEQ ID NO: 11929 - DNA, 16 bp, H. sapiens
aaatttacttgaaaat

SEQ ID NO: 11930 - DNA, 16 bp, H. sapiens
aaatttactttcttaa

SEQ ID NO: 11931 - DNA, 16 bp, H. sapiens
aaatttagaagaaatg

SEQ ID NO: 11932 - DNA, 16 bp, H. sapiens
aaatttagacacagaa

SEQ ID NO: 11933 - DNA, 16 bp, H. sapiens
aaatttagcaacttaa

SEQ ID NO: 11934 - DNA, 16 bp, H. sapiens
aaatttagctaggcat

SEQ ID NO: 11935 - DNA, 16 bp, H. sapiens
aaatttaggaaaattt

SEQ ID NO: 11936 - DNA, 16 bp, H. sapiens
aaatttagtgagaaga

SEQ ID NO: 11937 - DNA, 20 bp, H. sapiens
aaatttatagcactaaatgt

SEQ ID NO: 11938 - DNA, 17 bp, H. sapiens
aaatttatagcgctaaa

SEQ ID NO: 11939 - DNA, 16 bp, H. sapiens
aaatttatatcttcag

SEQ ID NO: 11940 - DNA, 16 bp, H. sapiens
aaatttatatgttgaa

SEQ ID NO: 11941 - DNA, 16 bp, H. sapiens
aaatttatcaaagaaa

SEQ ID NO: 11942 - DNA, 16 bp, H. sapiens
aaatttatcaagggct

SEQ ID NO: 11943 - DNA, 16 bp, H. sapiens
aaatttatccagaaaa

SEQ ID NO: 11944 - DNA, 16 bp, H. sapiens
aaatttatctgataga

SEQ ID NO: 11945 - DNA, 16 bp, H. sapiens
aaatttatctttcaaa

SEQ ID NO: 11946 - DNA, 16 bp, H. sapiens
aaatttatggggaaga

SEQ ID NO: 11947 - DNA, 16 bp, H. sapiens
aaatttatgtgaaaat

SEQ ID NO: 11948 - DNA, 16 bp, H. sapiens
aaatttatttaatgtg

SEQ ID NO: 11949 - DNA, 16 bp, H. sapiens
aaatttatttaccata

SEQ ID NO: 11950 - DNA, 16 bp, H. sapiens
aaatttatttcctaat

SEQ ID NO: 11951 - DNA, 16 bp, H. sapiens
aaatttatttggaacc

SEQ ID NO: 11952 - DNA, 16 bp, H. sapiens
aaatttattttccaaa

SEQ ID NO: 11953 - DNA, 16 bp, H. sapiens
aaatttattttcccaa

SEQ ID NO: 11954 - DNA, 16 bp, H. sapiens
aaatttattttgctta

SEQ ID NO: 11955 - DNA, 16 bp, H. sapiens
aaatttcaaaagaaat

SEQ ID NO: 11956 - DNA, 16 bp, H. sapiens
aaatttcaaaatgaat

SEQ ID NO: 11957 - DNA, 16 bp, H. sapiens
aaatttcaaaattttg

SEQ ID NO: 11958 - DNA, 16 bp, H. sapiens
aaatttcaaagaactg

SEQ ID NO: 11959 - DNA, 16 bp, H. sapiens
aaatttcaaaggaaat

SEQ ID NO: 11960 - DNA, 16 bp, H. sapiens
aaatttcaaattttgg

SEQ ID NO: 11961 - DNA, 16 bp, H. sapiens
aaatttcaacatccct

SEQ ID NO: 11962 - DNA, 16 bp, H. sapiens
aaatttcaagaggaaa

SEQ ID NO: 11963 - DNA, 16 bp, H. sapiens
aaatttcaaggaaaaa

SEQ ID NO: 11964 - DNA, 16 bp, H. sapiens
aaatttcaatatgaaa

SEQ ID NO: 11965 - DNA, 16 bp, H. sapiens
aaatttcaatgtccat

SEQ ID NO: 11966 - DNA, 16 bp, H. sapiens
aaatttcaattcaaat

SEQ ID NO: 11967 - DNA, 16 bp, H. sapiens
aaatttcacatttttc

SEQ ID NO: 11968 - DNA, 16 bp, H. sapiens
aaatttcactgaaaaa

SEQ ID NO: 11969 - DNA, 16 bp, H. sapiens
aaatttcagaaaaaca

SEQ ID NO: 11970 - DNA, 16 bp, H. sapiens
aaatttcagaaaatat

SEQ ID NO: 11971 - DNA, 16 bp, H. sapiens
aaatttcagaaaatta

SEQ ID NO: 11972 - DNA, 16 bp, H. sapiens
aaatttcagaagaaaa

SEQ ID NO: 11973 - DNA, 16 bp, H. sapiens
aaatttcagaaggaaa

SEQ ID NO: 11974 - DNA, 16 bp, H. sapiens
aaatttcagaagtttt

SEQ ID NO: 11975 - DNA, 16 bp, H. sapiens
aaatttcagaatatat

SEQ ID NO: 11976 - DNA, 16 bp, H. sapiens
aaatttcaggaagaaa

SEQ ID NO: 11977 - DNA, 16 bp, H. sapiens
aaatttcaggattgtt

SEQ ID NO: 11978 - DNA, 16 bp, H. sapiens
aaatttcagtttctct

SEQ ID NO: 11979 - DNA, 16 bp, H. sapiens
aaatttcagtttgaaa

SEQ ID NO: 11980 - DNA, 16 bp, H. sapiens
aaatttcagttttaaa

SEQ ID NO: 11981 - DNA, 16 bp, H. sapiens
aaatttcataaatgaa

SEQ ID NO: 11982 - DNA, 16 bp, H. sapiens
aaatttcatatttcat

SEQ ID NO: 11983 - DNA, 16 bp, H. sapiens
aaatttcatgaaaaat

SEQ ID NO: 11984 - DNA, 16 bp, H. sapiens
aaatttcatgaaaata

SEQ ID NO: 11985 - DNA, 16 bp, H. sapiens
aaatttcatgggaaaa

SEQ ID NO: 11986 - DNA, 16 bp, H. sapiens
aaatttcatgttaaaa

SEQ ID NO: 11987 - DNA, 16 bp, H. sapiens
aaatttcatgttcttt

SEQ ID NO: 11988 - DNA, 16 bp, H. sapiens
aaatttcatgttgaat

SEQ ID NO: 11989 - DNA, 16 bp, H. sapiens
aaatttcattttcaaa

SEQ ID NO: 11990 - DNA, 16 bp, H. sapiens
aaatttcattttctct

SEQ ID NO: 11991 - DNA, 16 bp, H. sapiens
aaatttccaaatgttt

SEQ ID NO: 11992 - DNA, 16 bp, H. sapiens
aaatttccaaatttta

SEQ ID NO: 11993 - DNA, 16 bp, H. sapiens
aaatttccaatatatt

SEQ ID NO: 11994 - DNA, 16 bp, H. sapiens
aaatttccagaagaaa

SEQ ID NO: 11995 - DNA, 16 bp, H. sapiens
aaatttccatttaaaa

SEQ ID NO: 11996 - DNA, 16 bp, H. sapiens
aaatttcccaaaataa

SEQ ID NO: 11997 - DNA, 16 bp, H. sapiens
aaatttcccacatttt

SEQ ID NO: 11998 - DNA, 16 bp, H. sapiens
aaatttccctttaaac

SEQ ID NO: 11999 - DNA, 16 bp, H. sapiens
aaatttcctgaaaatt

SEQ ID NO: 12000 - DNA, 16 bp, H. sapiens
aaatttccttaaaaat

SEQ ID NO: 12001 - DNA, 16 bp, H. sapiens
aaatttccttctgata

SEQ ID NO: 12002 - DNA, 16 bp, H. sapiens
aaatttccttgtcagt

SEQ ID NO: 12003 - DNA, 16 bp, H. sapiens
aaatttcctttaaatt

SEQ ID NO: 12004 - DNA, 16 bp, H. sapiens
aaatttccttttctgt

SEQ ID NO: 12005 - DNA, 16 bp, H. sapiens
aaatttccttttttgt

SEQ ID NO: 12006 - DNA, 16 bp, H. sapiens
aaatttctaaaaagaa

SEQ ID NO: 12007 - DNA, 16 bp, H. sapiens
aaatttctaaaaatga

SEQ ID NO: 12008 - DNA, 16 bp, H. sapiens
aaatttctagaaaaag

SEQ ID NO: 12009 - DNA, 16 bp, H. sapiens
aaatttctagaagaaa

SEQ ID NO: 12010 - DNA, 16 bp, H. sapiens
aaatttctagaagtgg

SEQ ID NO: 12011 - DNA, 16 bp, H. sapiens
aaatttctagaatttt

SEQ ID NO: 12012 - DNA, 16 bp, H. sapiens
aaatttctattgtttt

SEQ ID NO: 12013 - DNA, 16 bp, H. sapiens
aaatttctccttttta

SEQ ID NO: 12014 - DNA, 16 bp, H. sapiens
aaatttctcttttgta

SEQ ID NO: 12015 - DNA, 16 bp, H. sapiens
aaatttctgaaaacca

SEQ ID NO: 12016 - DNA, 16 bp, H. sapiens
aaatttctgaaaatgt

SEQ ID NO: 12017 - DNA, 16 bp, H. sapiens
aaatttctgaaatgat

SEQ ID NO: 12018 - DNA, 16 bp, H. sapiens
aaatttctgaaatttg

SEQ ID NO: 12019 - DNA, 16 bp, H. sapiens
aaatttctgacccaca

SEQ ID NO: 12020 - DNA, 16 bp, H. sapiens
aaatttctgagctcaa

SEQ ID NO: 12021 - DNA, 16 bp, H. sapiens
aaatttctggaaagat

SEQ ID NO: 12022 - DNA, 16 bp, H. sapiens
aaatttctgttcttat

SEQ ID NO: 12023 - DNA, 16 bp, H. sapiens
aaatttctgttgttca

SEQ ID NO: 12024 - DNA, 16 bp, H. sapiens
aaatttctgtttatat

SEQ ID NO: 12025 - DNA, 16 bp, H. sapiens
aaatttctgtttattt

SEQ ID NO: 12026 - DNA, 16 bp, H. sapiens
aaatttcttaagtttt

SEQ ID NO: 12027 - DNA, 16 bp, H. sapiens
aaatttcttcataaaa

SEQ ID NO: 12028 - DNA, 16 bp, H. sapiens
aaatttcttcttccag

SEQ ID NO: 12029 - DNA, 16 bp, H. sapiens
aaatttcttctttaaa

SEQ ID NO: 12030 - DNA, 16 bp, H. sapiens
aaatttcttcttttga

SEQ ID NO: 12031 - DNA, 16 bp, H. sapiens
aaatttcttgagtaat

SEQ ID NO: 12032 - DNA, 16 bp, H. sapiens
aaatttcttttgagac

SEQ ID NO: 12033 - DNA, 16 bp, H. sapiens
aaatttctttttgaaa

SEQ ID NO: 12034 - DNA, 16 bp, H. sapiens
aaatttgaaaactgaa

SEQ ID NO: 12035 - DNA, 16 bp, H. sapiens
aaatttgaaaatcaaa

SEQ ID NO: 12036 - DNA, 16 bp, H. sapiens
aaatttgaaaatcagt

SEQ ID NO: 12037 - DNA, 16 bp, H. sapiens
aaatttgaaaatgttt

SEQ ID NO: 12038 - DNA, 16 bp, H. sapiens
aaatttgaaagtgaga

SEQ ID NO: 12039 - DNA, 16 bp, H. sapiens
aaatttgaaatccaaa

SEQ ID NO: 12040 - DNA, 16 bp, H. sapiens
aaatttgaaatgagaa

SEQ ID NO: 12041 - DNA, 16 bp, H. sapiens
aaatttgaaattaaca

SEQ ID NO: 12042 - DNA, 16 bp, H. sapiens
aaatttgaacttaaaa

SEQ ID NO: 12043 - DNA, 16 bp, H. sapiens
aaatttgaagaggaaa

SEQ ID NO: 12044 - DNA, 16 bp, H. sapiens
aaatttgaatgtgaaa

SEQ ID NO: 12045 - DNA, 16 bp, H. sapiens
aaatttgaatttcaaa

SEQ ID NO: 12046 - DNA, 16 bp, H. sapiens
aaatttgaatttcata

SEQ ID NO: 12047 - DNA, 16 bp, H. sapiens
aaatttgaatttgaaa

SEQ ID NO: 12048 - DNA, 16 bp, H. sapiens
aaatttgagaactgct

SEQ ID NO: 12049 - DNA, 16 bp, H. sapiens
aaatttgagaggaaaa

SEQ ID NO: 12050 - DNA, 16 bp, H. sapiens
aaatttgaggaaaaat

SEQ ID NO: 12051 - DNA, 16 bp, H. sapiens
aaatttgataacttag

SEQ ID NO: 12052 - DNA, 16 bp, H. sapiens
aaatttgatccccagt

SEQ ID NO: 12053 - DNA, 16 bp, H. sapiens
aaatttgatgaaatat

SEQ ID NO: 12054 - DNA, 16 bp, H. sapiens
aaatttgatttacaaa

SEQ ID NO: 12055 - DNA, 16 bp, H. sapiens
aaatttgcaaaagtaa

SEQ ID NO: 12056 - DNA, 16 bp, H. sapiens
aaatttgcataagtaa

SEQ ID NO: 12057 - DNA, 16 bp, H. sapiens
aaatttgcattaattt

SEQ ID NO: 12058 - DNA, 16 bp, H. sapiens
aaatttgcatttccaa

SEQ ID NO: 12059 - DNA, 16 bp, H. sapiens
aaatttgcattttaaa

SEQ ID NO: 12060 - DNA, 16 bp, H. sapiens
aaatttgctcaaagaa

SEQ ID NO: 12061 - DNA, 16 bp, H. sapiens
aaatttgctgtttgat

SEQ ID NO: 12062 - DNA, 16 bp, H. sapiens
aaatttgcttaaaaaa

SEQ ID NO: 12063 - DNA, 16 bp, H. sapiens
aaatttgcttatttat

SEQ ID NO: 12064 - DNA, 16 bp, H. sapiens
aaatttggaaaactca

SEQ ID NO: 12065 - DNA, 16 bp, H. sapiens
aaatttggaaaatttg

SEQ ID NO: 12066 - DNA, 16 bp, H. sapiens
aaatttggaaactttt

SEQ ID NO: 12067 - DNA, 16 bp, H. sapiens
aaatttggaaaggaga

SEQ ID NO: 12068 - DNA, 16 bp, H. sapiens
aaatttggaaattttt

SEQ ID NO: 12069 - DNA, 16 bp, H. sapiens
aaatttggacacacac

SEQ ID NO: 12070 - DNA, 16 bp, H. sapiens
aaatttggattgtttc

SEQ ID NO: 12071 - DNA, 16 bp, H. sapiens
aaatttggattttctt

SEQ ID NO: 12072 - DNA, 16 bp, H. sapiens
aaatttggcaagtttt

SEQ ID NO: 12073 - DNA, 16 bp, H. sapiens
aaatttggcagtttct

SEQ ID NO: 12074 - DNA, 16 bp, H. sapiens
aaatttggcttatttg

SEQ ID NO: 12075 - DNA, 16 bp, H. sapiens
aaatttgggacatttt

SEQ ID NO: 12076 - DNA, 16 bp, H. sapiens
aaatttggggaaaata

SEQ ID NO: 12077 - DNA, 16 bp, H. sapiens
aaatttggggagtttt

SEQ ID NO: 12078 - DNA, 16 bp, H. sapiens
aaatttgggggaaaaa

SEQ ID NO: 12079 - DNA, 16 bp, H. sapiens
aaatttgggggaaaat

SEQ ID NO: 12080 - DNA, 16 bp, H. sapiens
aaatttgggttatttt

SEQ ID NO: 12081 - DNA, 16 bp, H. sapiens
aaatttggtgaaaatt

SEQ ID NO: 12082 - DNA, 16 bp, H. sapiens
aaatttgtaaactttg

SEQ ID NO: 12083 - DNA, 16 bp, H. sapiens
aaatttgtaaactttt

SEQ ID NO: 12084 - DNA, 16 bp, H. sapiens
aaatttgtagttaaaa

SEQ ID NO: 12085 - DNA, 16 bp, H. sapiens
aaatttgtattttgaa

SEQ ID NO: 12086 - DNA, 16 bp, H. sapiens
aaatttgtccatttca

SEQ ID NO: 12087 - DNA, 16 bp, H. sapiens
aaatttgtgaaaatta

SEQ ID NO: 12088 - DNA, 16 bp, H. sapiens
aaatttgttcatttca

SEQ ID NO: 12089 - DNA, 16 bp, H. sapiens
aaatttgttgtagaga

SEQ ID NO: 12090 - DNA, 16 bp, H. sapiens
aaatttgtttctgaaa

SEQ ID NO: 12091 - DNA, 16 bp, H. sapiens
aaatttgttttacatt

SEQ ID NO: 12092 - DNA, 16 bp, H. sapiens
aaatttgttttacttt

SEQ ID NO: 12093 - DNA, 16 bp, H. sapiens
aaatttgttttattct

SEQ ID NO: 12094 - DNA, 16 bp, H. sapiens
aaatttgttttcatat

SEQ ID NO: 12095 - DNA, 16 bp, H. sapiens
aaatttgttttcattt

SEQ ID NO: 12096 - DNA, 16 bp, H. sapiens
aaatttgttttgagtt

SEQ ID NO: 12097 - DNA, 16 bp, H. sapiens
aaatttgtttttctga

SEQ ID NO: 12098 - DNA, 16 bp, H. sapiens
aaattttaaaaactct

SEQ ID NO: 12099 - DNA, 16 bp, H. sapiens
aaattttaaaaagtgt

SEQ ID NO: 12100 - DNA, 16 bp, H. sapiens
aaattttaaaaatggg

SEQ ID NO: 12101 - DNA, 16 bp, H. sapiens
aaattttaaaagctga

SEQ ID NO: 12102 - DNA, 16 bp, H. sapiens
aaattttaaaagtcag

SEQ ID NO: 12103 - DNA, 16 bp, H. sapiens
aaattttaaaagtgga

SEQ ID NO: 12104 - DNA, 16 bp, H. sapiens
aaattttaaaagttct

SEQ ID NO: 12105 - DNA, 16 bp, H. sapiens
aaattttaaagcattt

SEQ ID NO: 12106 - DNA, 16 bp, H. sapiens
aaattttaaagcttca

SEQ ID NO: 12107 - DNA, 16 bp, H. sapiens
aaattttaaagttcca

SEQ ID NO: 12108 - DNA, 16 bp, H. sapiens
aaattttaaagtttga

SEQ ID NO: 12109 - DNA, 16 bp, H. sapiens
aaattttaaatgcaca

SEQ ID NO: 12110 - DNA, 16 bp, H. sapiens
aaattttaaatgtaca

SEQ ID NO: 12111 - DNA, 16 bp, H. sapiens
aaattttaaatgtcaa

SEQ ID NO: 12112 - DNA, 16 bp, H. sapiens
aaattttaactcattt

SEQ ID NO: 12113 - DNA, 16 bp, H. sapiens
aaattttaactttcat

SEQ ID NO: 12114 - DNA, 16 bp, H. sapiens
aaattttaagtcattt

SEQ ID NO: 12115 - DNA, 16 bp, H. sapiens
aaattttaattttgtc

SEQ ID NO: 12116 - DNA, 16 bp, H. sapiens
aaattttacaaacttt

SEQ ID NO: 12117 - DNA, 16 bp, H. sapiens
aaattttacctcattt

SEQ ID NO: 12118 - DNA, 16 bp, H. sapiens
aaattttagaaaatgt

SEQ ID NO: 12119 - DNA, 17 bp, H. sapiens
aaattttagaatagttt

SEQ ID NO: 12120 - DNA, 16 bp, H. sapiens
aaattttagaatcaga

SEQ ID NO: 12121 - DNA, 16 bp, H. sapiens
aaattttagaatttgt

SEQ ID NO: 12122 - DNA, 16 bp, H. sapiens
aaattttaggagaaaa

SEQ ID NO: 12123 - DNA, 16 bp, H. sapiens
aaattttatagcttta

SEQ ID NO: 12124 - DNA, 16 bp, H. sapiens
aaattttatcttgaaa

SEQ ID NO: 12125 - DNA, 16 bp, H. sapiens
aaattttatctttaga

SEQ ID NO: 12126 - DNA, 16 bp, H. sapiens
aaattttatgttacat

SEQ ID NO: 12127 - DNA, 16 bp, H. sapiens
aaattttattagaaca

SEQ ID NO: 12128 - DNA, 16 bp, H. sapiens
aaattttattgaaaca

SEQ ID NO: 12129 - DNA, 16 bp, H. sapiens
aaattttattgtgaaa

SEQ ID NO: 12130 - DNA, 16 bp, H. sapiens
aaattttatttagctt

SEQ ID NO: 12131 - DNA, 16 bp, H. sapiens
aaattttatttctgta

SEQ ID NO: 12132 - DNA, 16 bp, H. sapiens
aaattttattttagca

SEQ ID NO: 12133 - DNA, 16 bp, H. sapiens
aaattttcaaagaaaa

SEQ ID NO: 12134 - DNA, 16 bp, H. sapiens
aaattttcaacattta

SEQ ID NO: 12135 - DNA, 16 bp, H. sapiens
aaattttcagaaaaga

SEQ ID NO: 12136 - DNA, 16 bp, H. sapiens
aaattttcagcatttt

SEQ ID NO: 12137 - DNA, 16 bp, H. sapiens
aaattttcagtttcta

SEQ ID NO: 12138 - DNA, 16 bp, H. sapiens
aaattttcagttttaa

SEQ ID NO: 12139 - DNA, 16 bp, H. sapiens
aaattttcattgttta

SEQ ID NO: 12140 - DNA, 16 bp, H. sapiens
aaattttcatttcaaa

SEQ ID NO: 12141 - DNA, 16 bp, H. sapiens
aaattttcatttgatt

SEQ ID NO: 12142 - DNA, 16 bp, H. sapiens
aaattttccaaaatca

SEQ ID NO: 12143 - DNA, 16 bp, H. sapiens
aaattttccaaaatgt

SEQ ID NO: 12144 - DNA, 16 bp, H. sapiens
aaattttccaaatttt

SEQ ID NO: 12145 - DNA, 16 bp, H. sapiens
aaattttccacatttt

SEQ ID NO: 12146 - DNA, 16 bp, H. sapiens
aaattttccatgaaaa

SEQ ID NO: 12147 - DNA, 16 bp, H. sapiens
aaattttccatttaat

SEQ ID NO: 12148 - DNA, 16 bp, H. sapiens
aaattttcccaacttt

SEQ ID NO: 12149 - DNA, 16 bp, H. sapiens
aaattttccctgtttg

SEQ ID NO: 12150 - DNA, 16 bp, H. sapiens
aaattttcccttttta

SEQ ID NO: 12151 - DNA, 16 bp, H. sapiens
aaattttcctatttct

SEQ ID NO: 12152 - DNA, 16 bp, H. sapiens
aaattttcctgttttt

SEQ ID NO: 12153 - DNA, 16 bp, H. sapiens
aaattttcctttaaaa

SEQ ID NO: 12154 - DNA, 16 bp, H. sapiens
aaattttcctttgttt

SEQ ID NO: 12155 - DNA, 16 bp, H. sapiens
aaattttctaacattt

SEQ ID NO: 12156 - DNA, 16 bp, H. sapiens
aaattttctgaaagaa

SEQ ID NO: 12157 - DNA, 16 bp, H. sapiens
aaattttctgttaaaa

SEQ ID NO: 12158 - DNA, 16 bp, H. sapiens
aaattttctgttactt

SEQ ID NO: 12159 - DNA, 16 bp, H. sapiens
aaattttctgtttgtt

SEQ ID NO: 12160 - DNA, 16 bp, H. sapiens
aaattttcttcaaaat

SEQ ID NO: 12161 - DNA, 16 bp, H. sapiens
aaattttcttccattt

SEQ ID NO: 12162 - DNA, 16 bp, H. sapiens
aaattttcttttgaaa

SEQ ID NO: 12163 - DNA, 16 bp, H. sapiens
aaattttctttttcac

SEQ ID NO: 12164 - DNA, 16 bp, H. sapiens
aaattttgaaaaacat

SEQ ID NO: 12165 - DNA, 16 bp, H. sapiens
aaattttgaaaattca

SEQ ID NO: 12166 - DNA, 16 bp, H. sapiens
aaattttgaaacaatt

SEQ ID NO: 12167 - DNA, 16 bp, H. sapiens
aaattttgaaagcatt

SEQ ID NO: 12168 - DNA, 16 bp, H. sapiens
aaattttgaaatacat

SEQ ID NO: 12169 - DNA, 16 bp, H. sapiens
aaattttgaagaattt

SEQ ID NO: 12170 - DNA, 16 bp, H. sapiens
aaattttgaagacatt

SEQ ID NO: 12171 - DNA, 16 bp, H. sapiens
aaattttgaagtcaga

SEQ ID NO: 12172 - DNA, 16 bp, H. sapiens
aaattttgaatgaaat

SEQ ID NO: 12173 - DNA, 16 bp, H. sapiens
aaattttgacttaaaa

SEQ ID NO: 12174 - DNA, 16 bp, H. sapiens
aaattttgagagaaaa

SEQ ID NO: 12175 - DNA, 16 bp, H. sapiens
aaattttgatgaagtc

SEQ ID NO: 12176 - DNA, 16 bp, H. sapiens
aaattttgatgaattt

SEQ ID NO: 12177 - DNA, 16 bp, H. sapiens
aaattttgatgttaaa

SEQ ID NO: 12178 - DNA, 16 bp, H. sapiens
aaattttgcaaaatat

SEQ ID NO: 12179 - DNA, 16 bp, H. sapiens
aaattttgcatgttct

SEQ ID NO: 12180 - DNA, 16 bp, H. sapiens
aaattttgctaaattt

SEQ ID NO: 12181 - DNA, 16 bp, H. sapiens
aaattttggaaaatgt

SEQ ID NO: 12182 - DNA, 16 bp, H. sapiens
aaattttggaactgaa

SEQ ID NO: 12183 - DNA, 16 bp, H. sapiens
aaattttggagaaaat

SEQ ID NO: 12184 - DNA, 16 bp, H. sapiens
aaattttggatattaa

SEQ ID NO: 12185 - DNA, 16 bp, H. sapiens
aaattttgtaaacttt

SEQ ID NO: 12186 - DNA, 16 bp, H. sapiens
aaattttgtcaaaggc

SEQ ID NO: 12187 - DNA, 16 bp, H. sapiens
aaattttgtcatgctg

SEQ ID NO: 12188 - DNA, 16 bp, H. sapiens
aaattttgttacatgc

SEQ ID NO: 12189 - DNA, 16 bp, H. sapiens
aaattttgtttaaaga

SEQ ID NO: 12190 - DNA, 16 bp, H. sapiens
aaattttgtttaactt

SEQ ID NO: 12191 - DNA, 16 bp, H. sapiens
aaattttgtttatcca

SEQ ID NO: 12192 - DNA, 16 bp, H. sapiens
aaattttgtttcaaaa

SEQ ID NO: 12193 - DNA, 16 bp, H. sapiens
aaattttgtttcatat

SEQ ID NO: 12194 - DNA, 16 bp, H. sapiens
aaattttgtttctgtt

SEQ ID NO: 12195 - DNA, 16 bp, H. sapiens
aaattttgttttctaa

SEQ ID NO: 12196 - DNA, 16 bp, H. sapiens
aaattttgttttgaaa

SEQ ID NO: 12197 - DNA, 16 bp, H. sapiens
aaatttttaaaaagtg

SEQ ID NO: 12198 - DNA, 16 bp, H. sapiens
aaatttttaaaaatcc

SEQ ID NO: 12199 - DNA, 16 bp, H. sapiens
aaatttttagaaatca

SEQ ID NO: 12200 - DNA, 16 bp, H. sapiens
aaatttttatagagat

SEQ ID NO: 12201 - DNA, 16 bp, H. sapiens
aaatttttatcagttt

SEQ ID NO: 12202 - DNA, 16 bp, H. sapiens
aaatttttattggaaa

SEQ ID NO: 12203 - DNA, 16 bp, H. sapiens
aaatttttcaaagaat

SEQ ID NO: 12204 - DNA, 16 bp, H. sapiens
aaatttttcaagaaaa

SEQ ID NO: 12205 - DNA, 16 bp, H. sapiens
aaatttttccaaataa

SEQ ID NO: 12206 - DNA, 16 bp, H. sapiens
aaatttttctagaaaa

SEQ ID NO: 12207 - DNA, 16 bp, H. sapiens
aaatttttctagaaat

SEQ ID NO: 12208 - DNA, 16 bp, H. sapiens
aaatttttctcagttt

SEQ ID NO: 12209 - DNA, 16 bp, H. sapiens
aaatttttctgtaaaa

SEQ ID NO: 12210 - DNA, 16 bp, H. sapiens
aaatttttggaaagaa

SEQ ID NO: 12211 - DNA, 16 bp, H. sapiens
aaatttttggtagaat

SEQ ID NO: 12212 - DNA, 16 bp, H. sapiens
aaatttttggtagaga

SEQ ID NO: 12213 - DNA, 16 bp, H. sapiens
aaatttttgtaaccta

SEQ ID NO: 12214 - DNA, 16 bp, H. sapiens
aaatttttgtattttc

SEQ ID NO: 12215 - DNA, 16 bp, H. sapiens
aaattttttaaatagg

SEQ ID NO: 12216 - DNA, 16 bp, H. sapiens
aaattttttgtagaca

SEQ ID NO: 12217 - DNA, 16 bp, H. sapiens
aaatttttttaagtga

SEQ ID NO: 12218 - DNA, 16 bp, H. sapiens
aaattttttttccaag

SEQ ID NO: 12219 - DNA, 16 bp, H. sapiens
aaatttttttttctag

SEQ ID NO: 12220 - DNA, 16 bp, H. sapiens
aacaaaaaaacagttg

SEQ ID NO: 12221 - DNA, 16 bp, H. sapiens
aacaaaaaaacctcag

SEQ ID NO: 12222 - DNA, 16 bp, H. sapiens
aacaaaaaaattctga

SEQ ID NO: 12223 - DNA, 16 bp, H. sapiens
aacaaaaaacaagtgt

SEQ ID NO: 12224 - DNA, 16 bp, H. sapiens
aacaaaaaaccagcat

SEQ ID NO: 12225 - DNA, 16 bp, H. sapiens
aacaaaaaacttcaga

SEQ ID NO: 12226 - DNA, 16 bp, H. sapiens
aacaaaaaattgtata

SEQ ID NO: 12227 - DNA, 16 bp, H. sapiens
aacaaaaacagtaatt

SEQ ID NO: 12228 - DNA, 16 bp, H. sapiens
aacaaaaaccacatga

SEQ ID NO: 12229 - DNA, 16 bp, H. sapiens
aacaaaaactttattt

SEQ ID NO: 12230 - DNA, 16 bp, H. sapiens
aacaaaaagaaagctg

SEQ ID NO: 12231 - DNA, 16 bp, H. sapiens
aacaaaaagaaatctt

SEQ ID NO: 12232 - DNA, 16 bp, H. sapiens
aacaaaaagaagttta

SEQ ID NO: 12233 - DNA, 16 bp, H. sapiens
aacaaaaaggagtttt

SEQ ID NO: 12234 - DNA, 16 bp, H. sapiens
aacaaaaaggccccca

SEQ ID NO: 12235 - DNA, 16 bp, H. sapiens
aacaaaaataaatgtt

SEQ ID NO: 12236 - DNA, 16 bp, H. sapiens
aacaaaaatatatgca

SEQ ID NO: 12237 - DNA, 16 bp, H. sapiens
aacaaaaatatgtatt

SEQ ID NO: 12238 - DNA, 16 bp, H. sapiens
aacaaaaatatttgta

SEQ ID NO: 12239 - DNA, 16 bp, H. sapiens
aacaaaaatattttct

SEQ ID NO: 12240 - DNA, 16 bp, H. sapiens
aacaaaaatgaatttt

SEQ ID NO: 12241 - DNA, 16 bp, H. sapiens
aacaaaaatgccataa

SEQ ID NO: 12242 - DNA, 16 bp, H. sapiens
aacaaaaatgttttct

SEQ ID NO: 12243 - DNA, 16 bp, H. sapiens
aacaaaacaaaatttg

SEQ ID NO: 12244 - DNA, 16 bp, H. sapiens
aacaaaacatgtttta

SEQ ID NO: 12245 - DNA, 16 bp, H. sapiens
aacaaaacattttgaa

SEQ ID NO: 12246 - DNA, 16 bp, H. sapiens
aacaaaaccaaaagtt

SEQ ID NO: 12247 - DNA, 16 bp, H. sapiens
aacaaaacctctaaga

SEQ ID NO: 12248 - DNA, 16 bp, H. sapiens
aacaaaacctggatga

SEQ ID NO: 12249 - DNA, 16 bp, H. sapiens
aacaaaactgcacatt

SEQ ID NO: 12250 - DNA, 16 bp, H. sapiens
aacaaaactggacaga

SEQ ID NO: 12251 - DNA, 16 bp, H. sapiens
aacaaaactggacgga

SEQ ID NO: 12252 - DNA, 16 bp, H. sapiens
aacaaaactttattta

SEQ ID NO: 12253 - DNA, 16 bp, H. sapiens
aacaaaagaaaacttt

SEQ ID NO: 12254 - DNA, 16 bp, H. sapiens
aacaaaagaaaatttc

SEQ ID NO: 12255 - DNA, 16 bp, H. sapiens
aacaaaagaaatttta

SEQ ID NO: 12256 - DNA, 16 bp, H. sapiens
aacaaaagaggtgaaa

SEQ ID NO: 12257 - DNA, 16 bp, H. sapiens
aacaaaagattctcct

SEQ ID NO: 12258 - DNA, 16 bp, H. sapiens
aacaaaagattttaaa

SEQ ID NO: 12259 - DNA, 16 bp, H. sapiens
aacaaaagcaatttta

SEQ ID NO: 12260 - DNA, 16 bp, H. sapiens
aacaaaagccaaattg

SEQ ID NO: 12261 - DNA, 16 bp, H. sapiens
aacaaaagtcaaaatg

SEQ ID NO: 12262 - DNA, 18 bp, H. sapiens
aacaaaagtcaaaattga

SEQ ID NO: 12263 - DNA, 16 bp, H. sapiens
aacaaaagttgaaaat

SEQ ID NO: 12264 - DNA, 16 bp, H. sapiens
aacaaaataaaggcca

SEQ ID NO: 12265 - DNA, 16 bp, H. sapiens
aacaaaataaagtatt

SEQ ID NO: 12266 - DNA, 16 bp, H. sapiens
aacaaaataaagtcat

SEQ ID NO: 12267 - DNA, 16 bp, H. sapiens
aacaaaataaatttga

SEQ ID NO: 12268 - DNA, 16 bp, H. sapiens
aacaaaataatatgta

SEQ ID NO: 12269 - DNA, 16 bp, H. sapiens
aacaaaatacaggcaa

SEQ ID NO: 12270 - DNA, 16 bp, H. sapiens
aacaaaatactataga

SEQ ID NO: 12271 - DNA, 16 bp, H. sapiens
aacaaaatactatttt

SEQ ID NO: 12272 - DNA, 16 bp, H. sapiens
aacaaaatagatacac

SEQ ID NO: 12273 - DNA, 16 bp, H. sapiens
aacaaaatagatagac

SEQ ID NO: 12274 - DNA, 16 bp, H. sapiens
aacaaaatagcccaga

SEQ ID NO: 12275 - DNA, 16 bp, H. sapiens
aacaaaatatcatgga

SEQ ID NO: 12276 - DNA, 16 bp, H. sapiens
aacaaaatattatgaa

SEQ ID NO: 12277 - DNA, 16 bp, H. sapiens
aacaaaatcaatagac

SEQ ID NO: 12278 - DNA, 16 bp, H. sapiens
aacaaaatcaattttt

SEQ ID NO: 12279 - DNA, 16 bp, H. sapiens
aacaaaatcacatgat

SEQ ID NO: 12280 - DNA, 16 bp, H. sapiens
aacaaaatcatgcctt

SEQ ID NO: 12281 - DNA, 16 bp, H. sapiens
aacaaaatcgatagac

SEQ ID NO: 12282 - DNA, 16 bp, H. sapiens
aacaaaatgaaaagtc

SEQ ID NO: 12283 - DNA, 16 bp, H. sapiens
aacaaaatgaaaatgt

SEQ ID NO: 12284 - DNA, 16 bp, H. sapiens
aacaaaatgaaacttt

SEQ ID NO: 12285 - DNA, 16 bp, H. sapiens
aacaaaatgaaattat

SEQ ID NO: 12286 - DNA, 16 bp, H. sapiens
aacaaaatgaacattt

SEQ ID NO: 12287 - DNA, 16 bp, H. sapiens
aacaaaatgaaggaca

SEQ ID NO: 12288 - DNA, 16 bp, H. sapiens
aacaaaatgacaattt

SEQ ID NO: 12289 - DNA, 16 bp, H. sapiens
aacaaaatgagataat

SEQ ID NO: 12290 - DNA, 16 bp, H. sapiens
aacaaaatgattttat

SEQ ID NO: 12291 - DNA, 16 bp, H. sapiens
aacaaaatgctacaga

SEQ ID NO: 12292 - DNA, 16 bp, H. sapiens
aacaaaatggaaatca

SEQ ID NO: 12293 - DNA, 16 bp, H. sapiens
aacaaaatggcagcag

SEQ ID NO: 12294 - DNA, 16 bp, H. sapiens
aacaaaatgttatata

SEQ ID NO: 12295 - DNA, 16 bp, H. sapiens
aacaaaattaaaaggc

SEQ ID NO: 12296 - DNA, 16 bp, H. sapiens
aacaaaatttaagaat

SEQ ID NO: 12297 - DNA, 16 bp, H. sapiens
aacaaaattttacttt

SEQ ID NO: 12298 - DNA, 16 bp, H. sapiens
aacaaacaaacatttt

SEQ ID NO: 12299 - DNA, 16 bp, H. sapiens
aacaaacaaagcttcc

SEQ ID NO: 12300 - DNA, 16 bp, H. sapiens
aacaaacacatgaaga

SEQ ID NO: 12301 - DNA, 16 bp, H. sapiens
aacaaacacttactga

SEQ ID NO: 12302 - DNA, 16 bp, H. sapiens
aacaaacaggaaaatg

SEQ ID NO: 12303 - DNA, 16 bp, H. sapiens
aacaaacatatgaaga

SEQ ID NO: 12304 - DNA, 16 bp, H. sapiens
aacaaacatgtattga

SEQ ID NO: 12305 - DNA, 16 bp, H. sapiens
aacaaacatttattga

SEQ ID NO: 12306 - DNA, 16 bp, H. sapiens
aacaaacatttcaaac

SEQ ID NO: 12307 - DNA, 16 bp, H. sapiens
aacaaacatttgtttc

SEQ ID NO: 12308 - DNA, 16 bp, H. sapiens
aacaaactaggcattg

SEQ ID NO: 12309 - DNA, 16 bp, H. sapiens
aacaaactatggtata

SEQ ID NO: 12310 - DNA, 16 bp, H. sapiens
aacaaactattttttt

SEQ ID NO: 12311 - DNA, 16 bp, H. sapiens
aacaaactgaaaaatc

SEQ ID NO: 12312 - DNA, 16 bp, H. sapiens
aacaaactgaaaatca

SEQ ID NO: 12313 - DNA, 16 bp, H. sapiens
aacaaactgaaaggaa

SEQ ID NO: 12314 - DNA, 16 bp, H. sapiens
aacaaactgaatccaa

SEQ ID NO: 12315 - DNA, 16 bp, H. sapiens
aacaaactttaaagta

SEQ ID NO: 12316 - DNA, 16 bp, H. sapiens
aacaaacttttattaa

SEQ ID NO: 12317 - DNA, 16 bp, H. sapiens
aacaaactttttgttt

SEQ ID NO: 12318 - DNA, 16 bp, H. sapiens
aacaaagaaaagccta

SEQ ID NO: 12319 - DNA, 16 bp, H. sapiens
aacaaagaaaatctca

SEQ ID NO: 12320 - DNA, 16 bp, H. sapiens
aacaaagaaaatggag

SEQ ID NO: 12321 - DNA, 16 bp, H. sapiens
aacaaagaaaattttt

SEQ ID NO: 12322 - DNA, 16 bp, H. sapiens
aacaaagaaacaggtg

SEQ ID NO: 12323 - DNA, 16 bp, H. sapiens
aacaaagaaatatatt

SEQ ID NO: 12324 - DNA, 16 bp, H. sapiens
aacaaagaagctacag

SEQ ID NO: 12325 - DNA, 16 bp, H. sapiens
aacaaagaatatattt

SEQ ID NO: 12326 - DNA, 16 bp, H. sapiens
aacaaagaattaccca

SEQ ID NO: 12327 - DNA, 16 bp, H. sapiens
aacaaagaattatcca

SEQ ID NO: 12328 - DNA, 16 bp, H. sapiens
aacaaagaatttagaa

SEQ ID NO: 12329 - DNA, 16 bp, H. sapiens
aacaaagacttcaaag

SEQ ID NO: 12330 - DNA, 16 bp, H. sapiens
aacaaagagaatttta

SEQ ID NO: 12331 - DNA, 16 bp, H. sapiens
aacaaagagagaccct

SEQ ID NO: 12332 - DNA, 16 bp, H. sapiens
aacaaagatacaacat

SEQ ID NO: 12333 - DNA, 16 bp, H. sapiens
aacaaagcaagactcc

SEQ ID NO: 12334 - DNA, 16 bp, H. sapiens
aacaaagccaaaaatt

SEQ ID NO: 12335 - DNA, 16 bp, H. sapiens
aacaaagcctccatga

SEQ ID NO: 12336 - DNA, 16 bp, H. sapiens
aacaaagcctggatga

SEQ ID NO: 12337 - DNA, 16 bp, H. sapiens
aacaaaggatttacaa

SEQ ID NO: 12338 - DNA, 16 bp, H. sapiens
aacaaaggcagtttta

SEQ ID NO: 12339 - DNA, 16 bp, H. sapiens
aacaaagtaccacaaa

SEQ ID NO: 12340 - DNA, 16 bp, H. sapiens
aacaaagtatcacaga

SEQ ID NO: 12341 - DNA, 16 bp, H. sapiens
aacaaagtccaggctg

SEQ ID NO: 12342 - DNA, 16 bp, H. sapiens
aacaaagtcgacaaaa

SEQ ID NO: 12343 - DNA, 17 bp, H. sapiens
aacaaagtctccaagaa

SEQ ID NO: 12344 - DNA, 16 bp, H. sapiens
aacaaagtgaagagaa

SEQ ID NO: 12345 - DNA, 16 bp, H. sapiens
aacaaagtgagacctg

SEQ ID NO: 12346 - DNA, 16 bp, H. sapiens
aacaaagttcaaaaga

SEQ ID NO: 12347 - DNA, 16 bp, H. sapiens
aacaaataaaaagctg

SEQ ID NO: 12348 - DNA, 16 bp, H. sapiens
aacaaataaattgtaa

SEQ ID NO: 12349 - DNA, 16 bp, H. sapiens
aacaaataatttgaaa

SEQ ID NO: 12350 - DNA, 16 bp, H. sapiens
aacaaatacttgaaaa

SEQ ID NO: 12351 - DNA, 16 bp, H. sapiens
aacaaatacttgctga

SEQ ID NO: 12352 - DNA, 16 bp, H. sapiens
aacaaatatatttgtt

SEQ ID NO: 12353 - DNA, 16 bp, H. sapiens
aacaaatattgattga

SEQ ID NO: 12354 - DNA, 16 bp, H. sapiens
aacaaatatttactta

SEQ ID NO: 12355 - DNA, 16 bp, H. sapiens
aacaaatatttattga

SEQ ID NO: 12356 - DNA, 16 bp, H. sapiens
aacaaatatttattgc

SEQ ID NO: 12357 - DNA, 16 bp, H. sapiens
aacaaatatttcctga

SEQ ID NO: 12358 - DNA, 16 bp, H. sapiens
aacaaatatttcttca

SEQ ID NO: 12359 - DNA, 16 bp, H. sapiens
aacaaatatttgataa

SEQ ID NO: 12360 - DNA, 16 bp, H. sapiens
aacaaatatttgatga

SEQ ID NO: 12361 - DNA, 18 bp, H. sapiens
aacaaatcacaatggtgg

SEQ ID NO: 12362 - DNA, 16 bp, H. sapiens
aacaaatccaggagct

SEQ ID NO: 12363 - DNA, 16 bp, H. sapiens
aacaaatccttgaaat

SEQ ID NO: 12364 - DNA, 16 bp, H. sapiens
aacaaatctctaggaa

SEQ ID NO: 12365 - DNA, 16 bp, H. sapiens
aacaaatctgacaaaa

SEQ ID NO: 12366 - DNA, 16 bp, H. sapiens
aacaaatgaaacatat

SEQ ID NO: 12367 - DNA, 16 bp, H. sapiens
aacaaatgaccacaaa

SEQ ID NO: 12368 - DNA, 16 bp, H. sapiens
aacaaatgcagagaag

SEQ ID NO: 12369 - DNA, 16 bp, H. sapiens
aacaaatgcattattt

SEQ ID NO: 12370 - DNA, 16 bp, H. sapiens
aacaaatgctgacaag

SEQ ID NO: 12371 - DNA, 16 bp, H. sapiens
aacaaatggaaaaatg

SEQ ID NO: 12372 - DNA, 16 bp, H. sapiens
aacaaatggaaaaatt

SEQ ID NO: 12373 - DNA, 16 bp, H. sapiens
aacaaatggaaaagca

SEQ ID NO: 12374 - DNA, 16 bp, H. sapiens
aacaaatggaaaatat

SEQ ID NO: 12375 - DNA, 16 bp, H. sapiens
aacaaatggaaataca

SEQ ID NO: 12376 - DNA, 16 bp, H. sapiens
aacaaatggaaatgga

SEQ ID NO: 12377 - DNA, 16 bp, H. sapiens
aacaaatggaaattct

SEQ ID NO: 12378 - DNA, 16 bp, H. sapiens
aacaaatggaagaatg

SEQ ID NO: 12379 - DNA, 16 bp, H. sapiens
aacaaatgggctacag

SEQ ID NO: 12380 - DNA, 16 bp, H. sapiens
aacaaatgtaaacaca

SEQ ID NO: 12381 - DNA, 16 bp, H. sapiens
aacaaatgtatgaaaa

SEQ ID NO: 12382 - DNA, 16 bp, H. sapiens
aacaaatgtgtatttt

SEQ ID NO: 12383 - DNA, 16 bp, H. sapiens
aacaaatgttgatgag

SEQ ID NO: 12384 - DNA, 16 bp, H. sapiens
aacaaatgttggtgaa

SEQ ID NO: 12385 - DNA, 16 bp, H. sapiens
aacaaatgtttattaa

SEQ ID NO: 12386 - DNA, 16 bp, H. sapiens
aacaaatgtttcaaat

SEQ ID NO: 12387 - DNA, 16 bp, H. sapiens
aacaaatgtttgttaa

SEQ ID NO: 12388 - DNA, 16 bp, H. sapiens
aacaaattagataatc

SEQ ID NO: 12389 - DNA, 16 bp, H. sapiens
aacaaattctttttct

SEQ ID NO: 12390 - DNA, 16 bp, H. sapiens
aacaaatttagaagaa

SEQ ID NO: 12391 - DNA, 16 bp, H. sapiens
aacaaatttctatttt

SEQ ID NO: 12392 - DNA, 16 bp, H. sapiens
aacaaatttctgttgt

SEQ ID NO: 12393 - DNA, 16 bp, H. sapiens
aacaaattttggtttt

SEQ ID NO: 12394 - DNA, 16 bp, H. sapiens
aacaaatttttttaag

SEQ ID NO: 12395 - DNA, 16 bp, H. sapiens
aacaacaaaaaatgcc

SEQ ID NO: 12396 - DNA, 16 bp, H. sapiens
aacaacaaaaatttga

SEQ ID NO: 12397 - DNA, 16 bp, H. sapiens
aacaacaaaacctttt

SEQ ID NO: 12398 - DNA, 16 bp, H. sapiens
aacaacaaagatgggg

SEQ ID NO: 12399 - DNA, 16 bp, H. sapiens
aacaacaacaaactga

SEQ ID NO: 12400 - DNA, 16 bp, H. sapiens
aacaacaacagaatat

SEQ ID NO: 12401 - DNA, 16 bp, H. sapiens
aacaacaacagcaaat

SEQ ID NO: 12402 - DNA, 16 bp, H. sapiens
aacaacaactcctttc

SEQ ID NO: 12403 - DNA, 16 bp, H. sapiens
aacaacaatattttat

SEQ ID NO: 12404 - DNA, 16 bp, H. sapiens
aacaacaattcaagat

SEQ ID NO: 12405 - DNA, 16 bp, H. sapiens
aacaacaatttacata

SEQ ID NO: 12406 - DNA, 16 bp, H. sapiens
aacaacacacactggg

SEQ ID NO: 12407 - DNA, 16 bp, H. sapiens
aacaacacacagtggg

SEQ ID NO: 12408 - DNA, 16 bp, H. sapiens
aacaacacacatcagg

SEQ ID NO: 12409 - DNA, 16 bp, H. sapiens
aacaacagaatttatt

SEQ ID NO: 12410 - DNA, 16 bp, H. sapiens
aacaacagacacatag

SEQ ID NO: 12411 - DNA, 16 bp, H. sapiens
aacaacagacactggg

SEQ ID NO: 12412 - DNA, 16 bp, H. sapiens
aacaacagatgcagga

SEQ ID NO: 12413 - DNA, 16 bp, H. sapiens
aacaacagcaacaata

SEQ ID NO: 12414 - DNA, 16 bp, H. sapiens
aacaacagcagcaata

SEQ ID NO: 12415 - DNA, 16 bp, H. sapiens
aacaacagcagcagca

SEQ ID NO: 12416 - DNA, 16 bp, H. sapiens
aacaacagcagcatca

SEQ ID NO: 12417 - DNA, 16 bp, H. sapiens
aacaacagccaagctg

SEQ ID NO: 12418 - DNA, 16 bp, H. sapiens
aacaacagtgtctaga

SEQ ID NO: 12419 - DNA, 16 bp, H. sapiens
aacaacatagatgaaa

SEQ ID NO: 12420 - DNA, 16 bp, H. sapiens
aacaacatattgtata

SEQ ID NO: 12421 - DNA, 16 bp, H. sapiens
aacaacatatttttaa

SEQ ID NO: 12422 - DNA, 16 bp, H. sapiens
aacaacatgaataaat

SEQ ID NO: 12423 - DNA, 16 bp, H. sapiens
aacaacatgctaaatg

SEQ ID NO: 12424 - DNA, 16 bp, H. sapiens
aacaacatggatggaa

SEQ ID NO: 12425 - DNA, 16 bp, H. sapiens
aacaacatggatggac

SEQ ID NO: 12426 - DNA, 16 bp, H. sapiens
aacaacatggtgaaac

SEQ ID NO: 12427 - DNA, 16 bp, H. sapiens
aacaacatgtgtaaaa

SEQ ID NO: 12428 - DNA, 16 bp, H. sapiens
aacaacatttcagtca

SEQ ID NO: 12429 - DNA, 16 bp, H. sapiens
aacaaccaaaatatct

SEQ ID NO: 12430 - DNA, 16 bp, H. sapiens
aacaaccagatctccc

SEQ ID NO: 12431 - DNA, 16 bp, H. sapiens
aacaaccatgcccagc

SEQ ID NO: 12432 - DNA, 16 bp, H. sapiens
aacaacccaaatgtcc

SEQ ID NO: 12433 - DNA, 16 bp, H. sapiens
aacaaccccattgaaa

SEQ ID NO: 12434 - DNA, 16 bp, H. sapiens
aacaaccctaggaggt

SEQ ID NO: 12435 - DNA, 16 bp, H. sapiens
aacaaccctgtgaggt

SEQ ID NO: 12436 - DNA, 16 bp, H. sapiens
aacaacctactcctga

SEQ ID NO: 12437 - DNA, 16 bp, H. sapiens
aacaacctgaatgtcc

SEQ ID NO: 12438 - DNA, 16 bp, H. sapiens
aacaacctgcccctga

SEQ ID NO: 12439 - DNA, 16 bp, H. sapiens
aacaacctgcttctga

SEQ ID NO: 12440 - DNA, 16 bp, H. sapiens
aacaaccttgaaaaaa

SEQ ID NO: 12441 - DNA, 16 bp, H. sapiens
aacaacctttatccca

SEQ ID NO: 12442 - DNA, 16 bp, H. sapiens
aacaacgagaacactt

SEQ ID NO: 12443 - DNA, 16 bp, H. sapiens
aacaactaacaaaatg

SEQ ID NO: 12444 - DNA, 16 bp, H. sapiens
aacaactacagaatac

SEQ ID NO: 12445 - DNA, 16 bp, H. sapiens
aacaactagaaaactg

SEQ ID NO: 12446 - DNA, 16 bp, H. sapiens
aacaactatttattga

SEQ ID NO: 12447 - DNA, 17 bp, H. sapiens
aacaactccagacgcgc

SEQ ID NO: 12448 - DNA, 16 bp, H. sapiens
aacaactctatagaaa

SEQ ID NO: 12449 - DNA, 16 bp, H. sapiens
aacaactctcaataaa

SEQ ID NO: 12450 - DNA, 16 bp, H. sapiens
aacaactctccatttc

SEQ ID NO: 12451 - DNA, 16 bp, H. sapiens
aacaactctggacatg

SEQ ID NO: 12452 - DNA, 16 bp, H. sapiens
aacaactgcaacaaca

SEQ ID NO: 12453 - DNA, 16 bp, H. sapiens
aacaactggatgtcca

SEQ ID NO: 12454 - DNA, 16 bp, H. sapiens
aacaacttagaagaaa

SEQ ID NO: 12455 - DNA, 16 bp, H. sapiens
aacaacttcagtaaaa

SEQ ID NO: 12456 - DNA, 16 bp, H. sapiens
aacaacttcagtaaag

SEQ ID NO: 12457 - DNA, 16 bp, H. sapiens
aacaacttgaaaaaca

SEQ ID NO: 12458 - DNA, 16 bp, H. sapiens
aacaacttgattaaaa

SEQ ID NO: 12459 - DNA, 16 bp, H. sapiens
aacaacttggataaat

SEQ ID NO: 12460 - DNA, 16 bp, H. sapiens
aacaagaaaaaagtct

SEQ ID NO: 12461 - DNA, 16 bp, H. sapiens
aacaagaaaacttcag

SEQ ID NO: 12462 - DNA, 16 bp, H. sapiens
aacaagaaaatatatg

SEQ ID NO: 12463 - DNA, 23 bp, H. sapiens
aacaagaaacatgtctaatatct

SEQ ID NO: 12464 - DNA, 16 bp, H. sapiens
aacaagaaatatttat

SEQ ID NO: 12465 - DNA, 16 bp, H. sapiens
aacaagaaatcttgca

SEQ ID NO: 12466 - DNA, 16 bp, H. sapiens
aacaagaaatgggaaa

SEQ ID NO: 12467 - DNA, 16 bp, H. sapiens
aacaagaatgaaattc

SEQ ID NO: 12468 - DNA, 16 bp, H. sapiens
aacaagacagaaaatt

SEQ ID NO: 12469 - DNA, 16 bp, H. sapiens
aacaagaccatgaacc

SEQ ID NO: 12470 - DNA, 16 bp, H. sapiens
aacaagaccctgtctc

SEQ ID NO: 12471 - DNA, 16 bp, H. sapiens
aacaagactctgtctc

SEQ ID NO: 12472 - DNA, 16 bp, H. sapiens
aacaagactttgtctc

SEQ ID NO: 12473 - DNA, 16 bp, H. sapiens
aacaagagacatttat

SEQ ID NO: 12474 - DNA, 16 bp, H. sapiens
aacaagagagaaaatt

SEQ ID NO: 12475 - DNA, 16 bp, H. sapiens
aacaagagagaagatc

SEQ ID NO: 12476 - DNA, 16 bp, H. sapiens
aacaagagggaaactt

SEQ ID NO: 12477 - DNA, 16 bp, H. sapiens
aacaagatccccagat

SEQ ID NO: 12478 - DNA, 16 bp, H. sapiens
aacaagatctccaggt

SEQ ID NO: 12479 - DNA, 16 bp, H. sapiens
aacaagcaagcaagca

SEQ ID NO: 12480 - DNA, 16 bp, H. sapiens
aacaagcaatgagaaa

SEQ ID NO: 12481 - DNA, 16 bp, H. sapiens
aacaagcaattacaaa

SEQ ID NO: 12482 - DNA, 16 bp, H. sapiens
aacaagcagatgaaaa

SEQ ID NO: 12483 - DNA, 16 bp, H. sapiens
aacaagccagaagaga

SEQ ID NO: 12484 - DNA, 16 bp, H. sapiens
aacaagcccaggacca

SEQ ID NO: 12485 - DNA, 16 bp, H. sapiens
aacaaggaaaagttga

SEQ ID NO: 12486 - DNA, 16 bp, H. sapiens
aacaaggaaaatgaag

SEQ ID NO: 12487 - DNA, 16 bp, H. sapiens
aacaaggaaactgagg

SEQ ID NO: 12488 - DNA, 16 bp, H. sapiens
aacaaggaagtaaaac

SEQ ID NO: 12489 - DNA, 16 bp, H. sapiens
aacaaggaagtgaaag

SEQ ID NO: 12490 - DNA, 16 bp, H. sapiens
aacaaggatatgaaaa

SEQ ID NO: 12491 - DNA, 16 bp, H. sapiens
aacaaggatgagttca

SEQ ID NO: 12492 - DNA, 16 bp, H. sapiens
aacaaggatgccaaga

SEQ ID NO: 12493 - DNA, 16 bp, H. sapiens
aacaaggcaccttctt

SEQ ID NO: 12494 - DNA, 16 bp, H. sapiens
aacaaggtcttgctat

SEQ ID NO: 12495 - DNA, 16 bp, H. sapiens
aacaagtaaaaagctg

SEQ ID NO: 12496 - DNA, 16 bp, H. sapiens
aacaagtaaaataatt

SEQ ID NO: 12497 - DNA, 16 bp, H. sapiens
aacaagtaaatattta

SEQ ID NO: 12498 - DNA, 16 bp, H. sapiens
aacaagtatttattga

SEQ ID NO: 12499 - DNA, 16 bp, H. sapiens
aacaagtccttcttca

SEQ ID NO: 12500 - DNA, 16 bp, H. sapiens
aacaagtgaataaatg

SEQ ID NO: 12501 - DNA, 16 bp, H. sapiens
aacaagtggggagaaa

SEQ ID NO: 12502 - DNA, 16 bp, H. sapiens
aacaagttttggcaag

SEQ ID NO: 12503 - DNA, 16 bp, H. sapiens
aacaagtttttaaaaa

SEQ ID NO: 12504 - DNA, 16 bp, H. sapiens
aacaagttttttgttt

SEQ ID NO: 12505 - DNA, 16 bp, H. sapiens
aacaataaagatcaga

SEQ ID NO: 12506 - DNA, 16 bp, H. sapiens
aacaataaagtttgcc

SEQ ID NO: 12507 - DNA, 16 bp, H. sapiens
aacaataaagtttgct

SEQ ID NO: 12508 - DNA, 16 bp, H. sapiens
aacaataacaataatg

SEQ ID NO: 12509 - DNA, 16 bp, H. sapiens
aacaataagcatttat

SEQ ID NO: 12510 - DNA, 16 bp, H. sapiens
aacaataatcatttta

SEQ ID NO: 12511 - DNA, 16 bp, H. sapiens
aacaataattccccat

SEQ ID NO: 12512 - DNA, 16 bp, H. sapiens
aacaatacaaatgtcc

SEQ ID NO: 12513 - DNA, 16 bp, H. sapiens
aacaatacacaccagg

SEQ ID NO: 12514 - DNA, 16 bp, H. sapiens
aacaataggcactggg

SEQ ID NO: 12515 - DNA, 16 bp, H. sapiens
aacaatatcacggggg

SEQ ID NO: 12516 - DNA, 16 bp, H. sapiens
aacaatattacagggg

SEQ ID NO: 12517 - DNA, 16 bp, H. sapiens
aacaatattcttccaa

SEQ ID NO: 12518 - DNA, 16 bp, H. sapiens
aacaatattgaaatga

SEQ ID NO: 12519 - DNA, 16 bp, H. sapiens
aacaatcaaaaatgtc

SEQ ID NO: 12520 - DNA, 16 bp, H. sapiens
aacaatcactgcagtt

SEQ ID NO: 12521 - DNA, 17 bp, H. sapiens
aacaatcatcagagtga

SEQ ID NO: 12522 - DNA, 16 bp, H. sapiens
aacaatcatttattgt

SEQ ID NO: 12523 - DNA, 16 bp, H. sapiens
aacaatcccatttatg

SEQ ID NO: 12524 - DNA, 16 bp, H. sapiens
aacaatgaaatgaaga

SEQ ID NO: 12525 - DNA, 16 bp, H. sapiens
aacaatgacaacaaca

SEQ ID NO: 12526 - DNA, 16 bp, H. sapiens
aacaatgacaataata

SEQ ID NO: 12527 - DNA, 16 bp, H. sapiens
aacaatgagaacacat

SEQ ID NO: 12528 - DNA, 16 bp, H. sapiens
aacaatgagaacattt

SEQ ID NO: 12529 - DNA, 16 bp, H. sapiens
aacaatgagaaccctt

SEQ ID NO: 12530 - DNA, 16 bp, H. sapiens
aacaatgagatcactt

SEQ ID NO: 12531 - DNA, 16 bp, H. sapiens
aacaatgatgataata

SEQ ID NO: 12532 - DNA, 16 bp, H. sapiens
aacaatgcatctgaca

SEQ ID NO: 12533 - DNA, 16 bp, H. sapiens
aacaatggaataaaac

SEQ ID NO: 12534 - DNA, 16 bp, H. sapiens
aacaatgtataaaaat

SEQ ID NO: 12535 - DNA, 16 bp, H. sapiens
aacaatgtattttata

SEQ ID NO: 12536 - DNA, 16 bp, H. sapiens
aacaatgtgtattctg

SEQ ID NO: 12537 - DNA, 16 bp, H. sapiens
aacaatgttcacaaca

SEQ ID NO: 12538 - DNA, 16 bp, H. sapiens
aacaattaaaagaact

SEQ ID NO: 12539 - DNA, 16 bp, H. sapiens
aacaattcagtcacat

SEQ ID NO: 12540 - DNA, 16 bp, H. sapiens
aacaattctttatatt

SEQ ID NO: 12541 - DNA, 16 bp, H. sapiens
aacaattgcaacaaaa

SEQ ID NO: 12542 - DNA, 16 bp, H. sapiens
aacaattgcagaatat

SEQ ID NO: 12543 - DNA, 16 bp, H. sapiens
aacaattgtttttaaa

SEQ ID NO: 12544 - DNA, 16 bp, H. sapiens
aacaatttaacatttt

SEQ ID NO: 12545 - DNA, 16 bp, H. sapiens
aacaatttcagtattg

SEQ ID NO: 12546 - DNA, 16 bp, H. sapiens
aacaatttcattttct

SEQ ID NO: 12547 - DNA, 16 bp, H. sapiens
aacaatttctttttca

SEQ ID NO: 12548 - DNA, 16 bp, H. sapiens
aacaatttgaagaaat

SEQ ID NO: 12549 - DNA, 16 bp, H. sapiens
aacaatttggcaattt

SEQ ID NO: 12550 - DNA, 16 bp, H. sapiens
aacaatttgtaagttt

SEQ ID NO: 12551 - DNA, 16 bp, H. sapiens
aacaattttacttctg

SEQ ID NO: 12552 - DNA, 16 bp, H. sapiens
aacaatttttgttttg

SEQ ID NO: 12553 - DNA, 16 bp, H. sapiens
aacacaaaaataagcc

SEQ ID NO: 12554 - DNA, 16 bp, H. sapiens
aacacaaacacattgt

SEQ ID NO: 12555 - DNA, 16 bp, H. sapiens
aacacaaagaaacttc

SEQ ID NO: 12556 - DNA, 16 bp, H. sapiens
aacacaaagaaatgat

SEQ ID NO: 12557 - DNA, 16 bp, H. sapiens
aacacaaagcctattt

SEQ ID NO: 12558 - DNA, 16 bp, H. sapiens
aacacaaagcttttgg

SEQ ID NO: 12559 - DNA, 16 bp, H. sapiens
aacacaaagtttaaaa

SEQ ID NO: 12560 - DNA, 16 bp, H. sapiens
aacacaaatgaactaa

SEQ ID NO: 12561 - DNA, 16 bp, H. sapiens
aacacaaatgtctatc

SEQ ID NO: 12562 - DNA, 16 bp, H. sapiens
aacacaacagaaattt

SEQ ID NO: 12563 - DNA, 16 bp, H. sapiens
aacacaagaaataact

SEQ ID NO: 12564 - DNA, 16 bp, H. sapiens
aacacaatcagaaata

SEQ ID NO: 12565 - DNA, 16 bp, H. sapiens
aacacaatcatgccct

SEQ ID NO: 12566 - DNA, 16 bp, H. sapiens
aacacaatggcaagta

SEQ ID NO: 12567 - DNA, 16 bp, H. sapiens
aacacaatggtatttg

SEQ ID NO: 12568 - DNA, 16 bp, H. sapiens
aacacaatgtaccaaa

SEQ ID NO: 12569 - DNA, 16 bp, H. sapiens
aacacaatgtctggca

SEQ ID NO: 12570 - DNA, 16 bp, H. sapiens
aacacaattattttaa

SEQ ID NO: 12571 - DNA, 16 bp, H. sapiens
aacacaattccattta

SEQ ID NO: 12572 - DNA, 16 bp, H. sapiens
aacacaattctaaata

SEQ ID NO: 12573 - DNA, 16 bp, H. sapiens
aacacaattgtaagta

SEQ ID NO: 12574 - DNA, 16 bp, H. sapiens
aacacacacatatgta

SEQ ID NO: 12575 - DNA, 16 bp, H. sapiens
aacacacacgtgcaca

SEQ ID NO: 12576 - DNA, 16 bp, H. sapiens
aacacacactggggct

SEQ ID NO: 12577 - DNA, 16 bp, H. sapiens
aacacacagccaacat

SEQ ID NO: 12578 - DNA, 16 bp, H. sapiens
aacacacatatatata

SEQ ID NO: 12579 - DNA, 16 bp, H. sapiens
aacacacatatatgtg

SEQ ID NO: 12580 - DNA, 16 bp, H. sapiens
aacacacatatgcaca

SEQ ID NO: 12581 - DNA, 16 bp, H. sapiens
aacacacattcaggtg

SEQ ID NO: 12582 - DNA, 16 bp, H. sapiens
aacacacatttattat

SEQ ID NO: 12583 - DNA, 16 bp, H. sapiens
aacacacccagttaat

SEQ ID NO: 12584 - DNA, 16 bp, H. sapiens
aacacacgtgcacaca

SEQ ID NO: 12585 - DNA, 16 bp, H. sapiens
aacacactttgagaaa

SEQ ID NO: 12586 - DNA, 16 bp, H. sapiens
aacacactttgggaaa

SEQ ID NO: 12587 - DNA, 16 bp, H. sapiens
aacacagaaataaatt

SEQ ID NO: 12588 - DNA, 16 bp, H. sapiens
aacacagaaggtgggt

SEQ ID NO: 12589 - DNA, 16 bp, H. sapiens
aacacagaatgtcttt

SEQ ID NO: 12590 - DNA, 16 bp, H. sapiens
aacacagacatgaaaa

SEQ ID NO: 12591 - DNA, 16 bp, H. sapiens
aacacagagaaaatat

SEQ ID NO: 12592 - DNA, 16 bp, H. sapiens
aacacagagaaagaat

SEQ ID NO: 12593 - DNA, 16 bp, H. sapiens
aacacagagaagaaat

SEQ ID NO: 12594 - DNA, 16 bp, H. sapiens
aacacagagaaggaat

SEQ ID NO: 12595 - DNA, 16 bp, H. sapiens
aacacagatgaatctc

SEQ ID NO: 12596 - DNA, 16 bp, H. sapiens
aacacagatgcagaaa

SEQ ID NO: 12597 - DNA, 16 bp, H. sapiens
aacacagcaaaaccct

SEQ ID NO: 12598 - DNA, 16 bp, H. sapiens
aacacagcaagactgt

SEQ ID NO: 12599 - DNA, 16 bp, H. sapiens
aacacagcattggaag

SEQ ID NO: 12600 - DNA, 16 bp, H. sapiens
aacacagcatttaaaa

SEQ ID NO: 12601 - DNA, 16 bp, H. sapiens
aacacagccaaatcat

SEQ ID NO: 12602 - DNA, 16 bp, H. sapiens
aacacagccatgccca

SEQ ID NO: 12603 - DNA, 16 bp, H. sapiens
aacacagctctgcacc

SEQ ID NO: 12604 - DNA, 16 bp, H. sapiens
aacacaggaaagacct

SEQ ID NO: 12605 - DNA, 16 bp, H. sapiens
aacacaggaggcggag

SEQ ID NO: 12606 - DNA, 16 bp, H. sapiens
aacacaggcctcagaa

SEQ ID NO: 12607 - DNA, 16 bp, H. sapiens
aacacaggctctggag

SEQ ID NO: 12608 - DNA, 16 bp, H. sapiens
aacacagtgaaactcc

SEQ ID NO: 12609 - DNA, 16 bp, H. sapiens
aacacagtgaaagcct

SEQ ID NO: 12610 - DNA, 16 bp, H. sapiens
aacacagtgcctggca

SEQ ID NO: 12611 - DNA, 16 bp, H. sapiens
aacacagtgtctggca

SEQ ID NO: 12612 - DNA, 16 bp, H. sapiens
aacacagtgtttccaa

SEQ ID NO: 12613 - DNA, 16 bp, H. sapiens
aacacataatttttaa

SEQ ID NO: 12614 - DNA, 16 bp, H. sapiens
aacacatacacatttt

SEQ ID NO: 12615 - DNA, 16 bp, H. sapiens
aacacatagacacatg

SEQ ID NO: 12616 - DNA, 16 bp, H. sapiens
aacacatatataacta

SEQ ID NO: 12617 - DNA, 16 bp, H. sapiens
aacacatcaaaaagtt

SEQ ID NO: 12618 - DNA, 16 bp, H. sapiens
aacacatgaattttag

SEQ ID NO: 12619 - DNA, 16 bp, H. sapiens
aacacatgaattttgg

SEQ ID NO: 12620 - DNA, 16 bp, H. sapiens
aacacatgagaattca

SEQ ID NO: 12621 - DNA, 16 bp, H. sapiens
aacacatgcacacata

SEQ ID NO: 12622 - DNA, 16 bp, H. sapiens
aacacatggaagaaca

SEQ ID NO: 12623 - DNA, 16 bp, H. sapiens
aacacatggacacaca

SEQ ID NO: 12624 - DNA, 16 bp, H. sapiens
aacacatggacacagg

SEQ ID NO: 12625 - DNA, 16 bp, H. sapiens
aacacattaaaaatgt

SEQ ID NO: 12626 - DNA, 16 bp, H. sapiens
aacacattatttttaa

SEQ ID NO: 12627 - DNA, 16 bp, H. sapiens
aacacattcttttttt

SEQ ID NO: 12628 - DNA, 16 bp, H. sapiens
aacacatttattgatt

SEQ ID NO: 12629 - DNA, 16 bp, H. sapiens
aacacatttcaaagaa

SEQ ID NO: 12630 - DNA, 16 bp, H. sapiens
aacacatttcatttat

SEQ ID NO: 12631 - DNA, 16 bp, H. sapiens
aacacatttgtaaata

SEQ ID NO: 12632 - DNA, 16 bp, H. sapiens
aacacattttatattt

SEQ ID NO: 12633 - DNA, 16 bp, H. sapiens
aacacattttcaatgt

SEQ ID NO: 12634 - DNA, 16 bp, H. sapiens
aacacattttctaata

SEQ ID NO: 12635 - DNA, 16 bp, H. sapiens
aacacatttttcttct

SEQ ID NO: 12636 - DNA, 16 bp, H. sapiens
aacacatttttgccaa

SEQ ID NO: 12637 - DNA, 16 bp, H. sapiens
aacaccaaaagaaatg

SEQ ID NO: 12638 - DNA, 16 bp, H. sapiens
aacaccaaaagcagtg

SEQ ID NO: 12639 - DNA, 16 bp, H. sapiens
aacaccaaaagcatga

SEQ ID NO: 12640 - DNA, 16 bp, H. sapiens
aacaccacatcttctc

SEQ ID NO: 12641 - DNA, 16 bp, H. sapiens
aacaccaccaccagtg

SEQ ID NO: 12642 - DNA, 16 bp, H. sapiens
aacaccagaaattatt

SEQ ID NO: 12643 - DNA, 16 bp, H. sapiens
aacaccagtcattgga

SEQ ID NO: 12644 - DNA, 16 bp, H. sapiens
aacaccatcaccatca

SEQ ID NO: 12645 - DNA, 16 bp, H. sapiens
aacaccatgcccggct

SEQ ID NO: 12646 - DNA, 16 bp, H. sapiens
aacaccatggaatact

SEQ ID NO: 12647 - DNA, 16 bp, H. sapiens
aacaccatgtgaaagc

SEQ ID NO: 12648 - DNA, 16 bp, H. sapiens
aacacccaaagcaatg

SEQ ID NO: 12649 - DNA, 16 bp, H. sapiens
aacaccccactctcag

SEQ ID NO: 12650 - DNA, 16 bp, H. sapiens
aacaccctcaaagaca

SEQ ID NO: 12651 - DNA, 16 bp, H. sapiens
aacaccctcacagaca

SEQ ID NO: 12652 - DNA, 16 bp, H. sapiens
aacacctaatacaatg

SEQ ID NO: 12653 - DNA, 16 bp, H. sapiens
aacacctacctcacag

SEQ ID NO: 12654 - DNA, 27 bp, H. sapiens
aacacctattccaaaattgaccacata

SEQ ID NO: 12655 - DNA, 16 bp, H. sapiens
aacacctgaggtcagg

SEQ ID NO: 12656 - DNA, 16 bp, H. sapiens
aacacctggcctgccc

SEQ ID NO: 12657 - DNA, 16 bp, H. sapiens
aacacctgggctcaag

SEQ ID NO: 12658 - DNA, 16 bp, H. sapiens
aacacctgggcttaag

SEQ ID NO: 12659 - DNA, 16 bp, H. sapiens
aacaccttaatcttaa

SEQ ID NO: 12660 - DNA, 17 bp, H. sapiens
aacacggtgaaacccca

SEQ ID NO: 12661 - DNA, 17 bp, H. sapiens
aacacggtgaaaccccc

SEQ ID NO: 12662 - DNA, 22 bp, H. sapiens
aacacggtgaaaccccgtctcc

SEQ ID NO: 12663 - DNA, 16 bp, H. sapiens
aacactaaaacttatt

SEQ ID NO: 12664 - DNA, 16 bp, H. sapiens
aacactaaacagacta

SEQ ID NO: 12665 - DNA, 17 bp, H. sapiens
aacactaaggtctgcag

SEQ ID NO: 12666 - DNA, 16 bp, H. sapiens
aacactaatttatttt

SEQ ID NO: 12667 - DNA, 16 bp, H. sapiens
aacactaatttttaaa

SEQ ID NO: 12668 - DNA, 16 bp, H. sapiens
aacactagaacttatt

SEQ ID NO: 12669 - DNA, 16 bp, H. sapiens
aacactattgaactgt

SEQ ID NO: 12670 - DNA, 16 bp, H. sapiens
aacactatttatttat

SEQ ID NO: 12671 - DNA, 16 bp, H. sapiens
aacactattttatgtt

SEQ ID NO: 12672 - DNA, 16 bp, H. sapiens
aacactatttttgtag

SEQ ID NO: 12673 - DNA, 16 bp, H. sapiens
aacactgaatatcttt

SEQ ID NO: 12674 - DNA, 16 bp, H. sapiens
aacactgaattagcaa

SEQ ID NO: 12675 - DNA, 16 bp, H. sapiens
aacactgaattgtata

SEQ ID NO: 12676 - DNA, 16 bp, H. sapiens
aacactgacattttaa

SEQ ID NO: 12677 - DNA, 16 bp, H. sapiens
aacactgagaagttat

SEQ ID NO: 12678 - DNA, 16 bp, H. sapiens
aacactgatgcaagaa

SEQ ID NO: 12679 - DNA, 16 bp, H. sapiens
aacactgctctaaaaa

SEQ ID NO: 12680 - DNA, 16 bp, H. sapiens
aacactgctgaactgt

SEQ ID NO: 12681 - DNA, 16 bp, H. sapiens
aacactgcttcatgct

SEQ ID NO: 12682 - DNA, 16 bp, H. sapiens
aacactggaacaccca

SEQ ID NO: 12683 - DNA, 16 bp, H. sapiens
aacactggaacagaaa

SEQ ID NO: 12684 - DNA, 16 bp, H. sapiens
aacactggagatcaaa

SEQ ID NO: 12685 - DNA, 16 bp, H. sapiens
aacactgtgaatgtaa

SEQ ID NO: 12686 - DNA, 16 bp, H. sapiens
aacactgtgggaggcc

SEQ ID NO: 12687 - DNA, 16 bp, H. sapiens
aacactgttacaatgg

SEQ ID NO: 12688 - DNA, 16 bp, H. sapiens
aacactgtttattgaa

SEQ ID NO: 12689 - DNA, 16 bp, H. sapiens
aacacttaataaactc

SEQ ID NO: 12690 - DNA, 16 bp, H. sapiens
aacacttagcttaaaa

SEQ ID NO: 12691 - DNA, 17 bp, H. sapiens
aacacttctacactgct

SEQ ID NO: 12692 - DNA, 16 bp, H. sapiens
aacacttctccaaaga

SEQ ID NO: 12693 - DNA, 16 bp, H. sapiens
aacactttgagaagct

SEQ ID NO: 12694 - DNA, 16 bp, H. sapiens
aacactttggaaacac

SEQ ID NO: 12695 - DNA, 16 bp, H. sapiens
aacactttgggaggcc

SEQ ID NO: 12696 - DNA, 16 bp, H. sapiens
aacactttgttataaa

SEQ ID NO: 12697 - DNA, 16 bp, H. sapiens
aacacttttataattt

SEQ ID NO: 12698 - DNA, 16 bp, H. sapiens
aacacttttattttct

SEQ ID NO: 12699 - DNA, 16 bp, H. sapiens
aacagaaaaatggaag

SEQ ID NO: 12700 - DNA, 16 bp, H. sapiens
aacagaaaaatgtgaa

SEQ ID NO: 12701 - DNA, 16 bp, H. sapiens
aacagaaaaccacata

SEQ ID NO: 12702 - DNA, 16 bp, H. sapiens
aacagaaaacctacag

SEQ ID NO: 12703 - DNA, 16 bp, H. sapiens
aacagaaaaggtacag

SEQ ID NO: 12704 - DNA, 16 bp, H. sapiens
aacagaaaataaattt

SEQ ID NO: 12705 - DNA, 16 bp, H. sapiens
aacagaaaataatttt

SEQ ID NO: 12706 - DNA, 16 bp, H. sapiens
aacagaaaatatattc

SEQ ID NO: 12707 - DNA, 16 bp, H. sapiens
aacagaaaattcacaa

SEQ ID NO: 12708 - DNA, 16 bp, H. sapiens
aacagaaaattcagaa

SEQ ID NO: 12709 - DNA, 16 bp, H. sapiens
aacagaaaattccaaa

SEQ ID NO: 12710 - DNA, 16 bp, H. sapiens
aacagaaaattggaaa

SEQ ID NO: 12711 - DNA, 16 bp, H. sapiens
aacagaaacaaaacct

SEQ ID NO: 12712 - DNA, 16 bp, H. sapiens
aacagaaacaatttca

SEQ ID NO: 12713 - DNA, 16 bp, H. sapiens
aacagaaacatggcag

SEQ ID NO: 12714 - DNA, 16 bp, H. sapiens
aacagaaacttttcaa

SEQ ID NO: 12715 - DNA, 16 bp, H. sapiens
aacagaaagaaggcca

SEQ ID NO: 12716 - DNA, 16 bp, H. sapiens
aacagaaagaggagtg

SEQ ID NO: 12717 - DNA, 16 bp, H. sapiens
aacagaaaggaaatcc

SEQ ID NO: 12718 - DNA, 16 bp, H. sapiens
aacagaaaggacaccc

SEQ ID NO: 12719 - DNA, 17 bp, H. sapiens
aacagaaaggacaccca

SEQ ID NO: 12720 - DNA, 16 bp, H. sapiens
aacagaaatatatttt

SEQ ID NO: 12721 - DNA, 16 bp, H. sapiens
aacagaaatcattcta

SEQ ID NO: 12722 - DNA, 16 bp, H. sapiens
aacagaaatgcattct

SEQ ID NO: 12723 - DNA, 16 bp, H. sapiens
aacagaaattgacaaa

SEQ ID NO: 12724 - DNA, 16 bp, H. sapiens
aacagaaatttgtttt

SEQ ID NO: 12725 - DNA, 16 bp, H. sapiens
aacagaaattttgaaa

SEQ ID NO: 12726 - DNA, 16 bp, H. sapiens
aacagaacaagacttt

SEQ ID NO: 12727 - DNA, 16 bp, H. sapiens
aacagaacaagatcct

SEQ ID NO: 12728 - DNA, 16 bp, H. sapiens
aacagaacagaaaatt

SEQ ID NO: 12729 - DNA, 16 bp, H. sapiens
aacagaacagagactt

SEQ ID NO: 12730 - DNA, 25 bp, H. sapiens
aacagaacagaggcctcagaaataa

SEQ ID NO: 12731 - DNA, 18 bp, H. sapiens
aacagaaccaaagataaa

SEQ ID NO: 12732 - DNA, 16 bp, H. sapiens
aacagaaccagagaca

SEQ ID NO: 12733 - DNA, 16 bp, H. sapiens
aacagaagaaaatatt

SEQ ID NO: 12734 - DNA, 16 bp, H. sapiens
aacagaagaaaatgtt

SEQ ID NO: 12735 - DNA, 16 bp, H. sapiens
aacagaagaaaattta

SEQ ID NO: 12736 - DNA, 16 bp, H. sapiens
aacagaagaaacattt

SEQ ID NO: 12737 - DNA, 16 bp, H. sapiens
aacagaagaaagaact

SEQ ID NO: 12738 - DNA, 16 bp, H. sapiens
aacagaagacaaaatt

SEQ ID NO: 12739 - DNA, 16 bp, H. sapiens
aacagaagagagaact

SEQ ID NO: 12740 - DNA, 16 bp, H. sapiens
aacagaagatgaaaca

SEQ ID NO: 12741 - DNA, 16 bp, H. sapiens
aacagaagctcagaga

SEQ ID NO: 12742 - DNA, 16 bp, H. sapiens
aacagaagtggcaaga

SEQ ID NO: 12743 - DNA, 16 bp, H. sapiens
aacagaagttttaaaa

SEQ ID NO: 12744 - DNA, 16 bp, H. sapiens
aacagaataaaggaga

SEQ ID NO: 12745 - DNA, 16 bp, H. sapiens
aacagaataccataga

SEQ ID NO: 12746 - DNA, 16 bp, H. sapiens
aacagaatagaaaatg

SEQ ID NO: 12747 - DNA, 16 bp, H. sapiens
aacagaatagaccaag

SEQ ID NO: 12748 - DNA, 16 bp, H. sapiens
aacagaatatgcattc

SEQ ID NO: 12749 - DNA, 16 bp, H. sapiens
aacagaatatggcaaa

SEQ ID NO: 12750 - DNA, 16 bp, H. sapiens
aacagaatcacctgga

SEQ ID NO: 12751 - DNA, 16 bp, H. sapiens
aacagaatgaaataat

SEQ ID NO: 12752 - DNA, 16 bp, H. sapiens
aacagaatgaagaaca

SEQ ID NO: 12753 - DNA, 16 bp, H. sapiens
aacagaatgagacctt

SEQ ID NO: 12754 - DNA, 16 bp, H. sapiens
aacagaatgagactgt

SEQ ID NO: 12755 - DNA, 16 bp, H. sapiens
aacagaatggaatgga

SEQ ID NO: 12756 - DNA, 16 bp, H. sapiens
aacagaattaaaaacc

SEQ ID NO: 12757 - DNA, 16 bp, H. sapiens
aacagaattaaagaca

SEQ ID NO: 12758 - DNA, 16 bp, H. sapiens
aacagaattatttgac

SEQ ID NO: 12759 - DNA, 16 bp, H. sapiens
aacagaattcaacagc

SEQ ID NO: 12760 - DNA, 16 bp, H. sapiens
aacagaatttaaaaca

SEQ ID NO: 12761 - DNA, 16 bp, H. sapiens
aacagacaaatacacc

SEQ ID NO: 12762 - DNA, 16 bp, H. sapiens
aacagacaaccaaata

SEQ ID NO: 12763 - DNA, 16 bp, H. sapiens
aacagacatgtacaga

SEQ ID NO: 12764 - DNA, 16 bp, H. sapiens
aacagacatttacaaa

SEQ ID NO: 12765 - DNA, 16 bp, H. sapiens
aacagacatttctcca

SEQ ID NO: 12766 - DNA, 16 bp, H. sapiens
aacagaccaataagaa

SEQ ID NO: 12767 - DNA, 16 bp, H. sapiens
aacagaccactgggct

SEQ ID NO: 12768 - DNA, 16 bp, H. sapiens
aacagacctaagaaat

SEQ ID NO: 12769 - DNA, 16 bp, H. sapiens
aacagagaaagactct

SEQ ID NO: 12770 - DNA, 16 bp, H. sapiens
aacagagaaatgcaaa

SEQ ID NO: 12771 - DNA, 35 bp, H. sapiens
aacagagaaccaaatcatgagtgaactcccattca

SEQ ID NO: 12772 - DNA, 16 bp, H. sapiens
aacagagaacccagaa

SEQ ID NO: 12773 - DNA, 16 bp, H. sapiens
aacagagaactttcca

SEQ ID NO: 12774 - DNA, 16 bp, H. sapiens
aacagagaagtgacag

SEQ ID NO: 12775 - DNA, 16 bp, H. sapiens
aacagagaccccatct

SEQ ID NO: 12776 - DNA, 17 bp, H. sapiens
aacagagacctcagaaa

SEQ ID NO: 12777 - DNA, 16 bp, H. sapiens
aacagagagaaactcc

SEQ ID NO: 12778 - DNA, 16 bp, H. sapiens
aacagagagagacctc

SEQ ID NO: 12779 - DNA, 16 bp, H. sapiens
aacagagatgcaaaaa

SEQ ID NO: 12780 - DNA, 16 bp, H. sapiens
aacagagatttaccca

SEQ ID NO: 12781 - DNA, 16 bp, H. sapiens
aacagagatttttaaa

SEQ ID NO: 12782 - DNA, 16 bp, H. sapiens
aacagagcaagaccca

SEQ ID NO: 12783 - DNA, 17 bp, H. sapiens
aacagagcaagacccta

SEQ ID NO: 12784 - DNA, 16 bp, H. sapiens
aacagagcaagactcc

SEQ ID NO: 12785 - DNA, 16 bp, H. sapiens
aacagagccagactcc

SEQ ID NO: 12786 - DNA, 16 bp, H. sapiens
aacagagccagactct

SEQ ID NO: 12787 - DNA, 37 bp, H. sapiens
aacagagccctcagaaataatgccacatatctacaac

SEQ ID NO: 12788 - DNA, 16 bp, H. sapiens
aacagagcgagactcc

SEQ ID NO: 12789 - DNA, 16 bp, H. sapiens
aacagagcgaggctgt

SEQ ID NO: 12790 - DNA, 16 bp, H. sapiens
aacagagctagactcc

SEQ ID NO: 12791 - DNA, 16 bp, H. sapiens
aacagaggagaccctg

SEQ ID NO: 12792 - DNA, 16 bp, H. sapiens
aacagaggatactaga

SEQ ID NO: 12793 - DNA, 16 bp, H. sapiens
aacagaggcccagaga

SEQ ID NO: 12794 - DNA, 16 bp, H. sapiens
aacagaggccccagaa

SEQ ID NO: 12795 - DNA, 16 bp, H. sapiens
aacagaggctgcagaa

SEQ ID NO: 12796 - DNA, 16 bp, H. sapiens
aacagagtaaacaaac

SEQ ID NO: 12797 - DNA, 16 bp, H. sapiens
aacagagtaagacccc

SEQ ID NO: 12798 - DNA, 16 bp, H. sapiens
aacagagtaagactcc

SEQ ID NO: 12799 - DNA, 16 bp, H. sapiens
aacagagtaagacttt

SEQ ID NO: 12800 - DNA, 16 bp, H. sapiens
aacagagtagatttta

SEQ ID NO: 12801 - DNA, 16 bp, H. sapiens
aacagagtctcactct

SEQ ID NO: 12802 - DNA, 16 bp, H. sapiens
aacagagtgaagaaaa

SEQ ID NO: 12803 - DNA, 16 bp, H. sapiens
aacagagtgagaactc

SEQ ID NO: 12804 - DNA, 19 bp, H. sapiens
aacagagtgagaccctatt

SEQ ID NO: 12805 - DNA, 16 bp, H. sapiens
aacagagtgagactcc

SEQ ID NO: 12806 - DNA, 18 bp, H. sapiens
aacagagtgagactctgc

SEQ ID NO: 12807 - DNA, 19 bp, H. sapiens
aacagagtgagactctgtt

SEQ ID NO: 12808 - DNA, 16 bp, H. sapiens
aacagagtgagactta

SEQ ID NO: 12809 - DNA, 16 bp, H. sapiens
aacagagtgttggaag

SEQ ID NO: 12810 - DNA, 16 bp, H. sapiens
aacagataaatggatt

SEQ ID NO: 12811 - DNA, 16 bp, H. sapiens
aacagataataaatat

SEQ ID NO: 12812 - DNA, 16 bp, H. sapiens
aacagataataataat

SEQ ID NO: 12813 - DNA, 16 bp, H. sapiens
aacagatatatacaaa

SEQ ID NO: 12814 - DNA, 16 bp, H. sapiens
aacagatatttattga

SEQ ID NO: 12815 - DNA, 16 bp, H. sapiens
aacagatatttgtaca

SEQ ID NO: 12816 - DNA, 16 bp, H. sapiens
aacagatcaagaccct

SEQ ID NO: 12817 - DNA, 16 bp, H. sapiens
aacagatccttcccta

SEQ ID NO: 12818 - DNA, 16 bp, H. sapiens
aacagatctggaggca

SEQ ID NO: 12819 - DNA, 16 bp, H. sapiens
aacagatgaaaagata

SEQ ID NO: 12820 - DNA, 16 bp, H. sapiens
aacagatgagaaaaca

SEQ ID NO: 12821 - DNA, 16 bp, H. sapiens
aacagatgagaaaatg

SEQ ID NO: 12822 - DNA, 16 bp, H. sapiens
aacagatgaggagttg

SEQ ID NO: 12823 - DNA, 16 bp, H. sapiens
aacagatgccagtgag

SEQ ID NO: 12824 - DNA, 16 bp, H. sapiens
aacagatgctggagaa

SEQ ID NO: 12825 - DNA, 16 bp, H. sapiens
aacagatgcttctcaa

SEQ ID NO: 12826 - DNA, 16 bp, H. sapiens
aacagatggaaaaaca

SEQ ID NO: 12827 - DNA, 16 bp, H. sapiens
aacagatggaaaaata

SEQ ID NO: 12828 - DNA, 16 bp, H. sapiens
aacagatgtgtgtgtg

SEQ ID NO: 12829 - DNA, 16 bp, H. sapiens
aacagatgttgatgag

SEQ ID NO: 12830 - DNA, 16 bp, H. sapiens
aacagattctgaaatt

SEQ ID NO: 12831 - DNA, 16 bp, H. sapiens
aacagatttatttata

SEQ ID NO: 12832 - DNA, 16 bp, H. sapiens
aacagattttaaatca

SEQ ID NO: 12833 - DNA, 16 bp, H. sapiens
aacagatttttaatgt

SEQ ID NO: 12834 - DNA, 16 bp, H. sapiens
aacagatttttttttt

SEQ ID NO: 12835 - DNA, 16 bp, H. sapiens
aacagcaaaaatggca

SEQ ID NO: 12836 - DNA, 16 bp, H. sapiens
aacagcaaaagaaact

SEQ ID NO: 12837 - DNA, 16 bp, H. sapiens
aacagcaaagatggca

SEQ ID NO: 12838 - DNA, 16 bp, H. sapiens
aacagcaaaggcaaag

SEQ ID NO: 12839 - DNA, 16 bp, H. sapiens
aacagcaacaaaattt

SEQ ID NO: 12840 - DNA, 16 bp, H. sapiens
aacagcaacagtatat

SEQ ID NO: 12841 - DNA, 16 bp, H. sapiens
aacagcaactccaaga

SEQ ID NO: 12842 - DNA, 16 bp, H. sapiens
aacagcaagaaaaact

SEQ ID NO: 12843 - DNA, 16 bp, H. sapiens
aacagcaagactctgt

SEQ ID NO: 12844 - DNA, 16 bp, H. sapiens
aacagcaataataaca

SEQ ID NO: 12845 - DNA, 16 bp, H. sapiens
aacagcacaaacaata

SEQ ID NO: 12846 - DNA, 16 bp, H. sapiens
aacagcacatcaaaaa

SEQ ID NO: 12847 - DNA, 16 bp, H. sapiens
aacagcagaatacaca

SEQ ID NO: 12848 - DNA, 16 bp, H. sapiens
aacagcagatctctct

SEQ ID NO: 12849 - DNA, 16 bp, H. sapiens
aacagcagcagcaaca

SEQ ID NO: 12850 - DNA, 16 bp, H. sapiens
aacagcagcagcatca

SEQ ID NO: 12851 - DNA, 16 bp, H. sapiens
aacagcagcatggagg

SEQ ID NO: 12852 - DNA, 16 bp, H. sapiens
aacagcaggccttgag

SEQ ID NO: 12853 - DNA, 16 bp, H. sapiens
aacagcaggctattag

SEQ ID NO: 12854 - DNA, 16 bp, H. sapiens
aacagcagtgttctgg

SEQ ID NO: 12855 - DNA, 16 bp, H. sapiens
aacagcatatgcaaag

SEQ ID NO: 12856 - DNA, 16 bp, H. sapiens
aacagcatcaacatca

SEQ ID NO: 12857 - DNA, 16 bp, H. sapiens
aacagcatggagaaaa

SEQ ID NO: 12858 - DNA, 18 bp, H. sapiens
aacagcatgggaaagact

SEQ ID NO: 12859 - DNA, 16 bp, H. sapiens
aacagcatgggaaagg

SEQ ID NO: 12860 - DNA, 16 bp, H. sapiens
aacagcatgggggaaa

SEQ ID NO: 12861 - DNA, 16 bp, H. sapiens
aacagcatggtaccag

SEQ ID NO: 12862 - DNA, 16 bp, H. sapiens
aacagcatgtgcaaag

SEQ ID NO: 12863 - DNA, 16 bp, H. sapiens
aacagcatttttaaaa

SEQ ID NO: 12864 - DNA, 16 bp, H. sapiens
aacagccaaatggaag

SEQ ID NO: 12865 - DNA, 16 bp, H. sapiens
aacagccagctaaaat

SEQ ID NO: 12866 - DNA, 16 bp, H. sapiens
aacagccaggcatggt

SEQ ID NO: 12867 - DNA, 16 bp, H. sapiens
aacagcccaagtgtcc

SEQ ID NO: 12868 - DNA, 16 bp, H. sapiens
aacagcccagaaataa

SEQ ID NO: 12869 - DNA, 16 bp, H. sapiens
aacagcccaggaaaga

SEQ ID NO: 12870 - DNA, 16 bp, H. sapiens
aacagccccaccccat

SEQ ID NO: 12871 - DNA, 16 bp, H. sapiens
aacagccctttcccaa

SEQ ID NO: 12872 - DNA, 16 bp, H. sapiens
aacagccctttcctga

SEQ ID NO: 12873 - DNA, 16 bp, H. sapiens
aacagcctcacagaca

SEQ ID NO: 12874 - DNA, 16 bp, H. sapiens
aacagcctcaggcagg

SEQ ID NO: 12875 - DNA, 16 bp, H. sapiens
aacagcctgaaaaatc

SEQ ID NO: 12876 - DNA, 16 bp, H. sapiens
aacagcctgctcctga

SEQ ID NO: 12877 - DNA, 16 bp, H. sapiens
aacagcctgggcatca

SEQ ID NO: 12878 - DNA, 16 bp, H. sapiens
aacagcgtgggggaaa

SEQ ID NO: 12879 - DNA, 16 bp, H. sapiens
aacagctaccatttat

SEQ ID NO: 12880 - DNA, 16 bp, H. sapiens
aacagctcagagaaga

SEQ ID NO: 12881 - DNA, 16 bp, H. sapiens
aacagctcagaggaga

SEQ ID NO: 12882 - DNA, 16 bp, H. sapiens
aacagctcctggattt

SEQ ID NO: 12883 - DNA, 16 bp, H. sapiens
aacagctctgaagaga

SEQ ID NO: 12884 - DNA, 16 bp, H. sapiens
aacagctgcaaaaaat

SEQ ID NO: 12885 - DNA, 16 bp, H. sapiens
aacagctgctggagag

SEQ ID NO: 12886 - DNA, 16 bp, H. sapiens
aacagctgtgtgacct

SEQ ID NO: 12887 - DNA, 16 bp, H. sapiens
aacagcttgggggaaa

SEQ ID NO: 12888 - DNA, 16 bp, H. sapiens
aacagctttatggaga

SEQ ID NO: 12889 - DNA, 16 bp, H. sapiens
aacagctttccaaagt

SEQ ID NO: 12890 - DNA, 16 bp, H. sapiens
aacagctttttgtttt

SEQ ID NO: 12891 - DNA, 16 bp, H. sapiens
aacaggaaaagaagtc

SEQ ID NO: 12892 - DNA, 17 bp, H. sapiens
aacaggaaaatatcaca

SEQ ID NO: 12893 - DNA, 16 bp, H. sapiens
aacaggaaaatgaaca

SEQ ID NO: 12894 - DNA, 16 bp, H. sapiens
aacaggaaacacttct

SEQ ID NO: 12895 - DNA, 16 bp, H. sapiens
aacaggaaatattttt

SEQ ID NO: 12896 - DNA, 16 bp, H. sapiens
aacaggaaatgaaaca

SEQ ID NO: 12897 - DNA, 16 bp, H. sapiens
aacaggaacaatttga

SEQ ID NO: 12898 - DNA, 16 bp, H. sapiens
aacaggaatatgaaaa

SEQ ID NO: 12899 - DNA, 16 bp, H. sapiens
aacaggaatgcctgtt

SEQ ID NO: 12900 - DNA, 16 bp, H. sapiens
aacaggaattccttat

SEQ ID NO: 12901 - DNA, 16 bp, H. sapiens
aacaggacagcactga

SEQ ID NO: 12902 - DNA, 16 bp, H. sapiens
aacaggagaaaatatt

SEQ ID NO: 12903 - DNA, 16 bp, H. sapiens
aacaggagagactcct

SEQ ID NO: 12904 - DNA, 28 bp, H. sapiens
aacaggagcacccagattcataaagcaa

SEQ ID NO: 12905 - DNA, 16 bp, H. sapiens
aacaggagtgaaactc

SEQ ID NO: 12906 - DNA, 16 bp, H. sapiens
aacaggatgatgctgg

SEQ ID NO: 12907 - DNA, 16 bp, H. sapiens
aacaggatggctgggt

SEQ ID NO: 12908 - DNA, 16 bp, H. sapiens
aacaggatttgctgat

SEQ ID NO: 12909 - DNA, 16 bp, H. sapiens
aacaggattttatttt

SEQ ID NO: 12910 - DNA, 16 bp, H. sapiens
aacaggcaaatccata

SEQ ID NO: 12911 - DNA, 16 bp, H. sapiens
aacaggcagagattga

SEQ ID NO: 12912 - DNA, 16 bp, H. sapiens
aacaggcagaggctga

SEQ ID NO: 12913 - DNA, 17 bp, H. sapiens
aacaggcagaggctgga

SEQ ID NO: 12914 - DNA, 16 bp, H. sapiens
aacaggcagagtttgg

SEQ ID NO: 12915 - DNA, 17 bp, H. sapiens
aacaggcagcaatcttt

SEQ ID NO: 12916 - DNA, 16 bp, H. sapiens
aacaggcaggcctcca

SEQ ID NO: 12917 - DNA, 16 bp, H. sapiens
aacaggcatgagccac

SEQ ID NO: 12918 - DNA, 16 bp, H. sapiens
aacaggcccaggagcc

SEQ ID NO: 12919 - DNA, 16 bp, H. sapiens
aacaggccccagtgtg

SEQ ID NO: 12920 - DNA, 16 bp, H. sapiens
aacaggcccccatgtg

SEQ ID NO: 12921 - DNA, 16 bp, H. sapiens
aacaggccctggggtg

SEQ ID NO: 12922 - DNA, 17 bp, H. sapiens
aacaggctagccatatg

SEQ ID NO: 12923 - DNA, 16 bp, H. sapiens
aacaggctcagagagg

SEQ ID NO: 12924 - DNA, 16 bp, H. sapiens
aacaggctggccaaca

SEQ ID NO: 12925 - DNA, 20 bp, H. sapiens
aacaggctttgtgtgagcaa

SEQ ID NO: 12926 - DNA, 16 bp, H. sapiens
aacagggacaattgga

SEQ ID NO: 12927 - DNA, 16 bp, H. sapiens
aacagggagaggctgg

SEQ ID NO: 12928 - DNA, 16 bp, H. sapiens
aacaggggaggcagag

SEQ ID NO: 12929 - DNA, 16 bp, H. sapiens
aacaggggatttaaat

SEQ ID NO: 12930 - DNA, 16 bp, H. sapiens
aacagggtctcacttt

SEQ ID NO: 12931 - DNA, 16 bp, H. sapiens
aacagggtctggagta

SEQ ID NO: 12932 - DNA, 16 bp, H. sapiens
aacagggtcttcctct

SEQ ID NO: 12933 - DNA, 16 bp, H. sapiens
aacagggtcttgctct

SEQ ID NO: 12934 - DNA, 16 bp, H. sapiens
aacagggtgaaaccct

SEQ ID NO: 12935 - DNA, 16 bp, H. sapiens
aacagggtgaaactct

SEQ ID NO: 12936 - DNA, 16 bp, H. sapiens
aacagggtgtggagtg

SEQ ID NO: 12937 - DNA, 16 bp, H. sapiens
aacagggtgtgtgtgt

SEQ ID NO: 12938 - DNA, 16 bp, H. sapiens
aacaggtatatgaaaa

SEQ ID NO: 12939 - DNA, 16 bp, H. sapiens
aacaggtccaggagct

SEQ ID NO: 12940 - DNA, 16 bp, H. sapiens
aacaggtgcaggactg

SEQ ID NO: 12941 - DNA, 16 bp, H. sapiens
aacaggtgtgagatga

SEQ ID NO: 12942 - DNA, 16 bp, H. sapiens
aacaggttttcaccat

SEQ ID NO: 12943 - DNA, 16 bp, H. sapiens
aacagtaaaatatata

SEQ ID NO: 12944 - DNA, 16 bp, H. sapiens
aacagtaaattttttt

SEQ ID NO: 12945 - DNA, 16 bp, H. sapiens
aacagtaagctattag

SEQ ID NO: 12946 - DNA, 16 bp, H. sapiens
aacagtacattaaaaa

SEQ ID NO: 12947 - DNA, 16 bp, H. sapiens
aacagtagttccaaat

SEQ ID NO: 12948 - DNA, 16 bp, H. sapiens
aacagtattaaaaggt

SEQ ID NO: 12949 - DNA, 16 bp, H. sapiens
aacagtattaagaagt

SEQ ID NO: 12950 - DNA, 16 bp, H. sapiens
aacagtattttaaaga

SEQ ID NO: 12951 - DNA, 16 bp, H. sapiens
aacagtcactggggca

SEQ ID NO: 12952 - DNA, 16 bp, H. sapiens
aacagtccccagaatg

SEQ ID NO: 12953 - DNA, 16 bp, H. sapiens
aacagtcccccaaaat

SEQ ID NO: 12954 - DNA, 16 bp, H. sapiens
aacagtctttttgaag

SEQ ID NO: 12955 - DNA, 16 bp, H. sapiens
aacagtgaaaagttga

SEQ ID NO: 12956 - DNA, 16 bp, H. sapiens
aacagtgaaacagcaa

SEQ ID NO: 12957 - DNA, 16 bp, H. sapiens
aacagtgaaaccccat

SEQ ID NO: 12958 - DNA, 16 bp, H. sapiens
aacagtgaaactccat

SEQ ID NO: 12959 - DNA, 16 bp, H. sapiens
aacagtgaaactctgt

SEQ ID NO: 12960 - DNA, 16 bp, H. sapiens
aacagtgaagtccagg

SEQ ID NO: 12961 - DNA, 16 bp, H. sapiens
aacagtgacaatttga

SEQ ID NO: 12962 - DNA, 16 bp, H. sapiens
aacagtgaggattatc

SEQ ID NO: 12963 - DNA, 16 bp, H. sapiens
aacagtgatgaaagtg

SEQ ID NO: 12964 - DNA, 16 bp, H. sapiens
aacagtgatgatgagc

SEQ ID NO: 12965 - DNA, 16 bp, H. sapiens
aacagtgcctggtaca

SEQ ID NO: 12966 - DNA, 16 bp, H. sapiens
aacagtgctgctgtga

SEQ ID NO: 12967 - DNA, 16 bp, H. sapiens
aacagtggatttaaac

SEQ ID NO: 12968 - DNA, 16 bp, H. sapiens
aacagtggatttctca

SEQ ID NO: 12969 - DNA, 16 bp, H. sapiens
aacagtggttcttaaa

SEQ ID NO: 12970 - DNA, 20 bp, H. sapiens
aacagtgtaaaagcattcct

SEQ ID NO: 12971 - DNA, 16 bp, H. sapiens
aacagtgttttatagt

SEQ ID NO: 12972 - DNA, 16 bp, H. sapiens
aacagttctcaaaaga

SEQ ID NO: 12973 - DNA, 16 bp, H. sapiens
aacagttctttatata

SEQ ID NO: 12974 - DNA, 16 bp, H. sapiens
aacagtttatttttct

SEQ ID NO: 12975 - DNA, 16 bp, H. sapiens
aacagtttcatccaga

SEQ ID NO: 12976 - DNA, 16 bp, H. sapiens
aacagtttcctcatct

SEQ ID NO: 12977 - DNA, 16 bp, H. sapiens
aacagtttttaaaaat

SEQ ID NO: 12978 - DNA, 16 bp, H. sapiens
aacagtttttctttca

SEQ ID NO: 12979 - DNA, 16 bp, H. sapiens
aacagttttttctaat

SEQ ID NO: 12980 - DNA, 16 bp, H. sapiens
aacataaaatatatgt

SEQ ID NO: 12981 - DNA, 16 bp, H. sapiens
aacataaaatgtttat

SEQ ID NO: 12982 - DNA, 16 bp, H. sapiens
aacataaacattttta

SEQ ID NO: 12983 - DNA, 16 bp, H. sapiens
aacataaatattttct

SEQ ID NO: 12984 - DNA, 16 bp, H. sapiens
aacataaatgaatttc

SEQ ID NO: 12985 - DNA, 16 bp, H. sapiens
aacataaatgtattat

SEQ ID NO: 12986 - DNA, 16 bp, H. sapiens
aacataacaagaccct

SEQ ID NO: 12987 - DNA, 16 bp, H. sapiens
aacataagacctgaaa

SEQ ID NO: 12988 - DNA, 16 bp, H. sapiens
aacataagtttatttt

SEQ ID NO: 12989 - DNA, 16 bp, H. sapiens
aacataatacctgaaa

SEQ ID NO: 12990 - DNA, 16 bp, H. sapiens
aacataatgatttcca

SEQ ID NO: 12991 - DNA, 16 bp, H. sapiens
aacataattatctcca

SEQ ID NO: 12992 - DNA, 16 bp, H. sapiens
aacataattcctatca

SEQ ID NO: 12993 - DNA, 16 bp, H. sapiens
aacataattggaaaat

SEQ ID NO: 12994 - DNA, 16 bp, H. sapiens
aacatacaatttttaa

SEQ ID NO: 12995 - DNA, 16 bp, H. sapiens
aacatacacatatttt

SEQ ID NO: 12996 - DNA, 16 bp, H. sapiens
aacatacatgtaaaaa

SEQ ID NO: 12997 - DNA, 16 bp, H. sapiens
aacatacattgaagaa

SEQ ID NO: 12998 - DNA, 16 bp, H. sapiens
aacatacatttatata

SEQ ID NO: 12999 - DNA, 16 bp, H. sapiens
aacatacatttctcaa

SEQ ID NO: 13000 - DNA, 16 bp, H. sapiens
aacataccaggaaagc

SEQ ID NO: 13001 - DNA, 16 bp, H. sapiens
aacataccatgtttgg

SEQ ID NO: 13002 - DNA, 16 bp, H. sapiens
aacatagaatatcttt

SEQ ID NO: 13003 - DNA, 16 bp, H. sapiens
aacatagaccctcatc

SEQ ID NO: 13004 - DNA, 16 bp, H. sapiens
aacatagataaatctt

SEQ ID NO: 13005 - DNA, 16 bp, H. sapiens
aacatagatgaaaaat

SEQ ID NO: 13006 - DNA, 16 bp, H. sapiens
aacatagatgaaactg

SEQ ID NO: 13007 - DNA, 16 bp, H. sapiens
aacatagatgaacctt

SEQ ID NO: 13008 - DNA, 16 bp, H. sapiens
aacatagcaagactcc

SEQ ID NO: 13009 - DNA, 16 bp, H. sapiens
aacatagcaagactgc

SEQ ID NO: 13010 - DNA, 16 bp, H. sapiens
aacatagcaagatctc

SEQ ID NO: 13011 - DNA, 16 bp, H. sapiens
aacatagcgaaaccct

SEQ ID NO: 13012 - DNA, 17 bp, H. sapiens
aacatagggagacccca

SEQ ID NO: 13013 - DNA, 16 bp, H. sapiens
aacatagtaaaaatgt

SEQ ID NO: 13014 - DNA, 16 bp, H. sapiens
aacatagtaaaacccc

SEQ ID NO: 13015 - DNA, 16 bp, H. sapiens
aacatagtgaaacccc

SEQ ID NO: 13016 - DNA, 16 bp, H. sapiens
aacatagtgagaccct

SEQ ID NO: 13017 - DNA, 16 bp, H. sapiens
aacatagtgagacctc

SEQ ID NO: 13018 - DNA, 16 bp, H. sapiens
aacatagtgaggcctc

SEQ ID NO: 13019 - DNA, 16 bp, H. sapiens
aacatagtttattctt

SEQ ID NO: 13020 - DNA, 16 bp, H. sapiens
aacatagtttattttt

SEQ ID NO: 13021 - DNA, 16 bp, H. sapiens
aacatagttttttttt

SEQ ID NO: 13022 - DNA, 16 bp, H. sapiens
aacatatacagaacat

SEQ ID NO: 13023 - DNA, 16 bp, H. sapiens
aacatatagaaaaatg

SEQ ID NO: 13024 - DNA, 16 bp, H. sapiens
aacatatagaaatata

SEQ ID NO: 13025 - DNA, 16 bp, H. sapiens
aacatatagaaatgta

SEQ ID NO: 13026 - DNA, 16 bp, H. sapiens
aacatatatatacaca

SEQ ID NO: 13027 - DNA, 16 bp, H. sapiens
aacatatatgtgtgta

SEQ ID NO: 13028 - DNA, 16 bp, H. sapiens
aacatatatgtgtgtg

SEQ ID NO: 13029 - DNA, 16 bp, H. sapiens
aacatatgatatttgt

SEQ ID NO: 13030 - DNA, 16 bp, H. sapiens
aacatatggaaaaata

SEQ ID NO: 13031 - DNA, 16 bp, H. sapiens
aacatatggtatttgg

SEQ ID NO: 13032 - DNA, 16 bp, H. sapiens
aacatatggtatttgt

SEQ ID NO: 13033 - DNA, 16 bp, H. sapiens
aacatatgtctacaca

SEQ ID NO: 13034 - DNA, 16 bp, H. sapiens
aacatatgttttatat

SEQ ID NO: 13035 - DNA, 16 bp, H. sapiens
aacatattaaaaatga

SEQ ID NO: 13036 - DNA, 16 bp, H. sapiens
aacatattaaaatgta

SEQ ID NO: 13037 - DNA, 16 bp, H. sapiens
aacatattaatatgtt

SEQ ID NO: 13038 - DNA, 16 bp, H. sapiens
aacatattcataggtt

SEQ ID NO: 13039 - DNA, 16 bp, H. sapiens
aacatattcatcactt

SEQ ID NO: 13040 - DNA, 16 bp, H. sapiens
aacatattcctcattt

SEQ ID NO: 13041 - DNA, 16 bp, H. sapiens
aacatattgtatattt

SEQ ID NO: 13042 - DNA, 16 bp, H. sapiens
aacatatttaaaatag

SEQ ID NO: 13043 - DNA, 16 bp, H. sapiens
aacatatttaaagaaa

SEQ ID NO: 13044 - DNA, 16 bp, H. sapiens
aacatatttacttatt

SEQ ID NO: 13045 - DNA, 16 bp, H. sapiens
aacatatttctcagaa

SEQ ID NO: 13046 - DNA, 16 bp, H. sapiens
aacatatttgaaataa

SEQ ID NO: 13047 - DNA, 16 bp, H. sapiens
aacatatttgagaata

SEQ ID NO: 13048 - DNA, 16 bp, H. sapiens
aacatatttgcaaaat

SEQ ID NO: 13049 - DNA, 16 bp, H. sapiens
aacatattttccttta

SEQ ID NO: 13050 - DNA, 16 bp, H. sapiens
aacatattttgaaaac

SEQ ID NO: 13051 - DNA, 16 bp, H. sapiens
aacatattttgtattt

SEQ ID NO: 13052 - DNA, 16 bp, H. sapiens
aacatatttttttctc

SEQ ID NO: 13053 - DNA, 16 bp, H. sapiens
aacatcaaagatcaca

SEQ ID NO: 13054 - DNA, 16 bp, H. sapiens
aacatcaacaatgcat

SEQ ID NO: 13055 - DNA, 16 bp, H. sapiens
aacatcaagcagaaca

SEQ ID NO: 13056 - DNA, 16 bp, H. sapiens
aacatcacaaaccagg

SEQ ID NO: 13057 - DNA, 16 bp, H. sapiens
aacatcacaattcaaa

SEQ ID NO: 13058 - DNA, 16 bp, H. sapiens
aacatcacacacaagg

SEQ ID NO: 13059 - DNA, 16 bp, H. sapiens
aacatcacacactgag

SEQ ID NO: 13060 - DNA, 18 bp, H. sapiens
aacatcacactccggggc

SEQ ID NO: 13061 - DNA, 16 bp, H. sapiens
aacatcaccactatct

SEQ ID NO: 13062 - DNA, 16 bp, H. sapiens
aacatcactaatgatc

SEQ ID NO: 13063 - DNA, 16 bp, H. sapiens
aacatcactgataatt

SEQ ID NO: 13064 - DNA, 21 bp, H. sapiens
aacatcagaaggaacaaactc

SEQ ID NO: 13065 - DNA, 16 bp, H. sapiens
aacatcagaatcatct

SEQ ID NO: 13066 - DNA, 16 bp, H. sapiens
aacatcagacagatca

SEQ ID NO: 13067 - DNA, 16 bp, H. sapiens
aacatcagcatcacct

SEQ ID NO: 13068 - DNA, 16 bp, H. sapiens
aacatcagctcagagc

SEQ ID NO: 13069 - DNA, 16 bp, H. sapiens
aacatcagtttcctca

SEQ ID NO: 13070 - DNA, 16 bp, H. sapiens
aacatcagtttttatt

SEQ ID NO: 13071 - DNA, 16 bp, H. sapiens
aacatcataatgacac

SEQ ID NO: 13072 - DNA, 16 bp, H. sapiens
aacatcatactgaatg

SEQ ID NO: 13073 - DNA, 16 bp, H. sapiens
aacatcatagagtgta

SEQ ID NO: 13074 - DNA, 16 bp, H. sapiens
aacatcatagagtgtg

SEQ ID NO: 13075 - DNA, 16 bp, H. sapiens
aacatcatagcttagc

SEQ ID NO: 13076 - DNA, 16 bp, H. sapiens
aacatcatcaccatca

SEQ ID NO: 13077 - DNA, 16 bp, H. sapiens
aacatcatcattatta

SEQ ID NO: 13078 - DNA, 17 bp, H. sapiens
aacatcatgaaacccca

SEQ ID NO: 13079 - DNA, 16 bp, H. sapiens
aacatcatgaaaccct

SEQ ID NO: 13080 - DNA, 16 bp, H. sapiens
aacatcattagctatt

SEQ ID NO: 13081 - DNA, 16 bp, H. sapiens
aacatcatttttcata

SEQ ID NO: 13082 - DNA, 16 bp, H. sapiens
aacatccatctcctgg

SEQ ID NO: 13083 - DNA, 16 bp, H. sapiens
aacatccatgtgaaaa

SEQ ID NO: 13084 - DNA, 16 bp, H. sapiens
aacatcctacaacaca

SEQ ID NO: 13085 - DNA, 16 bp, H. sapiens
aacatcctgcaatgca

SEQ ID NO: 13086 - DNA, 16 bp, H. sapiens
aacatcctgggctcag

SEQ ID NO: 13087 - DNA, 16 bp, H. sapiens
aacatccttgtacata

SEQ ID NO: 13088 - DNA, 16 bp, H. sapiens
aacatcctttataata

SEQ ID NO: 13089 - DNA, 16 bp, H. sapiens
aacatctacaagcatc

SEQ ID NO: 13090 - DNA, 16 bp, H. sapiens
aacatctagaagaaat

SEQ ID NO: 13091 - DNA, 16 bp, H. sapiens
aacatctattgctttt

SEQ ID NO: 13092 - DNA, 16 bp, H. sapiens
aacatctcaccaattt

SEQ ID NO: 13093 - DNA, 16 bp, H. sapiens
aacatctctctctctc

SEQ ID NO: 13094 - DNA, 16 bp, H. sapiens
aacatctgaaataaaa

SEQ ID NO: 13095 - DNA, 16 bp, H. sapiens
aacatctgaaggaaca

SEQ ID NO: 13096 - DNA, 16 bp, H. sapiens
aacatctgcctccctg

SEQ ID NO: 13097 - DNA, 16 bp, H. sapiens
aacatcttaaagaaaa

SEQ ID NO: 13098 - DNA, 16 bp, H. sapiens
aacatcttcatataaa

SEQ ID NO: 13099 - DNA, 16 bp, H. sapiens
aacatcttgcaaaact

SEQ ID NO: 13100 - DNA, 16 bp, H. sapiens
aacatctttttatgtg

SEQ ID NO: 13101 - DNA, 16 bp, H. sapiens
aacatcttttttgttt

SEQ ID NO: 13102 - DNA, 16 bp, H. sapiens
aacatgaaaaaaatct

SEQ ID NO: 13103 - DNA, 16 bp, H. sapiens
aacatgaaaaaccctt

SEQ ID NO: 13104 - DNA, 16 bp, H. sapiens
aacatgaaaatatata

SEQ ID NO: 13105 - DNA, 16 bp, H. sapiens
aacatgaaaatatgtt

SEQ ID NO: 13106 - DNA, 16 bp, H. sapiens
aacatgaaaatattaa

SEQ ID NO: 13107 - DNA, 16 bp, H. sapiens
aacatgaaaatgaaag

SEQ ID NO: 13108 - DNA, 16 bp, H. sapiens
aacatgaaactataaa

SEQ ID NO: 13109 - DNA, 16 bp, H. sapiens
aacatgaaatcaacct

SEQ ID NO: 13110 - DNA, 16 bp, H. sapiens
aacatgaaatggggaa

SEQ ID NO: 13111 - DNA, 16 bp, H. sapiens
aacatgaagaaatgct

SEQ ID NO: 13112 - DNA, 16 bp, H. sapiens
aacatgaagatgatga

SEQ ID NO: 13113 - DNA, 16 bp, H. sapiens
aacatgaagggatttt

SEQ ID NO: 13114 - DNA, 16 bp, H. sapiens
aacatgaatttttttt

SEQ ID NO: 13115 - DNA, 16 bp, H. sapiens
aacatgacaaaactct

SEQ ID NO: 13116 - DNA, 16 bp, H. sapiens
aacatgagagttggag

SEQ ID NO: 13117 - DNA, 16 bp, H. sapiens
aacatgagatgtgggt

SEQ ID NO: 13118 - DNA, 16 bp, H. sapiens
aacatgaggaaaccct

SEQ ID NO: 13119 - DNA, 16 bp, H. sapiens
aacatgataaaatata

SEQ ID NO: 13120 - DNA, 16 bp, H. sapiens
aacatgatgaaaccgc

SEQ ID NO: 13121 - DNA, 16 bp, H. sapiens
aacatgatgactggaa

SEQ ID NO: 13122 - DNA, 16 bp, H. sapiens
aacatgatgatgatga

SEQ ID NO: 13123 - DNA, 16 bp, H. sapiens
aacatgatgctttgaa

SEQ ID NO: 13124 - DNA, 16 bp, H. sapiens
aacatgcaaacaaaca

SEQ ID NO: 13125 - DNA, 16 bp, H. sapiens
aacatgcaaaggaaca

SEQ ID NO: 13126 - DNA, 16 bp, H. sapiens
aacatgcaatatttat

SEQ ID NO: 13127 - DNA, 16 bp, H. sapiens
aacatgcatatgaaaa

SEQ ID NO: 13128 - DNA, 16 bp, H. sapiens
aacatgccaccatgcc

SEQ ID NO: 13129 - DNA, 16 bp, H. sapiens
aacatgccagaaggaa

SEQ ID NO: 13130 - DNA, 16 bp, H. sapiens
aacatgccccaagtca

SEQ ID NO: 13131 - DNA, 16 bp, H. sapiens
aacatgcgatgtttgg

SEQ ID NO: 13132 - DNA, 16 bp, H. sapiens
aacatgctcctgaatg

SEQ ID NO: 13133 - DNA, 16 bp, H. sapiens
aacatgctgtatttga

SEQ ID NO: 13134 - DNA, 16 bp, H. sapiens
aacatgcttctgaaca

SEQ ID NO: 13135 - DNA, 16 bp, H. sapiens
aacatggaaagaaaat

SEQ ID NO: 13136 - DNA, 16 bp, H. sapiens
aacatggaaataaaag

SEQ ID NO: 13137 - DNA, 16 bp, H. sapiens
aacatggaatattttt

SEQ ID NO: 13138 - DNA, 16 bp, H. sapiens
aacatggagaaacctc

SEQ ID NO: 13139 - DNA, 16 bp, H. sapiens
aacatggagaaccccc

SEQ ID NO: 13140 - DNA, 16 bp, H. sapiens
aacatggatagagcta

SEQ ID NO: 13141 - DNA, 16 bp, H. sapiens
aacatggatggcactg

SEQ ID NO: 13142 - DNA, 16 bp, H. sapiens
aacatggatgggactg

SEQ ID NO: 13143 - DNA, 16 bp, H. sapiens
aacatggcaaaactgt

SEQ ID NO: 13144 - DNA, 16 bp, H. sapiens
aacatggcaaaatcct

SEQ ID NO: 13145 - DNA, 16 bp, H. sapiens
aacatggcgaaacccc

SEQ ID NO: 13146 - DNA, 16 bp, H. sapiens
aacatggctaaaccct

SEQ ID NO: 13147 - DNA, 16 bp, H. sapiens
aacatggctgtgcttt

SEQ ID NO: 13148 - DNA, 16 bp, H. sapiens
aacatgggaatacaga

SEQ ID NO: 13149 - DNA, 16 bp, H. sapiens
aacatgggagtgcaga

SEQ ID NO: 13150 - DNA, 17 bp, H. sapiens
aacatggggaaacccca

SEQ ID NO: 13151 - DNA, 16 bp, H. sapiens
aacatgggttttggag

SEQ ID NO: 13152 - DNA, 16 bp, H. sapiens
aacatggtaagaccct

SEQ ID NO: 13153 - DNA, 16 bp, H. sapiens
aacatggtagtgcaga

SEQ ID NO: 13154 - DNA, 16 bp, H. sapiens
aacatggtctggagtg

SEQ ID NO: 13155 - DNA, 16 bp, H. sapiens
aacatggtgaaacatt

SEQ ID NO: 13156 - DNA, 18 bp, H. sapiens
aacatggtgaaacccccg

SEQ ID NO: 13157 - DNA, 19 bp, H. sapiens
aacatggtgaaaccccgtt

SEQ ID NO: 13158 - DNA, 17 bp, H. sapiens
aacatggtgaaacccct

SEQ ID NO: 13159 - DNA, 16 bp, H. sapiens
aacatggtgaaaccgt

SEQ ID NO: 13160 - DNA, 16 bp, H. sapiens
aacatggtgaaagccg

SEQ ID NO: 13161 - DNA, 16 bp, H. sapiens
aacatggtgaagctcc

SEQ ID NO: 13162 - DNA, 16 bp, H. sapiens
aacatggtgaagctct

SEQ ID NO: 13163 - DNA, 16 bp, H. sapiens
aacatggtgagacact

SEQ ID NO: 13164 - DNA, 16 bp, H. sapiens
aacatgtagtatttgt

SEQ ID NO: 13165 - DNA, 16 bp, H. sapiens
aacatgtattatttaa

SEQ ID NO: 13166 - DNA, 16 bp, H. sapiens
aacatgtatttattga

SEQ ID NO: 13167 - DNA, 16 bp, H. sapiens
aacatgtattttaaaa

SEQ ID NO: 13168 - DNA, 16 bp, H. sapiens
aacatgtattttattt

SEQ ID NO: 13169 - DNA, 16 bp, H. sapiens
aacatgtattttttaa

SEQ ID NO: 13170 - DNA, 16 bp, H. sapiens
aacatgtctcgcctcc

SEQ ID NO: 13171 - DNA, 16 bp, H. sapiens
aacatgtgagaattca

SEQ ID NO: 13172 - DNA, 16 bp, H. sapiens
aacatgtgcaggggaa

SEQ ID NO: 13173 - DNA, 16 bp, H. sapiens
aacatgtgcccaaggt

SEQ ID NO: 13174 - DNA, 16 bp, H. sapiens
aacatgtgctatttgg

SEQ ID NO: 13175 - DNA, 16 bp, H. sapiens
aacatgtggtgtttgg

SEQ ID NO: 13176 - DNA, 16 bp, H. sapiens
aacatgttttaaaagt

SEQ ID NO: 13177 - DNA, 16 bp, H. sapiens
aacattaaaaactttt

SEQ ID NO: 13178 - DNA, 16 bp, H. sapiens
aacattaaagatcact

SEQ ID NO: 13179 - DNA, 16 bp, H. sapiens
aacattaaagttccaa

SEQ ID NO: 13180 - DNA, 16 bp, H. sapiens
aacattaaccaaaaga

SEQ ID NO: 13181 - DNA, 16 bp, H. sapiens
aacattacaaatattt

SEQ ID NO: 13182 - DNA, 16 bp, H. sapiens
aacattactgaaagaa

SEQ ID NO: 13183 - DNA, 16 bp, H. sapiens
aacattactgattttt

SEQ ID NO: 13184 - DNA, 16 bp, H. sapiens
aacattagaaaatcaa

SEQ ID NO: 13185 - DNA, 16 bp, H. sapiens
aacattatactggaag

SEQ ID NO: 13186 - DNA, 16 bp, H. sapiens
aacattatagagtgta

SEQ ID NO: 13187 - DNA, 16 bp, H. sapiens
aacattatgctaagta

SEQ ID NO: 13188 - DNA, 16 bp, H. sapiens
aacattattaaaatgt

SEQ ID NO: 13189 - DNA, 16 bp, H. sapiens
aacattattcacaaca

SEQ ID NO: 13190 - DNA, 16 bp, H. sapiens
aacattatttccattt

SEQ ID NO: 13191 - DNA, 16 bp, H. sapiens
aacattatttctggat

SEQ ID NO: 13192 - DNA, 16 bp, H. sapiens
aacattatttgaaata

SEQ ID NO: 13193 - DNA, 16 bp, H. sapiens
aacattatttttaaag

SEQ ID NO: 13194 - DNA, 16 bp, H. sapiens
aacattcaaaccaaag

SEQ ID NO: 13195 - DNA, 16 bp, H. sapiens
aacattcaaattcagt

SEQ ID NO: 13196 - DNA, 16 bp, H. sapiens
aacattcagagaacaa

SEQ ID NO: 13197 - DNA, 16 bp, H. sapiens
aacattcatgcaaaaa

SEQ ID NO: 13198 - DNA, 16 bp, H. sapiens
aacattccatgctcac

SEQ ID NO: 13199 - DNA, 16 bp, H. sapiens
aacattccatgcttat

SEQ ID NO: 13200 - DNA, 16 bp, H. sapiens
aacattccattctcat

SEQ ID NO: 13201 - DNA, 16 bp, H. sapiens
aacattccctttgaaa

SEQ ID NO: 13202 - DNA, 16 bp, H. sapiens
aacattccttttactt

SEQ ID NO: 13203 - DNA, 16 bp, H. sapiens
aacattctaaaagaaa

SEQ ID NO: 13204 - DNA, 16 bp, H. sapiens
aacattctcacagaca

SEQ ID NO: 13205 - DNA, 16 bp, H. sapiens
aacattcttaaacaaa

SEQ ID NO: 13206 - DNA, 16 bp, H. sapiens
aacattcttaaagaac

SEQ ID NO: 13207 - DNA, 16 bp, H. sapiens
aacattcttgaaaaag

SEQ ID NO: 13208 - DNA, 16 bp, H. sapiens
aacattcttttaaaat

SEQ ID NO: 13209 - DNA, 16 bp, H. sapiens
aacattgaaaaaaatc

SEQ ID NO: 13210 - DNA, 16 bp, H. sapiens
aacattgaatataaat

SEQ ID NO: 13211 - DNA, 16 bp, H. sapiens
aacattgagaattaca

SEQ ID NO: 13212 - DNA, 16 bp, H. sapiens
aacattgatgagagaa

SEQ ID NO: 13213 - DNA, 16 bp, H. sapiens
aacattgatgtacaag

SEQ ID NO: 13214 - DNA, 16 bp, H. sapiens
aacattgctgattctt

SEQ ID NO: 13215 - DNA, 16 bp, H. sapiens
aacattgcttttaaaa

SEQ ID NO: 13216 - DNA, 16 bp, H. sapiens
aacattggcaaaataa

SEQ ID NO: 13217 - DNA, 16 bp, H. sapiens
aacattgggaaaactc

SEQ ID NO: 13218 - DNA, 16 bp, H. sapiens
aacattgggaattata

SEQ ID NO: 13219 - DNA, 16 bp, H. sapiens
aacattgtgaatgtaa

SEQ ID NO: 13220 - DNA, 16 bp, H. sapiens
aacattgttaaaatga

SEQ ID NO: 13221 - DNA, 16 bp, H. sapiens
aacattgttaaagaaa

SEQ ID NO: 13222 - DNA, 16 bp, H. sapiens
aacattgttgaaagaa

SEQ ID NO: 13223 - DNA, 16 bp, H. sapiens
aacattgttttattaa

SEQ ID NO: 13224 - DNA, 16 bp, H. sapiens
aacattgttttttgtt

SEQ ID NO: 13225 - DNA, 16 bp, H. sapiens
aacatttaaaaatgta

SEQ ID NO: 13226 - DNA, 16 bp, H. sapiens
aacatttaaaagattt

SEQ ID NO: 13227 - DNA, 16 bp, H. sapiens
aacatttaaaataatg

SEQ ID NO: 13228 - DNA, 16 bp, H. sapiens
aacatttaaaatattg

SEQ ID NO: 13229 - DNA, 16 bp, H. sapiens
aacatttaaaatcatt

SEQ ID NO: 13230 - DNA, 16 bp, H. sapiens
aacatttaaagaaaga

SEQ ID NO: 13231 - DNA, 16 bp, H. sapiens
aacatttaaatggaaa

SEQ ID NO: 13232 - DNA, 16 bp, H. sapiens
aacatttaagccttta

SEQ ID NO: 13233 - DNA, 16 bp, H. sapiens
aacatttaataaaatg

SEQ ID NO: 13234 - DNA, 16 bp, H. sapiens
aacatttacactgact

SEQ ID NO: 13235 - DNA, 16 bp, H. sapiens
aacatttacagaagaa

SEQ ID NO: 13236 - DNA, 16 bp, H. sapiens
aacatttacatttaca

SEQ ID NO: 13237 - DNA, 16 bp, H. sapiens
aacatttagaaaaaat

SEQ ID NO: 13238 - DNA, 16 bp, H. sapiens
aacatttatagaagaa

SEQ ID NO: 13239 - DNA, 16 bp, H. sapiens
aacatttatcacttct

SEQ ID NO: 13240 - DNA, 16 bp, H. sapiens
aacatttatctcattt

SEQ ID NO: 13241 - DNA, 16 bp, H. sapiens
aacatttatgaagcac

SEQ ID NO: 13242 - DNA, 16 bp, H. sapiens
aacatttattaagcac

SEQ ID NO: 13243 - DNA, 16 bp, H. sapiens
aacatttattatgtgt

SEQ ID NO: 13244 - DNA, 16 bp, H. sapiens
aacatttattgaatga

SEQ ID NO: 13245 - DNA, 16 bp, H. sapiens
aacatttattgagcat

SEQ ID NO: 13246 - DNA, 16 bp, H. sapiens
aacatttattgagtgc

SEQ ID NO: 13247 - DNA, 16 bp, H. sapiens
aacatttatttcaaat

SEQ ID NO: 13248 - DNA, 16 bp, H. sapiens
aacatttatttcttca

SEQ ID NO: 13249 - DNA, 16 bp, H. sapiens
aacatttattttttga

SEQ ID NO: 13250 - DNA, 16 bp, H. sapiens
aacatttcaggccaat

SEQ ID NO: 13251 - DNA, 16 bp, H. sapiens
aacatttcatataaat

SEQ ID NO: 13252 - DNA, 16 bp, H. sapiens
aacatttcattcattt

SEQ ID NO: 13253 - DNA, 16 bp, H. sapiens
aacatttccatcaccc

SEQ ID NO: 13254 - DNA, 16 bp, H. sapiens
aacatttcctgagcac

SEQ ID NO: 13255 - DNA, 16 bp, H. sapiens
aacatttctagaaaaa

SEQ ID NO: 13256 - DNA, 16 bp, H. sapiens
aacatttctagacaca

SEQ ID NO: 13257 - DNA, 16 bp, H. sapiens
aacatttctgtaaatt

SEQ ID NO: 13258 - DNA, 16 bp, H. sapiens
aacatttcttgagcac

SEQ ID NO: 13259 - DNA, 16 bp, H. sapiens
aacatttcttgcaaag

SEQ ID NO: 13260 - DNA, 16 bp, H. sapiens
aacatttgaaaaaaat

SEQ ID NO: 13261 - DNA, 16 bp, H. sapiens
aacatttgaaaataaa

SEQ ID NO: 13262 - DNA, 16 bp, H. sapiens
aacatttgaaaatatt

SEQ ID NO: 13263 - DNA, 16 bp, H. sapiens
aacatttgaaaatcaa

SEQ ID NO: 13264 - DNA, 16 bp, H. sapiens
aacatttgaagaaaaa

SEQ ID NO: 13265 - DNA, 16 bp, H. sapiens
aacatttgaattgttt

SEQ ID NO: 13266 - DNA, 16 bp, H. sapiens
aacatttgagtcagtg

SEQ ID NO: 13267 - DNA, 16 bp, H. sapiens
aacatttggaaaatat

SEQ ID NO: 13268 - DNA, 16 bp, H. sapiens
aacatttggaaataaa

SEQ ID NO: 13269 - DNA, 16 bp, H. sapiens
aacatttggaaatcaa

SEQ ID NO: 13270 - DNA, 16 bp, H. sapiens
aacatttggaagatct

SEQ ID NO: 13271 - DNA, 16 bp, H. sapiens
aacatttgtacatatt

SEQ ID NO: 13272 - DNA, 16 bp, H. sapiens
aacatttgtatacaag

SEQ ID NO: 13273 - DNA, 16 bp, H. sapiens
aacatttgtgtacaag

SEQ ID NO: 13274 - DNA, 16 bp, H. sapiens
aacatttgtgttgttt

SEQ ID NO: 13275 - DNA, 16 bp, H. sapiens
aacatttgttattttc

SEQ ID NO: 13276 - DNA, 16 bp, H. sapiens
aacatttgttgaacac

SEQ ID NO: 13277 - DNA, 16 bp, H. sapiens
aacattttaaaaagaa

SEQ ID NO: 13278 - DNA, 16 bp, H. sapiens
aacattttaaaattca

SEQ ID NO: 13279 - DNA, 16 bp, H. sapiens
aacattttaaaccaaa

SEQ ID NO: 13280 - DNA, 16 bp, H. sapiens
aacattttaaagaaaa

SEQ ID NO: 13281 - DNA, 16 bp, H. sapiens
aacattttaaagtata

SEQ ID NO: 13282 - DNA, 16 bp, H. sapiens
aacattttaaagttaa

SEQ ID NO: 13283 - DNA, 16 bp, H. sapiens
aacattttaaataact

SEQ ID NO: 13284 - DNA, 16 bp, H. sapiens
aacattttaaatgaaa

SEQ ID NO: 13285 - DNA, 16 bp, H. sapiens
aacattttaaatgttt

SEQ ID NO: 13286 - DNA, 16 bp, H. sapiens
aacattttaagaaact

SEQ ID NO: 13287 - DNA, 16 bp, H. sapiens
aacattttaataactt

SEQ ID NO: 13288 - DNA, 16 bp, H. sapiens
aacattttaatgattt

SEQ ID NO: 13289 - DNA, 16 bp, H. sapiens
aacattttaatgtata

SEQ ID NO: 13290 - DNA, 16 bp, H. sapiens
aacattttaatgttta

SEQ ID NO: 13291 - DNA, 16 bp, H. sapiens
aacattttaatttgaa

SEQ ID NO: 13292 - DNA, 16 bp, H. sapiens
aacattttacttaaaa

SEQ ID NO: 13293 - DNA, 16 bp, H. sapiens
aacattttagaaacat

SEQ ID NO: 13294 - DNA, 16 bp, H. sapiens
aacattttagactttg

SEQ ID NO: 13295 - DNA, 16 bp, H. sapiens
aacattttagttgttt

SEQ ID NO: 13296 - DNA, 16 bp, H. sapiens
aacattttatccaaga

SEQ ID NO: 13297 - DNA, 16 bp, H. sapiens
aacattttatttatac

SEQ ID NO: 13298 - DNA, 16 bp, H. sapiens
aacattttatttctcc

SEQ ID NO: 13299 - DNA, 16 bp, H. sapiens
aacattttattttcag

SEQ ID NO: 13300 - DNA, 16 bp, H. sapiens
aacattttcaaaaaga

SEQ ID NO: 13301 - DNA, 16 bp, H. sapiens
aacattttcaaaatca

SEQ ID NO: 13302 - DNA, 16 bp, H. sapiens
aacattttcaaagtgc

SEQ ID NO: 13303 - DNA, 16 bp, H. sapiens
aacattttcaagaaaa

SEQ ID NO: 13304 - DNA, 16 bp, H. sapiens
aacattttcagaaata

SEQ ID NO: 13305 - DNA, 16 bp, H. sapiens
aacattttcatcaacc

SEQ ID NO: 13306 - DNA, 16 bp, H. sapiens
aacattttcatgttta

SEQ ID NO: 13307 - DNA, 16 bp, H. sapiens
aacattttcatttcca

SEQ ID NO: 13308 - DNA, 16 bp, H. sapiens
aacattttctaatttc

SEQ ID NO: 13309 - DNA, 16 bp, H. sapiens
aacattttctcattta

SEQ ID NO: 13310 - DNA, 16 bp, H. sapiens
aacattttctcccatt

SEQ ID NO: 13311 - DNA, 16 bp, H. sapiens
aacattttctcttaaa

SEQ ID NO: 13312 - DNA, 16 bp, H. sapiens
aacattttctgaaaaa

SEQ ID NO: 13313 - DNA, 16 bp, H. sapiens
aacattttcttccttt

SEQ ID NO: 13314 - DNA, 16 bp, H. sapiens
aacattttcttctctc

SEQ ID NO: 13315 - DNA, 16 bp, H. sapiens
aacattttgaaaaact

SEQ ID NO: 13316 - DNA, 16 bp, H. sapiens
aacattttgaaaactg

SEQ ID NO: 13317 - DNA, 16 bp, H. sapiens
aacattttgaaattta

SEQ ID NO: 13318 - DNA, 16 bp, H. sapiens
aacattttgcaaaact

SEQ ID NO: 13319 - DNA, 16 bp, H. sapiens
aacattttgctaaatt

SEQ ID NO: 13320 - DNA, 16 bp, H. sapiens
aacattttggtcaaag

SEQ ID NO: 13321 - DNA, 16 bp, H. sapiens
aacattttggttattt

SEQ ID NO: 13322 - DNA, 16 bp, H. sapiens
aacattttggttgttt

SEQ ID NO: 13323 - DNA, 16 bp, H. sapiens
aacattttgtattttt

SEQ ID NO: 13324 - DNA, 16 bp, H. sapiens
aacattttgttatatt

SEQ ID NO: 13325 - DNA, 16 bp, H. sapiens
aacattttgtttaatt

SEQ ID NO: 13326 - DNA, 16 bp, H. sapiens
aacatttttaaaaatc

SEQ ID NO: 13327 - DNA, 16 bp, H. sapiens
aacatttttaaaaatg

SEQ ID NO: 13328 - DNA, 16 bp, H. sapiens
aacatttttaaagaaa

SEQ ID NO: 13329 - DNA, 16 bp, H. sapiens
aacatttttacaataa

SEQ ID NO: 13330 - DNA, 16 bp, H. sapiens
aacatttttatagttt

SEQ ID NO: 13331 - DNA, 16 bp, H. sapiens
aacatttttatcaacc

SEQ ID NO: 13332 - DNA, 16 bp, H. sapiens
aacatttttattacat

SEQ ID NO: 13333 - DNA, 16 bp, H. sapiens
aacatttttcaaatgt

SEQ ID NO: 13334 - DNA, 16 bp, H. sapiens
aacatttttcattaaa

SEQ ID NO: 13335 - DNA, 16 bp, H. sapiens
aacatttttgaaaaaa

SEQ ID NO: 13336 - DNA, 16 bp, H. sapiens
aacatttttgaaaaag

SEQ ID NO: 13337 - DNA, 16 bp, H. sapiens
aacatttttgaaacaa

SEQ ID NO: 13338 - DNA, 16 bp, H. sapiens
aacatttttgctttct

SEQ ID NO: 13339 - DNA, 16 bp, H. sapiens
aacatttttggagaaa

SEQ ID NO: 13340 - DNA, 16 bp, H. sapiens
aacatttttggttttc

SEQ ID NO: 13341 - DNA, 16 bp, H. sapiens
aacatttttgtaattt

SEQ ID NO: 13342 - DNA, 16 bp, H. sapiens
aacattttttaaaaag

SEQ ID NO: 13343 - DNA, 16 bp, H. sapiens
aacattttttaatggt

SEQ ID NO: 13344 - DNA, 16 bp, H. sapiens
aacattttttatttga

SEQ ID NO: 13345 - DNA, 16 bp, H. sapiens
aacattttttccatat

SEQ ID NO: 13346 - DNA, 16 bp, H. sapiens
aacatttttttaaaag

SEQ ID NO: 13347 - DNA, 16 bp, H. sapiens
aacatttttttcaata

SEQ ID NO: 13348 - DNA, 16 bp, H. sapiens
aacatttttttcatct

SEQ ID NO: 13349 - DNA, 16 bp, H. sapiens
aacatttttttgtgtg

SEQ ID NO: 13350 - DNA, 16 bp, H. sapiens
aacattttttttccaa

SEQ ID NO: 13351 - DNA, 16 bp, H. sapiens
aacattttttttccta

SEQ ID NO: 13352 - DNA, 16 bp, H. sapiens
aaccaaaaaaagctca

SEQ ID NO: 13353 - DNA, 16 bp, H. sapiens
aaccaaaaaacagcct

SEQ ID NO: 13354 - DNA, 16 bp, H. sapiens
aaccaaaaaagtgccc

SEQ ID NO: 13355 - DNA, 16 bp, H. sapiens
aaccaaaacatttgtg

SEQ ID NO: 13356 - DNA, 16 bp, H. sapiens
aaccaaaagctgtttc

SEQ ID NO: 13357 - DNA, 16 bp, H. sapiens
aaccaaaataagatac

SEQ ID NO: 13358 - DNA, 16 bp, H. sapiens
aaccaaacaccacctg

SEQ ID NO: 13359 - DNA, 16 bp, H. sapiens
aaccaaagaaagtcca

SEQ ID NO: 13360 - DNA, 16 bp, H. sapiens
aaccaaagaagagcct

SEQ ID NO: 13361 - DNA, 16 bp, H. sapiens
aaccaaagaagtgaaa

SEQ ID NO: 13362 - DNA, 16 bp, H. sapiens
aaccaaagagagctgt

SEQ ID NO: 13363 - DNA, 16 bp, H. sapiens
aaccaaagcaactcca

SEQ ID NO: 13364 - DNA, 16 bp, H. sapiens
aaccaaagcagcatga

SEQ ID NO: 13365 - DNA, 16 bp, H. sapiens
aaccaaagccaaaatg

SEQ ID NO: 13366 - DNA, 16 bp, H. sapiens
aaccaacaaaatggga

SEQ ID NO: 13367 - DNA, 17 bp, H. sapiens
aaccaactccagacaca

SEQ ID NO: 13368 - DNA, 16 bp, H. sapiens
aaccaagaaaagtcca

SEQ ID NO: 13369 - DNA, 16 bp, H. sapiens
aaccaagaaattaaca

SEQ ID NO: 13370 - DNA, 16 bp, H. sapiens
aaccaagaattttata

SEQ ID NO: 13371 - DNA, 16 bp, H. sapiens
aaccaagctgtaccct

SEQ ID NO: 13372 - DNA, 16 bp, H. sapiens
aaccaaggagatgaaa

SEQ ID NO: 13373 - DNA, 16 bp, H. sapiens
aaccaaggagtcaaaa

SEQ ID NO: 13374 - DNA, 16 bp, H. sapiens
aaccaaggcccagaaa

SEQ ID NO: 13375 - DNA, 16 bp, H. sapiens
aaccaaggctcagaga

SEQ ID NO: 13376 - DNA, 16 bp, H. sapiens
aaccaaggtggtgaaa

SEQ ID NO: 13377 - DNA, 16 bp, H. sapiens
aaccaagtcaaaacca

SEQ ID NO: 13378 - DNA, 17 bp, H. sapiens
aaccaagttgggaaaca

SEQ ID NO: 13379 - DNA, 16 bp, H. sapiens
aaccaataaaatctca

SEQ ID NO: 13380 - DNA, 16 bp, H. sapiens
aaccaatattaataca

SEQ ID NO: 13381 - DNA, 16 bp, H. sapiens
aaccaatattgtgaaa

SEQ ID NO: 13382 - DNA, 16 bp, H. sapiens
aaccaatattttcaaa

SEQ ID NO: 13383 - DNA, 16 bp, H. sapiens
aaccaatgacaaaacc

SEQ ID NO: 13384 - DNA, 16 bp, H. sapiens
aaccaatgacaaaatc

SEQ ID NO: 13385 - DNA, 16 bp, H. sapiens
aaccaatgcaaagaag

SEQ ID NO: 13386 - DNA, 16 bp, H. sapiens
aaccaatggaacagaa

SEQ ID NO: 13387 - DNA, 16 bp, H. sapiens
aaccaatgttcatctt

SEQ ID NO: 13388 - DNA, 16 bp, H. sapiens
aaccaattataacttc

SEQ ID NO: 13389 - DNA, 16 bp, H. sapiens
aaccaatttctccaat

SEQ ID NO: 13390 - DNA, 16 bp, H. sapiens
aaccaatttggaaaac

SEQ ID NO: 13391 - DNA, 16 bp, H. sapiens
aaccacaaaaattcta

SEQ ID NO: 13392 - DNA, 16 bp, H. sapiens
aaccacaaaagaccct

SEQ ID NO: 13393 - DNA, 16 bp, H. sapiens
aaccacaatgagataa

SEQ ID NO: 13394 - DNA, 23 bp, H. sapiens
aaccacaatgagataccatctca

SEQ ID NO: 13395 - DNA, 16 bp, H. sapiens
aaccacagatcaaaaa

SEQ ID NO: 13396 - DNA, 16 bp, H. sapiens
aaccacagatgctgga

SEQ ID NO: 13397 - DNA, 16 bp, H. sapiens
aaccacagattgaaaa

SEQ ID NO: 13398 - DNA, 21 bp, H. sapiens
aaccacatagttggaagtaaa

SEQ ID NO: 13399 - DNA, 16 bp, H. sapiens
aaccaccaatctgctt

SEQ ID NO: 13400 - DNA, 16 bp, H. sapiens
aaccaccacctcctgg

SEQ ID NO: 13401 - DNA, 16 bp, H. sapiens
aaccaccagaagctag

SEQ ID NO: 13402 - DNA, 16 bp, H. sapiens
aaccaccatggcaaat

SEQ ID NO: 13403 - DNA, 16 bp, H. sapiens
aaccaccatggcacgc

SEQ ID NO: 13404 - DNA, 16 bp, H. sapiens
aaccacccagctaagc

SEQ ID NO: 13405 - DNA, 16 bp, H. sapiens
aaccaccctggcacat

SEQ ID NO: 13406 - DNA, 16 bp, H. sapiens
aaccacctgaacccag

SEQ ID NO: 13407 - DNA, 16 bp, H. sapiens
aaccaccttctaaaga

SEQ ID NO: 13408 - DNA, 16 bp, H. sapiens
aaccactaagaaaata

SEQ ID NO: 13409 - DNA, 16 bp, H. sapiens
aaccactcatcttttt

SEQ ID NO: 13410 - DNA, 16 bp, H. sapiens
aaccactgacctcagg

SEQ ID NO: 13411 - DNA, 16 bp, H. sapiens
aaccactttctccttt

SEQ ID NO: 13412 - DNA, 16 bp, H. sapiens
aaccactttgacccaa

SEQ ID NO: 13413 - DNA, 16 bp, H. sapiens
aaccactttggaaaat

SEQ ID NO: 13414 - DNA, 16 bp, H. sapiens
aaccagaaaagagcag

SEQ ID NO: 13415 - DNA, 16 bp, H. sapiens
aaccagaaatatcatt

SEQ ID NO: 13416 - DNA, 16 bp, H. sapiens
aaccagacaaagacag

SEQ ID NO: 13417 - DNA, 16 bp, H. sapiens
aaccagacactgcatg

SEQ ID NO: 13418 - DNA, 16 bp, H. sapiens
aaccagacagaagcat

SEQ ID NO: 13419 - DNA, 16 bp, H. sapiens
aaccagagagatggca

SEQ ID NO: 13420 - DNA, 17 bp, H. sapiens
aaccagagcaactccat

SEQ ID NO: 13421 - DNA, 17 bp, H. sapiens
aaccagaggcagaaaca

SEQ ID NO: 13422 - DNA, 17 bp, H. sapiens
aaccagatggattcaca

SEQ ID NO: 13423 - DNA, 16 bp, H. sapiens
aaccagatgtggtggc

SEQ ID NO: 13424 - DNA, 16 bp, H. sapiens
aaccagatttcatgag

SEQ ID NO: 13425 - DNA, 16 bp, H. sapiens
aaccagatttttaaaa

SEQ ID NO: 13426 - DNA, 16 bp, H. sapiens
aaccagcagcacatca

SEQ ID NO: 13427 - DNA, 16 bp, H. sapiens
aaccagcagccctctg

SEQ ID NO: 13428 - DNA, 16 bp, H. sapiens
aaccagccaggcacag

SEQ ID NO: 13429 - DNA, 16 bp, H. sapiens
aaccagccatcccatt

SEQ ID NO: 13430 - DNA, 16 bp, H. sapiens
aaccagccctagccag

SEQ ID NO: 13431 - DNA, 16 bp, H. sapiens
aaccagccctgcccac

SEQ ID NO: 13432 - DNA, 16 bp, H. sapiens
aaccagcctggccaat

SEQ ID NO: 13433 - DNA, 17 bp, H. sapiens
aaccagcctgggcaaca

SEQ ID NO: 13434 - DNA, 17 bp, H. sapiens
aaccagcctgggtgaca

SEQ ID NO: 13435 - DNA, 16 bp, H. sapiens
aaccagcctggtcaac

SEQ ID NO: 13436 - DNA, 16 bp, H. sapiens
aaccagctttttgttt

SEQ ID NO: 13437 - DNA, 16 bp, H. sapiens
aaccaggaaaggacac

SEQ ID NO: 13438 - DNA, 16 bp, H. sapiens
aaccaggaagaaattc

SEQ ID NO: 13439 - DNA, 16 bp, H. sapiens
aaccaggaagtcagag

SEQ ID NO: 13440 - DNA, 16 bp, H. sapiens
aaccaggaagtgctac

SEQ ID NO: 13441 - DNA, 16 bp, H. sapiens
aaccaggacctgggag

SEQ ID NO: 13442 - DNA, 16 bp, H. sapiens
aaccaggagattccct

SEQ ID NO: 13443 - DNA, 16 bp, H. sapiens
aaccaggaggaagttg

SEQ ID NO: 13444 - DNA, 16 bp, H. sapiens
aaccaggaggcaaagg

SEQ ID NO: 13445 - DNA, 16 bp, H. sapiens
aaccaggagttggagg

SEQ ID NO: 13446 - DNA, 16 bp, H. sapiens
aaccaggattcaaact

SEQ ID NO: 13447 - DNA, 16 bp, H. sapiens
aaccaggatttaaacc

SEQ ID NO: 13448 - DNA, 16 bp, H. sapiens
aaccaggcactgtgct

SEQ ID NO: 13449 - DNA, 16 bp, H. sapiens
aaccaggcatggtggt

SEQ ID NO: 13450 - DNA, 16 bp, H. sapiens
aaccagggagtcagaa

SEQ ID NO: 13451 - DNA, 16 bp, H. sapiens
aaccagggctgcgcgc

SEQ ID NO: 13452 - DNA, 21 bp, H. sapiens
aaccaggggcacaatgcactg

SEQ ID NO: 13453 - DNA, 16 bp, H. sapiens
aaccagtcctcctgcc

SEQ ID NO: 13454 - DNA, 16 bp, H. sapiens
aaccagtgatcttttt

SEQ ID NO: 13455 - DNA, 16 bp, H. sapiens
aaccagttacagaaat

SEQ ID NO: 13456 - DNA, 16 bp, H. sapiens
aaccagtttggaaaac

SEQ ID NO: 13457 - DNA, 16 bp, H. sapiens
aaccagtttggagaag

SEQ ID NO: 13458 - DNA, 16 bp, H. sapiens
aaccagttttcccagc

SEQ ID NO: 13459 - DNA, 16 bp, H. sapiens
aaccagtttttccaat

SEQ ID NO: 13460 - DNA, 22 bp, H. sapiens
aaccataaggtctgactgcctg

SEQ ID NO: 13461 - DNA, 16 bp, H. sapiens
aaccatatcagcatct

SEQ ID NO: 13462 - DNA, 16 bp, H. sapiens
aaccatatgaaattgc

SEQ ID NO: 13463 - DNA, 16 bp, H. sapiens
aaccatattcaaacca

SEQ ID NO: 13464 - DNA, 16 bp, H. sapiens
aaccatatttttaaaa

SEQ ID NO: 13465 - DNA, 16 bp, H. sapiens
aaccatcaccaccatc

SEQ ID NO: 13466 - DNA, 16 bp, H. sapiens
aaccatcaccactatc

SEQ ID NO: 13467 - DNA, 16 bp, H. sapiens
aaccatcaggaaaatg

SEQ ID NO: 13468 - DNA, 16 bp, H. sapiens
aaccatcatacttcct

SEQ ID NO: 13469 - DNA, 16 bp, H. sapiens
aaccatcattctactc

SEQ ID NO: 13470 - DNA, 16 bp, H. sapiens
aaccatccctgcattc

SEQ ID NO: 13471 - DNA, 17 bp, H. sapiens
aaccatcctggctaaca

SEQ ID NO: 13472 - DNA, 16 bp, H. sapiens
aaccatccttgcattc

SEQ ID NO: 13473 - DNA, 16 bp, H. sapiens
aaccatctcacatgca

SEQ ID NO: 13474 - DNA, 16 bp, H. sapiens
aaccatcttttgaaga

SEQ ID NO: 13475 - DNA, 16 bp, H. sapiens
aaccatgaagaaacag

SEQ ID NO: 13476 - DNA, 16 bp, H. sapiens
aaccattaaaaaatgt

SEQ ID NO: 13477 - DNA, 16 bp, H. sapiens
aaccattaaaaagtgg

SEQ ID NO: 13478 - DNA, 16 bp, H. sapiens
aaccatttgatcttca

SEQ ID NO: 13479 - DNA, 16 bp, H. sapiens
aaccattttaaatgta

SEQ ID NO: 13480 - DNA, 16 bp, H. sapiens
aaccattttctgggga

SEQ ID NO: 13481 - DNA, 16 bp, H. sapiens
aacccaaaactcaggg

SEQ ID NO: 13482 - DNA, 16 bp, H. sapiens
aacccaaaaggactgg

SEQ ID NO: 13483 - DNA, 16 bp, H. sapiens
aacccaaactaagaca

SEQ ID NO: 13484 - DNA, 16 bp, H. sapiens
aacccaaagcaagcag

SEQ ID NO: 13485 - DNA, 16 bp, H. sapiens
aacccaaaggattata

SEQ ID NO: 13486 - DNA, 16 bp, H. sapiens
aacccaaatgtccaat

SEQ ID NO: 13487 - DNA, 16 bp, H. sapiens
aacccaaatgtccttc

SEQ ID NO: 13488 - DNA, 16 bp, H. sapiens
aacccaagaatttgag

SEQ ID NO: 13489 - DNA, 16 bp, H. sapiens
aacccaagacacataa

SEQ ID NO: 13490 - DNA, 16 bp, H. sapiens
aacccaagaggcagag

SEQ ID NO: 13491 - DNA, 16 bp, H. sapiens
aacccaagaggctgag

SEQ ID NO: 13492 - DNA, 16 bp, H. sapiens
aacccaagaggtggag

SEQ ID NO: 13493 - DNA, 16 bp, H. sapiens
aacccaaggagggggt

SEQ ID NO: 13494 - DNA, 16 bp, H. sapiens
aacccaagtgtccatc

SEQ ID NO: 13495 - DNA, 16 bp, H. sapiens
aacccaatacaaggaa

SEQ ID NO: 13496 - DNA, 16 bp, H. sapiens
aacccaatggaaggaa

SEQ ID NO: 13497 - DNA, 16 bp, H. sapiens
aacccacagaagggga

SEQ ID NO: 13498 - DNA, 16 bp, H. sapiens
aacccacagaatagga

SEQ ID NO: 13499 - DNA, 17 bp, H. sapiens
aacccaccttggcctcc

SEQ ID NO: 13500 - DNA, 16 bp, H. sapiens
aacccagaaaatctga

SEQ ID NO: 13501 - DNA, 16 bp, H. sapiens
aacccagaaacaaatc

SEQ ID NO: 13502 - DNA, 16 bp, H. sapiens
aacccagaaacaaatt

SEQ ID NO: 13503 - DNA, 16 bp, H. sapiens
aacccagaaataaact

SEQ ID NO: 13504 - DNA, 16 bp, H. sapiens
aacccagaaatgaacc

SEQ ID NO: 13505 - DNA, 16 bp, H. sapiens
aacccagaagcagagg

SEQ ID NO: 13506 - DNA, 16 bp, H. sapiens
aacccagaagccagag

SEQ ID NO: 13507 - DNA, 16 bp, H. sapiens
aacccagaagcccagc

SEQ ID NO: 13508 - DNA, 16 bp, H. sapiens
aacccagaaggtggag

SEQ ID NO: 13509 - DNA, 16 bp, H. sapiens
aacccagagagatgaa

SEQ ID NO: 13510 - DNA, 16 bp, H. sapiens
aacccagagaggttaa

SEQ ID NO: 13511 - DNA, 16 bp, H. sapiens
aacccagcacttcggg

SEQ ID NO: 13512 - DNA, 16 bp, H. sapiens
aacccagcagcagttt

SEQ ID NO: 13513 - DNA, 20 bp, H. sapiens
aacccagctactcaggaggc

SEQ ID NO: 13514 - DNA, 16 bp, H. sapiens
aacccaggagacacag

SEQ ID NO: 13515 - DNA, 16 bp, H. sapiens
aacccaggagcgggag

SEQ ID NO: 13516 - DNA, 16 bp, H. sapiens
aacccaggaggaagag

SEQ ID NO: 13517 - DNA, 16 bp, H. sapiens
aacccaggaggcagaa

SEQ ID NO: 13518 - DNA, 17 bp, H. sapiens
aacccaggaggcagagc

SEQ ID NO: 13519 - DNA, 16 bp, H. sapiens
aacccaggaggccgag

SEQ ID NO: 13520 - DNA, 16 bp, H. sapiens
aacccaggaggtggaa

SEQ ID NO: 13521 - DNA, 16 bp, H. sapiens
aacccaggaggttgaa

SEQ ID NO: 13522 - DNA, 16 bp, H. sapiens
aacccaggagtcagag

SEQ ID NO: 13523 - DNA, 16 bp, H. sapiens
aacccaggcaggctgg

SEQ ID NO: 13524 - DNA, 16 bp, H. sapiens
aacccaggcctgcctg

SEQ ID NO: 13525 - DNA, 16 bp, H. sapiens
aacccaggcctgtctg

SEQ ID NO: 13526 - DNA, 16 bp, H. sapiens
aacccaggtgtgtctg

SEQ ID NO: 13527 - DNA, 16 bp, H. sapiens
aacccagtaatgctgt

SEQ ID NO: 13528 - DNA, 16 bp, H. sapiens
aacccagtacctcaga

SEQ ID NO: 13529 - DNA, 16 bp, H. sapiens
aacccagtcagacaaa

SEQ ID NO: 13530 - DNA, 16 bp, H. sapiens
aacccatcaaagtcat

SEQ ID NO: 13531 - DNA, 18 bp, H. sapiens
aacccatcatctacatta

SEQ ID NO: 13532 - DNA, 16 bp, H. sapiens
aacccatgaggcggag

SEQ ID NO: 13533 - DNA, 16 bp, H. sapiens
aacccatggatacaga

SEQ ID NO: 13534 - DNA, 16 bp, H. sapiens
aacccatggatatgga

SEQ ID NO: 13535 - DNA, 16 bp, H. sapiens
aacccattttgaactc

SEQ ID NO: 13536 - DNA, 16 bp, H. sapiens
aaccccaaactgtaaa

SEQ ID NO: 13537 - DNA, 16 bp, H. sapiens
aaccccacctctagta

SEQ ID NO: 13538 - DNA, 17 bp, H. sapiens
aaccccactgtcaacat

SEQ ID NO: 13539 - DNA, 16 bp, H. sapiens
aaccccagctacctgg

SEQ ID NO: 13540 - DNA, 16 bp, H. sapiens
aaccccagctactctg

SEQ ID NO: 13541 - DNA, 16 bp, H. sapiens
aaccccaggactttgg

SEQ ID NO: 13542 - DNA, 16 bp, H. sapiens
aaccccatcatctcat

SEQ ID NO: 13543 - DNA, 19 bp, H. sapiens
aaccccatctctacaaaag

SEQ ID NO: 13544 - DNA, 16 bp, H. sapiens
aaccccattttgcaga

SEQ ID NO: 13545 - DNA, 16 bp, H. sapiens
aaccccgtctccacca

SEQ ID NO: 13546 - DNA, 16 bp, H. sapiens
aaccccgtctctaccc

SEQ ID NO: 13547 - DNA, 16 bp, H. sapiens
aacccctgacctcaag

SEQ ID NO: 13548 - DNA, 16 bp, H. sapiens
aacccctgcaaaatac

SEQ ID NO: 13549 - DNA, 16 bp, H. sapiens
aacccctggcctcaag

SEQ ID NO: 13550 - DNA, 16 bp, H. sapiens
aaccccttgtggcctt

SEQ ID NO: 13551 - DNA, 16 bp, H. sapiens
aacccgggaagaggag

SEQ ID NO: 13552 - DNA, 16 bp, H. sapiens
aacccgggagaaggag

SEQ ID NO: 13553 - DNA, 16 bp, H. sapiens
aacccgggaggctgag

SEQ ID NO: 13554 - DNA, 16 bp, H. sapiens
aacccgggaggtggag

SEQ ID NO: 13555 - DNA, 16 bp, H. sapiens
aacccgtgaggtggag

SEQ ID NO: 13556 - DNA, 16 bp, H. sapiens
aaccctcacaataacc

SEQ ID NO: 13557 - DNA, 16 bp, H. sapiens
aaccctcagcaaaata

SEQ ID NO: 13558 - DNA, 16 bp, H. sapiens
aaccctcagctgcagg

SEQ ID NO: 13559 - DNA, 16 bp, H. sapiens
aaccctcattctcagc

SEQ ID NO: 13560 - DNA, 16 bp, H. sapiens
aaccctctctctacca

SEQ ID NO: 13561 - DNA, 16 bp, H. sapiens
aaccctgaaaacatta

SEQ ID NO: 13562 - DNA, 16 bp, H. sapiens
aaccctgaactggaat

SEQ ID NO: 13563 - DNA, 36 bp, H. sapiens
aaccctgagtggacacagcacatgtttcagagagca

SEQ ID NO: 13564 - DNA, 31 bp, H. sapiens
aaccctgagtggatacagcacatgtttcaga

SEQ ID NO: 13565 - DNA, 16 bp, H. sapiens
aaccctgcccccacct

SEQ ID NO: 13566 - DNA, 16 bp, H. sapiens
aaccctgccgacacct

SEQ ID NO: 13567 - DNA, 16 bp, H. sapiens
aaccctgctgacacct

SEQ ID NO: 13568 - DNA, 16 bp, H. sapiens
aaccctggaggtggag

SEQ ID NO: 13569 - DNA, 16 bp, H. sapiens
aaccctggctctgcca

SEQ ID NO: 13570 - DNA, 19 bp, H. sapiens
aaccctgtctcaaaaaaaa

SEQ ID NO: 13571 - DNA, 16 bp, H. sapiens
aaccctgtctctcaaa

SEQ ID NO: 13572 - DNA, 16 bp, H. sapiens
aaccctgtctcttaaa

SEQ ID NO: 13573 - DNA, 16 bp, H. sapiens
aaccctgtgctctctg

SEQ ID NO: 13574 - DNA, 16 bp, H. sapiens
aacccttcaagtgcat

SEQ ID NO: 13575 - DNA, 16 bp, H. sapiens
aacccttctgcctcag

SEQ ID NO: 13576 - DNA, 16 bp, H. sapiens
aacccttgacctcagg

SEQ ID NO: 13577 - DNA, 16 bp, H. sapiens
aaccgctgcctcccag

SEQ ID NO: 13578 - DNA, 16 bp, H. sapiens
aaccggaaggcagagg

SEQ ID NO: 13579 - DNA, 16 bp, H. sapiens
aacctaaaactactct

SEQ ID NO: 13580 - DNA, 16 bp, H. sapiens
aacctaaaactgctct

SEQ ID NO: 13581 - DNA, 16 bp, H. sapiens
aacctaaaataaaagt

SEQ ID NO: 13582 - DNA, 16 bp, H. sapiens
aacctaaaataaagtt

SEQ ID NO: 13583 - DNA, 16 bp, H. sapiens
aacctaaaataacagt

SEQ ID NO: 13584 - DNA, 16 bp, H. sapiens
aacctaaaatagaagt

SEQ ID NO: 13585 - DNA, 16 bp, H. sapiens
aacctaaactgtaatt

SEQ ID NO: 13586 - DNA, 16 bp, H. sapiens
aacctaaagaaagata

SEQ ID NO: 13587 - DNA, 16 bp, H. sapiens
aacctaagaaatacca

SEQ ID NO: 13588 - DNA, 16 bp, H. sapiens
aacctaagcaaaaaga

SEQ ID NO: 13589 - DNA, 22 bp, H. sapiens
aacctaatagacatctacagaa

SEQ ID NO: 13590 - DNA, 16 bp, H. sapiens
aacctacacatgtact

SEQ ID NO: 13591 - DNA, 16 bp, H. sapiens
aacctacagaaagata

SEQ ID NO: 13592 - DNA, 16 bp, H. sapiens
aacctacagaatggga

SEQ ID NO: 13593 - DNA, 16 bp, H. sapiens
aacctaccaaacatca

SEQ ID NO: 13594 - DNA, 16 bp, H. sapiens
aacctaccaagaaaaa

SEQ ID NO: 13595 - DNA, 16 bp, H. sapiens
aacctactaaacatca

SEQ ID NO: 13596 - DNA, 17 bp, H. sapiens
aacctactcctgaatga

SEQ ID NO: 13597 - DNA, 16 bp, H. sapiens
aacctactgaatcaaa

SEQ ID NO: 13598 - DNA, 16 bp, H. sapiens
aacctactgctcagaa

SEQ ID NO: 13599 - DNA, 16 bp, H. sapiens
aacctagaaaaaactc

SEQ ID NO: 13600 - DNA, 16 bp, H. sapiens
aacctagaaggtggag

SEQ ID NO: 13601 - DNA, 16 bp, H. sapiens
aacctagcaaaacagg

SEQ ID NO: 13602 - DNA, 16 bp, H. sapiens
aacctcaaaaacatga

SEQ ID NO: 13603 - DNA, 16 bp, H. sapiens
aacctcaagctcctgg

SEQ ID NO: 13604 - DNA, 16 bp, H. sapiens
aacctcaagtgatcca

SEQ ID NO: 13605 - DNA, 20 bp, H. sapiens
aacctcaagtgatccaccca

SEQ ID NO: 13606 - DNA, 16 bp, H. sapiens
aacctcaagtgatctg

SEQ ID NO: 13607 - DNA, 16 bp, H. sapiens
aacctcaccaaatgaa

SEQ ID NO: 13608 - DNA, 16 bp, H. sapiens
aacctcacctcccggg

SEQ ID NO: 13609 - DNA, 16 bp, H. sapiens
aacctcacctcctggg

SEQ ID NO: 13610 - DNA, 16 bp, H. sapiens
aacctcagcatcacat

SEQ ID NO: 13611 - DNA, 16 bp, H. sapiens
aacctcagcatcatga

SEQ ID NO: 13612 - DNA, 16 bp, H. sapiens
aacctcagcatcatgc

SEQ ID NO: 13613 - DNA, 16 bp, H. sapiens
aacctcagcctctcag

SEQ ID NO: 13614 - DNA, 16 bp, H. sapiens
aacctcagctctgcca

SEQ ID NO: 13615 - DNA, 26 bp, H. sapiens
aacctcaggtgatccacccacctcag

SEQ ID NO: 13616 - DNA, 16 bp, H. sapiens
aacctcatcagcatct

SEQ ID NO: 13617 - DNA, 16 bp, H. sapiens
aacctcattctttttt

SEQ ID NO: 13618 - DNA, 16 bp, H. sapiens
aacctcatttaaaaat

SEQ ID NO: 13619 - DNA, 16 bp, H. sapiens
aacctccacatcccag

SEQ ID NO: 13620 - DNA, 16 bp, H. sapiens
aacctccacatgttca

SEQ ID NO: 13621 - DNA, 17 bp, H. sapiens
aacctccacctagattt

SEQ ID NO: 13622 - DNA, 19 bp, H. sapiens
aacctccacctcccaggct

SEQ ID NO: 13623 - DNA, 16 bp, H. sapiens
aacctccagaggaacg

SEQ ID NO: 13624 - DNA, 16 bp, H. sapiens
aacctccatctctcag

SEQ ID NO: 13625 - DNA, 16 bp, H. sapiens
aacctccatctctggg

SEQ ID NO: 13626 - DNA, 16 bp, H. sapiens
aacctccccttcctgg

SEQ ID NO: 13627 - DNA, 16 bp, H. sapiens
aacctccctggctcaa

SEQ ID NO: 13628 - DNA, 21 bp, H. sapiens
aacctccgcctcccgagttca

SEQ ID NO: 13629 - DNA, 16 bp, H. sapiens
aacctccgcctgccag

SEQ ID NO: 13630 - DNA, 16 bp, H. sapiens
aacctccgtctcaaaa

SEQ ID NO: 13631 - DNA, 16 bp, H. sapiens
aacctcctcccacagg

SEQ ID NO: 13632 - DNA, 16 bp, H. sapiens
aacctcctcctccagg

SEQ ID NO: 13633 - DNA, 16 bp, H. sapiens
aacctcctcctcccag

SEQ ID NO: 13634 - DNA, 16 bp, H. sapiens
aacctcctcctcctgg

SEQ ID NO: 13635 - DNA, 16 bp, H. sapiens
aacctcctgaggctgt

SEQ ID NO: 13636 - DNA, 16 bp, H. sapiens
aacctcctgcctcagc

SEQ ID NO: 13637 - DNA, 16 bp, H. sapiens
aacctcctgggctcca

SEQ ID NO: 13638 - DNA, 16 bp, H. sapiens
aacctccttcctttat

SEQ ID NO: 13639 - DNA, 16 bp, H. sapiens
aacctcgtgatccacc

SEQ ID NO: 13640 - DNA, 16 bp, H. sapiens
aacctctactagggca

SEQ ID NO: 13641 - DNA, 16 bp, H. sapiens
aacctctcagagcctc

SEQ ID NO: 13642 - DNA, 17 bp, H. sapiens
aacctctctcctttata

SEQ ID NO: 13643 - DNA, 16 bp, H. sapiens
aacctctctgtgtctt

SEQ ID NO: 13644 - DNA, 16 bp, H. sapiens
aacctctcttcatccc

SEQ ID NO: 13645 - DNA, 16 bp, H. sapiens
aacctctgataaaccc

SEQ ID NO: 13646 - DNA, 16 bp, H. sapiens
aacctctgcagactta

SEQ ID NO: 13647 - DNA, 16 bp, H. sapiens
aacctctgccagggca

SEQ ID NO: 13648 - DNA, 16 bp, H. sapiens
aacctctgcccctcgg

SEQ ID NO: 13649 - DNA, 16 bp, H. sapiens
aacctctgccctcctg

SEQ ID NO: 13650 - DNA, 16 bp, H. sapiens
aacctctgcctccaaa

SEQ ID NO: 13651 - DNA, 17 bp, H. sapiens
aacctctgcctcccagt

SEQ ID NO: 13652 - DNA, 16 bp, H. sapiens
aacctctgcctccgag

SEQ ID NO: 13653 - DNA, 16 bp, H. sapiens
aacctctgcctccggg

SEQ ID NO: 13654 - DNA, 16 bp, H. sapiens
aacctctgccttccaa

SEQ ID NO: 13655 - DNA, 19 bp, H. sapiens
aacctctgctagggcagta

SEQ ID NO: 13656 - DNA, 19 bp, H. sapiens
aacctctgtcacgaccttc

SEQ ID NO: 13657 - DNA, 16 bp, H. sapiens
aacctctgtgtgcctc

SEQ ID NO: 13658 - DNA, 16 bp, H. sapiens
aacctcttcctcctgg

SEQ ID NO: 13659 - DNA, 16 bp, H. sapiens
aacctctttatttctg

SEQ ID NO: 13660 - DNA, 16 bp, H. sapiens
aacctctttctttggt

SEQ ID NO: 13661 - DNA, 16 bp, H. sapiens
aacctctttgagcctc

SEQ ID NO: 13662 - DNA, 16 bp, H. sapiens
aacctctttggaaaaa

SEQ ID NO: 13663 - DNA, 18 bp, H. sapiens
aacctcttttcttataaa

SEQ ID NO: 13664 - DNA, 16 bp, H. sapiens
aacctcttttcttgta

SEQ ID NO: 13665 - DNA, 16 bp, H. sapiens
aacctcttttgtaaat

SEQ ID NO: 13666 - DNA, 16 bp, H. sapiens
aacctgaaaatctagt

SEQ ID NO: 13667 - DNA, 16 bp, H. sapiens
aacctgaaagactggt

SEQ ID NO: 13668 - DNA, 16 bp, H. sapiens
aacctgaagatgtgac

SEQ ID NO: 13669 - DNA, 16 bp, H. sapiens
aacctgacacacacaa

SEQ ID NO: 13670 - DNA, 16 bp, H. sapiens
aacctgacagagctga

SEQ ID NO: 13671 - DNA, 16 bp, H. sapiens
aacctgaccaacatga

SEQ ID NO: 13672 - DNA, 16 bp, H. sapiens
aacctgaggaaagcag

SEQ ID NO: 13673 - DNA, 18 bp, H. sapiens
aacctgaggtcaggagtt

SEQ ID NO: 13674 - DNA, 16 bp, H. sapiens
aacctgcacaagacaa

SEQ ID NO: 13675 - DNA, 16 bp, H. sapiens
aacctgcacaccctgc

SEQ ID NO: 13676 - DNA, 16 bp, H. sapiens
aacctgcacatcgtgc

SEQ ID NO: 13677 - DNA, 16 bp, H. sapiens
aacctgcatatatacc

SEQ ID NO: 13678 - DNA, 16 bp, H. sapiens
aacctgcatttaagaa

SEQ ID NO: 13679 - DNA, 16 bp, H. sapiens
aacctgccagaaggaa

SEQ ID NO: 13680 - DNA, 16 bp, H. sapiens
aacctgcctcccattt

SEQ ID NO: 13681 - DNA, 16 bp, H. sapiens
aacctgcctgcctcag

SEQ ID NO: 13682 - DNA, 16 bp, H. sapiens
aacctgctcctaaatg

SEQ ID NO: 13683 - DNA, 27 bp, H. sapiens
aacctgctcctgaatgactactgggtg

SEQ ID NO: 13684 - DNA, 16 bp, H. sapiens
aacctgctgcttcctg

SEQ ID NO: 13685 - DNA, 16 bp, H. sapiens
aacctggaagacagag

SEQ ID NO: 13686 - DNA, 16 bp, H. sapiens
aacctggaagagatgg

SEQ ID NO: 13687 - DNA, 16 bp, H. sapiens
aacctggaaggcagag

SEQ ID NO: 13688 - DNA, 16 bp, H. sapiens
aacctggacctcctgg

SEQ ID NO: 13689 - DNA, 16 bp, H. sapiens
aacctggcatggtggt

SEQ ID NO: 13690 - DNA, 16 bp, H. sapiens
aacctggccaacagag

SEQ ID NO: 13691 - DNA, 16 bp, H. sapiens
aacctggccaacgtgg

SEQ ID NO: 13692 - DNA, 16 bp, H. sapiens
aacctgggaaatacca

SEQ ID NO: 13693 - DNA, 16 bp, H. sapiens
aacctgggaagcagag

SEQ ID NO: 13694 - DNA, 16 bp, H. sapiens
aacctgggaagcggag

SEQ ID NO: 13695 - DNA, 16 bp, H. sapiens
aacctgggaagtggaa

SEQ ID NO: 13696 - DNA, 16 bp, H. sapiens
aacctgggaatcagag

SEQ ID NO: 13697 - DNA, 16 bp, H. sapiens
aacctgggagacggaa

SEQ ID NO: 13698 - DNA, 16 bp, H. sapiens
aacctgggagatagag

SEQ ID NO: 13699 - DNA, 16 bp, H. sapiens
aacctgggaggaggag

SEQ ID NO: 13700 - DNA, 16 bp, H. sapiens
aacctgggaggcgaag

SEQ ID NO: 13701 - DNA, 16 bp, H. sapiens
aacctgggaggggagg

SEQ ID NO: 13702 - DNA, 16 bp, H. sapiens
aacctgggagtgggag

SEQ ID NO: 13703 - DNA, 16 bp, H. sapiens
aacctgggcaaaaaga

SEQ ID NO: 13704 - DNA, 16 bp, H. sapiens
aacctgggggtggagg

SEQ ID NO: 13705 - DNA, 16 bp, H. sapiens
aacctgggtgacagaa

SEQ ID NO: 13706 - DNA, 16 bp, H. sapiens
aacctggtgaaacctc

SEQ ID NO: 13707 - DNA, 16 bp, H. sapiens
aacctgtccctggtgc

SEQ ID NO: 13708 - DNA, 16 bp, H. sapiens
aacctgtctccacaaa

SEQ ID NO: 13709 - DNA, 16 bp, H. sapiens
aacctgtctctgaaaa

SEQ ID NO: 13710 - DNA, 16 bp, H. sapiens
aacctgtcttcaagct

SEQ ID NO: 13711 - DNA, 16 bp, H. sapiens
aacctgtgaatatgtt

SEQ ID NO: 13712 - DNA, 16 bp, H. sapiens
aacctgtgcaacatag

SEQ ID NO: 13713 - DNA, 16 bp, H. sapiens
aacctgtggggtctga

SEQ ID NO: 13714 - DNA, 17 bp, H. sapiens
aacctgttcctgaatga

SEQ ID NO: 13715 - DNA, 16 bp, H. sapiens
aacctgtttctacaaa

SEQ ID NO: 13716 - DNA, 16 bp, H. sapiens
aacctgtttttcttcc

SEQ ID NO: 13717 - DNA, 16 bp, H. sapiens
aaccttatttggaaat

SEQ ID NO: 13718 - DNA, 16 bp, H. sapiens
aaccttcaaaaccatg

SEQ ID NO: 13719 - DNA, 16 bp, H. sapiens
aaccttcaatggctcc

SEQ ID NO: 13720 - DNA, 16 bp, H. sapiens
aaccttcaccttccag

SEQ ID NO: 13721 - DNA, 16 bp, H. sapiens
aaccttcctttgatag

SEQ ID NO: 13722 - DNA, 16 bp, H. sapiens
aaccttctggaaagaa

SEQ ID NO: 13723 - DNA, 16 bp, H. sapiens
aaccttcttggcacca

SEQ ID NO: 13724 - DNA, 16 bp, H. sapiens
aaccttgagcaaatta

SEQ ID NO: 13725 - DNA, 16 bp, H. sapiens
aaccttgaggacatta

SEQ ID NO: 13726 - DNA, 16 bp, H. sapiens
aaccttggaggcggag

SEQ ID NO: 13727 - DNA, 16 bp, H. sapiens
aaccttggctgcacct

SEQ ID NO: 13728 - DNA, 16 bp, H. sapiens
aaccttggtttccaca

SEQ ID NO: 13729 - DNA, 16 bp, H. sapiens
aaccttgtctccacaa

SEQ ID NO: 13730 - DNA, 16 bp, H. sapiens
aaccttgttaatctga

SEQ ID NO: 13731 - DNA, 16 bp, H. sapiens
aacctttctttacatt

SEQ ID NO: 13732 - DNA, 16 bp, H. sapiens
aacctttctttgattg

SEQ ID NO: 13733 - DNA, 16 bp, H. sapiens
aacctttgcctcctgg

SEQ ID NO: 13734 - DNA, 16 bp, H. sapiens
aacctttgctagggca

SEQ ID NO: 13735 - DNA, 16 bp, H. sapiens
aaccttttaaaaagtt

SEQ ID NO: 13736 - DNA, 16 bp, H. sapiens
aaccttttatcaagtt

SEQ ID NO: 13737 - DNA, 16 bp, H. sapiens
aaccttttttaaaaaa

SEQ ID NO: 13738 - DNA, 16 bp, H. sapiens
aaccttttttgattac

SEQ ID NO: 13739 - DNA, 16 bp, H. sapiens
aacgaaactccatctc

SEQ ID NO: 13740 - DNA, 16 bp, H. sapiens
aacgaaagcctcaaag

SEQ ID NO: 13741 - DNA, 16 bp, H. sapiens
aacgaatgaatgaaca

SEQ ID NO: 13742 - DNA, 17 bp, H. sapiens
aacgagacagaaagtta

SEQ ID NO: 13743 - DNA, 16 bp, H. sapiens
aacgagaccctgtctc

SEQ ID NO: 13744 - DNA, 16 bp, H. sapiens
aacgagactctgtttc

SEQ ID NO: 13745 - DNA, 16 bp, H. sapiens
aacgagacttcgtctc

SEQ ID NO: 13746 - DNA, 16 bp, H. sapiens
aacgataatagtgaca

SEQ ID NO: 13747 - DNA, 17 bp, H. sapiens
aacgcccagctaatttt

SEQ ID NO: 13748 - DNA, 16 bp, H. sapiens
aacgcctgacctcatg

SEQ ID NO: 13749 - DNA, 16 bp, H. sapiens
aacggacacatgaaaa

SEQ ID NO: 13750 - DNA, 16 bp, H. sapiens
aacgggagaaaatttt

SEQ ID NO: 13751 - DNA, 17 bp, H. sapiens
aacggtgaggattatcc

SEQ ID NO: 13752 - DNA, 16 bp, H. sapiens
aacgtccacctcctgg

SEQ ID NO: 13753 - DNA, 16 bp, H. sapiens
aacgtgagccactgtg

SEQ ID NO: 13754 - DNA, 16 bp, H. sapiens
aacgtggatgcagctg

SEQ ID NO: 13755 - DNA, 16 bp, H. sapiens
aacgtggcgaaacccc

SEQ ID NO: 13756 - DNA, 16 bp, H. sapiens
aacgtggtgaaactcc

SEQ ID NO: 13757 - DNA, 16 bp, H. sapiens
aacgtgtgtgtgtgtg

SEQ ID NO: 13758 - DNA, 16 bp, H. sapiens
aacgttccatgctcat

SEQ ID NO: 13759 - DNA, 16 bp, H. sapiens
aacgtttcttttcatt

SEQ ID NO: 13760 - DNA, 16 bp, H. sapiens
aactaaaaaagagcag

SEQ ID NO: 13761 - DNA, 16 bp, H. sapiens
aactaaaacaacaatg

SEQ ID NO: 13762 - DNA, 16 bp, H. sapiens
aactaaaactattttt

SEQ ID NO: 13763 - DNA, 16 bp, H. sapiens
aactaaaagctggttc

SEQ ID NO: 13764 - DNA, 16 bp, H. sapiens
aactaaaatacctctt

SEQ ID NO: 13765 - DNA, 16 bp, H. sapiens
aactaaaattagaaat

SEQ ID NO: 13766 - DNA, 16 bp, H. sapiens
aactaaagaaatctga

SEQ ID NO: 13767 - DNA, 16 bp, H. sapiens
aactaaagaatttctg

SEQ ID NO: 13768 - DNA, 16 bp, H. sapiens
aactaaagagcttttt

SEQ ID NO: 13769 - DNA, 16 bp, H. sapiens
aactaaagcaaatggt

SEQ ID NO: 13770 - DNA, 16 bp, H. sapiens
aactaaatgaaataga

SEQ ID NO: 13771 - DNA, 16 bp, H. sapiens
aactaaatgaaattca

SEQ ID NO: 13772 - DNA, 16 bp, H. sapiens
aactaaattcttccca

SEQ ID NO: 13773 - DNA, 16 bp, H. sapiens
aactaaattgaaagga

SEQ ID NO: 13774 - DNA, 16 bp, H. sapiens
aactaacaggaacaga

SEQ ID NO: 13775 - DNA, 16 bp, H. sapiens
aactaacccactccca

SEQ ID NO: 13776 - DNA, 16 bp, H. sapiens
aactaactaactaact

SEQ ID NO: 13777 - DNA, 16 bp, H. sapiens
aactaacttgctttta

SEQ ID NO: 13778 - DNA, 16 bp, H. sapiens
aactaagaaatacatt

SEQ ID NO: 13779 - DNA, 16 bp, H. sapiens
aactaagacacaaata

SEQ ID NO: 13780 - DNA, 16 bp, H. sapiens
aactaagacacacaca

SEQ ID NO: 13781 - DNA, 16 bp, H. sapiens
aactaagtttaacatt

SEQ ID NO: 13782 - DNA, 16 bp, H. sapiens
aactaagtttcataag

SEQ ID NO: 13783 - DNA, 16 bp, H. sapiens
aactaataaaaactct

SEQ ID NO: 13784 - DNA, 16 bp, H. sapiens
aactaatacagaaaca

SEQ ID NO: 13785 - DNA, 16 bp, H. sapiens
aactaatattaaaagt

SEQ ID NO: 13786 - DNA, 16 bp, H. sapiens
aactaatatttattga

SEQ ID NO: 13787 - DNA, 16 bp, H. sapiens
aactaatgaacacaaa

SEQ ID NO: 13788 - DNA, 16 bp, H. sapiens
aactaatggaaaaata

SEQ ID NO: 13789 - DNA, 16 bp, H. sapiens
aactaatgtttattaa

SEQ ID NO: 13790 - DNA, 17 bp, H. sapiens
aactaattggattctcc

SEQ ID NO: 13791 - DNA, 16 bp, H. sapiens
aactaatttgcatttc

SEQ ID NO: 13792 - DNA, 16 bp, H. sapiens
aactaatttttgaatt

SEQ ID NO: 13793 - DNA, 16 bp, H. sapiens
aactacaaaacagtga

SEQ ID NO: 13794 - DNA, 16 bp, H. sapiens
aactacaaaacttcta

SEQ ID NO: 13795 - DNA, 16 bp, H. sapiens
aactacaaaagaccct

SEQ ID NO: 13796 - DNA, 16 bp, H. sapiens
aactacaaaccactga

SEQ ID NO: 13797 - DNA, 21 bp, H. sapiens
aactacaaaccactgctcaac

SEQ ID NO: 13798 - DNA, 16 bp, H. sapiens
aactacaaagatgggg

SEQ ID NO: 13799 - DNA, 25 bp, H. sapiens
aactacaaggctacagtaaccaaaa

SEQ ID NO: 13800 - DNA, 16 bp, H. sapiens
aactacaatgagaaat

SEQ ID NO: 13801 - DNA, 16 bp, H. sapiens
aactacaccatcagct

SEQ ID NO: 13802 - DNA, 16 bp, H. sapiens
aactacacttcccaga

SEQ ID NO: 13803 - DNA, 16 bp, H. sapiens
aactacagaaatttat

SEQ ID NO: 13804 - DNA, 16 bp, H. sapiens
aactacagcctgtggg

SEQ ID NO: 13805 - DNA, 16 bp, H. sapiens
aactacaggcatgcac

SEQ ID NO: 13806 - DNA, 16 bp, H. sapiens
aactacaggtgcacat

SEQ ID NO: 13807 - DNA, 16 bp, H. sapiens
aactacatggaaaatg

SEQ ID NO: 13808 - DNA, 16 bp, H. sapiens
aactacatttcccaga

SEQ ID NO: 13809 - DNA, 16 bp, H. sapiens
aactaccagactgttt

SEQ ID NO: 13810 - DNA, 16 bp, H. sapiens
aactaccattttactt

SEQ ID NO: 13811 - DNA, 16 bp, H. sapiens
aactacctaagactgg

SEQ ID NO: 13812 - DNA, 16 bp, H. sapiens
aactacctgatctttg

SEQ ID NO: 13813 - DNA, 16 bp, H. sapiens
aactactcaactctac

SEQ ID NO: 13814 - DNA, 16 bp, H. sapiens
aactactcaactctgc

SEQ ID NO: 13815 - DNA, 16 bp, H. sapiens
aactactcaactctgt

SEQ ID NO: 13816 - DNA, 16 bp, H. sapiens
aactactcaatgaaaa

SEQ ID NO: 13817 - DNA, 16 bp, H. sapiens
aactactcagctctgc

SEQ ID NO: 13818 - DNA, 16 bp, H. sapiens
aactactgagctcaag

SEQ ID NO: 13819 - DNA, 16 bp, H. sapiens
aactactgggctcaag

SEQ ID NO: 13820 - DNA, 16 bp, H. sapiens
aactacttaaaagttc

SEQ ID NO: 13821 - DNA, 16 bp, H. sapiens
aactactttaaaatat

SEQ ID NO: 13822 - DNA, 16 bp, H. sapiens
aactactttggaggct

SEQ ID NO: 13823 - DNA, 16 bp, H. sapiens
aactactttttaaaaa

SEQ ID NO: 13824 - DNA, 16 bp, H. sapiens
aactagaaaaactatt

SEQ ID NO: 13825 - DNA, 16 bp, H. sapiens
aactagaaacaccatt

SEQ ID NO: 13826 - DNA, 16 bp, H. sapiens
aactagaaagtctaga

SEQ ID NO: 13827 - DNA, 16 bp, H. sapiens
aactagaaataaaatg

SEQ ID NO: 13828 - DNA, 16 bp, H. sapiens
aactagaatataaatt

SEQ ID NO: 13829 - DNA, 16 bp, H. sapiens
aactagaattagaagt

SEQ ID NO: 13830 - DNA, 16 bp, H. sapiens
aactagacaaactcac

SEQ ID NO: 13831 - DNA, 16 bp, H. sapiens
aactagactctgtctc

SEQ ID NO: 13832 - DNA, 16 bp, H. sapiens
aactagagaaacaagg

SEQ ID NO: 13833 - DNA, 18 bp, H. sapiens
aactagatcccttcctta

SEQ ID NO: 13834 - DNA, 16 bp, H. sapiens
aactagcacaagacaa

SEQ ID NO: 13835 - DNA, 16 bp, H. sapiens
aactagccacatttca

SEQ ID NO: 13836 - DNA, 16 bp, H. sapiens
aactagcccaaatgcc

SEQ ID NO: 13837 - DNA, 16 bp, H. sapiens
aactagctagccatat

SEQ ID NO: 13838 - DNA, 16 bp, H. sapiens
aactagctggaggaca

SEQ ID NO: 13839 - DNA, 16 bp, H. sapiens
aactagggaggtggag

SEQ ID NO: 13840 - DNA, 16 bp, H. sapiens
aactaggggcaaggag

SEQ ID NO: 13841 - DNA, 16 bp, H. sapiens
aactagtaaaagaaga

SEQ ID NO: 13842 - DNA, 16 bp, H. sapiens
aactataaaagcaaga

SEQ ID NO: 13843 - DNA, 16 bp, H. sapiens
aactataagccaaata

SEQ ID NO: 13844 - DNA, 16 bp, H. sapiens
aactataatttattgt

SEQ ID NO: 13845 - DNA, 16 bp, H. sapiens
aactatacaactttta

SEQ ID NO: 13846 - DNA, 18 bp, H. sapiens
aactatactacaagccta

SEQ ID NO: 13847 - DNA, 16 bp, H. sapiens
aactatactacagagc

SEQ ID NO: 13848 - DNA, 16 bp, H. sapiens
aactatagttaataat

SEQ ID NO: 13849 - DNA, 16 bp, H. sapiens
aactatatatatgtat

SEQ ID NO: 13850 - DNA, 16 bp, H. sapiens
aactatatgaggtgat

SEQ ID NO: 13851 - DNA, 16 bp, H. sapiens
aactatcacaagaata

SEQ ID NO: 13852 - DNA, 16 bp, H. sapiens
aactatcatcagaatg

SEQ ID NO: 13853 - DNA, 16 bp, H. sapiens
aactatcccaaatata

SEQ ID NO: 13854 - DNA, 16 bp, H. sapiens
aactatccccacctcc

SEQ ID NO: 13855 - DNA, 16 bp, H. sapiens
aactatgaaaataatt

SEQ ID NO: 13856 - DNA, 16 bp, H. sapiens
aactatgaaaatatta

SEQ ID NO: 13857 - DNA, 16 bp, H. sapiens
aactatgaaaatgtta

SEQ ID NO: 13858 - DNA, 16 bp, H. sapiens
aactatgatcagagca

SEQ ID NO: 13859 - DNA, 16 bp, H. sapiens
aactatgctaaatata

SEQ ID NO: 13860 - DNA, 16 bp, H. sapiens
aactatggcaaggaca

SEQ ID NO: 13861 - DNA, 16 bp, H. sapiens
aactatggggttttct

SEQ ID NO: 13862 - DNA, 20 bp, H. sapiens
aactatgtgaaaagaccaaa

SEQ ID NO: 13863 - DNA, 16 bp, H. sapiens
aactatgtgtatatat

SEQ ID NO: 13864 - DNA, 16 bp, H. sapiens
aactatgttactggtt

SEQ ID NO: 13865 - DNA, 16 bp, H. sapiens
aactattcaggaggct

SEQ ID NO: 13866 - DNA, 16 bp, H. sapiens
aactattctaaataca

SEQ ID NO: 13867 - DNA, 16 bp, H. sapiens
aactattgaaattttt

SEQ ID NO: 13868 - DNA, 16 bp, H. sapiens
aactatttaaagaaat

SEQ ID NO: 13869 - DNA, 16 bp, H. sapiens
aactatttatattcct

SEQ ID NO: 13870 - DNA, 16 bp, H. sapiens
aactatttattgaatg

SEQ ID NO: 13871 - DNA, 16 bp, H. sapiens
aactatttattgagca

SEQ ID NO: 13872 - DNA, 16 bp, H. sapiens
aactatttcaaaaatt

SEQ ID NO: 13873 - DNA, 16 bp, H. sapiens
aactatttgatctttg

SEQ ID NO: 13874 - DNA, 16 bp, H. sapiens
aactattttaaagtga

SEQ ID NO: 13875 - DNA, 16 bp, H. sapiens
aactattttaaagtgt

SEQ ID NO: 13876 - DNA, 16 bp, H. sapiens
aactattttcaaataa

SEQ ID NO: 13877 - DNA, 16 bp, H. sapiens
aactattttgaattat

SEQ ID NO: 13878 - DNA, 16 bp, H. sapiens
aactatttttaagtat

SEQ ID NO: 13879 - DNA, 16 bp, H. sapiens
aactatttttgtttgt

SEQ ID NO: 13880 - DNA, 16 bp, H. sapiens
aactatttttttcaaa

SEQ ID NO: 13881 - DNA, 16 bp, H. sapiens
aactcaaaaagccaga

SEQ ID NO: 13882 - DNA, 16 bp, H. sapiens
aactcaaaagtttaaa

SEQ ID NO: 13883 - DNA, 16 bp, H. sapiens
aactcaaaatacatta

SEQ ID NO: 13884 - DNA, 16 bp, H. sapiens
aactcaaaatgtattt

SEQ ID NO: 13885 - DNA, 16 bp, H. sapiens
aactcaaaattatttt

SEQ ID NO: 13886 - DNA, 16 bp, H. sapiens
aactcaaacaaaccag

SEQ ID NO: 13887 - DNA, 16 bp, H. sapiens
aactcaaacaaatcag

SEQ ID NO: 13888 - DNA, 16 bp, H. sapiens
aactcaaacaaattca

SEQ ID NO: 13889 - DNA, 16 bp, H. sapiens
aactcaaaggataaat

SEQ ID NO: 13890 - DNA, 16 bp, H. sapiens
aactcaaagtcatccc

SEQ ID NO: 13891 - DNA, 16 bp, H. sapiens
aactcaaataactcaa

SEQ ID NO: 13892 - DNA, 16 bp, H. sapiens
aactcaacaagaagag

SEQ ID NO: 13893 - DNA, 40 bp, H. sapiens
aactcaagagcttctgcacagcaaaagaaactaccatcag

SEQ ID NO: 13894 - DNA, 16 bp, H. sapiens
aactcaagatagatga

SEQ ID NO: 13895 - DNA, 16 bp, H. sapiens
aactcaagatggatca

SEQ ID NO: 13896 - DNA, 16 bp, H. sapiens
aactcaagtgatcctc

SEQ ID NO: 13897 - DNA, 16 bp, H. sapiens
aactcacacaggaaca

SEQ ID NO: 13898 - DNA, 16 bp, H. sapiens
aactcacagaactgta

SEQ ID NO: 13899 - DNA, 16 bp, H. sapiens
aactcacagaggcaga

SEQ ID NO: 13900 - DNA, 16 bp, H. sapiens
aactcaccaaagaaga

SEQ ID NO: 13901 - DNA, 16 bp, H. sapiens
aactcactcactcact

SEQ ID NO: 13902 - DNA, 16 bp, H. sapiens
aactcactcattacca

SEQ ID NO: 13903 - DNA, 16 bp, H. sapiens
aactcactcattgtca

SEQ ID NO: 13904 - DNA, 16 bp, H. sapiens
aactcactgcatcctc

SEQ ID NO: 13905 - DNA, 16 bp, H. sapiens
aactcactttaaatat

SEQ ID NO: 13906 - DNA, 16 bp, H. sapiens
aactcagaaaaataag

SEQ ID NO: 13907 - DNA, 16 bp, H. sapiens
aactcagaaaatacag

SEQ ID NO: 13908 - DNA, 16 bp, H. sapiens
aactcagaaatggaaa

SEQ ID NO: 13909 - DNA, 16 bp, H. sapiens
aactcagaccagatgg

SEQ ID NO: 13910 - DNA, 16 bp, H. sapiens
aactcagagggcagag

SEQ ID NO: 13911 - DNA, 16 bp, H. sapiens
aactcagcaaaataaa

SEQ ID NO: 13912 - DNA, 16 bp, H. sapiens
aactcagcaacaacaa

SEQ ID NO: 13913 - DNA, 16 bp, H. sapiens
aactcagccctgcacc

SEQ ID NO: 13914 - DNA, 16 bp, H. sapiens
aactcaggaacagcca

SEQ ID NO: 13915 - DNA, 16 bp, H. sapiens
aactcaggaggaggag

SEQ ID NO: 13916 - DNA, 16 bp, H. sapiens
aactcaggaggcagaa

SEQ ID NO: 13917 - DNA, 16 bp, H. sapiens
aactcaggaggctgag

SEQ ID NO: 13918 - DNA, 16 bp, H. sapiens
aactcaggagttcaaa

SEQ ID NO: 13919 - DNA, 16 bp, H. sapiens
aactcaggagtttgag

SEQ ID NO: 13920 - DNA, 16 bp, H. sapiens
aactcaggattaacaa

SEQ ID NO: 13921 - DNA, 16 bp, H. sapiens
aactcagggaaacact

SEQ ID NO: 13922 - DNA, 16 bp, H. sapiens
aactcagggaaaggaa

SEQ ID NO: 13923 - DNA, 16 bp, H. sapiens
aactcagggattctgt

SEQ ID NO: 13924 - DNA, 16 bp, H. sapiens
aactcagggggcagag

SEQ ID NO: 13925 - DNA, 16 bp, H. sapiens
aactcagtaagaaaaa

SEQ ID NO: 13926 - DNA, 16 bp, H. sapiens
aactcagtcagacaaa

SEQ ID NO: 13927 - DNA, 16 bp, H. sapiens
aactcagtgctgcctt

SEQ ID NO: 13928 - DNA, 16 bp, H. sapiens
aactcagtggcttaaa

SEQ ID NO: 13929 - DNA, 16 bp, H. sapiens
aactcagtttccttat

SEQ ID NO: 13930 - DNA, 16 bp, H. sapiens
aactcatagaagaaaa

SEQ ID NO: 13931 - DNA, 16 bp, H. sapiens
aactcatagagataga

SEQ ID NO: 13932 - DNA, 16 bp, H. sapiens
aactcatatctaacaa

SEQ ID NO: 13933 - DNA, 16 bp, H. sapiens
aactcatattgaaact

SEQ ID NO: 13934 - DNA, 16 bp, H. sapiens
aactcatcatttttat

SEQ ID NO: 13935 - DNA, 16 bp, H. sapiens
aactcatcctctttta

SEQ ID NO: 13936 - DNA, 16 bp, H. sapiens
aactcatgagctcaag

SEQ ID NO: 13937 - DNA, 16 bp, H. sapiens
aactcatggaaataga

SEQ ID NO: 13938 - DNA, 16 bp, H. sapiens
aactcatggagataca

SEQ ID NO: 13939 - DNA, 16 bp, H. sapiens
aactcatgtggaattg

SEQ ID NO: 13940 - DNA, 16 bp, H. sapiens
aactcattctatgggg

SEQ ID NO: 13941 - DNA, 16 bp, H. sapiens
aactcattgcagcctc

SEQ ID NO: 13942 - DNA, 16 bp, H. sapiens
aactcatttaatcatc

SEQ ID NO: 13943 - DNA, 17 bp, H. sapiens
aactcattttatgagga

SEQ ID NO: 13944 - DNA, 16 bp, H. sapiens
aactcattttcaacaa

SEQ ID NO: 13945 - DNA, 16 bp, H. sapiens
aactcattttctacaa

SEQ ID NO: 13946 - DNA, 16 bp, H. sapiens
aactccacattcagtg

SEQ ID NO: 13947 - DNA, 16 bp, H. sapiens
aactccacctcctgga

SEQ ID NO: 13948 - DNA, 16 bp, H. sapiens
aactccactttataaa

SEQ ID NO: 13949 - DNA, 16 bp, H. sapiens
aactccagaactcaag

SEQ ID NO: 13950 - DNA, 20 bp, H. sapiens
aactccagacctcaggtgat

SEQ ID NO: 13951 - DNA, 16 bp, H. sapiens
aactccagagctcaag

SEQ ID NO: 13952 - DNA, 16 bp, H. sapiens
aactccagcaaagtct

SEQ ID NO: 13953 - DNA, 20 bp, H. sapiens
aactccagcctgggcaacag

SEQ ID NO: 13954 - DNA, 16 bp, H. sapiens
aactccaggaaaaaca

SEQ ID NO: 13955 - DNA, 16 bp, H. sapiens
aactccaggcctcagg

SEQ ID NO: 13956 - DNA, 16 bp, H. sapiens
aactccagggctcaag

SEQ ID NO: 13957 - DNA, 16 bp, H. sapiens
aactccagggctccag

SEQ ID NO: 13958 - DNA, 16 bp, H. sapiens
aactccaggggaagat

SEQ ID NO: 13959 - DNA, 16 bp, H. sapiens
aactccatccaggttg

SEQ ID NO: 13960 - DNA, 16 bp, H. sapiens
aactccatctcaaaag

SEQ ID NO: 13961 - DNA, 16 bp, H. sapiens
aactccatcttgcttt

SEQ ID NO: 13962 - DNA, 16 bp, H. sapiens
aactccatgagggcag

SEQ ID NO: 13963 - DNA, 16 bp, H. sapiens
aactccattataatct

SEQ ID NO: 13964 - DNA, 16 bp, H. sapiens
aactcccaaagatcaa

SEQ ID NO: 13965 - DNA, 17 bp, H. sapiens
aactcccaacctcaagc

SEQ ID NO: 13966 - DNA, 20 bp, H. sapiens
aactcccaacctcaggtgac

SEQ ID NO: 13967 - DNA, 20 bp, H. sapiens
aactcccaacctcaggtgat

SEQ ID NO: 13968 - DNA, 16 bp, H. sapiens
aactcccaagttcaag

SEQ ID NO: 13969 - DNA, 16 bp, H. sapiens
aactcccacaattcct

SEQ ID NO: 13970 - DNA, 16 bp, H. sapiens
aactcccacttacaag

SEQ ID NO: 13971 - DNA, 16 bp, H. sapiens
aactcccatctcccta

SEQ ID NO: 13972 - DNA, 19 bp, H. sapiens
aactcccattcacaattgt

SEQ ID NO: 13973 - DNA, 16 bp, H. sapiens
aactccccaggcctcc

SEQ ID NO: 13974 - DNA, 16 bp, H. sapiens
aactccccaggctcag

SEQ ID NO: 13975 - DNA, 16 bp, H. sapiens
aactcccgacctcaag

SEQ ID NO: 13976 - DNA, 16 bp, H. sapiens
aactcccgacctcagg

SEQ ID NO: 13977 - DNA, 20 bp, H. sapiens
aactcccgacctcaggtgac

SEQ ID NO: 13978 - DNA, 20 bp, H. sapiens
aactcccgacctcaggtgat

SEQ ID NO: 13979 - DNA, 20 bp, H. sapiens
aactcccgaccttaggtgat

SEQ ID NO: 13980 - DNA, 20 bp, H. sapiens
aactcccgacttcaggtgat

SEQ ID NO: 13981 - DNA, 16 bp, H. sapiens
aactcccgggctcaag

SEQ ID NO: 13982 - DNA, 16 bp, H. sapiens
aactccctgagcctca

SEQ ID NO: 13983 - DNA, 16 bp, H. sapiens
aactccctggacagag

SEQ ID NO: 13984 - DNA, 16 bp, H. sapiens
aactcccttctttccc

SEQ ID NO: 13985 - DNA, 16 bp, H. sapiens
aactccggagctcaag

SEQ ID NO: 13986 - DNA, 17 bp, H. sapiens
aactccggcgccagtca

SEQ ID NO: 13987 - DNA, 16 bp, H. sapiens
aactcctaaaatcctt

SEQ ID NO: 13988 - DNA, 16 bp, H. sapiens
aactcctaaactcaaa

SEQ ID NO: 13989 - DNA, 20 bp, H. sapiens
aactcctaacctcaggtgat

SEQ ID NO: 13990 - DNA, 16 bp, H. sapiens
aactcctaacctgaag

SEQ ID NO: 13991 - DNA, 16 bp, H. sapiens
aactcctacaactcaa

SEQ ID NO: 13992 - DNA, 16 bp, H. sapiens
aactcctacacatcct

SEQ ID NO: 13993 - DNA, 16 bp, H. sapiens
aactcctacccatcct

SEQ ID NO: 13994 - DNA, 16 bp, H. sapiens
aactcctagactcaag

SEQ ID NO: 13995 - DNA, 16 bp, H. sapiens
aactcctaggctcaag

SEQ ID NO: 13996 - DNA, 16 bp, H. sapiens
aactcctaggcttaag

SEQ ID NO: 13997 - DNA, 16 bp, H. sapiens
aactcctaggttcaag

SEQ ID NO: 13998 - DNA, 16 bp, H. sapiens
aactcctatgctcaag

SEQ ID NO: 13999 - DNA, 17 bp, H. sapiens
aactcctccttgtacct

SEQ ID NO: 14000 - DNA, 16 bp, H. sapiens
aactcctcgcctcaag

SEQ ID NO: 14001 - DNA, 16 bp, H. sapiens
aactcctgaactcaag

SEQ ID NO: 14002 - DNA, 16 bp, H. sapiens
aactcctgaactcagg

SEQ ID NO: 14003 - DNA, 17 bp, H. sapiens
aactcctgaaggaagca

SEQ ID NO: 14004 - DNA, 16 bp, H. sapiens
aactcctgacatcaag

SEQ ID NO: 14005 - DNA, 20 bp, H. sapiens
aactcctgacatcaggtgat

SEQ ID NO: 14006 - DNA, 16 bp, H. sapiens
aactcctgaccacagg

SEQ ID NO: 14007 - DNA, 16 bp, H. sapiens
aactcctgaccccaga

SEQ ID NO: 14008 - DNA, 21 bp, H. sapiens
aactcctgaccccaggtgatc

SEQ ID NO: 14009 - DNA, 21 bp, H. sapiens
aactcctgaccgcaggtgatc

SEQ ID NO: 14010 - DNA, 16 bp, H. sapiens
aactcctgacctaaag

SEQ ID NO: 14011 - DNA, 20 bp, H. sapiens
aactcctgacctaaggtgat

SEQ ID NO: 14012 - DNA, 16 bp, H. sapiens
aactcctgacctcaaa

SEQ ID NO: 14013 - DNA, 16 bp, H. sapiens
aactcctgacctcaac

SEQ ID NO: 14014 - DNA, 16 bp, H. sapiens
aactcctgacctcaag

SEQ ID NO: 14015 - DNA, 16 bp, H. sapiens
aactcctgacctcacg

SEQ ID NO: 14016 - DNA, 16 bp, H. sapiens
aactcctgacctcaga

SEQ ID NO: 14017 - DNA, 20 bp, H. sapiens
aactcctgacctcagatgat

SEQ ID NO: 14018 - DNA, 16 bp, H. sapiens
aactcctgacctcagc

SEQ ID NO: 14019 - DNA, 17 bp, H. sapiens
aactcctgacctcaggc

SEQ ID NO: 14020 - DNA, 22 bp, H. sapiens
aactcctgacctcaggcgatcc

SEQ ID NO: 14021 - DNA, 17 bp, H. sapiens
aactcctgacctcaggg

SEQ ID NO: 14022 - DNA, 20 bp, H. sapiens
aactcctgacctcaggtaat

SEQ ID NO: 14023 - DNA, 20 bp, H. sapiens
aactcctgacctcaggtgac

SEQ ID NO: 14024 - DNA, 20 bp, H. sapiens
aactcctgacctcaggtgag

SEQ ID NO: 14025 - DNA, 20 bp, H. sapiens
aactcctgacctcaggtgat

SEQ ID NO: 14026 - DNA, 19 bp, H. sapiens
aactcctgacctcaggtgc

SEQ ID NO: 14027 - DNA, 19 bp, H. sapiens
aactcctgacctcaggtgg

SEQ ID NO: 14028 - DNA, 19 bp, H. sapiens
aactcctgacctcaggtgt

SEQ ID NO: 14029 - DNA, 16 bp, H. sapiens
aactcctgacctcagt

SEQ ID NO: 14030 - DNA, 16 bp, H. sapiens
aactcctgacctcatc

SEQ ID NO: 14031 - DNA, 16 bp, H. sapiens
aactcctgacctcatg

SEQ ID NO: 14032 - DNA, 20 bp, H. sapiens
aactcctgacctcatgtgat

SEQ ID NO: 14033 - DNA, 16 bp, H. sapiens
aactcctgacctccag

SEQ ID NO: 14034 - DNA, 16 bp, H. sapiens
aactcctgacctcgag

SEQ ID NO: 14035 - DNA, 16 bp, H. sapiens
aactcctgacctcggg

SEQ ID NO: 14036 - DNA, 16 bp, H. sapiens
aactcctgacctctgg

SEQ ID NO: 14037 - DNA, 16 bp, H. sapiens
aactcctgacctgaag

SEQ ID NO: 14038 - DNA, 16 bp, H. sapiens
aactcctgacctgagg

SEQ ID NO: 14039 - DNA, 20 bp, H. sapiens
aactcctgaccttaggtgat

SEQ ID NO: 14040 - DNA, 16 bp, H. sapiens
aactcctgaccttgag

SEQ ID NO: 14041 - DNA, 16 bp, H. sapiens
aactcctgaccttggg

SEQ ID NO: 14042 - DNA, 16 bp, H. sapiens
aactcctgacgtcaag

SEQ ID NO: 14043 - DNA, 16 bp, H. sapiens
aactcctgactgacct

SEQ ID NO: 14044 - DNA, 17 bp, H. sapiens
aactcctgactgcaggt

SEQ ID NO: 14045 - DNA, 16 bp, H. sapiens
aactcctgacttcaaa

SEQ ID NO: 14046 - DNA, 16 bp, H. sapiens
aactcctgacttcaag

SEQ ID NO: 14047 - DNA, 20 bp, H. sapiens
aactcctgacttcaggtgat

SEQ ID NO: 14048 - DNA, 16 bp, H. sapiens
aactcctgactttagg

SEQ ID NO: 14049 - DNA, 16 bp, H. sapiens
aactcctgagctaaag

SEQ ID NO: 14050 - DNA, 16 bp, H. sapiens
aactcctgagctcaaa

SEQ ID NO: 14051 - DNA, 16 bp, H. sapiens
aactcctgagctcaag

SEQ ID NO: 14052 - DNA, 16 bp, H. sapiens
aactcctgagctcagc

SEQ ID NO: 14053 - DNA, 16 bp, H. sapiens
aactcctgagctcagg

SEQ ID NO: 14054 - DNA, 17 bp, H. sapiens
aactcctgagctcatgc

SEQ ID NO: 14055 - DNA, 16 bp, H. sapiens
aactcctgagctcgtg

SEQ ID NO: 14056 - DNA, 16 bp, H. sapiens
aactcctgagcttaag

SEQ ID NO: 14057 - DNA, 16 bp, H. sapiens
aactcctgagtccaag

SEQ ID NO: 14058 - DNA, 16 bp, H. sapiens
aactcctgatctcaag

SEQ ID NO: 14059 - DNA, 20 bp, H. sapiens
aactcctgatctcaggtgat

SEQ ID NO: 14060 - DNA, 16 bp, H. sapiens
aactcctgatttcaag

SEQ ID NO: 14061 - DNA, 21 bp, H. sapiens
aactcctgccctcaggtgatc

SEQ ID NO: 14062 - DNA, 16 bp, H. sapiens
aactcctgcgctcaag

SEQ ID NO: 14063 - DNA, 16 bp, H. sapiens
aactcctggaagaaaa

SEQ ID NO: 14064 - DNA, 16 bp, H. sapiens
aactcctggaatcaag

SEQ ID NO: 14065 - DNA, 16 bp, H. sapiens
aactcctggacacaag

SEQ ID NO: 14066 - DNA, 16 bp, H. sapiens
aactcctggactcaag

SEQ ID NO: 14067 - DNA, 16 bp, H. sapiens
aactcctggactctag

SEQ ID NO: 14068 - DNA, 16 bp, H. sapiens
aactcctggacttaag

SEQ ID NO: 14069 - DNA, 16 bp, H. sapiens
aactcctggattcaag

SEQ ID NO: 14070 - DNA, 16 bp, H. sapiens
aactcctggattcatt

SEQ ID NO: 14071 - DNA, 16 bp, H. sapiens
aactcctggatttaag

SEQ ID NO: 14072 - DNA, 16 bp, H. sapiens
aactcctggcatcaag

SEQ ID NO: 14073 - DNA, 16 bp, H. sapiens
aactcctggccacaag

SEQ ID NO: 14074 - DNA, 16 bp, H. sapiens
aactcctggccccagg

SEQ ID NO: 14075 - DNA, 16 bp, H. sapiens
aactcctggcctcaaa

SEQ ID NO: 14076 - DNA, 16 bp, H. sapiens
aactcctggcctcaac

SEQ ID NO: 14077 - DNA, 16 bp, H. sapiens
aactcctggcctcaag

SEQ ID NO: 14078 - DNA, 16 bp, H. sapiens
aactcctggcctcagg

SEQ ID NO: 14079 - DNA, 16 bp, H. sapiens
aactcctggcctcatg

SEQ ID NO: 14080 - DNA, 16 bp, H. sapiens
aactcctggcctccag

SEQ ID NO: 14081 - DNA, 16 bp, H. sapiens
aactcctggcctcgag

SEQ ID NO: 14082 - DNA, 16 bp, H. sapiens
aactcctggccttaag

SEQ ID NO: 14083 - DNA, 16 bp, H. sapiens
aactcctggcttcaag

SEQ ID NO: 14084 - DNA, 16 bp, H. sapiens
aactcctgggatcaag

SEQ ID NO: 14085 - DNA, 16 bp, H. sapiens
aactcctgggccaaag

SEQ ID NO: 14086 - DNA, 16 bp, H. sapiens
aactcctgggcccaag

SEQ ID NO: 14087 - DNA, 16 bp, H. sapiens
aactcctgggctaaag

SEQ ID NO: 14088 - DNA, 16 bp, H. sapiens
aactcctgggctcaaa

SEQ ID NO: 14089 - DNA, 16 bp, H. sapiens
aactcctgggctcaag

SEQ ID NO: 14090 - DNA, 17 bp, H. sapiens
aactcctgggctcaggc

SEQ ID NO: 14091 - DNA, 16 bp, H. sapiens
aactcctgggctcatg

SEQ ID NO: 14092 - DNA, 16 bp, H. sapiens
aactcctgggctccag

SEQ ID NO: 14093 - DNA, 16 bp, H. sapiens
aactcctgggcttaag

SEQ ID NO: 14094 - DNA, 16 bp, H. sapiens
aactcctgggttcaag

SEQ ID NO: 14095 - DNA, 16 bp, H. sapiens
aactcctggtcacaag

SEQ ID NO: 14096 - DNA, 16 bp, H. sapiens
aactcctggtctcaag

SEQ ID NO: 14097 - DNA, 16 bp, H. sapiens
aactcctggtctcgag

SEQ ID NO: 14098 - DNA, 16 bp, H. sapiens
aactcctgtcctcaag

SEQ ID NO: 14099 - DNA, 16 bp, H. sapiens
aactcctgtcctcagg

SEQ ID NO: 14100 - DNA, 16 bp, H. sapiens
aactcctgtgctcaag

SEQ ID NO: 14101 - DNA, 20 bp, H. sapiens
aactccttacctcaggtgat

SEQ ID NO: 14102 - DNA, 16 bp, H. sapiens
aactccttggctcaaa

SEQ ID NO: 14103 - DNA, 16 bp, H. sapiens
aactcctttttaaaaa

SEQ ID NO: 14104 - DNA, 16 bp, H. sapiens
aactcctttttttaaa

SEQ ID NO: 14105 - DNA, 16 bp, H. sapiens
aactcgtagaagcaga

SEQ ID NO: 14106 - DNA, 16 bp, H. sapiens
aactctaaacagacca

SEQ ID NO: 14107 - DNA, 16 bp, H. sapiens
aactctacagaaaaaa

SEQ ID NO: 14108 - DNA, 16 bp, H. sapiens
aactctatttaaaatt

SEQ ID NO: 14109 - DNA, 16 bp, H. sapiens
aactctcaaaagaaaa

SEQ ID NO: 14110 - DNA, 16 bp, H. sapiens
aactctcaaaattcaa

SEQ ID NO: 14111 - DNA, 16 bp, H. sapiens
aactctcattttaaaa

SEQ ID NO: 14112 - DNA, 16 bp, H. sapiens
aactctccacctcagg

SEQ ID NO: 14113 - DNA, 16 bp, H. sapiens
aactctgatgaaagaa

SEQ ID NO: 14114 - DNA, 16 bp, H. sapiens
aactctgccacttcct

SEQ ID NO: 14115 - DNA, 16 bp, H. sapiens
aactctgcctcaaaaa

SEQ ID NO: 14116 - DNA, 16 bp, H. sapiens
aactctgccttctggg

SEQ ID NO: 14117 - DNA, 16 bp, H. sapiens
aactctgctccccaaa

SEQ ID NO: 14118 - DNA, 16 bp, H. sapiens
aactctgcttcctggg

SEQ ID NO: 14119 - DNA, 16 bp, H. sapiens
aactctggagctccca

SEQ ID NO: 14120 - DNA, 16 bp, H. sapiens
aactctggagtcagac

SEQ ID NO: 14121 - DNA, 16 bp, H. sapiens
aactctgggattaaag

SEQ ID NO: 14122 - DNA, 16 bp, H. sapiens
aactctggggctcaag

SEQ ID NO: 14123 - DNA, 16 bp, H. sapiens
aactctgtacccatca

SEQ ID NO: 14124 - DNA, 16 bp, H. sapiens
aactctgtcccaaaaa

SEQ ID NO: 14125 - DNA, 16 bp, H. sapiens
aactctgtgaagaaag

SEQ ID NO: 14126 - DNA, 16 bp, H. sapiens
aactctgtgactttgg

SEQ ID NO: 14127 - DNA, 16 bp, H. sapiens
aactcttaaaacccaa

SEQ ID NO: 14128 - DNA, 16 bp, H. sapiens
aactcttagaagaaac

SEQ ID NO: 14129 - DNA, 16 bp, H. sapiens
aactcttcattttgtt

SEQ ID NO: 14130 - DNA, 16 bp, H. sapiens
aactcttccaatccat

SEQ ID NO: 14131 - DNA, 16 bp, H. sapiens
aactcttctgcctcag

SEQ ID NO: 14132 - DNA, 16 bp, H. sapiens
aactcttcttgttgca

SEQ ID NO: 14133 - DNA, 16 bp, H. sapiens
aactcttgacctcaaa

SEQ ID NO: 14134 - DNA, 16 bp, H. sapiens
aactcttgacctcaag

SEQ ID NO: 14135 - DNA, 16 bp, H. sapiens
aactcttgacctcagc

SEQ ID NO: 14136 - DNA, 18 bp, H. sapiens
aactcttgacctcaggta

SEQ ID NO: 14137 - DNA, 20 bp, H. sapiens
aactcttgacctcaggtgat

SEQ ID NO: 14138 - DNA, 16 bp, H. sapiens
aactcttgacctgaag

SEQ ID NO: 14139 - DNA, 16 bp, H. sapiens
aactcttgagctcaag

SEQ ID NO: 14140 - DNA, 16 bp, H. sapiens
aactcttggcctcaaa

SEQ ID NO: 14141 - DNA, 16 bp, H. sapiens
aactcttggcctcaag

SEQ ID NO: 14142 - DNA, 16 bp, H. sapiens
aactcttggcctcagg

SEQ ID NO: 14143 - DNA, 16 bp, H. sapiens
aactcttgggctcaag

SEQ ID NO: 14144 - DNA, 16 bp, H. sapiens
aactcttgggctcagg

SEQ ID NO: 14145 - DNA, 16 bp, H. sapiens
aactcttgggttcaag

SEQ ID NO: 14146 - DNA, 16 bp, H. sapiens
aactctttggctcaag

SEQ ID NO: 14147 - DNA, 16 bp, H. sapiens
aactcttttagggcag

SEQ ID NO: 14148 - DNA, 16 bp, H. sapiens
aactgaaaaaggaaat

SEQ ID NO: 14149 - DNA, 16 bp, H. sapiens
aactgaaaaatacaat

SEQ ID NO: 14150 - DNA, 16 bp, H. sapiens
aactgaaaacaaaatc

SEQ ID NO: 14151 - DNA, 16 bp, H. sapiens
aactgaaaaggaagaa

SEQ ID NO: 14152 - DNA, 16 bp, H. sapiens
aactgaaaataaaatt

SEQ ID NO: 14153 - DNA, 16 bp, H. sapiens
aactgaaaatgcaaaa

SEQ ID NO: 14154 - DNA, 16 bp, H. sapiens
aactgaaaatggaaaa

SEQ ID NO: 14155 - DNA, 16 bp, H. sapiens
aactgaaacagcatgg

SEQ ID NO: 14156 - DNA, 16 bp, H. sapiens
aactgaaacttcatac

SEQ ID NO: 14157 - DNA, 16 bp, H. sapiens
aactgaaagaaagggt

SEQ ID NO: 14158 - DNA, 16 bp, H. sapiens
aactgaaagaaattga

SEQ ID NO: 14159 - DNA, 16 bp, H. sapiens
aactgaaagaagccaa

SEQ ID NO: 14160 - DNA, 16 bp, H. sapiens
aactgaaagaagccag

SEQ ID NO: 14161 - DNA, 16 bp, H. sapiens
aactgaaagagaaaga

SEQ ID NO: 14162 - DNA, 16 bp, H. sapiens
aactgaaagagaaata

SEQ ID NO: 14163 - DNA, 16 bp, H. sapiens
aactgaaagagtataa

SEQ ID NO: 14164 - DNA, 16 bp, H. sapiens
aactgaaagtcaccag

SEQ ID NO: 14165 - DNA, 16 bp, H. sapiens
aactgaaataaaaagt

SEQ ID NO: 14166 - DNA, 16 bp, H. sapiens
aactgaaatatatata

SEQ ID NO: 14167 - DNA, 16 bp, H. sapiens
aactgaaatgaaaaat

SEQ ID NO: 14168 - DNA, 16 bp, H. sapiens
aactgaaatggaaaaa

SEQ ID NO: 14169 - DNA, 16 bp, H. sapiens
aactgaaattatacca

SEQ ID NO: 14170 - DNA, 16 bp, H. sapiens
aactgaaattatttta

SEQ ID NO: 14171 - DNA, 16 bp, H. sapiens
aactgaaatttcagtt

SEQ ID NO: 14172 - DNA, 16 bp, H. sapiens
aactgaaattttatac

SEQ ID NO: 14173 - DNA, 16 bp, H. sapiens
aactgaaattttgttt

SEQ ID NO: 14174 - DNA, 16 bp, H. sapiens
aactgaacaacatgct

SEQ ID NO: 14175 - DNA, 17 bp, H. sapiens
aactgaacaaccagctc

SEQ ID NO: 14176 - DNA, 16 bp, H. sapiens
aactgaacaagctgct

SEQ ID NO: 14177 - DNA, 16 bp, H. sapiens
aactgaacagtgagaa

SEQ ID NO: 14178 - DNA, 16 bp, H. sapiens
aactgaacattttaaa

SEQ ID NO: 14179 - DNA, 16 bp, H. sapiens
aactgaacccacaata

SEQ ID NO: 14180 - DNA, 16 bp, H. sapiens
aactgaagaaaatatt

SEQ ID NO: 14181 - DNA, 16 bp, H. sapiens
aactgaagaaaatgaa

SEQ ID NO: 14182 - DNA, 16 bp, H. sapiens
aactgaagaacagaga

SEQ ID NO: 14183 - DNA, 16 bp, H. sapiens
aactgaagaagacaca

SEQ ID NO: 14184 - DNA, 16 bp, H. sapiens
aactgaagaaggaaaa

SEQ ID NO: 14185 - DNA, 16 bp, H. sapiens
aactgaagaatgatga

SEQ ID NO: 14186 - DNA, 16 bp, H. sapiens
aactgaagaggaagga

SEQ ID NO: 14187 - DNA, 16 bp, H. sapiens
aactgaagaggaggaa

SEQ ID NO: 14188 - DNA, 16 bp, H. sapiens
aactgaagagtccttg

SEQ ID NO: 14189 - DNA, 16 bp, H. sapiens
aactgaagcacaggga

SEQ ID NO: 14190 - DNA, 16 bp, H. sapiens
aactgaagctcaaaga

SEQ ID NO: 14191 - DNA, 16 bp, H. sapiens
aactgaagctcagaga

SEQ ID NO: 14192 - DNA, 16 bp, H. sapiens
aactgaaggaaactga

SEQ ID NO: 14193 - DNA, 16 bp, H. sapiens
aactgaaggaaagaga

SEQ ID NO: 14194 - DNA, 16 bp, H. sapiens
aactgaaggaaattaa

SEQ ID NO: 14195 - DNA, 16 bp, H. sapiens
aactgaaggaaattga

SEQ ID NO: 14196 - DNA, 16 bp, H. sapiens
aactgaaggagacaga

SEQ ID NO: 14197 - DNA, 16 bp, H. sapiens
aactgaaggagctaga

SEQ ID NO: 14198 - DNA, 16 bp, H. sapiens
aactgaaggagttaga

SEQ ID NO: 14199 - DNA, 16 bp, H. sapiens
aactgaagggagaaat

SEQ ID NO: 14200 - DNA, 16 bp, H. sapiens
aactgaagttaaaatt

SEQ ID NO: 14201 - DNA, 16 bp, H. sapiens
aactgaagtttgattt

SEQ ID NO: 14202 - DNA, 16 bp, H. sapiens
aactgaataccacaga

SEQ ID NO: 14203 - DNA, 16 bp, H. sapiens
aactgaatattaaaat

SEQ ID NO: 14204 - DNA, 16 bp, H. sapiens
aactgaatgaaattga

SEQ ID NO: 14205 - DNA, 16 bp, H. sapiens
aactgaatgtttttaa

SEQ ID NO: 14206 - DNA, 16 bp, H. sapiens
aactgaattctgccaa

SEQ ID NO: 14207 - DNA, 16 bp, H. sapiens
aactgaatttaaaaaa

SEQ ID NO: 14208 - DNA, 16 bp, H. sapiens
aactgaatttatttta

SEQ ID NO: 14209 - DNA, 16 bp, H. sapiens
aactgaatttgtaatt

SEQ ID NO: 14210 - DNA, 16 bp, H. sapiens
aactgaattttctttt

SEQ ID NO: 14211 - DNA, 16 bp, H. sapiens
aactgaattttgacaa

SEQ ID NO: 14212 - DNA, 16 bp, H. sapiens
aactgaatttttcatt

SEQ ID NO: 14213 - DNA, 16 bp, H. sapiens
aactgacaaactgttt

SEQ ID NO: 14214 - DNA, 16 bp, H. sapiens
aactgacaagctgatc

SEQ ID NO: 14215 - DNA, 16 bp, H. sapiens
aactgacactacagaa

SEQ ID NO: 14216 - DNA, 16 bp, H. sapiens
aactgacagaactgaa

SEQ ID NO: 14217 - DNA, 16 bp, H. sapiens
aactgacatttattga

SEQ ID NO: 14218 - DNA, 16 bp, H. sapiens
aactgaccaacattaa

SEQ ID NO: 14219 - DNA, 16 bp, H. sapiens
aactgaccccaaagaa

SEQ ID NO: 14220 - DNA, 16 bp, H. sapiens
aactgaccctaaagaa

SEQ ID NO: 14221 - DNA, 16 bp, H. sapiens
aactgagaaaaaaatg

SEQ ID NO: 14222 - DNA, 16 bp, H. sapiens
aactgagaaaatgaaa

SEQ ID NO: 14223 - DNA, 16 bp, H. sapiens
aactgagaaagacaaa

SEQ ID NO: 14224 - DNA, 16 bp, H. sapiens
aactgagatcatgtca

SEQ ID NO: 14225 - DNA, 16 bp, H. sapiens
aactgagatccagaga

SEQ ID NO: 14226 - DNA, 16 bp, H. sapiens
aactgagcattttata

SEQ ID NO: 14227 - DNA, 16 bp, H. sapiens
aactgagcattttcaa

SEQ ID NO: 14228 - DNA, 16 bp, H. sapiens
aactgagcctgggagg

SEQ ID NO: 14229 - DNA, 16 bp, H. sapiens
aactgaggaggaggga

SEQ ID NO: 14230 - DNA, 16 bp, H. sapiens
aactgaggaggcggag

SEQ ID NO: 14231 - DNA, 16 bp, H. sapiens
aactgaggcaaagaga

SEQ ID NO: 14232 - DNA, 16 bp, H. sapiens
aactgaggcacagaga

SEQ ID NO: 14233 - DNA, 16 bp, H. sapiens
aactgaggcacagagg

SEQ ID NO: 14234 - DNA, 16 bp, H. sapiens
aactgaggcaggagac

SEQ ID NO: 14235 - DNA, 16 bp, H. sapiens
aactgaggcccagcaa

SEQ ID NO: 14236 - DNA, 16 bp, H. sapiens
aactgaggcttagaaa

SEQ ID NO: 14237 - DNA, 16 bp, H. sapiens
aactgaggcttggaaa

SEQ ID NO: 14238 - DNA, 16 bp, H. sapiens
aactgagggacattct

SEQ ID NO: 14239 - DNA, 16 bp, H. sapiens
aactgaggggaaaaaa

SEQ ID NO: 14240 - DNA, 16 bp, H. sapiens
aactgaggtccagaga

SEQ ID NO: 14241 - DNA, 16 bp, H. sapiens
aactgagtcttcaaaa

SEQ ID NO: 14242 - DNA, 16 bp, H. sapiens
aactgagtgacttaaa

SEQ ID NO: 14243 - DNA, 19 bp, H. sapiens
aactgataaaagaattcag

SEQ ID NO: 14244 - DNA, 16 bp, H. sapiens
aactgatatttattga

SEQ ID NO: 14245 - DNA, 16 bp, H. sapiens
aactgatcaaaaataa

SEQ ID NO: 14246 - DNA, 16 bp, H. sapiens
aactgatctgcctgcc

SEQ ID NO: 14247 - DNA, 16 bp, H. sapiens
aactgatctttgacag

SEQ ID NO: 14248 - DNA, 16 bp, H. sapiens
aactgatgaatggata

SEQ ID NO: 14249 - DNA, 16 bp, H. sapiens
aactgatgacattgtc

SEQ ID NO: 14250 - DNA, 22 bp, H. sapiens
aactgatgactttatttaccca

SEQ ID NO: 14251 - DNA, 16 bp, H. sapiens
aactgatggttttaaa

SEQ ID NO: 14252 - DNA, 16 bp, H. sapiens
aactgattcttctgcc

SEQ ID NO: 14253 - DNA, 16 bp, H. sapiens
aactgattgtaaatgt

SEQ ID NO: 14254 - DNA, 16 bp, H. sapiens
aactgattttcaacaa

SEQ ID NO: 14255 - DNA, 16 bp, H. sapiens
aactgattttcaataa

SEQ ID NO: 14256 - DNA, 16 bp, H. sapiens
aactgatttttaaaat

SEQ ID NO: 14257 - DNA, 16 bp, H. sapiens
aactgatttttgacaa

SEQ ID NO: 14258 - DNA, 16 bp, H. sapiens
aactgatttttttaaa

SEQ ID NO: 14259 - DNA, 16 bp, H. sapiens
aactgcaaatcagaaa

SEQ ID NO: 14260 - DNA, 16 bp, H. sapiens
aactgcaacaactttt

SEQ ID NO: 14261 - DNA, 16 bp, H. sapiens
aactgcaacaagacaa

SEQ ID NO: 14262 - DNA, 16 bp, H. sapiens
aactgcagatggaaaa

SEQ ID NO: 14263 - DNA, 16 bp, H. sapiens
aactgcagcagccctg

SEQ ID NO: 14264 - DNA, 16 bp, H. sapiens
aactgcagcctctgcc

SEQ ID NO: 14265 - DNA, 16 bp, H. sapiens
aactgcagctgcagac

SEQ ID NO: 14266 - DNA, 16 bp, H. sapiens
aactgcaggaaaaaaa

SEQ ID NO: 14267 - DNA, 16 bp, H. sapiens
aactgcaggccaatat

SEQ ID NO: 14268 - DNA, 16 bp, H. sapiens
aactgcagtggcacaa

SEQ ID NO: 14269 - DNA, 16 bp, H. sapiens
aactgcatcaactaac

SEQ ID NO: 14270 - DNA, 16 bp, H. sapiens
aactgcattttaacaa

SEQ ID NO: 14271 - DNA, 16 bp, H. sapiens
aactgccaaactcttt

SEQ ID NO: 14272 - DNA, 16 bp, H. sapiens
aactgccaaactgttt

SEQ ID NO: 14273 - DNA, 16 bp, H. sapiens
aactgccacctcctgg

SEQ ID NO: 14274 - DNA, 16 bp, H. sapiens
aactgccagactgttt

SEQ ID NO: 14275 - DNA, 16 bp, H. sapiens
aactgccatttattga

SEQ ID NO: 14276 - DNA, 16 bp, H. sapiens
aactgcccaagggctg

SEQ ID NO: 14277 - DNA, 16 bp, H. sapiens
aactgcccccattatt

SEQ ID NO: 14278 - DNA, 16 bp, H. sapiens
aactgccctgagctgc

SEQ ID NO: 14279 - DNA, 16 bp, H. sapiens
aactgcccttttataa

SEQ ID NO: 14280 - DNA, 16 bp, H. sapiens
aactgcctacaatatt

SEQ ID NO: 14281 - DNA, 16 bp, H. sapiens
aactgcctctgagctg

SEQ ID NO: 14282 - DNA, 16 bp, H. sapiens
aactgcctttgttctg

SEQ ID NO: 14283 - DNA, 16 bp, H. sapiens
aactgctccaacctct

SEQ ID NO: 14284 - DNA, 16 bp, H. sapiens
aactgctcttctgact

SEQ ID NO: 14285 - DNA, 16 bp, H. sapiens
aactgctcttttaaaa

SEQ ID NO: 14286 - DNA, 16 bp, H. sapiens
aactgctgacctcaag

SEQ ID NO: 14287 - DNA, 20 bp, H. sapiens
aactgctgacctcaggtgat

SEQ ID NO: 14288 - DNA, 16 bp, H. sapiens
aactgctgagctcaaa

SEQ ID NO: 14289 - DNA, 16 bp, H. sapiens
aactgctgcctcctgg

SEQ ID NO: 14290 - DNA, 16 bp, H. sapiens
aactgctggctttgca

SEQ ID NO: 14291 - DNA, 16 bp, H. sapiens
aactgctgggctcaag

SEQ ID NO: 14292 - DNA, 16 bp, H. sapiens
aactgctgggcttaag

SEQ ID NO: 14293 - DNA, 16 bp, H. sapiens
aactgcttcatgctgg

SEQ ID NO: 14294 - DNA, 16 bp, H. sapiens
aactgcttctttgact

SEQ ID NO: 14295 - DNA, 16 bp, H. sapiens
aactgcttctttggct

SEQ ID NO: 14296 - DNA, 16 bp, H. sapiens
aactgcttgagaccag

SEQ ID NO: 14297 - DNA, 16 bp, H. sapiens
aactgctttaaaaatt

SEQ ID NO: 14298 - DNA, 16 bp, H. sapiens
aactgcttttgaaaaa

SEQ ID NO: 14299 - DNA, 16 bp, H. sapiens
aactgctttttctgca

SEQ ID NO: 14300 - DNA, 16 bp, H. sapiens
aactggaaaaacagat

SEQ ID NO: 14301 - DNA, 16 bp, H. sapiens
aactggaaaaagacaa

SEQ ID NO: 14302 - DNA, 16 bp, H. sapiens
aactggaaaatctgga

SEQ ID NO: 14303 - DNA, 16 bp, H. sapiens
aactggaaagaaactt

SEQ ID NO: 14304 - DNA, 16 bp, H. sapiens
aactggaaagaagaaa

SEQ ID NO: 14305 - DNA, 16 bp, H. sapiens
aactggaaagaagcta

SEQ ID NO: 14306 - DNA, 16 bp, H. sapiens
aactggaaataaaatt

SEQ ID NO: 14307 - DNA, 16 bp, H. sapiens
aactggaaataacaca

SEQ ID NO: 14308 - DNA, 16 bp, H. sapiens
aactggaaataattca

SEQ ID NO: 14309 - DNA, 16 bp, H. sapiens
aactggaacatcagct

SEQ ID NO: 14310 - DNA, 16 bp, H. sapiens
aactggaacccttgtg

SEQ ID NO: 14311 - DNA, 16 bp, H. sapiens
aactggaagaaataaa

SEQ ID NO: 14312 - DNA, 16 bp, H. sapiens
aactggaagaatcaca

SEQ ID NO: 14313 - DNA, 16 bp, H. sapiens
aactggaaggagaaat

SEQ ID NO: 14314 - DNA, 16 bp, H. sapiens
aactggaatgacaaga

SEQ ID NO: 14315 - DNA, 16 bp, H. sapiens
aactggaattctcata

SEQ ID NO: 14316 - DNA, 16 bp, H. sapiens
aactggaatttttttt

SEQ ID NO: 14317 - DNA, 16 bp, H. sapiens
aactggaccccatcct

SEQ ID NO: 14318 - DNA, 16 bp, H. sapiens
aactggaccccttcct

SEQ ID NO: 14319 - DNA, 16 bp, H. sapiens
aactggacttacagtt

SEQ ID NO: 14320 - DNA, 16 bp, H. sapiens
aactggagaaccaaga

SEQ ID NO: 14321 - DNA, 16 bp, H. sapiens
aactggagaggcagag

SEQ ID NO: 14322 - DNA, 16 bp, H. sapiens
aactggaggcatcata

SEQ ID NO: 14323 - DNA, 16 bp, H. sapiens
aactggagtgcagtgg

SEQ ID NO: 14324 - DNA, 16 bp, H. sapiens
aactggatatccttat

SEQ ID NO: 14325 - DNA, 16 bp, H. sapiens
aactggatttgaatcc

SEQ ID NO: 14326 - DNA, 16 bp, H. sapiens
aactggcaaaatttga

SEQ ID NO: 14327 - DNA, 16 bp, H. sapiens
aactggcctgagatgg

SEQ ID NO: 14328 - DNA, 16 bp, H. sapiens
aactggctagccatac

SEQ ID NO: 14329 - DNA, 17 bp, H. sapiens
aactggctagccatata

SEQ ID NO: 14330 - DNA, 16 bp, H. sapiens
aactggctagccatgt

SEQ ID NO: 14331 - DNA, 16 bp, H. sapiens
aactggctcatgtgat

SEQ ID NO: 14332 - DNA, 16 bp, H. sapiens
aactgggaaaggaaaa

SEQ ID NO: 14333 - DNA, 16 bp, H. sapiens
aactgggactacagga

SEQ ID NO: 14334 - DNA, 16 bp, H. sapiens
aactgggagacacctc

SEQ ID NO: 14335 - DNA, 16 bp, H. sapiens
aactgggaggcagagg

SEQ ID NO: 14336 - DNA, 16 bp, H. sapiens
aactgggatttgaacc

SEQ ID NO: 14337 - DNA, 16 bp, H. sapiens
aactgggcaactgttg

SEQ ID NO: 14338 - DNA, 16 bp, H. sapiens
aactgggcaggtggag

SEQ ID NO: 14339 - DNA, 16 bp, H. sapiens
aactgggcatggtggt

SEQ ID NO: 14340 - DNA, 17 bp, H. sapiens
aactgggctgaggctga

SEQ ID NO: 14341 - DNA, 16 bp, H. sapiens
aactggggaaactgag

SEQ ID NO: 14342 - DNA, 16 bp, H. sapiens
aactggggctacaggt

SEQ ID NO: 14343 - DNA, 16 bp, H. sapiens
aactgggtaacttata

SEQ ID NO: 14344 - DNA, 45 bp, H. sapiens
aactgggtggagcccaccacagctcaaggaggcctgcctgcctct

SEQ ID NO: 14345 - DNA, 16 bp, H. sapiens
aactggtcttcctgct

SEQ ID NO: 14346 - DNA, 16 bp, H. sapiens
aactggtctttgacaa

SEQ ID NO: 14347 - DNA, 16 bp, H. sapiens
aactggtgaaaccctg

SEQ ID NO: 14348 - DNA, 16 bp, H. sapiens
aactggttttttaaaa

SEQ ID NO: 14349 - DNA, 16 bp, H. sapiens
aactgtaaaacattga

SEQ ID NO: 14350 - DNA, 16 bp, H. sapiens
aactgtaaaatattga

SEQ ID NO: 14351 - DNA, 16 bp, H. sapiens
aactgtaaatatattt

SEQ ID NO: 14352 - DNA, 17 bp, H. sapiens
aactgtaacactcaccg

SEQ ID NO: 14353 - DNA, 16 bp, H. sapiens
aactgtaagaaataaa

SEQ ID NO: 14354 - DNA, 16 bp, H. sapiens
aactgtaagaaatgaa

SEQ ID NO: 14355 - DNA, 16 bp, H. sapiens
aactgtaagataatac

SEQ ID NO: 14356 - DNA, 16 bp, H. sapiens
aactgtacactgaaaa

SEQ ID NO: 14357 - DNA, 16 bp, H. sapiens
aactgtacatatttat

SEQ ID NO: 14358 - DNA, 16 bp, H. sapiens
aactgtacatttaaaa

SEQ ID NO: 14359 - DNA, 16 bp, H. sapiens
aactgtagatgtggtg

SEQ ID NO: 14360 - DNA, 16 bp, H. sapiens
aactgtaggccaatat

SEQ ID NO: 14361 - DNA, 17 bp, H. sapiens
aactgtatccaggccat

SEQ ID NO: 14362 - DNA, 16 bp, H. sapiens
aactgtatgggggaaa

SEQ ID NO: 14363 - DNA, 16 bp, H. sapiens
aactgtatttatttta

SEQ ID NO: 14364 - DNA, 16 bp, H. sapiens
aactgtatttcttttt

SEQ ID NO: 14365 - DNA, 16 bp, H. sapiens
aactgtatttttgtac

SEQ ID NO: 14366 - DNA, 16 bp, H. sapiens
aactgtatttttgtat

SEQ ID NO: 14367 - DNA, 16 bp, H. sapiens
aactgtatttttgtgc

SEQ ID NO: 14368 - DNA, 16 bp, H. sapiens
aactgtcaacctagaa

SEQ ID NO: 14369 - DNA, 16 bp, H. sapiens
aactgtcaccacaatc

SEQ ID NO: 14370 - DNA, 16 bp, H. sapiens
aactgtcagccaagaa

SEQ ID NO: 14371 - DNA, 16 bp, H. sapiens
aactgtcatgagtatt

SEQ ID NO: 14372 - DNA, 16 bp, H. sapiens
aactgtctcaaaaaat

SEQ ID NO: 14373 - DNA, 16 bp, H. sapiens
aactgtctcctggaca

SEQ ID NO: 14374 - DNA, 16 bp, H. sapiens
aactgtctttgtttct

SEQ ID NO: 14375 - DNA, 16 bp, H. sapiens
aactgtgagaaaacaa

SEQ ID NO: 14376 - DNA, 16 bp, H. sapiens
aactgtgagaaataag

SEQ ID NO: 14377 - DNA, 16 bp, H. sapiens
aactgtgagaagaggg

SEQ ID NO: 14378 - DNA, 16 bp, H. sapiens
aactgtgagaataaat

SEQ ID NO: 14379 - DNA, 16 bp, H. sapiens
aactgtgagatagtaa

SEQ ID NO: 14380 - DNA, 17 bp, H. sapiens
aactgtgagtcaattaa

SEQ ID NO: 14381 - DNA, 16 bp, H. sapiens
aactgtgataaaataa

SEQ ID NO: 14382 - DNA, 16 bp, H. sapiens
aactgtggctcagaga

SEQ ID NO: 14383 - DNA, 16 bp, H. sapiens
aactgtggggccctgg

SEQ ID NO: 14384 - DNA, 16 bp, H. sapiens
aactgtggtatgtaaa

SEQ ID NO: 14385 - DNA, 16 bp, H. sapiens
aactgtgtaatttata

SEQ ID NO: 14386 - DNA, 16 bp, H. sapiens
aactgtgtagaggtgt

SEQ ID NO: 14387 - DNA, 16 bp, H. sapiens
aactgtgtgaccctgg

SEQ ID NO: 14388 - DNA, 16 bp, H. sapiens
aactgtgtgactttgg

SEQ ID NO: 14389 - DNA, 16 bp, H. sapiens
aactgtgtgtgtgtgt

SEQ ID NO: 14390 - DNA, 16 bp, H. sapiens
aactgtgtttaaataa

SEQ ID NO: 14391 - DNA, 16 bp, H. sapiens
aactgttaaacaaaaa

SEQ ID NO: 14392 - DNA, 16 bp, H. sapiens
aactgttaagtccatt

SEQ ID NO: 14393 - DNA, 16 bp, H. sapiens
aactgttaccaaaaaa

SEQ ID NO: 14394 - DNA, 16 bp, H. sapiens
aactgttccaacctct

SEQ ID NO: 14395 - DNA, 16 bp, H. sapiens
aactgttccagcctct

SEQ ID NO: 14396 - DNA, 16 bp, H. sapiens
aactgttgaaagacaa

SEQ ID NO: 14397 - DNA, 16 bp, H. sapiens
aactgtttcaattttt

SEQ ID NO: 14398 - DNA, 16 bp, H. sapiens
aactgtttcattttat

SEQ ID NO: 14399 - DNA, 16 bp, H. sapiens
aactgtttctttaaaa

SEQ ID NO: 14400 - DNA, 16 bp, H. sapiens
aactgtttgttgaatg

SEQ ID NO: 14401 - DNA, 16 bp, H. sapiens
aactgttttcttcttt

SEQ ID NO: 14402 - DNA, 16 bp, H. sapiens
aacttaaaaacaactg

SEQ ID NO: 14403 - DNA, 16 bp, H. sapiens
aacttaaaaatagaat

SEQ ID NO: 14404 - DNA, 16 bp, H. sapiens
aacttaaaacaatcct

SEQ ID NO: 14405 - DNA, 16 bp, H. sapiens
aacttaaaacagaatt

SEQ ID NO: 14406 - DNA, 16 bp, H. sapiens
aacttaaaagtccaca

SEQ ID NO: 14407 - DNA, 16 bp, H. sapiens
aacttaaaagttggaa

SEQ ID NO: 14408 - DNA, 16 bp, H. sapiens
aacttaaaatgtttaa

SEQ ID NO: 14409 - DNA, 16 bp, H. sapiens
aacttaaagaataata

SEQ ID NO: 14410 - DNA, 16 bp, H. sapiens
aacttaaagaatgtaa

SEQ ID NO: 14411 - DNA, 16 bp, H. sapiens
aacttaaagcagaact

SEQ ID NO: 14412 - DNA, 16 bp, H. sapiens
aacttaaaggataata

SEQ ID NO: 14413 - DNA, 17 bp, H. sapiens
aacttaaagtataataa

SEQ ID NO: 14414 - DNA, 17 bp, H. sapiens
aacttaaagtataatat

SEQ ID NO: 14415 - DNA, 16 bp, H. sapiens
aacttaaagtataatt

SEQ ID NO: 14416 - DNA, 16 bp, H. sapiens
aacttaaagtatgata

SEQ ID NO: 14417 - DNA, 16 bp, H. sapiens
aacttaaagtatttta

SEQ ID NO: 14418 - DNA, 16 bp, H. sapiens
aacttaactcttgttt

SEQ ID NO: 14419 - DNA, 16 bp, H. sapiens
aacttaactgataaat

SEQ ID NO: 14420 - DNA, 16 bp, H. sapiens
aacttaagaaataaat

SEQ ID NO: 14421 - DNA, 16 bp, H. sapiens
aacttaagatgaatta

SEQ ID NO: 14422 - DNA, 16 bp, H. sapiens
aacttaagcataaaaa

SEQ ID NO: 14423 - DNA, 16 bp, H. sapiens
aacttaatgaaataaa

SEQ ID NO: 14424 - DNA, 16 bp, H. sapiens
aacttaatgaaattaa

SEQ ID NO: 14425 - DNA, 16 bp, H. sapiens
aacttaattgataaat

SEQ ID NO: 14426 - DNA, 16 bp, H. sapiens
aacttacaaggaatgt

SEQ ID NO: 14427 - DNA, 16 bp, H. sapiens
aacttacatttaaaag

SEQ ID NO: 14428 - DNA, 16 bp, H. sapiens
aacttaccaaaattga

SEQ ID NO: 14429 - DNA, 16 bp, H. sapiens
aacttacccaaagtca

SEQ ID NO: 14430 - DNA, 16 bp, H. sapiens
aacttactcatcttgc

SEQ ID NO: 14431 - DNA, 16 bp, H. sapiens
aacttagaaaaatatt

SEQ ID NO: 14432 - DNA, 16 bp, H. sapiens
aacttagaattctgta

SEQ ID NO: 14433 - DNA, 16 bp, H. sapiens
aacttagataaaatgg

SEQ ID NO: 14434 - DNA, 16 bp, H. sapiens
aacttagcagcttcaa

SEQ ID NO: 14435 - DNA, 16 bp, H. sapiens
aacttatatttaaaag

SEQ ID NO: 14436 - DNA, 16 bp, H. sapiens
aacttatccaaggtca

SEQ ID NO: 14437 - DNA, 16 bp, H. sapiens
aacttatggtgctttt

SEQ ID NO: 14438 - DNA, 16 bp, H. sapiens
aacttattattgaaga

SEQ ID NO: 14439 - DNA, 16 bp, H. sapiens
aacttatttaacttct

SEQ ID NO: 14440 - DNA, 16 bp, H. sapiens
aacttatttaatgaaa

SEQ ID NO: 14441 - DNA, 16 bp, H. sapiens
aacttattttaaaaca

SEQ ID NO: 14442 - DNA, 16 bp, H. sapiens
aacttatttttaattg

SEQ ID NO: 14443 - DNA, 16 bp, H. sapiens
aacttatttttagttt

SEQ ID NO: 14444 - DNA, 16 bp, H. sapiens
aacttcaaactatact

SEQ ID NO: 14445 - DNA, 16 bp, H. sapiens
aacttcaaagaccaaa

SEQ ID NO: 14446 - DNA, 16 bp, H. sapiens
aacttcaatcacatac

SEQ ID NO: 14447 - DNA, 16 bp, H. sapiens
aacttcacaaatggaa

SEQ ID NO: 14448 - DNA, 16 bp, H. sapiens
aacttcacaagtgttt

SEQ ID NO: 14449 - DNA, 16 bp, H. sapiens
aacttcacaattaaaa

SEQ ID NO: 14450 - DNA, 16 bp, H. sapiens
aacttcaccacagcct

SEQ ID NO: 14451 - DNA, 16 bp, H. sapiens
aacttcacctcccggg

SEQ ID NO: 14452 - DNA, 16 bp, H. sapiens
aacttcactttcttca

SEQ ID NO: 14453 - DNA, 16 bp, H. sapiens
aacttcagaacatttt

SEQ ID NO: 14454 - DNA, 17 bp, H. sapiens
aacttcagcaaaatctc

SEQ ID NO: 14455 - DNA, 23 bp, H. sapiens
aacttcagcaaagtctcaggaca

SEQ ID NO: 14456 - DNA, 16 bp, H. sapiens
aacttcaggaaataaa

SEQ ID NO: 14457 - DNA, 16 bp, H. sapiens
aacttcaggaaataca

SEQ ID NO: 14458 - DNA, 16 bp, H. sapiens
aacttcaggccaatgt

SEQ ID NO: 14459 - DNA, 16 bp, H. sapiens
aacttcagtttttcat

SEQ ID NO: 14460 - DNA, 16 bp, H. sapiens
aacttcataaagaaca

SEQ ID NO: 14461 - DNA, 16 bp, H. sapiens
aacttcatattgctga

SEQ ID NO: 14462 - DNA, 16 bp, H. sapiens
aacttcatcatcatca

SEQ ID NO: 14463 - DNA, 16 bp, H. sapiens
aacttcattatttctg

SEQ ID NO: 14464 - DNA, 16 bp, H. sapiens
aacttcattcattttt

SEQ ID NO: 14465 - DNA, 16 bp, H. sapiens
aacttcatttaacctt

SEQ ID NO: 14466 - DNA, 16 bp, H. sapiens
aacttcatttttaaaa

SEQ ID NO: 14467 - DNA, 16 bp, H. sapiens
aacttccaaaagaaaa

SEQ ID NO: 14468 - DNA, 16 bp, H. sapiens
aacttccagaaataaa

SEQ ID NO: 14469 - DNA, 16 bp, H. sapiens
aacttccagaactgtg

SEQ ID NO: 14470 - DNA, 16 bp, H. sapiens
aacttccatttataaa

SEQ ID NO: 14471 - DNA, 16 bp, H. sapiens
aacttcccagcctcca

SEQ ID NO: 14472 - DNA, 16 bp, H. sapiens
aacttcccagtggctt

SEQ ID NO: 14473 - DNA, 16 bp, H. sapiens
aacttccctgagactg

SEQ ID NO: 14474 - DNA, 16 bp, H. sapiens
aacttcctagagattt

SEQ ID NO: 14475 - DNA, 16 bp, H. sapiens
aacttcctgattttga

SEQ ID NO: 14476 - DNA, 17 bp, H. sapiens
aacttcgtctcaaaaaa

SEQ ID NO: 14477 - DNA, 16 bp, H. sapiens
aacttctaaaatcctt

SEQ ID NO: 14478 - DNA, 16 bp, H. sapiens
aacttctacaagaaaa

SEQ ID NO: 14479 - DNA, 16 bp, H. sapiens
aacttctagaaatgaa

SEQ ID NO: 14480 - DNA, 16 bp, H. sapiens
aacttctaggctcaag

SEQ ID NO: 14481 - DNA, 16 bp, H. sapiens
aacttctcaacaaaat

SEQ ID NO: 14482 - DNA, 16 bp, H. sapiens
aacttctcttctctct

SEQ ID NO: 14483 - DNA, 16 bp, H. sapiens
aacttctgacctcaag

SEQ ID NO: 14484 - DNA, 20 bp, H. sapiens
aacttctgacctcaggtgat

SEQ ID NO: 14485 - DNA, 16 bp, H. sapiens
aacttctgagctcaag

SEQ ID NO: 14486 - DNA, 16 bp, H. sapiens
aacttctgcctgccag

SEQ ID NO: 14487 - DNA, 16 bp, H. sapiens
aacttctgctctttga

SEQ ID NO: 14488 - DNA, 16 bp, H. sapiens
aacttctgcttcccag

SEQ ID NO: 14489 - DNA, 16 bp, H. sapiens
aacttctggcctcaag

SEQ ID NO: 14490 - DNA, 16 bp, H. sapiens
aacttctgggatcaag

SEQ ID NO: 14491 - DNA, 16 bp, H. sapiens
aacttctgggctcaag

SEQ ID NO: 14492 - DNA, 16 bp, H. sapiens
aacttctggtctcaag

SEQ ID NO: 14493 - DNA, 16 bp, H. sapiens
aacttctgttcctgtt

SEQ ID NO: 14494 - DNA, 16 bp, H. sapiens
aacttcttaattttaa

SEQ ID NO: 14495 - DNA, 16 bp, H. sapiens
aacttcttcaacctga

SEQ ID NO: 14496 - DNA, 16 bp, H. sapiens
aacttcttggaggctt

SEQ ID NO: 14497 - DNA, 16 bp, H. sapiens
aacttcttgtgagtct

SEQ ID NO: 14498 - DNA, 16 bp, H. sapiens
aacttctttcagaatt

SEQ ID NO: 14499 - DNA, 16 bp, H. sapiens
aacttctttgtcaatt

SEQ ID NO: 14500 - DNA, 16 bp, H. sapiens
aacttctttttcttca

SEQ ID NO: 14501 - DNA, 16 bp, H. sapiens
aacttgaaaattattt

SEQ ID NO: 14502 - DNA, 16 bp, H. sapiens
aacttgaaagaaaaat

SEQ ID NO: 14503 - DNA, 16 bp, H. sapiens
aacttgaaagagaaaa

SEQ ID NO: 14504 - DNA, 16 bp, H. sapiens
aacttgaacagatgaa

SEQ ID NO: 14505 - DNA, 16 bp, H. sapiens
aacttgaagataaatc

SEQ ID NO: 14506 - DNA, 16 bp, H. sapiens
aacttgaagtataata

SEQ ID NO: 14507 - DNA, 16 bp, H. sapiens
aacttgaatgtaaatg

SEQ ID NO: 14508 - DNA, 16 bp, H. sapiens
aacttgaatttcagat

SEQ ID NO: 14509 - DNA, 16 bp, H. sapiens
aacttgaattttatct

SEQ ID NO: 14510 - DNA, 16 bp, H. sapiens
aacttgaccaagatca

SEQ ID NO: 14511 - DNA, 16 bp, H. sapiens
aacttgagagagataa

SEQ ID NO: 14512 - DNA, 16 bp, H. sapiens
aacttgataaataact

SEQ ID NO: 14513 - DNA, 16 bp, H. sapiens
aacttgatgactatgt

SEQ ID NO: 14514 - DNA, 16 bp, H. sapiens
aacttgattttaaaaa

SEQ ID NO: 14515 - DNA, 16 bp, H. sapiens
aacttgattttaaaat

SEQ ID NO: 14516 - DNA, 16 bp, H. sapiens
aacttgatttttcttt

SEQ ID NO: 14517 - DNA, 16 bp, H. sapiens
aacttgcccaacatca

SEQ ID NO: 14518 - DNA, 16 bp, H. sapiens
aacttgcccaagatca

SEQ ID NO: 14519 - DNA, 16 bp, H. sapiens
aacttgcccaaggcca

SEQ ID NO: 14520 - DNA, 16 bp, H. sapiens
aacttgcccaaggtaa

SEQ ID NO: 14521 - DNA, 16 bp, H. sapiens
aacttgcccaaggtca

SEQ ID NO: 14522 - DNA, 16 bp, H. sapiens
aacttgctcaaggtca

SEQ ID NO: 14523 - DNA, 16 bp, H. sapiens
aacttgctcctaaatg

SEQ ID NO: 14524 - DNA, 16 bp, H. sapiens
aacttgctttggccaa

SEQ ID NO: 14525 - DNA, 16 bp, H. sapiens
aacttgcttttgcttt

SEQ ID NO: 14526 - DNA, 16 bp, H. sapiens
aacttggaagcaacca

SEQ ID NO: 14527 - DNA, 16 bp, H. sapiens
aacttggaagcagcca

SEQ ID NO: 14528 - DNA, 16 bp, H. sapiens
aacttggccttccaaa

SEQ ID NO: 14529 - DNA, 16 bp, H. sapiens
aacttggggagggcag

SEQ ID NO: 14530 - DNA, 16 bp, H. sapiens
aacttgggtaccagct

SEQ ID NO: 14531 - DNA, 16 bp, H. sapiens
aacttggtgaaaccct

SEQ ID NO: 14532 - DNA, 16 bp, H. sapiens
aacttggtgaatctga

SEQ ID NO: 14533 - DNA, 16 bp, H. sapiens
aacttggtgccctgca

SEQ ID NO: 14534 - DNA, 16 bp, H. sapiens
aacttggtgctgttgg

SEQ ID NO: 14535 - DNA, 16 bp, H. sapiens
aacttggttccattgt

SEQ ID NO: 14536 - DNA, 17 bp, H. sapiens
aacttggttgcattctc

SEQ ID NO: 14537 - DNA, 16 bp, H. sapiens
aacttgtcatttaaaa

SEQ ID NO: 14538 - DNA, 16 bp, H. sapiens
aacttgtccaaaatca

SEQ ID NO: 14539 - DNA, 16 bp, H. sapiens
aacttgtctgaggcca

SEQ ID NO: 14540 - DNA, 16 bp, H. sapiens
aacttgtgcaggaaaa

SEQ ID NO: 14541 - DNA, 16 bp, H. sapiens
aacttgtgcagggaaa

SEQ ID NO: 14542 - DNA, 16 bp, H. sapiens
aacttgttacacagca

SEQ ID NO: 14543 - DNA, 16 bp, H. sapiens
aacttgttacagcagc

SEQ ID NO: 14544 - DNA, 16 bp, H. sapiens
aacttgttagaaaagc

SEQ ID NO: 14545 - DNA, 16 bp, H. sapiens
aacttgttatgcagca

SEQ ID NO: 14546 - DNA, 16 bp, H. sapiens
aacttgttgggaactg

SEQ ID NO: 14547 - DNA, 16 bp, H. sapiens
aacttgttgttgttgt

SEQ ID NO: 14548 - DNA, 16 bp, H. sapiens
aacttgtttccattct

SEQ ID NO: 14549 - DNA, 16 bp, H. sapiens
aacttgttttatttat

SEQ ID NO: 14550 - DNA, 16 bp, H. sapiens
aacttgttttgaaata

SEQ ID NO: 14551 - DNA, 16 bp, H. sapiens
aacttgtttttcattt

SEQ ID NO: 14552 - DNA, 16 bp, H. sapiens
aacttgtttttctcat

SEQ ID NO: 14553 - DNA, 16 bp, H. sapiens
aactttaaaaaaagat

SEQ ID NO: 14554 - DNA, 16 bp, H. sapiens
aactttaaaaaatgta

SEQ ID NO: 14555 - DNA, 16 bp, H. sapiens
aactttaaaaagacaa

SEQ ID NO: 14556 - DNA, 16 bp, H. sapiens
aactttaaaaagcatt

SEQ ID NO: 14557 - DNA, 16 bp, H. sapiens
aactttaaaaatgtgt

SEQ ID NO: 14558 - DNA, 16 bp, H. sapiens
aactttaaaacaaaga

SEQ ID NO: 14559 - DNA, 16 bp, H. sapiens
aactttaaaacattta

SEQ ID NO: 14560 - DNA, 16 bp, H. sapiens
aactttaaaataaatg

SEQ ID NO: 14561 - DNA, 16 bp, H. sapiens
aactttaaaatagaaa

SEQ ID NO: 14562 - DNA, 16 bp, H. sapiens
aactttaaagaagttt

SEQ ID NO: 14563 - DNA, 16 bp, H. sapiens
aactttaaagttaaaa

SEQ ID NO: 14564 - DNA, 16 bp, H. sapiens
aactttaaagttgttt

SEQ ID NO: 14565 - DNA, 16 bp, H. sapiens
aactttaaatggaaat

SEQ ID NO: 14566 - DNA, 16 bp, H. sapiens
aactttaattttgttt

SEQ ID NO: 14567 - DNA, 16 bp, H. sapiens
aactttacaagaaact

SEQ ID NO: 14568 - DNA, 16 bp, H. sapiens
aactttagaagaaaat

SEQ ID NO: 14569 - DNA, 16 bp, H. sapiens
aactttagcagcaaag

SEQ ID NO: 14570 - DNA, 16 bp, H. sapiens
aactttaggatttttt

SEQ ID NO: 14571 - DNA, 16 bp, H. sapiens
aactttagtattttta

SEQ ID NO: 14572 - DNA, 17 bp, H. sapiens
aactttatttacaaaag

SEQ ID NO: 14573 - DNA, 16 bp, H. sapiens
aactttatttacaaag

SEQ ID NO: 14574 - DNA, 16 bp, H. sapiens
aactttattttctaaa

SEQ ID NO: 14575 - DNA, 16 bp, H. sapiens
aactttattttgaaat

SEQ ID NO: 14576 - DNA, 16 bp, H. sapiens
aactttatttttagtt

SEQ ID NO: 14577 - DNA, 16 bp, H. sapiens
aactttcagaagaaaa

SEQ ID NO: 14578 - DNA, 16 bp, H. sapiens
aactttcatcttttca

SEQ ID NO: 14579 - DNA, 16 bp, H. sapiens
aactttcattttaaaa

SEQ ID NO: 14580 - DNA, 16 bp, H. sapiens
aactttcattttagat

SEQ ID NO: 14581 - DNA, 16 bp, H. sapiens
aactttccaaacctag

SEQ ID NO: 14582 - DNA, 16 bp, H. sapiens
aactttccaaatattt

SEQ ID NO: 14583 - DNA, 16 bp, H. sapiens
aactttccatgctcat

SEQ ID NO: 14584 - DNA, 16 bp, H. sapiens
aactttccattttgtt

SEQ ID NO: 14585 - DNA, 16 bp, H. sapiens
aactttccctttgata

SEQ ID NO: 14586 - DNA, 16 bp, H. sapiens
aactttctaagaaact

SEQ ID NO: 14587 - DNA, 16 bp, H. sapiens
aactttctcatcatcc

SEQ ID NO: 14588 - DNA, 16 bp, H. sapiens
aactttctccaagaca

SEQ ID NO: 14589 - DNA, 16 bp, H. sapiens
aactttctgtagaggt

SEQ ID NO: 14590 - DNA, 16 bp, H. sapiens
aactttctgttgtttt

SEQ ID NO: 14591 - DNA, 16 bp, H. sapiens
aactttcttaaaaaat

SEQ ID NO: 14592 - DNA, 16 bp, H. sapiens
aactttctttcaaaaa

SEQ ID NO: 14593 - DNA, 16 bp, H. sapiens
aactttgaaaaaaata

SEQ ID NO: 14594 - DNA, 16 bp, H. sapiens
aactttgaaaaacatt

SEQ ID NO: 14595 - DNA, 16 bp, H. sapiens
aactttgaaaaatatt

SEQ ID NO: 14596 - DNA, 16 bp, H. sapiens
aactttgaaaataaaa

SEQ ID NO: 14597 - DNA, 16 bp, H. sapiens
aactttgaaaatatat

SEQ ID NO: 14598 - DNA, 16 bp, H. sapiens
aactttgaaacaaaaa

SEQ ID NO: 14599 - DNA, 16 bp, H. sapiens
aactttgaaacaacca

SEQ ID NO: 14600 - DNA, 16 bp, H. sapiens
aactttgaacttgaga

SEQ ID NO: 14601 - DNA, 16 bp, H. sapiens
aactttgaagaggaaa

SEQ ID NO: 14602 - DNA, 16 bp, H. sapiens
aactttgatgaaataa

SEQ ID NO: 14603 - DNA, 16 bp, H. sapiens
aactttgcatgttctt

SEQ ID NO: 14604 - DNA, 16 bp, H. sapiens
aactttgcctcccagg

SEQ ID NO: 14605 - DNA, 16 bp, H. sapiens
aactttgctctgaaat

SEQ ID NO: 14606 - DNA, 16 bp, H. sapiens
aactttggaggcagaa

SEQ ID NO: 14607 - DNA, 18 bp, H. sapiens
aactttgggaggccaagg

SEQ ID NO: 14608 - DNA, 19 bp, H. sapiens
aactttgggaggctgaggc

SEQ ID NO: 14609 - DNA, 16 bp, H. sapiens
aactttgggcaagtta

SEQ ID NO: 14610 - DNA, 16 bp, H. sapiens
aactttggggaaaaaa

SEQ ID NO: 14611 - DNA, 16 bp, H. sapiens
aactttggtctccaca

SEQ ID NO: 14612 - DNA, 16 bp, H. sapiens
aactttgtaacttcac

SEQ ID NO: 14613 - DNA, 16 bp, H. sapiens
aactttgtaataattt

SEQ ID NO: 14614 - DNA, 16 bp, H. sapiens
aactttgtaatatttt

SEQ ID NO: 14615 - DNA, 16 bp, H. sapiens
aactttgtaattttga

SEQ ID NO: 14616 - DNA, 16 bp, H. sapiens
aactttgtactctttg

SEQ ID NO: 14617 - DNA, 16 bp, H. sapiens
aactttgttctctggc

SEQ ID NO: 14618 - DNA, 16 bp, H. sapiens
aactttgttcttattt

SEQ ID NO: 14619 - DNA, 16 bp, H. sapiens
aactttgttctttttg

SEQ ID NO: 14620 - DNA, 16 bp, H. sapiens
aactttgtttccttct

SEQ ID NO: 14621 - DNA, 16 bp, H. sapiens
aactttgttttatgca

SEQ ID NO: 14622 - DNA, 16 bp, H. sapiens
aacttttaaaactttt

SEQ ID NO: 14623 - DNA, 16 bp, H. sapiens
aacttttaaaatactt

SEQ ID NO: 14624 - DNA, 16 bp, H. sapiens
aacttttagaaaaaaa

SEQ ID NO: 14625 - DNA, 16 bp, H. sapiens
aacttttagaaaaaga

SEQ ID NO: 14626 - DNA, 16 bp, H. sapiens
aacttttagaaaaata

SEQ ID NO: 14627 - DNA, 16 bp, H. sapiens
aacttttagaaataaa

SEQ ID NO: 14628 - DNA, 16 bp, H. sapiens
aacttttagttttgtt

SEQ ID NO: 14629 - DNA, 16 bp, H. sapiens
aacttttatttatcaa

SEQ ID NO: 14630 - DNA, 16 bp, H. sapiens
aacttttatttgtcaa

SEQ ID NO: 14631 - DNA, 16 bp, H. sapiens
aacttttattttcagt

SEQ ID NO: 14632 - DNA, 16 bp, H. sapiens
aacttttattttggaa

SEQ ID NO: 14633 - DNA, 16 bp, H. sapiens
aacttttcaaaattaa

SEQ ID NO: 14634 - DNA, 16 bp, H. sapiens
aacttttcaaactttt

SEQ ID NO: 14635 - DNA, 16 bp, H. sapiens
aacttttcagctccat

SEQ ID NO: 14636 - DNA, 16 bp, H. sapiens
aacttttcagtggaaa

SEQ ID NO: 14637 - DNA, 16 bp, H. sapiens
aacttttcatatttct

SEQ ID NO: 14638 - DNA, 16 bp, H. sapiens
aacttttcatgttttt

SEQ ID NO: 14639 - DNA, 16 bp, H. sapiens
aacttttccaaacaat

SEQ ID NO: 14640 - DNA, 16 bp, H. sapiens
aacttttccaaagtca

SEQ ID NO: 14641 - DNA, 16 bp, H. sapiens
aacttttccacatctt

SEQ ID NO: 14642 - DNA, 16 bp, H. sapiens
aacttttccagtgact

SEQ ID NO: 14643 - DNA, 16 bp, H. sapiens
aacttttctaataaaa

SEQ ID NO: 14644 - DNA, 16 bp, H. sapiens
aacttttctctgaatt

SEQ ID NO: 14645 - DNA, 16 bp, H. sapiens
aacttttctgtatttt

SEQ ID NO: 14646 - DNA, 19 bp, H. sapiens
aacttttctgtcttacaag

SEQ ID NO: 14647 - DNA, 16 bp, H. sapiens
aacttttgactcccct

SEQ ID NO: 14648 - DNA, 16 bp, H. sapiens
aacttttgactcctca

SEQ ID NO: 14649 - DNA, 16 bp, H. sapiens
aacttttgactctttt

SEQ ID NO: 14650 - DNA, 16 bp, H. sapiens
aacttttgcagtttga

SEQ ID NO: 14651 - DNA, 16 bp, H. sapiens
aacttttgctcatttt

SEQ ID NO: 14652 - DNA, 16 bp, H. sapiens
aacttttgctccaaga

SEQ ID NO: 14653 - DNA, 16 bp, H. sapiens
aactttttaaaaaact

SEQ ID NO: 14654 - DNA, 16 bp, H. sapiens
aactttttaaaaaaga

SEQ ID NO: 14655 - DNA, 16 bp, H. sapiens
aactttttaaaaacca

SEQ ID NO: 14656 - DNA, 16 bp, H. sapiens
aactttttaaaaactt

SEQ ID NO: 14657 - DNA, 16 bp, H. sapiens
aactttttaaaaagga

SEQ ID NO: 14658 - DNA, 16 bp, H. sapiens
aactttttaaaagcca

SEQ ID NO: 14659 - DNA, 16 bp, H. sapiens
aactttttaaataaag

SEQ ID NO: 14660 - DNA, 16 bp, H. sapiens
aactttttaagaagct

SEQ ID NO: 14661 - DNA, 16 bp, H. sapiens
aactttttaatgtatt

SEQ ID NO: 14662 - DNA, 16 bp, H. sapiens
aactttttattggaaa

SEQ ID NO: 14663 - DNA, 16 bp, H. sapiens
aactttttatttagaa

SEQ ID NO: 14664 - DNA, 16 bp, H. sapiens
aactttttatttctcc

SEQ ID NO: 14665 - DNA, 16 bp, H. sapiens
aactttttcaaaaatt

SEQ ID NO: 14666 - DNA, 16 bp, H. sapiens
aactttttgaaaaaat

SEQ ID NO: 14667 - DNA, 16 bp, H. sapiens
aactttttgcagggaa

SEQ ID NO: 14668 - DNA, 16 bp, H. sapiens
aactttttggttaaaa

SEQ ID NO: 14669 - DNA, 16 bp, H. sapiens
aactttttgtgtaaat

SEQ ID NO: 14670 - DNA, 16 bp, H. sapiens
aacttttttaaaaaga

SEQ ID NO: 14671 - DNA, 16 bp, H. sapiens
aacttttttcaaaatt

SEQ ID NO: 14672 - DNA, 16 bp, H. sapiens
aactttttttaaaaag

SEQ ID NO: 14673 - DNA, 16 bp, H. sapiens
aactttttttaagttt

SEQ ID NO: 14674 - DNA, 16 bp, H. sapiens
aactttttttgggggg

SEQ ID NO: 14675 - DNA, 16 bp, H. sapiens
aacttttttttaatgt

SEQ ID NO: 14676 - DNA, 16 bp, H. sapiens
aacttttttttagaga

SEQ ID NO: 14677 - DNA, 16 bp, H. sapiens
aactttttttttaaag

SEQ ID NO: 14678 - DNA, 16 bp, H. sapiens
aactttttttttaagt

SEQ ID NO: 14679 - DNA, 16 bp, H. sapiens
aagaaaaaaaactgtt

SEQ ID NO: 14680 - DNA, 16 bp, H. sapiens
aagaaaaaaaagctgg

SEQ ID NO: 14681 - DNA, 16 bp, H. sapiens
aagaaaaaaaaggctg

SEQ ID NO: 14682 - DNA, 16 bp, H. sapiens
aagaaaaaaaaggctt

SEQ ID NO: 14683 - DNA, 16 bp, H. sapiens
aagaaaaaaaatcttt

SEQ ID NO: 14684 - DNA, 16 bp, H. sapiens
aagaaaaaaaattcct

SEQ ID NO: 14685 - DNA, 16 bp, H. sapiens
aagaaaaaaagatctc

SEQ ID NO: 14686 - DNA, 16 bp, H. sapiens
aagaaaaaaagtctgt

SEQ ID NO: 14687 - DNA, 16 bp, H. sapiens
aagaaaaaaatctgtt

SEQ ID NO: 14688 - DNA, 16 bp, H. sapiens
aagaaaaaaatcttca

SEQ ID NO: 14689 - DNA, 16 bp, H. sapiens
aagaaaaaaatgcttt

SEQ ID NO: 14690 - DNA, 16 bp, H. sapiens
aagaaaaaaatgtcat

SEQ ID NO: 14691 - DNA, 16 bp, H. sapiens
aagaaaaaaatgtctt

SEQ ID NO: 14692 - DNA, 16 bp, H. sapiens
aagaaaaaacaatttg

SEQ ID NO: 14693 - DNA, 16 bp, H. sapiens
aagaaaaaacacattt

SEQ ID NO: 14694 - DNA, 16 bp, H. sapiens
aagaaaaaacattttt

SEQ ID NO: 14695 - DNA, 16 bp, H. sapiens
aagaaaaaagaactct

SEQ ID NO: 14696 - DNA, 16 bp, H. sapiens
aagaaaaaagaaggct

SEQ ID NO: 14697 - DNA, 16 bp, H. sapiens
aagaaaaaagctcaga

SEQ ID NO: 14698 - DNA, 16 bp, H. sapiens
aagaaaaaagtgtctt

SEQ ID NO: 14699 - DNA, 16 bp, H. sapiens
aagaaaaaagttttca

SEQ ID NO: 14700 - DNA, 16 bp, H. sapiens
aagaaaaaatactgca

SEQ ID NO: 14701 - DNA, 16 bp, H. sapiens
aagaaaaaatcatttt

SEQ ID NO: 14702 - DNA, 16 bp, H. sapiens
aagaaaaaatctgaat

SEQ ID NO: 14703 - DNA, 16 bp, H. sapiens
aagaaaaaatcttcaa

SEQ ID NO: 14704 - DNA, 16 bp, H. sapiens
aagaaaaaatgctcat

SEQ ID NO: 14705 - DNA, 16 bp, H. sapiens
aagaaaaaattagtca

SEQ ID NO: 14706 - DNA, 16 bp, H. sapiens
aagaaaaaattagttg

SEQ ID NO: 14707 - DNA, 16 bp, H. sapiens
aagaaaaaattccatt

SEQ ID NO: 14708 - DNA, 16 bp, H. sapiens
aagaaaaaattttcaa

SEQ ID NO: 14709 - DNA, 16 bp, H. sapiens
aagaaaaacaaattct

SEQ ID NO: 14710 - DNA, 16 bp, H. sapiens
aagaaaaacacatttt

SEQ ID NO: 14711 - DNA, 16 bp, H. sapiens
aagaaaaacactgaat

SEQ ID NO: 14712 - DNA, 16 bp, H. sapiens
aagaaaaacagcttta

SEQ ID NO: 14713 - DNA, 16 bp, H. sapiens
aagaaaaacataattt

SEQ ID NO: 14714 - DNA, 16 bp, H. sapiens
aagaaaaacatgtctt

SEQ ID NO: 14715 - DNA, 16 bp, H. sapiens
aagaaaaacattgttt

SEQ ID NO: 14716 - DNA, 16 bp, H. sapiens
aagaaaaacattttaa

SEQ ID NO: 14717 - DNA, 16 bp, H. sapiens
aagaaaaacccatttt

SEQ ID NO: 14718 - DNA, 16 bp, H. sapiens
aagaaaaacttatttt

SEQ ID NO: 14719 - DNA, 16 bp, H. sapiens
aagaaaaacttccaaa

SEQ ID NO: 14720 - DNA, 16 bp, H. sapiens
aagaaaaacttctaaa

SEQ ID NO: 14721 - DNA, 16 bp, H. sapiens
aagaaaaactttattt

SEQ ID NO: 14722 - DNA, 16 bp, H. sapiens
aagaaaaactttgaaa

SEQ ID NO: 14723 - DNA, 16 bp, H. sapiens
aagaaaaacttttttt

SEQ ID NO: 14724 - DNA, 16 bp, H. sapiens
aagaaaaagaaatctt

SEQ ID NO: 14725 - DNA, 16 bp, H. sapiens
aagaaaaagaaattct

SEQ ID NO: 14726 - DNA, 16 bp, H. sapiens
aagaaaaagaaatttc

SEQ ID NO: 14727 - DNA, 16 bp, H. sapiens
aagaaaaagaagactt

SEQ ID NO: 14728 - DNA, 16 bp, H. sapiens
aagaaaaagaagtcat

SEQ ID NO: 14729 - DNA, 16 bp, H. sapiens
aagaaaaagaatttca

SEQ ID NO: 14730 - DNA, 16 bp, H. sapiens
aagaaaaagaggttta

SEQ ID NO: 14731 - DNA, 16 bp, H. sapiens
aagaaaaagaggtttc

SEQ ID NO: 14732 - DNA, 16 bp, H. sapiens
aagaaaaaggtgctgt

SEQ ID NO: 14733 - DNA, 16 bp, H. sapiens
aagaaaaagtgttttt

SEQ ID NO: 14734 - DNA, 16 bp, H. sapiens
aagaaaaagttgacaa

SEQ ID NO: 14735 - DNA, 16 bp, H. sapiens
aagaaaaataatctta

SEQ ID NO: 14736 - DNA, 16 bp, H. sapiens
aagaaaaataatcttt

SEQ ID NO: 14737 - DNA, 16 bp, H. sapiens
aagaaaaataattctg

SEQ ID NO: 14738 - DNA, 16 bp, H. sapiens
aagaaaaataattgtc

SEQ ID NO: 14739 - DNA, 16 bp, H. sapiens
aagaaaaatacatttt

SEQ ID NO: 14740 - DNA, 16 bp, H. sapiens
aagaaaaatactattt

SEQ ID NO: 14741 - DNA, 16 bp, H. sapiens
aagaaaaatagctcag

SEQ ID NO: 14742 - DNA, 16 bp, H. sapiens
aagaaaaatatcagga

SEQ ID NO: 14743 - DNA, 16 bp, H. sapiens
aagaaaaatattctga

SEQ ID NO: 14744 - DNA, 16 bp, H. sapiens
aagaaaaatcacttga

SEQ ID NO: 14745 - DNA, 16 bp, H. sapiens
aagaaaaatcagttta

SEQ ID NO: 14746 - DNA, 16 bp, H. sapiens
aagaaaaatcatgtga

SEQ ID NO: 14747 - DNA, 16 bp, H. sapiens
aagaaaaatcatgttt

SEQ ID NO: 14748 - DNA, 16 bp, H. sapiens
aagaaaaatcatttca

SEQ ID NO: 14749 - DNA, 16 bp, H. sapiens
aagaaaaatctcaaat

SEQ ID NO: 14750 - DNA, 16 bp, H. sapiens
aagaaaaatgaagcca

SEQ ID NO: 14751 - DNA, 16 bp, H. sapiens
aagaaaaatgaggttt

SEQ ID NO: 14752 - DNA, 16 bp, H. sapiens
aagaaaaatgatacag

SEQ ID NO: 14753 - DNA, 16 bp, H. sapiens
aagaaaaatgcaaagt

SEQ ID NO: 14754 - DNA, 16 bp, H. sapiens
aagaaaaatgtacatt

SEQ ID NO: 14755 - DNA, 16 bp, H. sapiens
aagaaaaatgtgtgtt

SEQ ID NO: 14756 - DNA, 16 bp, H. sapiens
aagaaaaatgtgttta

SEQ ID NO: 14757 - DNA, 16 bp, H. sapiens
aagaaaaatgtttatt

SEQ ID NO: 14758 - DNA, 16 bp, H. sapiens
aagaaaaatgtttgag

SEQ ID NO: 14759 - DNA, 16 bp, H. sapiens
aagaaaaattatatca

SEQ ID NO: 14760 - DNA, 16 bp, H. sapiens
aagaaaaattatttgt

SEQ ID NO: 14761 - DNA, 16 bp, H. sapiens
aagaaaaattcagagc

SEQ ID NO: 14762 - DNA, 16 bp, H. sapiens
aagaaaaattcctctg

SEQ ID NO: 14763 - DNA, 16 bp, H. sapiens
aagaaaaattgttctg

SEQ ID NO: 14764 - DNA, 16 bp, H. sapiens
aagaaaaatttccaaa

SEQ ID NO: 14765 - DNA, 16 bp, H. sapiens
aagaaaaatttgtttt

SEQ ID NO: 14766 - DNA, 16 bp, H. sapiens
aagaaaacaaaactct

SEQ ID NO: 14767 - DNA, 16 bp, H. sapiens
aagaaaacaaaatttt

SEQ ID NO: 14768 - DNA, 16 bp, H. sapiens
aagaaaacaaaggagt

SEQ ID NO: 14769 - DNA, 16 bp, H. sapiens
aagaaaacaaagtatc

SEQ ID NO: 14770 - DNA, 16 bp, H. sapiens
aagaaaacaaatttct

SEQ ID NO: 14771 - DNA, 16 bp, H. sapiens
aagaaaacactatttt

SEQ ID NO: 14772 - DNA, 16 bp, H. sapiens
aagaaaacactgataa

SEQ ID NO: 14773 - DNA, 16 bp, H. sapiens
aagaaaacactttttt

SEQ ID NO: 14774 - DNA, 16 bp, H. sapiens
aagaaaacagaaatgg

SEQ ID NO: 14775 - DNA, 16 bp, H. sapiens
aagaaaacagaatatt

SEQ ID NO: 14776 - DNA, 16 bp, H. sapiens
aagaaaacagaggctc

SEQ ID NO: 14777 - DNA, 16 bp, H. sapiens
aagaaaacaggaagat

SEQ ID NO: 14778 - DNA, 16 bp, H. sapiens
aagaaaacagggacct

SEQ ID NO: 14779 - DNA, 16 bp, H. sapiens
aagaaaacagttttaa

SEQ ID NO: 14780 - DNA, 16 bp, H. sapiens
aagaaaacatatgaat

SEQ ID NO: 14781 - DNA, 16 bp, H. sapiens
aagaaaacatattcaa

SEQ ID NO: 14782 - DNA, 16 bp, H. sapiens
aagaaaacatgaatat

SEQ ID NO: 14783 - DNA, 16 bp, H. sapiens
aagaaaacatgatttt

SEQ ID NO: 14784 - DNA, 16 bp, H. sapiens
aagaaaacatggaaga

SEQ ID NO: 14785 - DNA, 16 bp, H. sapiens
aagaaaacatgggcaa

SEQ ID NO: 14786 - DNA, 16 bp, H. sapiens
aagaaaacatgttaaa

SEQ ID NO: 14787 - DNA, 16 bp, H. sapiens
aagaaaacattcaata

SEQ ID NO: 14788 - DNA, 16 bp, H. sapiens
aagaaaacattcagaa

SEQ ID NO: 14789 - DNA, 16 bp, H. sapiens
aagaaaacattgcaaa

SEQ ID NO: 14790 - DNA, 16 bp, H. sapiens
aagaaaacatttacaa

SEQ ID NO: 14791 - DNA, 16 bp, H. sapiens
aagaaaacatttcaag

SEQ ID NO: 14792 - DNA, 16 bp, H. sapiens
aagaaaacatttgaag

SEQ ID NO: 14793 - DNA, 16 bp, H. sapiens
aagaaaacctaggaaa

SEQ ID NO: 14794 - DNA, 16 bp, H. sapiens
aagaaaaccttggaaa

SEQ ID NO: 14795 - DNA, 48 bp, H. sapiens
aagaaaacgtggcacatatacaccatggaatactatgcagccataaaa

SEQ ID NO: 14796 - DNA, 16 bp, H. sapiens
aagaaaactacagatc

SEQ ID NO: 14797 - DNA, 16 bp, H. sapiens
aagaaaactacatttt

SEQ ID NO: 14798 - DNA, 16 bp, H. sapiens
aagaaaactatttaaa

SEQ ID NO: 14799 - DNA, 16 bp, H. sapiens
aagaaaactgaaatta

SEQ ID NO: 14800 - DNA, 16 bp, H. sapiens
aagaaaactgaagcaa

SEQ ID NO: 14801 - DNA, 16 bp, H. sapiens
aagaaaactggaaaca

SEQ ID NO: 14802 - DNA, 16 bp, H. sapiens
aagaaaactggaggaa

SEQ ID NO: 14803 - DNA, 16 bp, H. sapiens
aagaaaactggagtgg

SEQ ID NO: 14804 - DNA, 16 bp, H. sapiens
aagaaaactgggaaat

SEQ ID NO: 14805 - DNA, 16 bp, H. sapiens
aagaaaactgtaaaac

SEQ ID NO: 14806 - DNA, 16 bp, H. sapiens
aagaaaactgtgtttc

SEQ ID NO: 14807 - DNA, 16 bp, H. sapiens
aagaaaacttcaggct

SEQ ID NO: 14808 - DNA, 16 bp, H. sapiens
aagaaaacttggaaaa

SEQ ID NO: 14809 - DNA, 16 bp, H. sapiens
aagaaaacttgttttt

SEQ ID NO: 14810 - DNA, 16 bp, H. sapiens
aagaaaactttgaaga

SEQ ID NO: 14811 - DNA, 16 bp, H. sapiens
aagaaaacttttctga

SEQ ID NO: 14812 - DNA, 16 bp, H. sapiens
aagaaaacttttgaaa

SEQ ID NO: 14813 - DNA, 16 bp, H. sapiens
aagaaaagaaaacctt

SEQ ID NO: 14814 - DNA, 16 bp, H. sapiens
aagaaaagaaaagctg

SEQ ID NO: 14815 - DNA, 16 bp, H. sapiens
aagaaaagaaaatggc

SEQ ID NO: 14816 - DNA, 16 bp, H. sapiens
aagaaaagaaacacct

SEQ ID NO: 14817 - DNA, 16 bp, H. sapiens
aagaaaagaaacactg

SEQ ID NO: 14818 - DNA, 16 bp, H. sapiens
aagaaaagaaacagct

SEQ ID NO: 14819 - DNA, 16 bp, H. sapiens
aagaaaagaaactttg

SEQ ID NO: 14820 - DNA, 16 bp, H. sapiens
aagaaaagaaagcatt

SEQ ID NO: 14821 - DNA, 16 bp, H. sapiens
aagaaaagaaagcttt

SEQ ID NO: 14822 - DNA, 16 bp, H. sapiens
aagaaaagaaagtcca

SEQ ID NO: 14823 - DNA, 16 bp, H. sapiens
aagaaaagaaagtctt

SEQ ID NO: 14824 - DNA, 16 bp, H. sapiens
aagaaaagaaatctgt

SEQ ID NO: 14825 - DNA, 16 bp, H. sapiens
aagaaaagaaatggca

SEQ ID NO: 14826 - DNA, 16 bp, H. sapiens
aagaaaagaaatgtct

SEQ ID NO: 14827 - DNA, 16 bp, H. sapiens
aagaaaagaactgcca

SEQ ID NO: 14828 - DNA, 16 bp, H. sapiens
aagaaaagaagaagtc

SEQ ID NO: 14829 - DNA, 16 bp, H. sapiens
aagaaaagaatttcca

SEQ ID NO: 14830 - DNA, 16 bp, H. sapiens
aagaaaagaatttcta

SEQ ID NO: 14831 - DNA, 16 bp, H. sapiens
aagaaaagaggttcag

SEQ ID NO: 14832 - DNA, 16 bp, H. sapiens
aagaaaagatttttca

SEQ ID NO: 14833 - DNA, 16 bp, H. sapiens
aagaaaagcaattttt

SEQ ID NO: 14834 - DNA, 16 bp, H. sapiens
aagaaaagcatttaaa

SEQ ID NO: 14835 - DNA, 16 bp, H. sapiens
aagaaaagcatttaat

SEQ ID NO: 14836 - DNA, 16 bp, H. sapiens
aagaaaagcattttca

SEQ ID NO: 14837 - DNA, 16 bp, H. sapiens
aagaaaagcccatttt

SEQ ID NO: 14838 - DNA, 16 bp, H. sapiens
aagaaaagctgaggaa

SEQ ID NO: 14839 - DNA, 16 bp, H. sapiens
aagaaaaggaaacttt

SEQ ID NO: 14840 - DNA, 16 bp, H. sapiens
aagaaaaggaaatcct

SEQ ID NO: 14841 - DNA, 16 bp, H. sapiens
aagaaaaggattttca

SEQ ID NO: 14842 - DNA, 16 bp, H. sapiens
aagaaaaggctgaaaa

SEQ ID NO: 14843 - DNA, 16 bp, H. sapiens
aagaaaaggggctttg

SEQ ID NO: 14844 - DNA, 16 bp, H. sapiens
aagaaaagtaaaagct

SEQ ID NO: 14845 - DNA, 16 bp, H. sapiens
aagaaaagtaactttg

SEQ ID NO: 14846 - DNA, 16 bp, H. sapiens
aagaaaagtaattttt

SEQ ID NO: 14847 - DNA, 16 bp, H. sapiens
aagaaaagtattttta

SEQ ID NO: 14848 - DNA, 16 bp, H. sapiens
aagaaaagtcagagaa

SEQ ID NO: 14849 - DNA, 16 bp, H. sapiens
aagaaaagtctgaaaa

SEQ ID NO: 14850 - DNA, 16 bp, H. sapiens
aagaaaagtgacattt

SEQ ID NO: 14851 - DNA, 16 bp, H. sapiens
aagaaaagtggtttaa

SEQ ID NO: 14852 - DNA, 16 bp, H. sapiens
aagaaaagttcttaaa

SEQ ID NO: 14853 - DNA, 16 bp, H. sapiens
aagaaaagtttagaga

SEQ ID NO: 14854 - DNA, 16 bp, H. sapiens
aagaaaagtttatttc

SEQ ID NO: 14855 - DNA, 16 bp, H. sapiens
aagaaaataaagcatg

SEQ ID NO: 14856 - DNA, 16 bp, H. sapiens
aagaaaataaatgtca

SEQ ID NO: 14857 - DNA, 16 bp, H. sapiens
aagaaaataaattctt

SEQ ID NO: 14858 - DNA, 16 bp, H. sapiens
aagaaaataacattct

SEQ ID NO: 14859 - DNA, 16 bp, H. sapiens
aagaaaataattctaa

SEQ ID NO: 14860 - DNA, 16 bp, H. sapiens
aagaaaataatttctg

SEQ ID NO: 14861 - DNA, 16 bp, H. sapiens
aagaaaataattttca

SEQ ID NO: 14862 - DNA, 16 bp, H. sapiens
aagaaaatacaaattt

SEQ ID NO: 14863 - DNA, 16 bp, H. sapiens
aagaaaatacacagat

SEQ ID NO: 14864 - DNA, 16 bp, H. sapiens
aagaaaatacagcaga

SEQ ID NO: 14865 - DNA, 16 bp, H. sapiens
aagaaaatacagtttt

SEQ ID NO: 14866 - DNA, 16 bp, H. sapiens
aagaaaatacatttgt

SEQ ID NO: 14867 - DNA, 16 bp, H. sapiens
aagaaaatacttcttt

SEQ ID NO: 14868 - DNA, 16 bp, H. sapiens
aagaaaatacttgcaa

SEQ ID NO: 14869 - DNA, 16 bp, H. sapiens
aagaaaatactttgaa

SEQ ID NO: 14870 - DNA, 16 bp, H. sapiens
aagaaaatacttttct

SEQ ID NO: 14871 - DNA, 16 bp, H. sapiens
aagaaaatagcatttt

SEQ ID NO: 14872 - DNA, 16 bp, H. sapiens
aagaaaatatcaacag

SEQ ID NO: 14873 - DNA, 16 bp, H. sapiens
aagaaaatatcacaat

SEQ ID NO: 14874 - DNA, 16 bp, H. sapiens
aagaaaatatccagaa

SEQ ID NO: 14875 - DNA, 16 bp, H. sapiens
aagaaaatatcttcat

SEQ ID NO: 14876 - DNA, 16 bp, H. sapiens
aagaaaatatctttat

SEQ ID NO: 14877 - DNA, 16 bp, H. sapiens
aagaaaatatgcaaat

SEQ ID NO: 14878 - DNA, 16 bp, H. sapiens
aagaaaatatgtttct

SEQ ID NO: 14879 - DNA, 16 bp, H. sapiens
aagaaaatattcatat

SEQ ID NO: 14880 - DNA, 16 bp, H. sapiens
aagaaaatattcttca

SEQ ID NO: 14881 - DNA, 16 bp, H. sapiens
aagaaaatattctttc

SEQ ID NO: 14882 - DNA, 16 bp, H. sapiens
aagaaaatattgtgaa

SEQ ID NO: 14883 - DNA, 16 bp, H. sapiens
aagaaaatatttcaga

SEQ ID NO: 14884 - DNA, 16 bp, H. sapiens
aagaaaatatttctta

SEQ ID NO: 14885 - DNA, 16 bp, H. sapiens
aagaaaatatttgcaa

SEQ ID NO: 14886 - DNA, 16 bp, H. sapiens
aagaaaatatttggaa

SEQ ID NO: 14887 - DNA, 16 bp, H. sapiens
aagaaaatattttcaa

SEQ ID NO: 14888 - DNA, 16 bp, H. sapiens
aagaaaatatttttct

SEQ ID NO: 14889 - DNA, 16 bp, H. sapiens
aagaaaatcacttgaa

SEQ ID NO: 14890 - DNA, 16 bp, H. sapiens
aagaaaatcagagagg

SEQ ID NO: 14891 - DNA, 16 bp, H. sapiens
aagaaaatcatttttt

SEQ ID NO: 14892 - DNA, 16 bp, H. sapiens
aagaaaatccagcctc

SEQ ID NO: 14893 - DNA, 16 bp, H. sapiens
aagaaaatctatgtat

SEQ ID NO: 14894 - DNA, 16 bp, H. sapiens
aagaaaatctgtattt

SEQ ID NO: 14895 - DNA, 16 bp, H. sapiens
aagaaaatcttaaaac

SEQ ID NO: 14896 - DNA, 16 bp, H. sapiens
aagaaaatcttattta

SEQ ID NO: 14897 - DNA, 16 bp, H. sapiens
aagaaaatcttatttt

SEQ ID NO: 14898 - DNA, 16 bp, H. sapiens
aagaaaatcttctaaa

SEQ ID NO: 14899 - DNA, 16 bp, H. sapiens
aagaaaatcttggcca

SEQ ID NO: 14900 - DNA, 16 bp, H. sapiens
aagaaaatctttattt

SEQ ID NO: 14901 - DNA, 16 bp, H. sapiens
aagaaaatgaaaacct

SEQ ID NO: 14902 - DNA, 16 bp, H. sapiens
aagaaaatgaaagttt

SEQ ID NO: 14903 - DNA, 16 bp, H. sapiens
aagaaaatgaaatcag

SEQ ID NO: 14904 - DNA, 16 bp, H. sapiens
aagaaaatgaaatgca

SEQ ID NO: 14905 - DNA, 16 bp, H. sapiens
aagaaaatgaaatttg

SEQ ID NO: 14906 - DNA, 16 bp, H. sapiens
aagaaaatgaagacag

SEQ ID NO: 14907 - DNA, 16 bp, H. sapiens
aagaaaatgaaggcag

SEQ ID NO: 14908 - DNA, 16 bp, H. sapiens
aagaaaatgaataggc

SEQ ID NO: 14909 - DNA, 16 bp, H. sapiens
aagaaaatgaattcag

SEQ ID NO: 14910 - DNA, 16 bp, H. sapiens
aagaaaatgaattttt

SEQ ID NO: 14911 - DNA, 16 bp, H. sapiens
aagaaaatgacttttt

SEQ ID NO: 14912 - DNA, 16 bp, H. sapiens
aagaaaatgagttttt

SEQ ID NO: 14913 - DNA, 16 bp, H. sapiens
aagaaaatgatatttt

SEQ ID NO: 14914 - DNA, 16 bp, H. sapiens
aagaaaatgatgagct

SEQ ID NO: 14915 - DNA, 16 bp, H. sapiens
aagaaaatgatgtata

SEQ ID NO: 14916 - DNA, 16 bp, H. sapiens
aagaaaatgatgttaa

SEQ ID NO: 14917 - DNA, 16 bp, H. sapiens
aagaaaatgattgctt

SEQ ID NO: 14918 - DNA, 16 bp, H. sapiens
aagaaaatgattttat

SEQ ID NO: 14919 - DNA, 16 bp, H. sapiens
aagaaaatgcagagaa

SEQ ID NO: 14920 - DNA, 16 bp, H. sapiens
aagaaaatgcagtttt

SEQ ID NO: 14921 - DNA, 16 bp, H. sapiens
aagaaaatgctaaata

SEQ ID NO: 14922 - DNA, 16 bp, H. sapiens
aagaaaatgctgaaaa

SEQ ID NO: 14923 - DNA, 16 bp, H. sapiens
aagaaaatggaaaact

SEQ ID NO: 14924 - DNA, 16 bp, H. sapiens
aagaaaatgtacaatt

SEQ ID NO: 14925 - DNA, 16 bp, H. sapiens
aagaaaatgtatgtaa

SEQ ID NO: 14926 - DNA, 16 bp, H. sapiens
aagaaaatgtcaaact

SEQ ID NO: 14927 - DNA, 16 bp, H. sapiens
aagaaaatgtcatttt

SEQ ID NO: 14928 - DNA, 16 bp, H. sapiens
aagaaaatgtgataca

SEQ ID NO: 14929 - DNA, 16 bp, H. sapiens
aagaaaatgtggaaca

SEQ ID NO: 14930 - DNA, 49 bp, H. sapiens
aagaaaatgtggcacatatacaccatggaatactatgcagccataaaaa

SEQ ID NO: 14931 - DNA, 18 bp, H. sapiens
aagaaaatgtggcacatg

SEQ ID NO: 14932 - DNA, 16 bp, H. sapiens
aagaaaatgtggcatt

SEQ ID NO: 14933 - DNA, 16 bp, H. sapiens
aagaaaatgtggtaca

SEQ ID NO: 14934 - DNA, 17 bp, H. sapiens
aagaaaatgtggtacat

SEQ ID NO: 14935 - DNA, 16 bp, H. sapiens
aagaaaatgtggtcca

SEQ ID NO: 14936 - DNA, 16 bp, H. sapiens
aagaaaatgtgtattt

SEQ ID NO: 14937 - DNA, 16 bp, H. sapiens
aagaaaatgtgtttca

SEQ ID NO: 14938 - DNA, 16 bp, H. sapiens
aagaaaatgttacttt

SEQ ID NO: 14939 - DNA, 16 bp, H. sapiens
aagaaaatgttatcaa

SEQ ID NO: 14940 - DNA, 16 bp, H. sapiens
aagaaaatgttattag

SEQ ID NO: 14941 - DNA, 16 bp, H. sapiens
aagaaaatgttgttaa

SEQ ID NO: 14942 - DNA, 16 bp, H. sapiens
aagaaaatgtttattt

SEQ ID NO: 14943 - DNA, 16 bp, H. sapiens
aagaaaatgtttcaag

SEQ ID NO: 14944 - DNA, 16 bp, H. sapiens
aagaaaatgtttctga

SEQ ID NO: 14945 - DNA, 16 bp, H. sapiens
aagaaaatgtttgcca

SEQ ID NO: 14946 - DNA, 16 bp, H. sapiens
aagaaaatgttttgta

SEQ ID NO: 14947 - DNA, 16 bp, H. sapiens
aagaaaatgtttttaa

SEQ ID NO: 14948 - DNA, 16 bp, H. sapiens
aagaaaatgtttttat

SEQ ID NO: 14949 - DNA, 16 bp, H. sapiens
aagaaaattagcctgg

SEQ ID NO: 14950 - DNA, 16 bp, H. sapiens
aagaaaattatgtttt

SEQ ID NO: 14951 - DNA, 16 bp, H. sapiens
aagaaaattatttctg

SEQ ID NO: 14952 - DNA, 16 bp, H. sapiens
aagaaaattcatttta

SEQ ID NO: 14953 - DNA, 16 bp, H. sapiens
aagaaaattcttttta

SEQ ID NO: 14954 - DNA, 16 bp, H. sapiens
aagaaaattgaaatca

SEQ ID NO: 14955 - DNA, 16 bp, H. sapiens
aagaaaattgaattca

SEQ ID NO: 14956 - DNA, 16 bp, H. sapiens
aagaaaattgacaaat

SEQ ID NO: 14957 - DNA, 16 bp, H. sapiens
aagaaaattgtgtgtg

SEQ ID NO: 14958 - DNA, 16 bp, H. sapiens
aagaaaatttacaaat

SEQ ID NO: 14959 - DNA, 16 bp, H. sapiens
aagaaaatttagtttt

SEQ ID NO: 14960 - DNA, 16 bp, H. sapiens
aagaaaattttattgg

SEQ ID NO: 14961 - DNA, 16 bp, H. sapiens
aagaaaattttctgaa

SEQ ID NO: 14962 - DNA, 16 bp, H. sapiens
aagaaacaaaatctta

SEQ ID NO: 14963 - DNA, 16 bp, H. sapiens
aagaaacaaaattcat

SEQ ID NO: 14964 - DNA, 16 bp, H. sapiens
aagaaacaaactccag

SEQ ID NO: 14965 - DNA, 16 bp, H. sapiens
aagaaacaaattattt

SEQ ID NO: 14966 - DNA, 16 bp, H. sapiens
aagaaacaaattttaa

SEQ ID NO: 14967 - DNA, 16 bp, H. sapiens
aagaaacaatagatgc

SEQ ID NO: 14968 - DNA, 16 bp, H. sapiens
aagaaacaatgcattt

SEQ ID NO: 14969 - DNA, 16 bp, H. sapiens
aagaaacaatttgaaa

SEQ ID NO: 14970 - DNA, 16 bp, H. sapiens
aagaaacacccatttt

SEQ ID NO: 14971 - DNA, 16 bp, H. sapiens
aagaaacagaaattct

SEQ ID NO: 14972 - DNA, 16 bp, H. sapiens
aagaaacagaagttta

SEQ ID NO: 14973 - DNA, 16 bp, H. sapiens
aagaaacagagtcttg

SEQ ID NO: 14974 - DNA, 16 bp, H. sapiens
aagaaacagatatttt

SEQ ID NO: 14975 - DNA, 16 bp, H. sapiens
aagaaacaggaaaatg

SEQ ID NO: 14976 - DNA, 16 bp, H. sapiens
aagaaacaggcaacat

SEQ ID NO: 14977 - DNA, 16 bp, H. sapiens
aagaaacaggccaggc

SEQ ID NO: 14978 - DNA, 16 bp, H. sapiens
aagaaacaggcccaga

SEQ ID NO: 14979 - DNA, 16 bp, H. sapiens
aagaaacagtctttta

SEQ ID NO: 14980 - DNA, 16 bp, H. sapiens
aagaaacagtgagaaa

SEQ ID NO: 14981 - DNA, 16 bp, H. sapiens
aagaaacatacctcaa

SEQ ID NO: 14982 - DNA, 16 bp, H. sapiens
aagaaacatcaaattt

SEQ ID NO: 14983 - DNA, 16 bp, H. sapiens
aagaaacatcagaatt

SEQ ID NO: 14984 - DNA, 16 bp, H. sapiens
aagaaacatcagactt

SEQ ID NO: 14985 - DNA, 16 bp, H. sapiens
aagaaacatcagattt

SEQ ID NO: 14986 - DNA, 16 bp, H. sapiens
aagaaacatctgaaaa

SEQ ID NO: 14987 - DNA, 16 bp, H. sapiens
aagaaacatgaaaatg

SEQ ID NO: 14988 - DNA, 16 bp, H. sapiens
aagaaacattaatttt

SEQ ID NO: 14989 - DNA, 16 bp, H. sapiens
aagaaacattcagaaa

SEQ ID NO: 14990 - DNA, 16 bp, H. sapiens
aagaaacatttaaatt

SEQ ID NO: 14991 - DNA, 16 bp, H. sapiens
aagaaacatttaactc

SEQ ID NO: 14992 - DNA, 16 bp, H. sapiens
aagaaacatttcaaaa

SEQ ID NO: 14993 - DNA, 16 bp, H. sapiens
aagaaacatttcagag

SEQ ID NO: 14994 - DNA, 16 bp, H. sapiens
aagaaacatttgcaat

SEQ ID NO: 14995 - DNA, 16 bp, H. sapiens
aagaaacatttgttgt

SEQ ID NO: 14996 - DNA, 16 bp, H. sapiens
aagaaaccaaaatatt

SEQ ID NO: 14997 - DNA, 16 bp, H. sapiens
aagaaaccaagactca

SEQ ID NO: 14998 - DNA, 16 bp, H. sapiens
aagaaaccagctcctg

SEQ ID NO: 14999 - DNA, 16 bp, H. sapiens
aagaaaccccagagag

SEQ ID NO: 15000 - DNA, 16 bp, H. sapiens
aagaaaccctacaagc

SEQ ID NO: 15001 - DNA, 16 bp, H. sapiens
aagaaactaaatttta

SEQ ID NO: 15002 - DNA, 16 bp, H. sapiens
aagaaactaaggctca

SEQ ID NO: 15003 - DNA, 16 bp, H. sapiens
aagaaactattatttt

SEQ ID NO: 15004 - DNA, 16 bp, H. sapiens
aagaaactcacccaaa

SEQ ID NO: 15005 - DNA, 18 bp, H. sapiens
aagaaactcactcaaaac

SEQ ID NO: 15006 - DNA, 16 bp, H. sapiens
aagaaactcacttcac

SEQ ID NO: 15007 - DNA, 16 bp, H. sapiens
aagaaactgaaaaact

SEQ ID NO: 15008 - DNA, 16 bp, H. sapiens
aagaaactgaaagaag

SEQ ID NO: 15009 - DNA, 16 bp, H. sapiens
aagaaactgaaataat

SEQ ID NO: 15010 - DNA, 16 bp, H. sapiens
aagaaactgaagaaga

SEQ ID NO: 15011 - DNA, 16 bp, H. sapiens
aagaaactgaagagaa

SEQ ID NO: 15012 - DNA, 16 bp, H. sapiens
aagaaactgaagagga

SEQ ID NO: 15013 - DNA, 16 bp, H. sapiens
aagaaactgaagcaaa

SEQ ID NO: 15014 - DNA, 16 bp, H. sapiens
aagaaactgaagccag

SEQ ID NO: 15015 - DNA, 16 bp, H. sapiens
aagaaactgaagccca

SEQ ID NO: 15016 - DNA, 16 bp, H. sapiens
aagaaactgaattcct

SEQ ID NO: 15017 - DNA, 16 bp, H. sapiens
aagaaactgaattttt

SEQ ID NO: 15018 - DNA, 16 bp, H. sapiens
aagaaactgacaaact

SEQ ID NO: 15019 - DNA, 16 bp, H. sapiens
aagaaactgagacaaa

SEQ ID NO: 15020 - DNA, 16 bp, H. sapiens
aagaaactgaggcttg

SEQ ID NO: 15021 - DNA, 16 bp, H. sapiens
aagaaactgaggttca

SEQ ID NO: 15022 - DNA, 16 bp, H. sapiens
aagaaactgagtccca

SEQ ID NO: 15023 - DNA, 16 bp, H. sapiens
aagaaactgagtttca

SEQ ID NO: 15024 - DNA, 16 bp, H. sapiens
aagaaactgccaaatt

SEQ ID NO: 15025 - DNA, 16 bp, H. sapiens
aagaaactgctgaact

SEQ ID NO: 15026 - DNA, 16 bp, H. sapiens
aagaaactgctttctt

SEQ ID NO: 15027 - DNA, 16 bp, H. sapiens
aagaaacttacttcaa

SEQ ID NO: 15028 - DNA, 16 bp, H. sapiens
aagaaacttcagagaa

SEQ ID NO: 15029 - DNA, 16 bp, H. sapiens
aagaaacttttaaaaa

SEQ ID NO: 15030 - DNA, 16 bp, H. sapiens
aagaaacttttttctt

SEQ ID NO: 15031 - DNA, 16 bp, H. sapiens
aagaaacttttttttt

SEQ ID NO: 15032 - DNA, 16 bp, H. sapiens
aagaaagaaaaatggc

SEQ ID NO: 15033 - DNA, 16 bp, H. sapiens
aagaaagaaaaattct

SEQ ID NO: 15034 - DNA, 16 bp, H. sapiens
aagaaagaaaacagct

SEQ ID NO: 15035 - DNA, 16 bp, H. sapiens
aagaaagaaaacattg

SEQ ID NO: 15036 - DNA, 16 bp, H. sapiens
aagaaagaaaacttca

SEQ ID NO: 15037 - DNA, 16 bp, H. sapiens
aagaaagaaaacttta

SEQ ID NO: 15038 - DNA, 16 bp, H. sapiens
aagaaagaaaagactg

SEQ ID NO: 15039 - DNA, 16 bp, H. sapiens
aagaaagaaaatatcc

SEQ ID NO: 15040 - DNA, 16 bp, H. sapiens
aagaaagaaaatatgc

SEQ ID NO: 15041 - DNA, 16 bp, H. sapiens
aagaaagaaaatctat

SEQ ID NO: 15042 - DNA, 16 bp, H. sapiens
aagaaagaaaatgtgt

SEQ ID NO: 15043 - DNA, 16 bp, H. sapiens
aagaaagaaaatgttt

SEQ ID NO: 15044 - DNA, 16 bp, H. sapiens
aagaaagaaaattctg

SEQ ID NO: 15045 - DNA, 16 bp, H. sapiens
aagaaagaaactggat

SEQ ID NO: 15046 - DNA, 16 bp, H. sapiens
aagaaagaaactttta

SEQ ID NO: 15047 - DNA, 16 bp, H. sapiens
aagaaagaaagaattc

SEQ ID NO: 15048 - DNA, 16 bp, H. sapiens
aagaaagaaagacatt

SEQ ID NO: 15049 - DNA, 16 bp, H. sapiens
aagaaagaaaggctgg

SEQ ID NO: 15050 - DNA, 16 bp, H. sapiens
aagaaagaaagtcaca

SEQ ID NO: 15051 - DNA, 16 bp, H. sapiens
aagaaagaaatacatg

SEQ ID NO: 15052 - DNA, 16 bp, H. sapiens
aagaaagaaatcaatc

SEQ ID NO: 15053 - DNA, 16 bp, H. sapiens
aagaaagaaatctttt

SEQ ID NO: 15054 - DNA, 16 bp, H. sapiens
aagaaagaaatgcatg

SEQ ID NO: 15055 - DNA, 16 bp, H. sapiens
aagaaagaaatggctt

SEQ ID NO: 15056 - DNA, 16 bp, H. sapiens
aagaaagaaatgtatt

SEQ ID NO: 15057 - DNA, 16 bp, H. sapiens
aagaaagaaatgttga

SEQ ID NO: 15058 - DNA, 16 bp, H. sapiens
aagaaagaaattacag

SEQ ID NO: 15059 - DNA, 16 bp, H. sapiens
aagaaagaaattacat

SEQ ID NO: 15060 - DNA, 16 bp, H. sapiens
aagaaagaaattatac

SEQ ID NO: 15061 - DNA, 16 bp, H. sapiens
aagaaagaaattctaa

SEQ ID NO: 15062 - DNA, 16 bp, H. sapiens
aagaaagaaattgatt

SEQ ID NO: 15063 - DNA, 16 bp, H. sapiens
aagaaagaacctcaga

SEQ ID NO: 15064 - DNA, 16 bp, H. sapiens
aagaaagaactcaggg

SEQ ID NO: 15065 - DNA, 16 bp, H. sapiens
aagaaagaaggccagg

SEQ ID NO: 15066 - DNA, 16 bp, H. sapiens
aagaaagaatctcaga

SEQ ID NO: 15067 - DNA, 16 bp, H. sapiens
aagaaagaatctgtga

SEQ ID NO: 15068 - DNA, 16 bp, H. sapiens
aagaaagaatgaagct

SEQ ID NO: 15069 - DNA, 16 bp, H. sapiens
aagaaagaatttatga

SEQ ID NO: 15070 - DNA, 16 bp, H. sapiens
aagaaagaatttcaaa

SEQ ID NO: 15071 - DNA, 16 bp, H. sapiens
aagaaagaatttgaga

SEQ ID NO: 15072 - DNA, 16 bp, H. sapiens
aagaaagaatttgtga

SEQ ID NO: 15073 - DNA, 16 bp, H. sapiens
aagaaagaatttttta

SEQ ID NO: 15074 - DNA, 16 bp, H. sapiens
aagaaagacacatttt

SEQ ID NO: 15075 - DNA, 16 bp, H. sapiens
aagaaagacatggaaa

SEQ ID NO: 15076 - DNA, 16 bp, H. sapiens
aagaaagacattacat

SEQ ID NO: 15077 - DNA, 16 bp, H. sapiens
aagaaagacattttca

SEQ ID NO: 15078 - DNA, 16 bp, H. sapiens
aagaaagacattttta

SEQ ID NO: 15079 - DNA, 16 bp, H. sapiens
aagaaagactgagaag

SEQ ID NO: 15080 - DNA, 16 bp, H. sapiens
aagaaagagaaattca

SEQ ID NO: 15081 - DNA, 16 bp, H. sapiens
aagaaagagaagagct

SEQ ID NO: 15082 - DNA, 16 bp, H. sapiens
aagaaagagcccacat

SEQ ID NO: 15083 - DNA, 16 bp, H. sapiens
aagaaagaggccaggc

SEQ ID NO: 15084 - DNA, 16 bp, H. sapiens
aagaaagataatttga

SEQ ID NO: 15085 - DNA, 16 bp, H. sapiens
aagaaagatgtgtttg

SEQ ID NO: 15086 - DNA, 16 bp, H. sapiens
aagaaagatttcaaat

SEQ ID NO: 15087 - DNA, 16 bp, H. sapiens
aagaaagattttttta

SEQ ID NO: 15088 - DNA, 16 bp, H. sapiens
aagaaagcaaagcagc

SEQ ID NO: 15089 - DNA, 16 bp, H. sapiens
aagaaagcaagcaagt

SEQ ID NO: 15090 - DNA, 16 bp, H. sapiens
aagaaagcaatgggca

SEQ ID NO: 15091 - DNA, 16 bp, H. sapiens
aagaaagcagagcttt

SEQ ID NO: 15092 - DNA, 16 bp, H. sapiens
aagaaagcatttaaaa

SEQ ID NO: 15093 - DNA, 16 bp, H. sapiens
aagaaagcccaggacc

SEQ ID NO: 15094 - DNA, 16 bp, H. sapiens
aagaaagcctatggga

SEQ ID NO: 15095 - DNA, 16 bp, H. sapiens
aagaaagctgaagaaa

SEQ ID NO: 15096 - DNA, 16 bp, H. sapiens
aagaaagcttcagacg

SEQ ID NO: 15097 - DNA, 16 bp, H. sapiens
aagaaagcttttttaa

SEQ ID NO: 15098 - DNA, 16 bp, H. sapiens
aagaaaggaaagattt

SEQ ID NO: 15099 - DNA, 16 bp, H. sapiens
aagaaaggaaatctgt

SEQ ID NO: 15100 - DNA, 16 bp, H. sapiens
aagaaaggaggccagg

SEQ ID NO: 15101 - DNA, 16 bp, H. sapiens
aagaaaggatatcagt

SEQ ID NO: 15102 - DNA, 16 bp, H. sapiens
aagaaaggatcttgta

SEQ ID NO: 15103 - DNA, 16 bp, H. sapiens
aagaaaggctggaaaa

SEQ ID NO: 15104 - DNA, 16 bp, H. sapiens
aagaaagggacaaatt

SEQ ID NO: 15105 - DNA, 16 bp, H. sapiens
aagaaaggtgatattg

SEQ ID NO: 15106 - DNA, 16 bp, H. sapiens
aagaaaggtttaaatt

SEQ ID NO: 15107 - DNA, 16 bp, H. sapiens
aagaaaggtttatttg

SEQ ID NO: 15108 - DNA, 16 bp, H. sapiens
aagaaaggttttactc

SEQ ID NO: 15109 - DNA, 16 bp, H. sapiens
aagaaagtatttgaaa

SEQ ID NO: 15110 - DNA, 16 bp, H. sapiens
aagaaagtcaatggca

SEQ ID NO: 15111 - DNA, 16 bp, H. sapiens
aagaaagtcagagaaa

SEQ ID NO: 15112 - DNA, 16 bp, H. sapiens
aagaaagtccaggacc

SEQ ID NO: 15113 - DNA, 16 bp, H. sapiens
aagaaagtgaaacagt

SEQ ID NO: 15114 - DNA, 16 bp, H. sapiens
aagaaagtgacctctg

SEQ ID NO: 15115 - DNA, 16 bp, H. sapiens
aagaaagtgtttttct

SEQ ID NO: 15116 - DNA, 16 bp, H. sapiens
aagaaagttcttcagg

SEQ ID NO: 15117 - DNA, 16 bp, H. sapiens
aagaaagtttattcaa

SEQ ID NO: 15118 - DNA, 16 bp, H. sapiens
aagaaagtttccttct

SEQ ID NO: 15119 - DNA, 16 bp, H. sapiens
aagaaataaaactgtt

SEQ ID NO: 15120 - DNA, 16 bp, H. sapiens
aagaaataaaagcttt

SEQ ID NO: 15121 - DNA, 16 bp, H. sapiens
aagaaataaaaggtgt

SEQ ID NO: 15122 - DNA, 16 bp, H. sapiens
aagaaataaaatgtca

SEQ ID NO: 15123 - DNA, 16 bp, H. sapiens
aagaaataaaatttca

SEQ ID NO: 15124 - DNA, 16 bp, H. sapiens
aagaaataaacccaca

SEQ ID NO: 15125 - DNA, 16 bp, H. sapiens
aagaaataaatctttg

SEQ ID NO: 15126 - DNA, 16 bp, H. sapiens
aagaaataaatgagac

SEQ ID NO: 15127 - DNA, 16 bp, H. sapiens
aagaaataaatgcaga

SEQ ID NO: 15128 - DNA, 16 bp, H. sapiens
aagaaataaatggtat

SEQ ID NO: 15129 - DNA, 16 bp, H. sapiens
aagaaataaatgtttt

SEQ ID NO: 15130 - DNA, 16 bp, H. sapiens
aagaaataacattttt

SEQ ID NO: 15131 - DNA, 16 bp, H. sapiens
aagaaataactaagac

SEQ ID NO: 15132 - DNA, 23 bp, H. sapiens
aagaaataactaagatcagagaa

SEQ ID NO: 15133 - DNA, 16 bp, H. sapiens
aagaaataactgaaat

SEQ ID NO: 15134 - DNA, 16 bp, H. sapiens
aagaaataagacattt

SEQ ID NO: 15135 - DNA, 16 bp, H. sapiens
aagaaataatagcaat

SEQ ID NO: 15136 - DNA, 16 bp, H. sapiens
aagaaataatcccctg

SEQ ID NO: 15137 - DNA, 16 bp, H. sapiens
aagaaataatggcaaa

SEQ ID NO: 15138 - DNA, 16 bp, H. sapiens
aagaaataatgtattt

SEQ ID NO: 15139 - DNA, 16 bp, H. sapiens
aagaaataattcagaa

SEQ ID NO: 15140 - DNA, 16 bp, H. sapiens
aagaaataattcagag

SEQ ID NO: 15141 - DNA, 16 bp, H. sapiens
aagaaataattgccaa

SEQ ID NO: 15142 - DNA, 16 bp, H. sapiens
aagaaatacaaaacct

SEQ ID NO: 15143 - DNA, 16 bp, H. sapiens
aagaaatacaaggcat

SEQ ID NO: 15144 - DNA, 16 bp, H. sapiens
aagaaatacaagtggc

SEQ ID NO: 15145 - DNA, 16 bp, H. sapiens
aagaaatacacatttt

SEQ ID NO: 15146 - DNA, 16 bp, H. sapiens
aagaaatacagaaatt

SEQ ID NO: 15147 - DNA, 16 bp, H. sapiens
aagaaatacatgaaat

SEQ ID NO: 15148 - DNA, 16 bp, H. sapiens
aagaaatacatttcct

SEQ ID NO: 15149 - DNA, 16 bp, H. sapiens
aagaaatacctgagtc

SEQ ID NO: 15150 - DNA, 16 bp, H. sapiens
aagaaatactaaaagg

SEQ ID NO: 15151 - DNA, 16 bp, H. sapiens
aagaaatactgaattt

SEQ ID NO: 15152 - DNA, 16 bp, H. sapiens
aagaaatacttccaaa

SEQ ID NO: 15153 - DNA, 16 bp, H. sapiens
aagaaatacttgagac

SEQ ID NO: 15154 - DNA, 16 bp, H. sapiens
aagaaatagaaaactt

SEQ ID NO: 15155 - DNA, 16 bp, H. sapiens
aagaaatagaaaatct

SEQ ID NO: 15156 - DNA, 16 bp, H. sapiens
aagaaatagaaaccct

SEQ ID NO: 15157 - DNA, 16 bp, H. sapiens
aagaaatagaaacttt

SEQ ID NO: 15158 - DNA, 16 bp, H. sapiens
aagaaatagaagactt

SEQ ID NO: 15159 - DNA, 16 bp, H. sapiens
aagaaatagataaatc

SEQ ID NO: 15160 - DNA, 16 bp, H. sapiens
aagaaatataaaactt

SEQ ID NO: 15161 - DNA, 16 bp, H. sapiens
aagaaatatatttcag

SEQ ID NO: 15162 - DNA, 16 bp, H. sapiens
aagaaatatctgtact

SEQ ID NO: 15163 - DNA, 16 bp, H. sapiens
aagaaatatgttttat

SEQ ID NO: 15164 - DNA, 16 bp, H. sapiens
aagaaatattaacatt

SEQ ID NO: 15165 - DNA, 16 bp, H. sapiens
aagaaatattacagaa

SEQ ID NO: 15166 - DNA, 16 bp, H. sapiens
aagaaatattattcag

SEQ ID NO: 15167 - DNA, 16 bp, H. sapiens
aagaaatatttactga

SEQ ID NO: 15168 - DNA, 16 bp, H. sapiens
aagaaatatttatgta

SEQ ID NO: 15169 - DNA, 16 bp, H. sapiens
aagaaatatttcaaaa

SEQ ID NO: 15170 - DNA, 16 bp, H. sapiens
aagaaatatttcttga

SEQ ID NO: 15171 - DNA, 16 bp, H. sapiens
aagaaatattttccta

SEQ ID NO: 15172 - DNA, 16 bp, H. sapiens
aagaaatattttctca

SEQ ID NO: 15173 - DNA, 16 bp, H. sapiens
aagaaatattttgatt

SEQ ID NO: 15174 - DNA, 16 bp, H. sapiens
aagaaatatttttcta

SEQ ID NO: 15175 - DNA, 16 bp, H. sapiens
aagaaatcaaagaagg

SEQ ID NO: 15176 - DNA, 16 bp, H. sapiens
aagaaatcaagaaagc

SEQ ID NO: 15177 - DNA, 16 bp, H. sapiens
aagaaatcaagaaatt

SEQ ID NO: 15178 - DNA, 16 bp, H. sapiens
aagaaatcaagaccat

SEQ ID NO: 15179 - DNA, 16 bp, H. sapiens
aagaaatcaatatatt

SEQ ID NO: 15180 - DNA, 16 bp, H. sapiens
aagaaatcagagataa

SEQ ID NO: 15181 - DNA, 16 bp, H. sapiens
aagaaatcagagatta

SEQ ID NO: 15182 - DNA, 16 bp, H. sapiens
aagaaatcagaggtga

SEQ ID NO: 15183 - DNA, 16 bp, H. sapiens
aagaaatcagcaattt

SEQ ID NO: 15184 - DNA, 16 bp, H. sapiens
aagaaatcaggagaga

SEQ ID NO: 15185 - DNA, 16 bp, H. sapiens
aagaaatcaggcaaat

SEQ ID NO: 15186 - DNA, 16 bp, H. sapiens
aagaaatcatagacga

SEQ ID NO: 15187 - DNA, 16 bp, H. sapiens
aagaaatcatttttaa

SEQ ID NO: 15188 - DNA, 16 bp, H. sapiens
aagaaatcattttttt

SEQ ID NO: 15189 - DNA, 16 bp, H. sapiens
aagaaatccatgccaa

SEQ ID NO: 15190 - DNA, 16 bp, H. sapiens
aagaaatccctgagac

SEQ ID NO: 15191 - DNA, 16 bp, H. sapiens
aagaaatcttatttta

SEQ ID NO: 15192 - DNA, 16 bp, H. sapiens
aagaaatctttcccta

SEQ ID NO: 15193 - DNA, 16 bp, H. sapiens
aagaaatgaaaacatg

SEQ ID NO: 15194 - DNA, 16 bp, H. sapiens
aagaaatgaaaactac

SEQ ID NO: 15195 - DNA, 16 bp, H. sapiens
aagaaatgaaaattac

SEQ ID NO: 15196 - DNA, 16 bp, H. sapiens
aagaaatgaaagcaca

SEQ ID NO: 15197 - DNA, 16 bp, H. sapiens
aagaaatgaaagcagg

SEQ ID NO: 15198 - DNA, 16 bp, H. sapiens
aagaaatgaaaggcat

SEQ ID NO: 15199 - DNA, 16 bp, H. sapiens
aagaaatgaacatgaa

SEQ ID NO: 15200 - DNA, 16 bp, H. sapiens
aagaaatgaagagcaa

SEQ ID NO: 15201 - DNA, 16 bp, H. sapiens
aagaaatgaaggcaga

SEQ ID NO: 15202 - DNA, 16 bp, H. sapiens
aagaaatgaccatggt

SEQ ID NO: 15203 - DNA, 16 bp, H. sapiens
aagaaatgatttttaa

SEQ ID NO: 15204 - DNA, 16 bp, H. sapiens
aagaaatgcattttct

SEQ ID NO: 15205 - DNA, 16 bp, H. sapiens
aagaaatgcccaagac

SEQ ID NO: 15206 - DNA, 16 bp, H. sapiens
aagaaatgctaaagaa

SEQ ID NO: 15207 - DNA, 16 bp, H. sapiens
aagaaatgctaaagga

SEQ ID NO: 15208 - DNA, 16 bp, H. sapiens
aagaaatgctgaagag

SEQ ID NO: 15209 - DNA, 16 bp, H. sapiens
aagaaatgctgagaaa

SEQ ID NO: 15210 - DNA, 16 bp, H. sapiens
aagaaatggaaaagca

SEQ ID NO: 15211 - DNA, 16 bp, H. sapiens
aagaaatggaaaatct

SEQ ID NO: 15212 - DNA, 16 bp, H. sapiens
aagaaatggaaactct

SEQ ID NO: 15213 - DNA, 16 bp, H. sapiens
aagaaatggaatattt

SEQ ID NO: 15214 - DNA, 16 bp, H. sapiens
aagaaatggagaagca

SEQ ID NO: 15215 - DNA, 16 bp, H. sapiens
aagaaatggcaaaaac

SEQ ID NO: 15216 - DNA, 16 bp, H. sapiens
aagaaatgggaaatat

SEQ ID NO: 15217 - DNA, 16 bp, H. sapiens
aagaaatgggcaaaat

SEQ ID NO: 15218 - DNA, 16 bp, H. sapiens
aagaaatggtaccaat

SEQ ID NO: 15219 - DNA, 16 bp, H. sapiens
aagaaatggttcattg

SEQ ID NO: 15220 - DNA, 16 bp, H. sapiens
aagaaatgtacagatt

SEQ ID NO: 15221 - DNA, 16 bp, H. sapiens
aagaaatgtatatttg

SEQ ID NO: 15222 - DNA, 16 bp, H. sapiens
aagaaatgtcaaaaga

SEQ ID NO: 15223 - DNA, 16 bp, H. sapiens
aagaaatgtctcaaat

SEQ ID NO: 15224 - DNA, 16 bp, H. sapiens
aagaaatgtggaaagg

SEQ ID NO: 15225 - DNA, 16 bp, H. sapiens
aagaaatgtgggatta

SEQ ID NO: 15226 - DNA, 16 bp, H. sapiens
aagaaatgtggtacat

SEQ ID NO: 15227 - DNA, 16 bp, H. sapiens
aagaaatgttattttt

SEQ ID NO: 15228 - DNA, 16 bp, H. sapiens
aagaaatgtttctgga

SEQ ID NO: 15229 - DNA, 16 bp, H. sapiens
aagaaatgtttgaaat

SEQ ID NO: 15230 - DNA, 16 bp, H. sapiens
aagaaatgtttgtaaa

SEQ ID NO: 15231 - DNA, 16 bp, H. sapiens
aagaaatgttttaaat

SEQ ID NO: 15232 - DNA, 16 bp, H. sapiens
aagaaatgtttttaaa

SEQ ID NO: 15233 - DNA, 16 bp, H. sapiens
aagaaattaaagcaga

SEQ ID NO: 15234 - DNA, 16 bp, H. sapiens
aagaaattaaagcata

SEQ ID NO: 15235 - DNA, 16 bp, H. sapiens
aagaaattaatacatt

SEQ ID NO: 15236 - DNA, 16 bp, H. sapiens
aagaaattatcaacag

SEQ ID NO: 15237 - DNA, 16 bp, H. sapiens
aagaaattatcttttt

SEQ ID NO: 15238 - DNA, 16 bp, H. sapiens
aagaaattattcagaa

SEQ ID NO: 15239 - DNA, 16 bp, H. sapiens
aagaaattattccaaa

SEQ ID NO: 15240 - DNA, 16 bp, H. sapiens
aagaaattatttcaaa

SEQ ID NO: 15241 - DNA, 16 bp, H. sapiens
aagaaattattttctg

SEQ ID NO: 15242 - DNA, 16 bp, H. sapiens
aagaaattcaagagga

SEQ ID NO: 15243 - DNA, 16 bp, H. sapiens
aagaaattcaagccag

SEQ ID NO: 15244 - DNA, 16 bp, H. sapiens
aagaaattcaaggtaa

SEQ ID NO: 15245 - DNA, 16 bp, H. sapiens
aagaaattcaataaat

SEQ ID NO: 15246 - DNA, 16 bp, H. sapiens
aagaaattcaatataa

SEQ ID NO: 15247 - DNA, 16 bp, H. sapiens
aagaaattcacttcaa

SEQ ID NO: 15248 - DNA, 16 bp, H. sapiens
aagaaattcagaaaat

SEQ ID NO: 15249 - DNA, 16 bp, H. sapiens
aagaaattcagagctt

SEQ ID NO: 15250 - DNA, 16 bp, H. sapiens
aagaaattccagaaaa

SEQ ID NO: 15251 - DNA, 16 bp, H. sapiens
aagaaattctaaaaat

SEQ ID NO: 15252 - DNA, 16 bp, H. sapiens
aagaaattctaaagaa

SEQ ID NO: 15253 - DNA, 16 bp, H. sapiens
aagaaattctgagaaa

SEQ ID NO: 15254 - DNA, 16 bp, H. sapiens
aagaaattctgggttg

SEQ ID NO: 15255 - DNA, 16 bp, H. sapiens
aagaaattcttagaaa

SEQ ID NO: 15256 - DNA, 16 bp, H. sapiens
aagaaattgaagacat

SEQ ID NO: 15257 - DNA, 16 bp, H. sapiens
aagaaattgaagaggg

SEQ ID NO: 15258 - DNA, 16 bp, H. sapiens
aagaaattgaagatga

SEQ ID NO: 15259 - DNA, 16 bp, H. sapiens
aagaaattgatatttt

SEQ ID NO: 15260 - DNA, 16 bp, H. sapiens
aagaaattgatctttt

SEQ ID NO: 15261 - DNA, 16 bp, H. sapiens
aagaaattgattccaa

SEQ ID NO: 15262 - DNA, 16 bp, H. sapiens
aagaaattgctacagc

SEQ ID NO: 15263 - DNA, 16 bp, H. sapiens
aagaaattggtaaatt

SEQ ID NO: 15264 - DNA, 16 bp, H. sapiens
aagaaatttaagagga

SEQ ID NO: 15265 - DNA, 16 bp, H. sapiens
aagaaatttatttctt

SEQ ID NO: 15266 - DNA, 16 bp, H. sapiens
aagaaatttctaagca

SEQ ID NO: 15267 - DNA, 16 bp, H. sapiens
aagaaatttctaagct

SEQ ID NO: 15268 - DNA, 16 bp, H. sapiens
aagaaatttctttttt

SEQ ID NO: 15269 - DNA, 16 bp, H. sapiens
aagaaatttgaggaaa

SEQ ID NO: 15270 - DNA, 16 bp, H. sapiens
aagaaatttgcaaaaa

SEQ ID NO: 15271 - DNA, 16 bp, H. sapiens
aagaaattttatgaat

SEQ ID NO: 15272 - DNA, 16 bp, H. sapiens
aagaaattttccattt

SEQ ID NO: 15273 - DNA, 16 bp, H. sapiens
aagaaatttttcagtt

SEQ ID NO: 15274 - DNA, 16 bp, H. sapiens
aagaaatttttgccca

SEQ ID NO: 15275 - DNA, 16 bp, H. sapiens
aagaaattttttcaaa

SEQ ID NO: 15276 - DNA, 16 bp, H. sapiens
aagaacaaaacttcat

SEQ ID NO: 15277 - DNA, 16 bp, H. sapiens
aagaacaaaatgaatt

SEQ ID NO: 15278 - DNA, 16 bp, H. sapiens
aagaacaaaattctgt

SEQ ID NO: 15279 - DNA, 16 bp, H. sapiens
aagaacaaactaaatc

SEQ ID NO: 15280 - DNA, 16 bp, H. sapiens
aagaacaaagctaaag

SEQ ID NO: 15281 - DNA, 16 bp, H. sapiens
aagaacaaagctggaa

SEQ ID NO: 15282 - DNA, 22 bp, H. sapiens
aagaacaaagctgggggcatca

SEQ ID NO: 15283 - DNA, 16 bp, H. sapiens
aagaacaaatctgaag

SEQ ID NO: 15284 - DNA, 16 bp, H. sapiens
aagaacaacaaaattg

SEQ ID NO: 15285 - DNA, 16 bp, H. sapiens
aagaacaagatcttgt

SEQ ID NO: 15286 - DNA, 16 bp, H. sapiens
aagaacaatttatgaa

SEQ ID NO: 15287 - DNA, 16 bp, H. sapiens
aagaacacaattccat

SEQ ID NO: 15288 - DNA, 16 bp, H. sapiens
aagaacacacactggg

SEQ ID NO: 15289 - DNA, 16 bp, H. sapiens
aagaacacagccctgc

SEQ ID NO: 15290 - DNA, 16 bp, H. sapiens
aagaacacaggaaaat

SEQ ID NO: 15291 - DNA, 16 bp, H. sapiens
aagaacacatttatgc

SEQ ID NO: 15292 - DNA, 16 bp, H. sapiens
aagaacacattttaaa

SEQ ID NO: 15293 - DNA, 16 bp, H. sapiens
aagaacactgaaaatt

SEQ ID NO: 15294 - DNA, 16 bp, H. sapiens
aagaacactttttttt

SEQ ID NO: 15295 - DNA, 16 bp, H. sapiens
aagaacagaaatcatg

SEQ ID NO: 15296 - DNA, 16 bp, H. sapiens
aagaacagaataacag

SEQ ID NO: 15297 - DNA, 16 bp, H. sapiens
aagaacagacatttat

SEQ ID NO: 15298 - DNA, 16 bp, H. sapiens
aagaacagagaaaatg

SEQ ID NO: 15299 - DNA, 16 bp, H. sapiens
aagaacagatatttat

SEQ ID NO: 15300 - DNA, 16 bp, H. sapiens
aagaacagcaaagggg

SEQ ID NO: 15301 - DNA, 16 bp, H. sapiens
aagaacagcagcatgg

SEQ ID NO: 15302 - DNA, 16 bp, H. sapiens
aagaacagcatgtgca

SEQ ID NO: 15303 - DNA, 16 bp, H. sapiens
aagaacagctagaact

SEQ ID NO: 15304 - DNA, 16 bp, H. sapiens
aagaacagtatggagg

SEQ ID NO: 15305 - DNA, 16 bp, H. sapiens
aagaacagtgaagaaa

SEQ ID NO: 15306 - DNA, 16 bp, H. sapiens
aagaacatacactggg

SEQ ID NO: 15307 - DNA, 16 bp, H. sapiens
aagaacatagctggag

SEQ ID NO: 15308 - DNA, 16 bp, H. sapiens
aagaacatctgtattt

SEQ ID NO: 15309 - DNA, 16 bp, H. sapiens
aagaacatctttcttt

SEQ ID NO: 15310 - DNA, 16 bp, H. sapiens
aagaacatgaaaagac

SEQ ID NO: 15311 - DNA, 16 bp, H. sapiens
aagaacatgtacagaa

SEQ ID NO: 15312 - DNA, 16 bp, H. sapiens
aagaacattccttgct

SEQ ID NO: 15313 - DNA, 16 bp, H. sapiens
aagaacattttataaa

SEQ ID NO: 15314 - DNA, 16 bp, H. sapiens
aagaacattttgaaag

SEQ ID NO: 15315 - DNA, 16 bp, H. sapiens
aagaacattttttttt

SEQ ID NO: 15316 - DNA, 16 bp, H. sapiens
aagaaccaaatggaaa

SEQ ID NO: 15317 - DNA, 16 bp, H. sapiens
aagaaccagctcctgg

SEQ ID NO: 15318 - DNA, 16 bp, H. sapiens
aagaaccagtctttga

SEQ ID NO: 15319 - DNA, 16 bp, H. sapiens
aagaaccattgctgga

SEQ ID NO: 15320 - DNA, 16 bp, H. sapiens
aagaacccatcaggtg

SEQ ID NO: 15321 - DNA, 16 bp, H. sapiens
aagaaccctctcttgg

SEQ ID NO: 15322 - DNA, 16 bp, H. sapiens
aagaacctagaaaaag

SEQ ID NO: 15323 - DNA, 16 bp, H. sapiens
aagaacctattgatga

SEQ ID NO: 15324 - DNA, 16 bp, H. sapiens
aagaacctggacaact

SEQ ID NO: 15325 - DNA, 16 bp, H. sapiens
aagaacctggagtctg

SEQ ID NO: 15326 - DNA, 16 bp, H. sapiens
aagaactaaaggaaat

SEQ ID NO: 15327 - DNA, 18 bp, H. sapiens
aagaactaatgataatcc

SEQ ID NO: 15328 - DNA, 16 bp, H. sapiens
aagaactagaaaacca

SEQ ID NO: 15329 - DNA, 16 bp, H. sapiens
aagaactagaaaatat

SEQ ID NO: 15330 - DNA, 16 bp, H. sapiens
aagaactagaaagaag

SEQ ID NO: 15331 - DNA, 16 bp, H. sapiens
aagaactagacagaaa

SEQ ID NO: 15332 - DNA, 16 bp, H. sapiens
aagaactagagaagaa

SEQ ID NO: 15333 - DNA, 16 bp, H. sapiens
aagaactagagaatca

SEQ ID NO: 15334 - DNA, 16 bp, H. sapiens
aagaactattaaaact

SEQ ID NO: 15335 - DNA, 16 bp, H. sapiens
aagaactcaaaagcaa

SEQ ID NO: 15336 - DNA, 16 bp, H. sapiens
aagaactcaaagcaga

SEQ ID NO: 15337 - DNA, 16 bp, H. sapiens
aagaactcagataaaa

SEQ ID NO: 15338 - DNA, 16 bp, H. sapiens
aagaactgaaaaatat

SEQ ID NO: 15339 - DNA, 16 bp, H. sapiens
aagaactgaaaacata

SEQ ID NO: 15340 - DNA, 16 bp, H. sapiens
aagaactgaaagaagg

SEQ ID NO: 15341 - DNA, 16 bp, H. sapiens
aagaactgaaatcata

SEQ ID NO: 15342 - DNA, 16 bp, H. sapiens
aagaactgaaggaaat

SEQ ID NO: 15343 - DNA, 16 bp, H. sapiens
aagaactgaatgaaat

SEQ ID NO: 15344 - DNA, 16 bp, H. sapiens
aagaactgagggtcct

SEQ ID NO: 15345 - DNA, 16 bp, H. sapiens
aagaactgcccaagat

SEQ ID NO: 15346 - DNA, 16 bp, H. sapiens
aagaactggaaaaaga

SEQ ID NO: 15347 - DNA, 16 bp, H. sapiens
aagaactggaagaaga

SEQ ID NO: 15348 - DNA, 16 bp, H. sapiens
aagaactgtaacattc

SEQ ID NO: 15349 - DNA, 16 bp, H. sapiens
aagaacttaaagaaat

SEQ ID NO: 15350 - DNA, 16 bp, H. sapiens
aagaacttacttattt

SEQ ID NO: 15351 - DNA, 16 bp, H. sapiens
aagaactttatgatga

SEQ ID NO: 15352 - DNA, 16 bp, H. sapiens
aagaacttttgcacag

SEQ ID NO: 15353 - DNA, 16 bp, H. sapiens
aagaactttttaaaaa

SEQ ID NO: 15354 - DNA, 16 bp, H. sapiens
aagaactttttaaatt

SEQ ID NO: 15355 - DNA, 16 bp, H. sapiens
aagaactttttctttt

SEQ ID NO: 15356 - DNA, 16 bp, H. sapiens
aagaagaaaaaggttt

SEQ ID NO: 15357 - DNA, 16 bp, H. sapiens
aagaagaaaaagttca

SEQ ID NO: 15358 - DNA, 16 bp, H. sapiens
aagaagaaaaatcacc

SEQ ID NO: 15359 - DNA, 16 bp, H. sapiens
aagaagaaaaatgtca

SEQ ID NO: 15360 - DNA, 16 bp, H. sapiens
aagaagaaaacatttt

SEQ ID NO: 15361 - DNA, 16 bp, H. sapiens
aagaagaaaactggag

SEQ ID NO: 15362 - DNA, 16 bp, H. sapiens
aagaagaaaagcattt

SEQ ID NO: 15363 - DNA, 16 bp, H. sapiens
aagaagaaaataagct

SEQ ID NO: 15364 - DNA, 16 bp, H. sapiens
aagaagaaaataccta

SEQ ID NO: 15365 - DNA, 16 bp, H. sapiens
aagaagaaaatatctt

SEQ ID NO: 15366 - DNA, 16 bp, H. sapiens
aagaagaaaatctgaa

SEQ ID NO: 15367 - DNA, 16 bp, H. sapiens
aagaagaaaatgaagc

SEQ ID NO: 15368 - DNA, 16 bp, H. sapiens
aagaagaaaatgtggc

SEQ ID NO: 15369 - DNA, 16 bp, H. sapiens
aagaagaaaattctgt

SEQ ID NO: 15370 - DNA, 16 bp, H. sapiens
aagaagaaaattcttt

SEQ ID NO: 15371 - DNA, 16 bp, H. sapiens
aagaagaaaattgtga

SEQ ID NO: 15372 - DNA, 16 bp, H. sapiens
aagaagaaactgaaac

SEQ ID NO: 15373 - DNA, 16 bp, H. sapiens
aagaagaaagaagttt

SEQ ID NO: 15374 - DNA, 16 bp, H. sapiens
aagaagaaagcatttt

SEQ ID NO: 15375 - DNA, 16 bp, H. sapiens
aagaagaaagctcaga

SEQ ID NO: 15376 - DNA, 16 bp, H. sapiens
aagaagaaatcacagg

SEQ ID NO: 15377 - DNA, 16 bp, H. sapiens
aagaagaaatccctga

SEQ ID NO: 15378 - DNA, 16 bp, H. sapiens
aagaagaaatctctga

SEQ ID NO: 15379 - DNA, 16 bp, H. sapiens
aagaagaaatgcagaa

SEQ ID NO: 15380 - DNA, 16 bp, H. sapiens
aagaagaaatgtgttt

SEQ ID NO: 15381 - DNA, 16 bp, H. sapiens
aagaagaaatgttttt

SEQ ID NO: 15382 - DNA, 16 bp, H. sapiens
aagaagaacaaagctg

SEQ ID NO: 15383 - DNA, 16 bp, H. sapiens
aagaagaacaagatca

SEQ ID NO: 15384 - DNA, 16 bp, H. sapiens
aagaagaactttggaa

SEQ ID NO: 15385 - DNA, 16 bp, H. sapiens
aagaagaagaaagact

SEQ ID NO: 15386 - DNA, 16 bp, H. sapiens
aagaagaagaaatgca

SEQ ID NO: 15387 - DNA, 16 bp, H. sapiens
aagaagaagaaatttg

SEQ ID NO: 15388 - DNA, 16 bp, H. sapiens
aagaagaagcagcagc

SEQ ID NO: 15389 - DNA, 16 bp, H. sapiens
aagaagaaggaaatac

SEQ ID NO: 15390 - DNA, 16 bp, H. sapiens
aagaagaaggtcatca

SEQ ID NO: 15391 - DNA, 16 bp, H. sapiens
aagaagaagttgaatc

SEQ ID NO: 15392 - DNA, 16 bp, H. sapiens
aagaagaatctgaaca

SEQ ID NO: 15393 - DNA, 16 bp, H. sapiens
aagaagaatctggaca

SEQ ID NO: 15394 - DNA, 16 bp, H. sapiens
aagaagaatgaagttg

SEQ ID NO: 15395 - DNA, 16 bp, H. sapiens
aagaagaattaatacc

SEQ ID NO: 15396 - DNA, 16 bp, H. sapiens
aagaagaattagtacc

SEQ ID NO: 15397 - DNA, 16 bp, H. sapiens
aagaagaattgtcttg

SEQ ID NO: 15398 - DNA, 16 bp, H. sapiens
aagaagacaaaatgga

SEQ ID NO: 15399 - DNA, 16 bp, H. sapiens
aagaagacagaaaagt

SEQ ID NO: 15400 - DNA, 16 bp, H. sapiens
aagaagacagaaatgt

SEQ ID NO: 15401 - DNA, 16 bp, H. sapiens
aagaagacagaagatc

SEQ ID NO: 15402 - DNA, 16 bp, H. sapiens
aagaagacagtaaaat

SEQ ID NO: 15403 - DNA, 16 bp, H. sapiens
aagaagacatactaat

SEQ ID NO: 15404 - DNA, 16 bp, H. sapiens
aagaagacatggaaat

SEQ ID NO: 15405 - DNA, 16 bp, H. sapiens
aagaagacattgttat

SEQ ID NO: 15406 - DNA, 16 bp, H. sapiens
aagaagacattttctt

SEQ ID NO: 15407 - DNA, 16 bp, H. sapiens
aagaagaccccatctc

SEQ ID NO: 15408 - DNA, 16 bp, H. sapiens
aagaagactgagaagg

SEQ ID NO: 15409 - DNA, 16 bp, H. sapiens
aagaagagaaaactgg

SEQ ID NO: 15410 - DNA, 16 bp, H. sapiens
aagaagagaaaagcat

SEQ ID NO: 15411 - DNA, 16 bp, H. sapiens
aagaagagaaaatttg

SEQ ID NO: 15412 - DNA, 16 bp, H. sapiens
aagaagagaaatccaa

SEQ ID NO: 15413 - DNA, 16 bp, H. sapiens
aagaagagaaatctaa

SEQ ID NO: 15414 - DNA, 16 bp, H. sapiens
aagaagagaaatctga

SEQ ID NO: 15415 - DNA, 16 bp, H. sapiens
aagaagagaagtttag

SEQ ID NO: 15416 - DNA, 16 bp, H. sapiens
aagaagagacctggag

SEQ ID NO: 15417 - DNA, 16 bp, H. sapiens
aagaagagagaaaact

SEQ ID NO: 15418 - DNA, 16 bp, H. sapiens
aagaagagatttttaa

SEQ ID NO: 15419 - DNA, 16 bp, H. sapiens
aagaagagcaacccca

SEQ ID NO: 15420 - DNA, 16 bp, H. sapiens
aagaagagcccaaata

SEQ ID NO: 15421 - DNA, 16 bp, H. sapiens
aagaagagcctaagga

SEQ ID NO: 15422 - DNA, 16 bp, H. sapiens
aagaagagctcactat

SEQ ID NO: 15423 - DNA, 16 bp, H. sapiens
aagaagagctggcacc

SEQ ID NO: 15424 - DNA, 16 bp, H. sapiens
aagaagaggccagaga

SEQ ID NO: 15425 - DNA, 16 bp, H. sapiens
aagaagagggaattct

SEQ ID NO: 15426 - DNA, 16 bp, H. sapiens
aagaagagtttttaaa

SEQ ID NO: 15427 - DNA, 16 bp, H. sapiens
aagaagatatacagat

SEQ ID NO: 15428 - DNA, 16 bp, H. sapiens
aagaagatattcagat

SEQ ID NO: 15429 - DNA, 16 bp, H. sapiens
aagaagatatttattt

SEQ ID NO: 15430 - DNA, 16 bp, H. sapiens
aagaagatcaccctca

SEQ ID NO: 15431 - DNA, 16 bp, H. sapiens
aagaagatctctcaaa

SEQ ID NO: 15432 - DNA, 16 bp, H. sapiens
aagaagatgatattac

SEQ ID NO: 15433 - DNA, 16 bp, H. sapiens
aagaagattaaaatca

SEQ ID NO: 15434 - DNA, 16 bp, H. sapiens
aagaagattcaaataa

SEQ ID NO: 15435 - DNA, 16 bp, H. sapiens
aagaagatttctcaaa

SEQ ID NO: 15436 - DNA, 16 bp, H. sapiens
aagaagcaaatgcaaa

SEQ ID NO: 15437 - DNA, 16 bp, H. sapiens
aagaagcaatctgtga

SEQ ID NO: 15438 - DNA, 16 bp, H. sapiens
aagaagcagaaaatat

SEQ ID NO: 15439 - DNA, 16 bp, H. sapiens
aagaagcagaaattct

SEQ ID NO: 15440 - DNA, 16 bp, H. sapiens
aagaagcagataaact

SEQ ID NO: 15441 - DNA, 16 bp, H. sapiens
aagaagcagcagcaga

SEQ ID NO: 15442 - DNA, 16 bp, H. sapiens
aagaagcagcagcagc

SEQ ID NO: 15443 - DNA, 16 bp, H. sapiens
aagaagcaggtggtga

SEQ ID NO: 15444 - DNA, 16 bp, H. sapiens
aagaagcagtgccaga

SEQ ID NO: 15445 - DNA, 16 bp, H. sapiens
aagaagcatatgaaaa

SEQ ID NO: 15446 - DNA, 17 bp, H. sapiens
aagaagcatgggtcagg

SEQ ID NO: 15447 - DNA, 16 bp, H. sapiens
aagaagcatggtgcca

SEQ ID NO: 15448 - DNA, 16 bp, H. sapiens
aagaagcatgtgaaaa

SEQ ID NO: 15449 - DNA, 16 bp, H. sapiens
aagaagccagacacag

SEQ ID NO: 15450 - DNA, 16 bp, H. sapiens
aagaagcccgcagtgc

SEQ ID NO: 15451 - DNA, 16 bp, H. sapiens
aagaagctagaaaaag

SEQ ID NO: 15452 - DNA, 16 bp, H. sapiens
aagaagctagagaaaa

SEQ ID NO: 15453 - DNA, 16 bp, H. sapiens
aagaagctctccagtg

SEQ ID NO: 15454 - DNA, 16 bp, H. sapiens
aagaagctgaagcagg

SEQ ID NO: 15455 - DNA, 16 bp, H. sapiens
aagaagctgaatctct

SEQ ID NO: 15456 - DNA, 16 bp, H. sapiens
aagaagctgagagaag

SEQ ID NO: 15457 - DNA, 16 bp, H. sapiens
aagaagctgcagaaga

SEQ ID NO: 15458 - DNA, 16 bp, H. sapiens
aagaagctgcagcaag

SEQ ID NO: 15459 - DNA, 16 bp, H. sapiens
aagaagctgggaccac

SEQ ID NO: 15460 - DNA, 16 bp, H. sapiens
aagaagctgggcatgg

SEQ ID NO: 15461 - DNA, 16 bp, H. sapiens
aagaagctggtggagc

SEQ ID NO: 15462 - DNA, 16 bp, H. sapiens
aagaagctgttctttc

SEQ ID NO: 15463 - DNA, 16 bp, H. sapiens
aagaagcttctgcaca

SEQ ID NO: 15464 - DNA, 16 bp, H. sapiens
aagaagctttaaaaaa

SEQ ID NO: 15465 - DNA, 16 bp, H. sapiens
aagaaggaaactgagg

SEQ ID NO: 15466 - DNA, 16 bp, H. sapiens
aagaaggaaattttaa

SEQ ID NO: 15467 - DNA, 16 bp, H. sapiens
aagaaggaattcagaa

SEQ ID NO: 15468 - DNA, 16 bp, H. sapiens
aagaaggaattttcaa

SEQ ID NO: 15469 - DNA, 16 bp, H. sapiens
aagaaggacatatttg

SEQ ID NO: 15470 - DNA, 16 bp, H. sapiens
aagaaggaggtttgtt

SEQ ID NO: 15471 - DNA, 16 bp, H. sapiens
aagaaggatggataca

SEQ ID NO: 15472 - DNA, 16 bp, H. sapiens
aagaaggatgtgtttg

SEQ ID NO: 15473 - DNA, 16 bp, H. sapiens
aagaaggcagacacaa

SEQ ID NO: 15474 - DNA, 16 bp, H. sapiens
aagaaggcatacaaat

SEQ ID NO: 15475 - DNA, 16 bp, H. sapiens
aagaaggcattgtttt

SEQ ID NO: 15476 - DNA, 16 bp, H. sapiens
aagaaggccagtgtgg

SEQ ID NO: 15477 - DNA, 16 bp, H. sapiens
aagaaggccattaaat

SEQ ID NO: 15478 - DNA, 16 bp, H. sapiens
aagaaggcggccatct

SEQ ID NO: 15479 - DNA, 16 bp, H. sapiens
aagaaggctcttgcca

SEQ ID NO: 15480 - DNA, 16 bp, H. sapiens
aagaaggctgtgatgt

SEQ ID NO: 15481 - DNA, 16 bp, H. sapiens
aagaagggaacagtag

SEQ ID NO: 15482 - DNA, 16 bp, H. sapiens
aagaagggaatttatt

SEQ ID NO: 15483 - DNA, 16 bp, H. sapiens
aagaagggccagatgg

SEQ ID NO: 15484 - DNA, 16 bp, H. sapiens
aagaaggggaaatttg

SEQ ID NO: 15485 - DNA, 17 bp, H. sapiens
aagaaggtaatgtggag

SEQ ID NO: 15486 - DNA, 16 bp, H. sapiens
aagaaggtgaaagacc

SEQ ID NO: 15487 - DNA, 16 bp, H. sapiens
aagaagtaaaagattt

SEQ ID NO: 15488 - DNA, 16 bp, H. sapiens
aagaagtaatttcaac

SEQ ID NO: 15489 - DNA, 16 bp, H. sapiens
aagaagtaattttttt

SEQ ID NO: 15490 - DNA, 16 bp, H. sapiens
aagaagtacattggtt

SEQ ID NO: 15491 - DNA, 16 bp, H. sapiens
aagaagtatggcaaga

SEQ ID NO: 15492 - DNA, 16 bp, H. sapiens
aagaagtcaaagagaa

SEQ ID NO: 15493 - DNA, 16 bp, H. sapiens
aagaagtcaaattatc

SEQ ID NO: 15494 - DNA, 16 bp, H. sapiens
aagaagtcagagaaaa

SEQ ID NO: 15495 - DNA, 16 bp, H. sapiens
aagaagtcagaggaaa

SEQ ID NO: 15496 - DNA, 16 bp, H. sapiens
aagaagtcagcagtct

SEQ ID NO: 15497 - DNA, 16 bp, H. sapiens
aagaagtgaaagatct

SEQ ID NO: 15498 - DNA, 16 bp, H. sapiens
aagaagttaaaacaga

SEQ ID NO: 15499 - DNA, 16 bp, H. sapiens
aagaagttaaacaaat

SEQ ID NO: 15500 - DNA, 16 bp, H. sapiens
aagaagttacagaaga

SEQ ID NO: 15501 - DNA, 16 bp, H. sapiens
aagaagttactgagaa

SEQ ID NO: 15502 - DNA, 16 bp, H. sapiens
aagaagttcctgagaa

SEQ ID NO: 15503 - DNA, 16 bp, H. sapiens
aagaagttctagagat

SEQ ID NO: 15504 - DNA, 16 bp, H. sapiens
aagaagttctctgaaa

SEQ ID NO: 15505 - DNA, 16 bp, H. sapiens
aagaagttctggagat

SEQ ID NO: 15506 - DNA, 16 bp, H. sapiens
aagaagttgaaaatat

SEQ ID NO: 15507 - DNA, 16 bp, H. sapiens
aagaagttgattccaa

SEQ ID NO: 15508 - DNA, 16 bp, H. sapiens
aagaagttgcagaaga

SEQ ID NO: 15509 - DNA, 16 bp, H. sapiens
aagaagtttctcggaa

SEQ ID NO: 15510 - DNA, 16 bp, H. sapiens
aagaagtttctgagaa

SEQ ID NO: 15511 - DNA, 16 bp, H. sapiens
aagaagtttgggacta

SEQ ID NO: 15512 - DNA, 16 bp, H. sapiens
aagaagttttaatttt

SEQ ID NO: 15513 - DNA, 16 bp, H. sapiens
aagaagtttttcagaa

SEQ ID NO: 15514 - DNA, 16 bp, H. sapiens
aagaagtttttgagaa

SEQ ID NO: 15515 - DNA, 16 bp, H. sapiens
aagaataaaatgccta

SEQ ID NO: 15516 - DNA, 16 bp, H. sapiens
aagaataaagctagag

SEQ ID NO: 15517 - DNA, 16 bp, H. sapiens
aagaataaagttggat

SEQ ID NO: 15518 - DNA, 16 bp, H. sapiens
aagaataaatttggag

SEQ ID NO: 15519 - DNA, 16 bp, H. sapiens
aagaataagagagctg

SEQ ID NO: 15520 - DNA, 16 bp, H. sapiens
aagaataaggacattc

SEQ ID NO: 15521 - DNA, 16 bp, H. sapiens
aagaataattagtgtt

SEQ ID NO: 15522 - DNA, 16 bp, H. sapiens
aagaatacaaaagtta

SEQ ID NO: 15523 - DNA, 16 bp, H. sapiens
aagaatacaaagagag

SEQ ID NO: 15524 - DNA, 16 bp, H. sapiens
aagaatacaataactg

SEQ ID NO: 15525 - DNA, 16 bp, H. sapiens
aagaatacaatgaaat

SEQ ID NO: 15526 - DNA, 16 bp, H. sapiens
aagaatacacactggg

SEQ ID NO: 15527 - DNA, 16 bp, H. sapiens
aagaatacagtataca

SEQ ID NO: 15528 - DNA, 16 bp, H. sapiens
aagaatacatacaaat

SEQ ID NO: 15529 - DNA, 16 bp, H. sapiens
aagaatacatatttat

SEQ ID NO: 15530 - DNA, 16 bp, H. sapiens
aagaataccacagagg

SEQ ID NO: 15531 - DNA, 16 bp, H. sapiens
aagaatacctgagact

SEQ ID NO: 15532 - DNA, 16 bp, H. sapiens
aagaatactcacaact

SEQ ID NO: 15533 - DNA, 17 bp, H. sapiens
aagaatagcatgggaaa

SEQ ID NO: 15534 - DNA, 16 bp, H. sapiens
aagaatataatacatt

SEQ ID NO: 15535 - DNA, 18 bp, H. sapiens
aagaatatccaggacttg

SEQ ID NO: 15536 - DNA, 16 bp, H. sapiens
aagaatatgtattctt

SEQ ID NO: 15537 - DNA, 16 bp, H. sapiens
aagaatatgttttgtt

SEQ ID NO: 15538 - DNA, 16 bp, H. sapiens
aagaatattcacaaat

SEQ ID NO: 15539 - DNA, 16 bp, H. sapiens
aagaatattcagaaaa

SEQ ID NO: 15540 - DNA, 16 bp, H. sapiens
aagaatattgattttt

SEQ ID NO: 15541 - DNA, 16 bp, H. sapiens
aagaatattttattgt

SEQ ID NO: 15542 - DNA, 16 bp, H. sapiens
aagaatattttcactg

SEQ ID NO: 15543 - DNA, 16 bp, H. sapiens
aagaatattttctttt

SEQ ID NO: 15544 - DNA, 16 bp, H. sapiens
aagaatattttgaaat

SEQ ID NO: 15545 - DNA, 16 bp, H. sapiens
aagaatcaaatattta

SEQ ID NO: 15546 - DNA, 16 bp, H. sapiens
aagaatcaatatgtca

SEQ ID NO: 15547 - DNA, 16 bp, H. sapiens
aagaatcatttgcatt

SEQ ID NO: 15548 - DNA, 16 bp, H. sapiens
aagaatccatctcaaa

SEQ ID NO: 15549 - DNA, 16 bp, H. sapiens
aagaatcctaaaagca

SEQ ID NO: 15550 - DNA, 16 bp, H. sapiens
aagaatcgcttgaaca

SEQ ID NO: 15551 - DNA, 16 bp, H. sapiens
aagaatctctgggaca

SEQ ID NO: 15552 - DNA, 16 bp, H. sapiens
aagaatctgaaaaaga

SEQ ID NO: 15553 - DNA, 16 bp, H. sapiens
aagaatctgaggctca

SEQ ID NO: 15554 - DNA, 16 bp, H. sapiens
aagaatctttttaaaa

SEQ ID NO: 15555 - DNA, 16 bp, H. sapiens
aagaatcttttttttt

SEQ ID NO: 15556 - DNA, 16 bp, H. sapiens
aagaatgaaaacattt

SEQ ID NO: 15557 - DNA, 16 bp, H. sapiens
aagaatgaaaaggaac

SEQ ID NO: 15558 - DNA, 16 bp, H. sapiens
aagaatgaaatactgt

SEQ ID NO: 15559 - DNA, 16 bp, H. sapiens
aagaatgaaatagaca

SEQ ID NO: 15560 - DNA, 16 bp, H. sapiens
aagaatgaaattatgt

SEQ ID NO: 15561 - DNA, 16 bp, H. sapiens
aagaatgaaattctgt

SEQ ID NO: 15562 - DNA, 16 bp, H. sapiens
aagaatgaaattcttt

SEQ ID NO: 15563 - DNA, 16 bp, H. sapiens
aagaatgaaattgaac

SEQ ID NO: 15564 - DNA, 16 bp, H. sapiens
aagaatgaagcaatga

SEQ ID NO: 15565 - DNA, 16 bp, H. sapiens
aagaatgaagctgccg

SEQ ID NO: 15566 - DNA, 16 bp, H. sapiens
aagaatgaaggttttt

SEQ ID NO: 15567 - DNA, 16 bp, H. sapiens
aagaatgaatgctttc

SEQ ID NO: 15568 - DNA, 16 bp, H. sapiens
aagaatgaatggatgg

SEQ ID NO: 15569 - DNA, 16 bp, H. sapiens
aagaatgagaacatgt

SEQ ID NO: 15570 - DNA, 16 bp, H. sapiens
aagaatgagacaggaa

SEQ ID NO: 15571 - DNA, 16 bp, H. sapiens
aagaatgagaggaagc

SEQ ID NO: 15572 - DNA, 16 bp, H. sapiens
aagaatgagatccagt

SEQ ID NO: 15573 - DNA, 16 bp, H. sapiens
aagaatgagattgtgt

SEQ ID NO: 15574 - DNA, 16 bp, H. sapiens
aagaatgaggatatgc

SEQ ID NO: 15575 - DNA, 16 bp, H. sapiens
aagaatgatacaatgg

SEQ ID NO: 15576 - DNA, 16 bp, H. sapiens
aagaatgatcaattaa

SEQ ID NO: 15577 - DNA, 16 bp, H. sapiens
aagaatgatgatgata

SEQ ID NO: 15578 - DNA, 16 bp, H. sapiens
aagaatgatgatggca

SEQ ID NO: 15579 - DNA, 16 bp, H. sapiens
aagaatgatgatggta

SEQ ID NO: 15580 - DNA, 16 bp, H. sapiens
aagaatgcaaaatggt

SEQ ID NO: 15581 - DNA, 31 bp, H. sapiens
aagaatgcaattaactgataagatactgtgg

SEQ ID NO: 15582 - DNA, 16 bp, H. sapiens
aagaatgcaattccat

SEQ ID NO: 15583 - DNA, 16 bp, H. sapiens
aagaatgcccactttt

SEQ ID NO: 15584 - DNA, 16 bp, H. sapiens
aagaatgccctctctc

SEQ ID NO: 15585 - DNA, 16 bp, H. sapiens
aagaatgcctttaagc

SEQ ID NO: 15586 - DNA, 16 bp, H. sapiens
aagaatgcctttaagt

SEQ ID NO: 15587 - DNA, 16 bp, H. sapiens
aagaatgcttcaaaga

SEQ ID NO: 15588 - DNA, 16 bp, H. sapiens
aagaatgcttttgatt

SEQ ID NO: 15589 - DNA, 16 bp, H. sapiens
aagaatggaaaaccaa

SEQ ID NO: 15590 - DNA, 16 bp, H. sapiens
aagaatggaatagtga

SEQ ID NO: 15591 - DNA, 16 bp, H. sapiens
aagaatggtttcatgg

SEQ ID NO: 15592 - DNA, 16 bp, H. sapiens
aagaatgtaattattt

SEQ ID NO: 15593 - DNA, 16 bp, H. sapiens
aagaatgtaattctct

SEQ ID NO: 15594 - DNA, 16 bp, H. sapiens
aagaatgtattgattt

SEQ ID NO: 15595 - DNA, 16 bp, H. sapiens
aagaatgtcactttct

SEQ ID NO: 15596 - DNA, 16 bp, H. sapiens
aagaatgtcattagta

SEQ ID NO: 15597 - DNA, 16 bp, H. sapiens
aagaatgtcattgtta

SEQ ID NO: 15598 - DNA, 16 bp, H. sapiens
aagaatgtgaaaagat

SEQ ID NO: 15599 - DNA, 16 bp, H. sapiens
aagaatgtggaaaaac

SEQ ID NO: 15600 - DNA, 16 bp, H. sapiens
aagaatgtggaaagac

SEQ ID NO: 15601 - DNA, 16 bp, H. sapiens
aagaatgtggagaaac

SEQ ID NO: 15602 - DNA, 16 bp, H. sapiens
aagaatgtggcaaaac

SEQ ID NO: 15603 - DNA, 16 bp, H. sapiens
aagaatgttcatagca

SEQ ID NO: 15604 - DNA, 16 bp, H. sapiens
aagaatgttgaaaata

SEQ ID NO: 15605 - DNA, 16 bp, H. sapiens
aagaatgtttacagca

SEQ ID NO: 15606 - DNA, 16 bp, H. sapiens
aagaatgtttatagca

SEQ ID NO: 15607 - DNA, 16 bp, H. sapiens
aagaatgtttcaactc

SEQ ID NO: 15608 - DNA, 16 bp, H. sapiens
aagaatgtttcctttt

SEQ ID NO: 15609 - DNA, 16 bp, H. sapiens
aagaattaaaaatact

SEQ ID NO: 15610 - DNA, 16 bp, H. sapiens
aagaattagaaaagca

SEQ ID NO: 15611 - DNA, 16 bp, H. sapiens
aagaattagagaaaca

SEQ ID NO: 15612 - DNA, 16 bp, H. sapiens
aagaattatactaaat

SEQ ID NO: 15613 - DNA, 16 bp, H. sapiens
aagaattcaaagcata

SEQ ID NO: 15614 - DNA, 16 bp, H. sapiens
aagaattcaaggccag

SEQ ID NO: 15615 - DNA, 16 bp, H. sapiens
aagaattcaagggtga

SEQ ID NO: 15616 - DNA, 16 bp, H. sapiens
aagaattcaccaacca

SEQ ID NO: 15617 - DNA, 16 bp, H. sapiens
aagaattcagaataat

SEQ ID NO: 15618 - DNA, 16 bp, H. sapiens
aagaattcagtaaagt

SEQ ID NO: 15619 - DNA, 16 bp, H. sapiens
aagaattccaattaat

SEQ ID NO: 15620 - DNA, 16 bp, H. sapiens
aagaattccctggatt

SEQ ID NO: 15621 - DNA, 16 bp, H. sapiens
aagaattcttatacac

SEQ ID NO: 15622 - DNA, 16 bp, H. sapiens
aagaattctttcaaaa

SEQ ID NO: 15623 - DNA, 16 bp, H. sapiens
aagaattgaaaacagg

SEQ ID NO: 15624 - DNA, 16 bp, H. sapiens
aagaattgagttttgg

SEQ ID NO: 15625 - DNA, 16 bp, H. sapiens
aagaattggataaatt

SEQ ID NO: 15626 - DNA, 16 bp, H. sapiens
aagaattggtccattt

SEQ ID NO: 15627 - DNA, 16 bp, H. sapiens
aagaattgtcttgagc

SEQ ID NO: 15628 - DNA, 16 bp, H. sapiens
aagaatttaaacaagc

SEQ ID NO: 15629 - DNA, 16 bp, H. sapiens
aagaatttaatccatt

SEQ ID NO: 15630 - DNA, 16 bp, H. sapiens
aagaatttatgactaa

SEQ ID NO: 15631 - DNA, 16 bp, H. sapiens
aagaatttattcattt

SEQ ID NO: 15632 - DNA, 16 bp, H. sapiens
aagaatttattgattt

SEQ ID NO: 15633 - DNA, 16 bp, H. sapiens
aagaatttatttttct

SEQ ID NO: 15634 - DNA, 16 bp, H. sapiens
aagaatttcaaaagaa

SEQ ID NO: 15635 - DNA, 16 bp, H. sapiens
aagaatttcagaagga

SEQ ID NO: 15636 - DNA, 16 bp, H. sapiens
aagaatttcataaaat

SEQ ID NO: 15637 - DNA, 16 bp, H. sapiens
aagaatttccagaact

SEQ ID NO: 15638 - DNA, 16 bp, H. sapiens
aagaatttctttttct

SEQ ID NO: 15639 - DNA, 16 bp, H. sapiens
aagaatttgaaaaaca

SEQ ID NO: 15640 - DNA, 16 bp, H. sapiens
aagaatttgaatctct

SEQ ID NO: 15641 - DNA, 16 bp, H. sapiens
aagaatttgaattttt

SEQ ID NO: 15642 - DNA, 16 bp, H. sapiens
aagaatttgagaagaa

SEQ ID NO: 15643 - DNA, 16 bp, H. sapiens
aagaatttgctttatg

SEQ ID NO: 15644 - DNA, 16 bp, H. sapiens
aagaatttggaaaaat

SEQ ID NO: 15645 - DNA, 16 bp, H. sapiens
aagaatttggagaaaa

SEQ ID NO: 15646 - DNA, 16 bp, H. sapiens
aagaatttggattttt

SEQ ID NO: 15647 - DNA, 16 bp, H. sapiens
aagaatttgtcatttt

SEQ ID NO: 15648 - DNA, 16 bp, H. sapiens
aagaatttgtccattt

SEQ ID NO: 15649 - DNA, 16 bp, H. sapiens
aagaattttcaaaaat

SEQ ID NO: 15650 - DNA, 16 bp, H. sapiens
aagaattttcaaacca

SEQ ID NO: 15651 - DNA, 16 bp, H. sapiens
aagaattttctaaaat

SEQ ID NO: 15652 - DNA, 16 bp, H. sapiens
aagaattttctttctt

SEQ ID NO: 15653 - DNA, 16 bp, H. sapiens
aagaattttgtatcca

SEQ ID NO: 15654 - DNA, 16 bp, H. sapiens
aagaattttgtttcca

SEQ ID NO: 15655 - DNA, 16 bp, H. sapiens
aagaatttttaaaagt

SEQ ID NO: 15656 - DNA, 16 bp, H. sapiens
aagaatttttcctttg

SEQ ID NO: 15657 - DNA, 16 bp, H. sapiens
aagaattttttcaatt

SEQ ID NO: 15658 - DNA, 16 bp, H. sapiens
aagaattttttgtttg

SEQ ID NO: 15659 - DNA, 16 bp, H. sapiens
aagacaaaaacaattt

SEQ ID NO: 15660 - DNA, 16 bp, H. sapiens
aagacaaaaacatttt

SEQ ID NO: 15661 - DNA, 16 bp, H. sapiens
aagacaaaaacctcat

SEQ ID NO: 15662 - DNA, 16 bp, H. sapiens
aagacaaaaatatttt

SEQ ID NO: 15663 - DNA, 16 bp, H. sapiens
aagacaaaatatattt

SEQ ID NO: 15664 - DNA, 16 bp, H. sapiens
aagacaaaatggagaa

SEQ ID NO: 15665 - DNA, 16 bp, H. sapiens
aagacaaaattaattt

SEQ ID NO: 15666 - DNA, 16 bp, H. sapiens
aagacaaaattagaga

SEQ ID NO: 15667 - DNA, 16 bp, H. sapiens
aagacaaacaccacat

SEQ ID NO: 15668 - DNA, 16 bp, H. sapiens
aagacaaacactgtat

SEQ ID NO: 15669 - DNA, 16 bp, H. sapiens
aagacaaacatcatat

SEQ ID NO: 15670 - DNA, 16 bp, H. sapiens
aagacaaacattgtat

SEQ ID NO: 15671 - DNA, 16 bp, H. sapiens
aagacaaactttgcat

SEQ ID NO: 15672 - DNA, 16 bp, H. sapiens
aagacaaagaaaggct

SEQ ID NO: 15673 - DNA, 16 bp, H. sapiens
aagacaaagagaagat

SEQ ID NO: 15674 - DNA, 16 bp, H. sapiens
aagacaaagatgccca

SEQ ID NO: 15675 - DNA, 16 bp, H. sapiens
aagacaaagattttta

SEQ ID NO: 15676 - DNA, 16 bp, H. sapiens
aagacaaagtccttgc

SEQ ID NO: 15677 - DNA, 16 bp, H. sapiens
aagacaaagttgaaaa

SEQ ID NO: 15678 - DNA, 16 bp, H. sapiens
aagacaaagtttaaaa

SEQ ID NO: 15679 - DNA, 16 bp, H. sapiens
aagacaaatctgaaaa

SEQ ID NO: 15680 - DNA, 16 bp, H. sapiens
aagacaaattataaat

SEQ ID NO: 15681 - DNA, 16 bp, H. sapiens
aagacaacatcagaaa

SEQ ID NO: 15682 - DNA, 16 bp, H. sapiens
aagacaactctaagaa

SEQ ID NO: 15683 - DNA, 16 bp, H. sapiens
aagacaactttttaaa

SEQ ID NO: 15684 - DNA, 16 bp, H. sapiens
aagacaaggagaaaat

SEQ ID NO: 15685 - DNA, 16 bp, H. sapiens
aagacaaggatgacca

SEQ ID NO: 15686 - DNA, 16 bp, H. sapiens
aagacaaggctttcaa

SEQ ID NO: 15687 - DNA, 16 bp, H. sapiens
aagacaaggttgccct

SEQ ID NO: 15688 - DNA, 16 bp, H. sapiens
aagacaataacaagtg

SEQ ID NO: 15689 - DNA, 16 bp, H. sapiens
aagacaatcagggaaa

SEQ ID NO: 15690 - DNA, 16 bp, H. sapiens
aagacaatccaggaaa

SEQ ID NO: 15691 - DNA, 16 bp, H. sapiens
aagacaatgaggaaaa

SEQ ID NO: 15692 - DNA, 16 bp, H. sapiens
aagacaatgatattga

SEQ ID NO: 15693 - DNA, 16 bp, H. sapiens
aagacaatgggaaaat

SEQ ID NO: 15694 - DNA, 16 bp, H. sapiens
aagacaatggggaaaa

SEQ ID NO: 15695 - DNA, 16 bp, H. sapiens
aagacaatggggtttt

SEQ ID NO: 15696 - DNA, 16 bp, H. sapiens
aagacaatttagaaaa

SEQ ID NO: 15697 - DNA, 16 bp, H. sapiens
aagacaattttgaaga

SEQ ID NO: 15698 - DNA, 19 bp, H. sapiens
aagacaatttttccatgga

SEQ ID NO: 15699 - DNA, 16 bp, H. sapiens
aagacaatttttcttc

SEQ ID NO: 15700 - DNA, 16 bp, H. sapiens
aagacaattttttaaa

SEQ ID NO: 15701 - DNA, 16 bp, H. sapiens
aagacacaaaaattag

SEQ ID NO: 15702 - DNA, 16 bp, H. sapiens
aagacacaaaatggca

SEQ ID NO: 15703 - DNA, 16 bp, H. sapiens
aagacacaaacaaatg

SEQ ID NO: 15704 - DNA, 16 bp, H. sapiens
aagacacacttttttt

SEQ ID NO: 15705 - DNA, 16 bp, H. sapiens
aagacacagaaataga

SEQ ID NO: 15706 - DNA, 16 bp, H. sapiens
aagacacagacacaga

SEQ ID NO: 15707 - DNA, 16 bp, H. sapiens
aagacacagactgaca

SEQ ID NO: 15708 - DNA, 16 bp, H. sapiens
aagacacagggtctca

SEQ ID NO: 15709 - DNA, 16 bp, H. sapiens
aagacacagttcctgc

SEQ ID NO: 15710 - DNA, 21 bp, H. sapiens
aagacacataattatcagatt

SEQ ID NO: 15711 - DNA, 27 bp, H. sapiens
aagacacataattgtcacattcaccaa

SEQ ID NO: 15712 - DNA, 21 bp, H. sapiens
aagacacataattgtcagact

SEQ ID NO: 15713 - DNA, 24 bp, H. sapiens
aagacacataattgtcagattcaa

SEQ ID NO: 15714 - DNA, 16 bp, H. sapiens
aagacacatcaaaaag

SEQ ID NO: 15715 - DNA, 16 bp, H. sapiens
aagacaccaaaagcag

SEQ ID NO: 15716 - DNA, 16 bp, H. sapiens
aagacaccaaattcca

SEQ ID NO: 15717 - DNA, 16 bp, H. sapiens
aagacaccatctctac

SEQ ID NO: 15718 - DNA, 16 bp, H. sapiens
aagacaccattaagaa

SEQ ID NO: 15719 - DNA, 16 bp, H. sapiens
aagacacctcctggtg

SEQ ID NO: 15720 - DNA, 16 bp, H. sapiens
aagacactttgggagg

SEQ ID NO: 15721 - DNA, 16 bp, H. sapiens
aagacagaaaagttct

SEQ ID NO: 15722 - DNA, 16 bp, H. sapiens
aagacagaaaatccaa

SEQ ID NO: 15723 - DNA, 16 bp, H. sapiens
aagacagaactaccat

SEQ ID NO: 15724 - DNA, 16 bp, H. sapiens
aagacagaagcagagg

SEQ ID NO: 15725 - DNA, 16 bp, H. sapiens
aagacagaatttaaaa

SEQ ID NO: 15726 - DNA, 16 bp, H. sapiens
aagacagaatttttaa

SEQ ID NO: 15727 - DNA, 16 bp, H. sapiens
aagacagaattttttt

SEQ ID NO: 15728 - DNA, 16 bp, H. sapiens
aagacagacaatacca

SEQ ID NO: 15729 - DNA, 16 bp, H. sapiens
aagacagactttaaac

SEQ ID NO: 15730 - DNA, 16 bp, H. sapiens
aagacagaggcagaga

SEQ ID NO: 15731 - DNA, 16 bp, H. sapiens
aagacagaggttgcag

SEQ ID NO: 15732 - DNA, 16 bp, H. sapiens
aagacagagtctcaca

SEQ ID NO: 15733 - DNA, 16 bp, H. sapiens
aagacagagtctcact

SEQ ID NO: 15734 - DNA, 16 bp, H. sapiens
aagacagattttattc

SEQ ID NO: 15735 - DNA, 16 bp, H. sapiens
aagacagcaccactgc

SEQ ID NO: 15736 - DNA, 16 bp, H. sapiens
aagacagcagccccag

SEQ ID NO: 15737 - DNA, 16 bp, H. sapiens
aagacagcagtggttc

SEQ ID NO: 15738 - DNA, 16 bp, H. sapiens
aagacagcatggtact

SEQ ID NO: 15739 - DNA, 16 bp, H. sapiens
aagacagcccacagaa

SEQ ID NO: 15740 - DNA, 16 bp, H. sapiens
aagacagctagagaga

SEQ ID NO: 15741 - DNA, 16 bp, H. sapiens
aagacaggaaaatgag

SEQ ID NO: 15742 - DNA, 16 bp, H. sapiens
aagacaggaggatcac

SEQ ID NO: 15743 - DNA, 16 bp, H. sapiens
aagacaggcaataatg

SEQ ID NO: 15744 - DNA, 16 bp, H. sapiens
aagacaggcagcccgg

SEQ ID NO: 15745 - DNA, 16 bp, H. sapiens
aagacagggtctcact

SEQ ID NO: 15746 - DNA, 16 bp, H. sapiens
aagacagggtcttgct

SEQ ID NO: 15747 - DNA, 19 bp, H. sapiens
aagacagggtttcaccatg

SEQ ID NO: 15748 - DNA, 16 bp, H. sapiens
aagacagggtttcatc

SEQ ID NO: 15749 - DNA, 18 bp, H. sapiens
aagacagggttttgccat

SEQ ID NO: 15750 - DNA, 16 bp, H. sapiens
aagacaggtttatttt

SEQ ID NO: 15751 - DNA, 16 bp, H. sapiens
aagacagtacaagaaa

SEQ ID NO: 15752 - DNA, 16 bp, H. sapiens
aagacagtgacattga

SEQ ID NO: 15753 - DNA, 16 bp, H. sapiens
aagacagtgggaaaaa

SEQ ID NO: 15754 - DNA, 16 bp, H. sapiens
aagacagtgtggtggt

SEQ ID NO: 15755 - DNA, 16 bp, H. sapiens
aagacagttgatttaa

SEQ ID NO: 15756 - DNA, 16 bp, H. sapiens
aagacagtttaaagcc

SEQ ID NO: 15757 - DNA, 16 bp, H. sapiens
aagacagttttacttt

SEQ ID NO: 15758 - DNA, 16 bp, H. sapiens
aagacagtttttattt

SEQ ID NO: 15759 - DNA, 16 bp, H. sapiens
aagacataaatggaaa

SEQ ID NO: 15760 - DNA, 16 bp, H. sapiens
aagacataaccaagac

SEQ ID NO: 15761 - DNA, 16 bp, H. sapiens
aagacatacaaatggg

SEQ ID NO: 15762 - DNA, 16 bp, H. sapiens
aagacatacatacagc

SEQ ID NO: 15763 - DNA, 21 bp, H. sapiens
aagacatataatcatcagatt

SEQ ID NO: 15764 - DNA, 16 bp, H. sapiens
aagacatatttaaaaa

SEQ ID NO: 15765 - DNA, 16 bp, H. sapiens
aagacatgaaaaacca

SEQ ID NO: 15766 - DNA, 16 bp, H. sapiens
aagacatgaaatcaac

SEQ ID NO: 15767 - DNA, 16 bp, H. sapiens
aagacatgaacagaaa

SEQ ID NO: 15768 - DNA, 16 bp, H. sapiens
aagacatgaagagaaa

SEQ ID NO: 15769 - DNA, 16 bp, H. sapiens
aagacatgaaggaacc

SEQ ID NO: 15770 - DNA, 16 bp, H. sapiens
aagacatgaataaatt

SEQ ID NO: 15771 - DNA, 16 bp, H. sapiens
aagacatgcccaccag

SEQ ID NO: 15772 - DNA, 16 bp, H. sapiens
aagacatggaaccaac

SEQ ID NO: 15773 - DNA, 16 bp, H. sapiens
aagacatggaataaat

SEQ ID NO: 15774 - DNA, 16 bp, H. sapiens
aagacattaaaatatt

SEQ ID NO: 15775 - DNA, 16 bp, H. sapiens
aagacattagaagaaa

SEQ ID NO: 15776 - DNA, 16 bp, H. sapiens
aagacattatcaagaa

SEQ ID NO: 15777 - DNA, 16 bp, H. sapiens
aagacattgaaagaaa

SEQ ID NO: 15778 - DNA, 16 bp, H. sapiens
aagacatttaaaaatg

SEQ ID NO: 15779 - DNA, 16 bp, H. sapiens
aagacatttaaaatga

SEQ ID NO: 15780 - DNA, 16 bp, H. sapiens
aagacatttcagagac

SEQ ID NO: 15781 - DNA, 16 bp, H. sapiens
aagacatttctaattt

SEQ ID NO: 15782 - DNA, 16 bp, H. sapiens
aagacattttaaattt

SEQ ID NO: 15783 - DNA, 16 bp, H. sapiens
aagacattttatttta

SEQ ID NO: 15784 - DNA, 16 bp, H. sapiens
aagacattttcactgg

SEQ ID NO: 15785 - DNA, 16 bp, H. sapiens
aagacatttttaaaag

SEQ ID NO: 15786 - DNA, 16 bp, H. sapiens
aagacatttttggttg

SEQ ID NO: 15787 - DNA, 16 bp, H. sapiens
aagacattttttaaaa

SEQ ID NO: 15788 - DNA, 16 bp, H. sapiens
aagacattttttgaaa

SEQ ID NO: 15789 - DNA, 16 bp, H. sapiens
aagaccaaacactgca

SEQ ID NO: 15790 - DNA, 16 bp, H. sapiens
aagaccaaatctaagt

SEQ ID NO: 15791 - DNA, 16 bp, H. sapiens
aagaccaacccctcct

SEQ ID NO: 15792 - DNA, 16 bp, H. sapiens
aagaccaacctaggca

SEQ ID NO: 15793 - DNA, 16 bp, H. sapiens
aagaccaacctggcca

SEQ ID NO: 15794 - DNA, 16 bp, H. sapiens
aagaccaacctggcta

SEQ ID NO: 15795 - DNA, 16 bp, H. sapiens
aagaccaacctggtca

SEQ ID NO: 15796 - DNA, 16 bp, H. sapiens
aagaccaagccatgat

SEQ ID NO: 15797 - DNA, 16 bp, H. sapiens
aagaccactctggcca

SEQ ID NO: 15798 - DNA, 16 bp, H. sapiens
aagaccagcaagaaga

SEQ ID NO: 15799 - DNA, 16 bp, H. sapiens
aagaccagccagacca

SEQ ID NO: 15800 - DNA, 16 bp, H. sapiens
aagaccagccctggca

SEQ ID NO: 15801 - DNA, 16 bp, H. sapiens
aagaccagcctgagca

SEQ ID NO: 15802 - DNA, 17 bp, H. sapiens
aagaccagcctggacaa

SEQ ID NO: 15803 - DNA, 16 bp, H. sapiens
aagaccagcctgttca

SEQ ID NO: 15804 - DNA, 19 bp, H. sapiens
aagaccagctctggctaag

SEQ ID NO: 15805 - DNA, 16 bp, H. sapiens
aagaccagcttggcca

SEQ ID NO: 15806 - DNA, 16 bp, H. sapiens
aagaccagtcagggca

SEQ ID NO: 15807 - DNA, 16 bp, H. sapiens
aagaccagtctgggaa

SEQ ID NO: 15808 - DNA, 16 bp, H. sapiens
aagaccagtgatgatg

SEQ ID NO: 15809 - DNA, 16 bp, H. sapiens
aagaccatcatggcca

SEQ ID NO: 15810 - DNA, 16 bp, H. sapiens
aagaccatcctggcaa

SEQ ID NO: 15811 - DNA, 16 bp, H. sapiens
aagaccatgggaaaag

SEQ ID NO: 15812 - DNA, 16 bp, H. sapiens
aagaccattggaaaaa

SEQ ID NO: 15813 - DNA, 16 bp, H. sapiens
aagacccaaaactata

SEQ ID NO: 15814 - DNA, 16 bp, H. sapiens
aagacccactggcttg

SEQ ID NO: 15815 - DNA, 16 bp, H. sapiens
aagacccagcaattcc

SEQ ID NO: 15816 - DNA, 16 bp, H. sapiens
aagacccagtgctgtg

SEQ ID NO: 15817 - DNA, 16 bp, H. sapiens
aagaccccattctcca

SEQ ID NO: 15818 - DNA, 16 bp, H. sapiens
aagacccccatctcta

SEQ ID NO: 15819 - DNA, 17 bp, H. sapiens
aagaccccgtctctact

SEQ ID NO: 15820 - DNA, 16 bp, H. sapiens
aagaccctatctctga

SEQ ID NO: 15821 - DNA, 16 bp, H. sapiens
aagaccctatttccaa

SEQ ID NO: 15822 - DNA, 20 bp, H. sapiens
aagaccctgtctcaaaaaat

SEQ ID NO: 15823 - DNA, 16 bp, H. sapiens
aagaccctgtctcaat

SEQ ID NO: 15824 - DNA, 16 bp, H. sapiens
aagaccctgtctccaa

SEQ ID NO: 15825 - DNA, 16 bp, H. sapiens
aagaccctgtcttgaa

SEQ ID NO: 15826 - DNA, 16 bp, H. sapiens
aagacccttgtctcta

SEQ ID NO: 15827 - DNA, 16 bp, H. sapiens
aagacctcaaaatata

SEQ ID NO: 15828 - DNA, 16 bp, H. sapiens
aagacctcatctccaa

SEQ ID NO: 15829 - DNA, 16 bp, H. sapiens
aagacctcatctttac

SEQ ID NO: 15830 - DNA, 19 bp, H. sapiens
aagacctcttcaaggagaa

SEQ ID NO: 15831 - DNA, 16 bp, H. sapiens
aagacctgaaagtcaa

SEQ ID NO: 15832 - DNA, 16 bp, H. sapiens
aagacctgaaatcata

SEQ ID NO: 15833 - DNA, 16 bp, H. sapiens
aagacctgaagacaga

SEQ ID NO: 15834 - DNA, 16 bp, H. sapiens
aagacctgcccctgtg

SEQ ID NO: 15835 - DNA, 16 bp, H. sapiens
aagacctggaacaaga

SEQ ID NO: 15836 - DNA, 16 bp, H. sapiens
aagacctggaatccat

SEQ ID NO: 15837 - DNA, 16 bp, H. sapiens
aagaccttcctggcca

SEQ ID NO: 15838 - DNA, 18 bp, H. sapiens
aagaccttgctgataaaa

SEQ ID NO: 15839 - DNA, 16 bp, H. sapiens
aagacgaggatgccca

SEQ ID NO: 15840 - DNA, 16 bp, H. sapiens
aagacgatgaggatga

SEQ ID NO: 15841 - DNA, 16 bp, H. sapiens
aagacggagtttcacc

SEQ ID NO: 15842 - DNA, 16 bp, H. sapiens
aagactaaataatatt

SEQ ID NO: 15843 - DNA, 16 bp, H. sapiens
aagactaagagcttta

SEQ ID NO: 15844 - DNA, 16 bp, H. sapiens
aagactacatactggg

SEQ ID NO: 15845 - DNA, 16 bp, H. sapiens
aagactacattttcca

SEQ ID NO: 15846 - DNA, 16 bp, H. sapiens
aagactactttaaagt

SEQ ID NO: 15847 - DNA, 16 bp, H. sapiens
aagactagcctgggaa

SEQ ID NO: 15848 - DNA, 16 bp, H. sapiens
aagactaggaagaaac

SEQ ID NO: 15849 - DNA, 16 bp, H. sapiens
aagactatcctgggca

SEQ ID NO: 15850 - DNA, 16 bp, H. sapiens
aagactattgcaatag

SEQ ID NO: 15851 - DNA, 16 bp, H. sapiens
aagactccacaagaaa

SEQ ID NO: 15852 - DNA, 16 bp, H. sapiens
aagactccagctcaaa

SEQ ID NO: 15853 - DNA, 16 bp, H. sapiens
aagactccatcacaca

SEQ ID NO: 15854 - DNA, 16 bp, H. sapiens
aagactccatcataaa

SEQ ID NO: 15855 - DNA, 17 bp, H. sapiens
aagactccatctcaaaa

SEQ ID NO: 15856 - DNA, 16 bp, H. sapiens
aagactccgtctctac

SEQ ID NO: 15857 - DNA, 16 bp, H. sapiens
aagactccttctccaa

SEQ ID NO: 15858 - DNA, 16 bp, H. sapiens
aagactctctattcaa

SEQ ID NO: 15859 - DNA, 16 bp, H. sapiens
aagactctgactctaa

SEQ ID NO: 15860 - DNA, 16 bp, H. sapiens
aagactctgctcctcc

SEQ ID NO: 15861 - DNA, 16 bp, H. sapiens
aagactctgtcccccc

SEQ ID NO: 15862 - DNA, 16 bp, H. sapiens
aagactctgtcttaaa

SEQ ID NO: 15863 - DNA, 16 bp, H. sapiens
aagactcttaaaaaaa

SEQ ID NO: 15864 - DNA, 16 bp, H. sapiens
aagactcttccaaaag

SEQ ID NO: 15865 - DNA, 16 bp, H. sapiens
aagactcttttttttt

SEQ ID NO: 15866 - DNA, 16 bp, H. sapiens
aagactgaaccagaaa

SEQ ID NO: 15867 - DNA, 16 bp, H. sapiens
aagactgaactaggaa

SEQ ID NO: 15868 - DNA, 16 bp, H. sapiens
aagactgaagcagaaa

SEQ ID NO: 15869 - DNA, 16 bp, H. sapiens
aagactgaataatgaa

SEQ ID NO: 15870 - DNA, 16 bp, H. sapiens
aagactgacaatatca

SEQ ID NO: 15871 - DNA, 16 bp, H. sapiens
aagactgagaaagaaa

SEQ ID NO: 15872 - DNA, 16 bp, H. sapiens
aagactgagaagaaaa

SEQ ID NO: 15873 - DNA, 16 bp, H. sapiens
aagactgagccaggaa

SEQ ID NO: 15874 - DNA, 16 bp, H. sapiens
aagactgaggcacaga

SEQ ID NO: 15875 - DNA, 16 bp, H. sapiens
aagactgatttttaaa

SEQ ID NO: 15876 - DNA, 16 bp, H. sapiens
aagactgcagaggtta

SEQ ID NO: 15877 - DNA, 16 bp, H. sapiens
aagactgcagtgagct

SEQ ID NO: 15878 - DNA, 16 bp, H. sapiens
aagactgcccttgcca

SEQ ID NO: 15879 - DNA, 16 bp, H. sapiens
aagactggaaagaaat

SEQ ID NO: 15880 - DNA, 16 bp, H. sapiens
aagactgggcaacata

SEQ ID NO: 15881 - DNA, 16 bp, H. sapiens
aagactggggagaaaa

SEQ ID NO: 15882 - DNA, 16 bp, H. sapiens
aagactggtctcaaac

SEQ ID NO: 15883 - DNA, 16 bp, H. sapiens
aagactgtttccaaat

SEQ ID NO: 15884 - DNA, 16 bp, H. sapiens
aagactgtttccaagc

SEQ ID NO: 15885 - DNA, 16 bp, H. sapiens
aagacttaatattttt

SEQ ID NO: 15886 - DNA, 16 bp, H. sapiens
aagacttagtacaaaa

SEQ ID NO: 15887 - DNA, 16 bp, H. sapiens
aagacttcatctccaa

SEQ ID NO: 15888 - DNA, 16 bp, H. sapiens
aagacttcccttttct

SEQ ID NO: 15889 - DNA, 16 bp, H. sapiens
aagacttcctggagga

SEQ ID NO: 15890 - DNA, 27 bp, H. sapiens
aagacttggaaccaacccaaatgtccg

SEQ ID NO: 15891 - DNA, 16 bp, H. sapiens
aagacttgggggactg

SEQ ID NO: 15892 - DNA, 16 bp, H. sapiens
aagactttctctttct

SEQ ID NO: 15893 - DNA, 16 bp, H. sapiens
aagactttggaggact

SEQ ID NO: 15894 - DNA, 16 bp, H. sapiens
aagactttgtctccaa

SEQ ID NO: 15895 - DNA, 16 bp, H. sapiens
aagacttttctttata

SEQ ID NO: 15896 - DNA, 16 bp, H. sapiens
aagactttttaaaagt

SEQ ID NO: 15897 - DNA, 16 bp, H. sapiens
aagactttttaatttt

SEQ ID NO: 15898 - DNA, 16 bp, H. sapiens
aagacttttttttttc

SEQ ID NO: 15899 - DNA, 16 bp, H. sapiens
aagagaaaaaagactg

SEQ ID NO: 15900 - DNA, 16 bp, H. sapiens
aagagaaaaacaatcc

SEQ ID NO: 15901 - DNA, 16 bp, H. sapiens
aagagaaaaactggaa

SEQ ID NO: 15902 - DNA, 16 bp, H. sapiens
aagagaaaaagactga

SEQ ID NO: 15903 - DNA, 16 bp, H. sapiens
aagagaaaaataactt

SEQ ID NO: 15904 - DNA, 16 bp, H. sapiens
aagagaaaaatatttg

SEQ ID NO: 15905 - DNA, 16 bp, H. sapiens
aagagaaaaatctcaa

SEQ ID NO: 15906 - DNA, 16 bp, H. sapiens
aagagaaaaatctttc

SEQ ID NO: 15907 - DNA, 16 bp, H. sapiens
aagagaaaaatgtgtg

SEQ ID NO: 15908 - DNA, 16 bp, H. sapiens
aagagaaaaattccat

SEQ ID NO: 15909 - DNA, 16 bp, H. sapiens
aagagaaaacagctgg

SEQ ID NO: 15910 - DNA, 16 bp, H. sapiens
aagagaaaacccacag

SEQ ID NO: 15911 - DNA, 16 bp, H. sapiens
aagagaaaactggaaa

SEQ ID NO: 15912 - DNA, 16 bp, H. sapiens
aagagaaaagactcaa

SEQ ID NO: 15913 - DNA, 16 bp, H. sapiens
aagagaaaagcatcta

SEQ ID NO: 15914 - DNA, 16 bp, H. sapiens
aagagaaaagtgagtg

SEQ ID NO: 15915 - DNA, 16 bp, H. sapiens
aagagaaaataagttt

SEQ ID NO: 15916 - DNA, 16 bp, H. sapiens
aagagaaaatatttct

SEQ ID NO: 15917 - DNA, 16 bp, H. sapiens
aagagaaaatatttgc

SEQ ID NO: 15918 - DNA, 16 bp, H. sapiens
aagagaaaatattttc

SEQ ID NO: 15919 - DNA, 16 bp, H. sapiens
aagagaaaatctgttt

SEQ ID NO: 15920 - DNA, 16 bp, H. sapiens
aagagaaaatgaaagc

SEQ ID NO: 15921 - DNA, 16 bp, H. sapiens
aagagaaaatgacaga

SEQ ID NO: 15922 - DNA, 16 bp, H. sapiens
aagagaaaatggaaac

SEQ ID NO: 15923 - DNA, 16 bp, H. sapiens
aagagaaaattttgaa

SEQ ID NO: 15924 - DNA, 16 bp, H. sapiens
aagagaaactagaaat

SEQ ID NO: 15925 - DNA, 16 bp, H. sapiens
aagagaaactatttta

SEQ ID NO: 15926 - DNA, 16 bp, H. sapiens
aagagaaactctcaaa

SEQ ID NO: 15927 - DNA, 16 bp, H. sapiens
aagagaaagcagctgg

SEQ ID NO: 15928 - DNA, 16 bp, H. sapiens
aagagaaagtatattt

SEQ ID NO: 15929 - DNA, 16 bp, H. sapiens
aagagaaatgcagaaa

SEQ ID NO: 15930 - DNA, 16 bp, H. sapiens
aagagaaatgcttcca

SEQ ID NO: 15931 - DNA, 16 bp, H. sapiens
aagagaaatgttttct

SEQ ID NO: 15932 - DNA, 16 bp, H. sapiens
aagagaaattatattt

SEQ ID NO: 15933 - DNA, 16 bp, H. sapiens
aagagaaattattttt

SEQ ID NO: 15934 - DNA, 16 bp, H. sapiens
aagagaaattcaaatt

SEQ ID NO: 15935 - DNA, 16 bp, H. sapiens
aagagaaatttcaaaa

SEQ ID NO: 15936 - DNA, 16 bp, H. sapiens
aagagaaattttaaag

SEQ ID NO: 15937 - DNA, 16 bp, H. sapiens
aagagaaattttggaa

SEQ ID NO: 15938 - DNA, 16 bp, H. sapiens
aagagaaccaggaagt

SEQ ID NO: 15939 - DNA, 16 bp, H. sapiens
aagagaagaaatattt

SEQ ID NO: 15940 - DNA, 16 bp, H. sapiens
aagagaagaatttgaa

SEQ ID NO: 15941 - DNA, 16 bp, H. sapiens
aagagaagattctcaa

SEQ ID NO: 15942 - DNA, 16 bp, H. sapiens
aagagaagcattctca

SEQ ID NO: 15943 - DNA, 16 bp, H. sapiens
aagagaagctgaaaat

SEQ ID NO: 15944 - DNA, 16 bp, H. sapiens
aagagaagctttgttt

SEQ ID NO: 15945 - DNA, 16 bp, H. sapiens
aagagaaggacccagt

SEQ ID NO: 15946 - DNA, 16 bp, H. sapiens
aagagaataattcaaa

SEQ ID NO: 15947 - DNA, 16 bp, H. sapiens
aagagaatacagcaaa

SEQ ID NO: 15948 - DNA, 16 bp, H. sapiens
aagagaatactatgaa

SEQ ID NO: 15949 - DNA, 16 bp, H. sapiens
aagagaatagagaact

SEQ ID NO: 15950 - DNA, 16 bp, H. sapiens
aagagaatataacaat

SEQ ID NO: 15951 - DNA, 16 bp, H. sapiens
aagagaatatatttct

SEQ ID NO: 15952 - DNA, 16 bp, H. sapiens
aagagaatattatgaa

SEQ ID NO: 15953 - DNA, 16 bp, H. sapiens
aagagaatattggaat

SEQ ID NO: 15954 - DNA, 16 bp, H. sapiens
aagagaatcacatgaa

SEQ ID NO: 15955 - DNA, 16 bp, H. sapiens
aagagaatctggctgc

SEQ ID NO: 15956 - DNA, 16 bp, H. sapiens
aagagaatgaaatatc

SEQ ID NO: 15957 - DNA, 16 bp, H. sapiens
aagagaatgaaatcat

SEQ ID NO: 15958 - DNA, 16 bp, H. sapiens
aagagaatgattaaat

SEQ ID NO: 15959 - DNA, 16 bp, H. sapiens
aagagaatgtctttgt

SEQ ID NO: 15960 - DNA, 16 bp, H. sapiens
aagagaatgtggagaa

SEQ ID NO: 15961 - DNA, 16 bp, H. sapiens
aagagaattgaaaaca

SEQ ID NO: 15962 - DNA, 16 bp, H. sapiens
aagagaattgcctgaa

SEQ ID NO: 15963 - DNA, 16 bp, H. sapiens
aagagaatttcagacc

SEQ ID NO: 15964 - DNA, 16 bp, H. sapiens
aagagaatttcaggcc

SEQ ID NO: 15965 - DNA, 16 bp, H. sapiens
aagagacaaaggaggc

SEQ ID NO: 15966 - DNA, 16 bp, H. sapiens
aagagacaagatcttg

SEQ ID NO: 15967 - DNA, 16 bp, H. sapiens
aagagacacagagaca

SEQ ID NO: 15968 - DNA, 16 bp, H. sapiens
aagagacagggtttta

SEQ ID NO: 15969 - DNA, 16 bp, H. sapiens
aagagacatttatttt

SEQ ID NO: 15970 - DNA, 16 bp, H. sapiens
aagagaccaaagaatg

SEQ ID NO: 15971 - DNA, 16 bp, H. sapiens
aagagactaacatttg

SEQ ID NO: 15972 - DNA, 16 bp, H. sapiens
aagagactctgatgca

SEQ ID NO: 15973 - DNA, 16 bp, H. sapiens
aagagactgaagaaaa

SEQ ID NO: 15974 - DNA, 16 bp, H. sapiens
aagagactgagaaaga

SEQ ID NO: 15975 - DNA, 16 bp, H. sapiens
aagagactggtgacat

SEQ ID NO: 15976 - DNA, 18 bp, H. sapiens
aagagacttagattccca

SEQ ID NO: 15977 - DNA, 16 bp, H. sapiens
aagagacttggactcc

SEQ ID NO: 15978 - DNA, 16 bp, H. sapiens
aagagactttcctttc

SEQ ID NO: 15979 - DNA, 16 bp, H. sapiens
aagagagaaactgtct

SEQ ID NO: 15980 - DNA, 16 bp, H. sapiens
aagagagaaatattca

SEQ ID NO: 15981 - DNA, 16 bp, H. sapiens
aagagagaaatgattt

SEQ ID NO: 15982 - DNA, 16 bp, H. sapiens
aagagagaagactcaa

SEQ ID NO: 15983 - DNA, 16 bp, H. sapiens
aagagagaagattcaa

SEQ ID NO: 15984 - DNA, 16 bp, H. sapiens
aagagagaatcttaaa

SEQ ID NO: 15985 - DNA, 16 bp, H. sapiens
aagagagagaaactga

SEQ ID NO: 15986 - DNA, 16 bp, H. sapiens
aagagagagacagaat

SEQ ID NO: 15987 - DNA, 16 bp, H. sapiens
aagagagagactccat

SEQ ID NO: 15988 - DNA, 16 bp, H. sapiens
aagagagagagcatgt

SEQ ID NO: 15989 - DNA, 16 bp, H. sapiens
aagagagaggccaggc

SEQ ID NO: 15990 - DNA, 16 bp, H. sapiens
aagagagatagtttga

SEQ ID NO: 15991 - DNA, 16 bp, H. sapiens
aagagagatattttga

SEQ ID NO: 15992 - DNA, 21 bp, H. sapiens
aagagagatcagattgttact

SEQ ID NO: 15993 - DNA, 16 bp, H. sapiens
aagagagctctggctg

SEQ ID NO: 15994 - DNA, 16 bp, H. sapiens
aagagaggaagtcaaa

SEQ ID NO: 15995 - DNA, 16 bp, H. sapiens
aagagaggccaggcat

SEQ ID NO: 15996 - DNA, 17 bp, H. sapiens
aagagaggctgggatga

SEQ ID NO: 15997 - DNA, 16 bp, H. sapiens
aagagaggctgggatt

SEQ ID NO: 15998 - DNA, 16 bp, H. sapiens
aagagagggcatccct

SEQ ID NO: 15999 - DNA, 16 bp, H. sapiens
aagagagtcagtgaag

SEQ ID NO: 16000 - DNA, 16 bp, H. sapiens
aagagagtcctcacca

SEQ ID NO: 16001 - DNA, 16 bp, H. sapiens
aagagataaaagcaga

SEQ ID NO: 16002 - DNA, 16 bp, H. sapiens
aagagatatgtgcact

SEQ ID NO: 16003 - DNA, 16 bp, H. sapiens
aagagatcagattgtt

SEQ ID NO: 16004 - DNA, 16 bp, H. sapiens
aagagatccagtttca

SEQ ID NO: 16005 - DNA, 16 bp, H. sapiens
aagagatcctgaagga

SEQ ID NO: 16006 - DNA, 16 bp, H. sapiens
aagagatgaaagatct

SEQ ID NO: 16007 - DNA, 16 bp, H. sapiens
aagagatgaacaacaa

SEQ ID NO: 16008 - DNA, 16 bp, H. sapiens
aagagatgaacaataa

SEQ ID NO: 16009 - DNA, 16 bp, H. sapiens
aagagatgacatttga

SEQ ID NO: 16010 - DNA, 16 bp, H. sapiens
aagagatgatggtggc

SEQ ID NO: 16011 - DNA, 16 bp, H. sapiens
aagagatgattttgaa

SEQ ID NO: 16012 - DNA, 16 bp, H. sapiens
aagagatgctggagag

SEQ ID NO: 16013 - DNA, 16 bp, H. sapiens
aagagatggagtctca

SEQ ID NO: 16014 - DNA, 16 bp, H. sapiens
aagagattaataacaa

SEQ ID NO: 16015 - DNA, 16 bp, H. sapiens
aagagattaggacaca

SEQ ID NO: 16016 - DNA, 16 bp, H. sapiens
aagagattattttaaa

SEQ ID NO: 16017 - DNA, 16 bp, H. sapiens
aagagattctcatgcc

SEQ ID NO: 16018 - DNA, 16 bp, H. sapiens
aagagattctccttcc

SEQ ID NO: 16019 - DNA, 16 bp, H. sapiens
aagagattcttatgcc

SEQ ID NO: 16020 - DNA, 16 bp, H. sapiens
aagagattgaaatcat

SEQ ID NO: 16021 - DNA, 16 bp, H. sapiens
aagagattgagagcat

SEQ ID NO: 16022 - DNA, 16 bp, H. sapiens
aagagattggcatttg

SEQ ID NO: 16023 - DNA, 16 bp, H. sapiens
aagagattgtagagaa

SEQ ID NO: 16024 - DNA, 16 bp, H. sapiens
aagagatttattttaa

SEQ ID NO: 16025 - DNA, 16 bp, H. sapiens
aagagcaaaactcagt

SEQ ID NO: 16026 - DNA, 16 bp, H. sapiens
aagagcaaaactggag

SEQ ID NO: 16027 - DNA, 16 bp, H. sapiens
aagagcaaacagattc

SEQ ID NO: 16028 - DNA, 16 bp, H. sapiens
aagagcaaacattcaa

SEQ ID NO: 16029 - DNA, 16 bp, H. sapiens
aagagcaaagaaaatt

SEQ ID NO: 16030 - DNA, 16 bp, H. sapiens
aagagcaaagccagag

SEQ ID NO: 16031 - DNA, 16 bp, H. sapiens
aagagcaaagctggag

SEQ ID NO: 16032 - DNA, 16 bp, H. sapiens
aagagcaaagtcatgt

SEQ ID NO: 16033 - DNA, 16 bp, H. sapiens
aagagcaagactccat

SEQ ID NO: 16034 - DNA, 18 bp, H. sapiens
aagagcaagactctatct

SEQ ID NO: 16035 - DNA, 16 bp, H. sapiens
aagagcaagactgtct

SEQ ID NO: 16036 - DNA, 16 bp, H. sapiens
aagagcacagactctg

SEQ ID NO: 16037 - DNA, 16 bp, H. sapiens
aagagcacagactttg

SEQ ID NO: 16038 - DNA, 16 bp, H. sapiens
aagagcacagattctg

SEQ ID NO: 16039 - DNA, 16 bp, H. sapiens
aagagcactggacttg

SEQ ID NO: 16040 - DNA, 16 bp, H. sapiens
aagagcagaaattata

SEQ ID NO: 16041 - DNA, 16 bp, H. sapiens
aagagcagaactgaag

SEQ ID NO: 16042 - DNA, 16 bp, H. sapiens
aagagcagaagcaagg

SEQ ID NO: 16043 - DNA, 16 bp, H. sapiens
aagagcagaaggcagg

SEQ ID NO: 16044 - DNA, 16 bp, H. sapiens
aagagcagcctggcca

SEQ ID NO: 16045 - DNA, 16 bp, H. sapiens
aagagcagcctggtca

SEQ ID NO: 16046 - DNA, 16 bp, H. sapiens
aagagcagctccaaga

SEQ ID NO: 16047 - DNA, 16 bp, H. sapiens
aagagcagcttggcca

SEQ ID NO: 16048 - DNA, 16 bp, H. sapiens
aagagcaggagtcact

SEQ ID NO: 16049 - DNA, 16 bp, H. sapiens
aagagcagggacaatg

SEQ ID NO: 16050 - DNA, 16 bp, H. sapiens
aagagcaggggtcact

SEQ ID NO: 16051 - DNA, 16 bp, H. sapiens
aagagcagttttcaaa

SEQ ID NO: 16052 - DNA, 16 bp, H. sapiens
aagagcatgctgcctt

SEQ ID NO: 16053 - DNA, 16 bp, H. sapiens
aagagcattccagaca

SEQ ID NO: 16054 - DNA, 16 bp, H. sapiens
aagagccaaatcatga

SEQ ID NO: 16055 - DNA, 16 bp, H. sapiens
aagagccaactgaaag

SEQ ID NO: 16056 - DNA, 16 bp, H. sapiens
aagagccagaccctgt

SEQ ID NO: 16057 - DNA, 16 bp, H. sapiens
aagagccagaggctgg

SEQ ID NO: 16058 - DNA, 16 bp, H. sapiens
aagagccagcccctct

SEQ ID NO: 16059 - DNA, 16 bp, H. sapiens
aagagccaggcatggt

SEQ ID NO: 16060 - DNA, 16 bp, H. sapiens
aagagcctagcacctc

SEQ ID NO: 16061 - DNA, 16 bp, H. sapiens
aagagcctgcacagcc

SEQ ID NO: 16062 - DNA, 16 bp, H. sapiens
aagagctaaaagcaga

SEQ ID NO: 16063 - DNA, 16 bp, H. sapiens
aagagctaaaattgac

SEQ ID NO: 16064 - DNA, 16 bp, H. sapiens
aagagctaaaggaaac

SEQ ID NO: 16065 - DNA, 16 bp, H. sapiens
aagagctaaataaatg

SEQ ID NO: 16066 - DNA, 16 bp, H. sapiens
aagagctagaaaagca

SEQ ID NO: 16067 - DNA, 16 bp, H. sapiens
aagagctataacactc

SEQ ID NO: 16068 - DNA, 16 bp, H. sapiens
aagagctatttttgac

SEQ ID NO: 16069 - DNA, 17 bp, H. sapiens
aagagctatttttgaca

SEQ ID NO: 16070 - DNA, 16 bp, H. sapiens
aagagctcaggataca

SEQ ID NO: 16071 - DNA, 16 bp, H. sapiens
aagagctcctgaagaa

SEQ ID NO: 16072 - DNA, 18 bp, H. sapiens
aagagctcctgaaggaag

SEQ ID NO: 16073 - DNA, 16 bp, H. sapiens
aagagctccttaagga

SEQ ID NO: 16074 - DNA, 16 bp, H. sapiens
aagagctcgggataca

SEQ ID NO: 16075 - DNA, 16 bp, H. sapiens
aagagctctgatggag

SEQ ID NO: 16076 - DNA, 16 bp, H. sapiens
aagagctctgcacagc

SEQ ID NO: 16077 - DNA, 16 bp, H. sapiens
aagagctgaaaacaga

SEQ ID NO: 16078 - DNA, 16 bp, H. sapiens
aagagctgaaacaaga

SEQ ID NO: 16079 - DNA, 16 bp, H. sapiens
aagagctgaaagaaaa

SEQ ID NO: 16080 - DNA, 16 bp, H. sapiens
aagagctgaaagaaat

SEQ ID NO: 16081 - DNA, 16 bp, H. sapiens
aagagctgaaagcaga

SEQ ID NO: 16082 - DNA, 16 bp, H. sapiens
aagagctgagatttga

SEQ ID NO: 16083 - DNA, 16 bp, H. sapiens
aagagctgctgcacag

SEQ ID NO: 16084 - DNA, 16 bp, H. sapiens
aagagctggagaccag

SEQ ID NO: 16085 - DNA, 16 bp, H. sapiens
aagagctgggactaca

SEQ ID NO: 16086 - DNA, 16 bp, H. sapiens
aagagctgggattaca

SEQ ID NO: 16087 - DNA, 16 bp, H. sapiens
aagagctgggcctgga

SEQ ID NO: 16088 - DNA, 16 bp, H. sapiens
aagagcttctgaacag

SEQ ID NO: 16089 - DNA, 16 bp, H. sapiens
aagagcttctgaagga

SEQ ID NO: 16090 - DNA, 16 bp, H. sapiens
aagagcttctgcatgg

SEQ ID NO: 16091 - DNA, 16 bp, H. sapiens
aagagcttctgtatag

SEQ ID NO: 16092 - DNA, 16 bp, H. sapiens
aagagcttgggctctg

SEQ ID NO: 16093 - DNA, 16 bp, H. sapiens
aagagcttgtaaacca

SEQ ID NO: 16094 - DNA, 16 bp, H. sapiens
aagagcttttgtttat

SEQ ID NO: 16095 - DNA, 16 bp, H. sapiens
aagaggaaaaacttca

SEQ ID NO: 16096 - DNA, 16 bp, H. sapiens
aagaggaaaattattt

SEQ ID NO: 16097 - DNA, 16 bp, H. sapiens
aagaggaaaggacttt

SEQ ID NO: 16098 - DNA, 16 bp, H. sapiens
aagaggaaagtggcct

SEQ ID NO: 16099 - DNA, 16 bp, H. sapiens
aagaggaaataagcaa

SEQ ID NO: 16100 - DNA, 16 bp, H. sapiens
aagaggaaatgtggac

SEQ ID NO: 16101 - DNA, 16 bp, H. sapiens
aagaggaaatttgaac

SEQ ID NO: 16102 - DNA, 16 bp, H. sapiens
aagaggaaatttggaa

SEQ ID NO: 16103 - DNA, 16 bp, H. sapiens
aagaggaactcaaact

SEQ ID NO: 16104 - DNA, 16 bp, H. sapiens
aagaggaagaaatact

SEQ ID NO: 16105 - DNA, 16 bp, H. sapiens
aagaggaagaggatca

SEQ ID NO: 16106 - DNA, 16 bp, H. sapiens
aagaggaagcaggcat

SEQ ID NO: 16107 - DNA, 16 bp, H. sapiens
aagaggaagctggaga

SEQ ID NO: 16108 - DNA, 17 bp, H. sapiens
aagaggaaggcatctgt

SEQ ID NO: 16109 - DNA, 24 bp, H. sapiens
aagaggaaggcatctgtctcctgc

SEQ ID NO: 16110 - DNA, 16 bp, H. sapiens
aagaggaagtcaaaat

SEQ ID NO: 16111 - DNA, 16 bp, H. sapiens
aagaggaagtcaaatc

SEQ ID NO: 16112 - DNA, 16 bp, H. sapiens
aagaggaagtcaagtt

SEQ ID NO: 16113 - DNA, 16 bp, H. sapiens
aagaggaagtctctca

SEQ ID NO: 16114 - DNA, 16 bp, H. sapiens
aagaggaatttattat

SEQ ID NO: 16115 - DNA, 16 bp, H. sapiens
aagaggacacaaatgg

SEQ ID NO: 16116 - DNA, 16 bp, H. sapiens
aagaggacagctttga

SEQ ID NO: 16117 - DNA, 16 bp, H. sapiens
aagaggagaaaacact

SEQ ID NO: 16118 - DNA, 16 bp, H. sapiens
aagaggagaggaaatt

SEQ ID NO: 16119 - DNA, 16 bp, H. sapiens
aagaggagccaaatgt

SEQ ID NO: 16120 - DNA, 16 bp, H. sapiens
aagaggagcccaaagt

SEQ ID NO: 16121 - DNA, 16 bp, H. sapiens
aagaggagcctaagga

SEQ ID NO: 16122 - DNA, 16 bp, H. sapiens
aagaggaggaacacat

SEQ ID NO: 16123 - DNA, 16 bp, H. sapiens
aagaggaggcagagca

SEQ ID NO: 16124 - DNA, 16 bp, H. sapiens
aagaggagttcccctg

SEQ ID NO: 16125 - DNA, 16 bp, H. sapiens
aagaggatacaaacaa

SEQ ID NO: 16126 - DNA, 16 bp, H. sapiens
aagaggatcacttgag

SEQ ID NO: 16127 - DNA, 16 bp, H. sapiens
aagaggatgatatgac

SEQ ID NO: 16128 - DNA, 16 bp, H. sapiens
aagaggatgtggagaa

SEQ ID NO: 16129 - DNA, 16 bp, H. sapiens
aagaggattttgtttt

SEQ ID NO: 16130 - DNA, 16 bp, H. sapiens
aagaggcaaaggtaga

SEQ ID NO: 16131 - DNA, 16 bp, H. sapiens
aagaggcaacccacag

SEQ ID NO: 16132 - DNA, 16 bp, H. sapiens
aagaggcagagctgga

SEQ ID NO: 16133 - DNA, 16 bp, H. sapiens
aagaggcagagctggg

SEQ ID NO: 16134 - DNA, 16 bp, H. sapiens
aagaggcagctcattt

SEQ ID NO: 16135 - DNA, 16 bp, H. sapiens
aagaggcctcaggaga

SEQ ID NO: 16136 - DNA, 16 bp, H. sapiens
aagaggcctgagggag

SEQ ID NO: 16137 - DNA, 16 bp, H. sapiens
aagaggctgagatggg

SEQ ID NO: 16138 - DNA, 16 bp, H. sapiens
aagaggctgaggctgg

SEQ ID NO: 16139 - DNA, 16 bp, H. sapiens
aagaggctgggctggg

SEQ ID NO: 16140 - DNA, 16 bp, H. sapiens
aagaggcttcagagag

SEQ ID NO: 16141 - DNA, 16 bp, H. sapiens
aagaggctttgcagat

SEQ ID NO: 16142 - DNA, 16 bp, H. sapiens
aagagggaaactccat

SEQ ID NO: 16143 - DNA, 16 bp, H. sapiens
aagagggaaactctgt

SEQ ID NO: 16144 - DNA, 16 bp, H. sapiens
aagagggacagacaca

SEQ ID NO: 16145 - DNA, 16 bp, H. sapiens
aagagggactcctctc

SEQ ID NO: 16146 - DNA, 16 bp, H. sapiens
aagagggactccttcc

SEQ ID NO: 16147 - DNA, 16 bp, H. sapiens
aagagggagcaggcac

SEQ ID NO: 16148 - DNA, 16 bp, H. sapiens
aagagggagtcaaaga

SEQ ID NO: 16149 - DNA, 16 bp, H. sapiens
aagagggccactgttc

SEQ ID NO: 16150 - DNA, 16 bp, H. sapiens
aagagggccttcacca

SEQ ID NO: 16151 - DNA, 16 bp, H. sapiens
aagagggctcagagga

SEQ ID NO: 16152 - DNA, 16 bp, H. sapiens
aagaggggaaactgag

SEQ ID NO: 16153 - DNA, 16 bp, H. sapiens
aagaggggctggagct

SEQ ID NO: 16154 - DNA, 16 bp, H. sapiens
aagaggggctggctct

SEQ ID NO: 16155 - DNA, 16 bp, H. sapiens
aagaggtaacttgggt

SEQ ID NO: 16156 - DNA, 17 bp, H. sapiens
aagaggtccaatataat

SEQ ID NO: 16157 - DNA, 16 bp, H. sapiens
aagaggtcctgatcca

SEQ ID NO: 16158 - DNA, 16 bp, H. sapiens
aagaggtctcttttgg

SEQ ID NO: 16159 - DNA, 16 bp, H. sapiens
aagaggtgaaagatct

SEQ ID NO: 16160 - DNA, 16 bp, H. sapiens
aagaggtgctggagag

SEQ ID NO: 16161 - DNA, 16 bp, H. sapiens
aagaggtgggttccca

SEQ ID NO: 16162 - DNA, 16 bp, H. sapiens
aagaggttaaatgact

SEQ ID NO: 16163 - DNA, 16 bp, H. sapiens
aagaggttctgttttg

SEQ ID NO: 16164 - DNA, 16 bp, H. sapiens
aagaggttgaggctgt

SEQ ID NO: 16165 - DNA, 16 bp, H. sapiens
aagaggtttcctcact

SEQ ID NO: 16166 - DNA, 16 bp, H. sapiens
aagaggtttctcagaa

SEQ ID NO: 16167 - DNA, 16 bp, H. sapiens
aagaggtttctttttt

SEQ ID NO: 16168 - DNA, 16 bp, H. sapiens
aagaggttttttaaaa

SEQ ID NO: 16169 - DNA, 16 bp, H. sapiens
aagagtacctacctca

SEQ ID NO: 16170 - DNA, 16 bp, H. sapiens
aagagtagtgatgctg

SEQ ID NO: 16171 - DNA, 16 bp, H. sapiens
aagagtatatgccctt

SEQ ID NO: 16172 - DNA, 16 bp, H. sapiens
aagagtatcagtgatt

SEQ ID NO: 16173 - DNA, 16 bp, H. sapiens
aagagtatgcatggaa

SEQ ID NO: 16174 - DNA, 16 bp, H. sapiens
aagagtatgtttagtt

SEQ ID NO: 16175 - DNA, 16 bp, H. sapiens
aagagtattcaaatag

SEQ ID NO: 16176 - DNA, 16 bp, H. sapiens
aagagtattttaagaa

SEQ ID NO: 16177 - DNA, 16 bp, H. sapiens
aagagtattttttaaa

SEQ ID NO: 16178 - DNA, 16 bp, H. sapiens
aagagtcacctttact

SEQ ID NO: 16179 - DNA, 16 bp, H. sapiens
aagagtcagtgaactt

SEQ ID NO: 16180 - DNA, 16 bp, H. sapiens
aagagtccagtttcat

SEQ ID NO: 16181 - DNA, 16 bp, H. sapiens
aagagtctggctctgt

SEQ ID NO: 16182 - DNA, 16 bp, H. sapiens
aagagtctgggacctc

SEQ ID NO: 16183 - DNA, 16 bp, H. sapiens
aagagtgaaacgctgt

SEQ ID NO: 16184 - DNA, 16 bp, H. sapiens
aagagtgaaagaacaa

SEQ ID NO: 16185 - DNA, 16 bp, H. sapiens
aagagtgaacagcagc

SEQ ID NO: 16186 - DNA, 16 bp, H. sapiens
aagagtgaaccccaat

SEQ ID NO: 16187 - DNA, 16 bp, H. sapiens
aagagtgacctttgct

SEQ ID NO: 16188 - DNA, 16 bp, H. sapiens
aagagtgagatcttgt

SEQ ID NO: 16189 - DNA, 16 bp, H. sapiens
aagagtgagtcccagg

SEQ ID NO: 16190 - DNA, 16 bp, H. sapiens
aagagtgattcaaaac

SEQ ID NO: 16191 - DNA, 16 bp, H. sapiens
aagagtggaaaggact

SEQ ID NO: 16192 - DNA, 16 bp, H. sapiens
aagagtggaactctgt

SEQ ID NO: 16193 - DNA, 16 bp, H. sapiens
aagagtggaagacaaa

SEQ ID NO: 16194 - DNA, 16 bp, H. sapiens
aagagtggattttaaa

SEQ ID NO: 16195 - DNA, 16 bp, H. sapiens
aagagtgggaagaact

SEQ ID NO: 16196 - DNA, 16 bp, H. sapiens
aagagtgggaaggatt

SEQ ID NO: 16197 - DNA, 16 bp, H. sapiens
aagagtggggtgctgc

SEQ ID NO: 16198 - DNA, 16 bp, H. sapiens
aagagtgtattgttta

SEQ ID NO: 16199 - DNA, 16 bp, H. sapiens
aagagtgtgagagaga

SEQ ID NO: 16200 - DNA, 16 bp, H. sapiens
aagagtgtggagggct

SEQ ID NO: 16201 - DNA, 16 bp, H. sapiens
aagagttaaagaaacc

SEQ ID NO: 16202 - DNA, 16 bp, H. sapiens
aagagttaaatctttt

SEQ ID NO: 16203 - DNA, 16 bp, H. sapiens
aagagttatactagat

SEQ ID NO: 16204 - DNA, 16 bp, H. sapiens
aagagttattggcctt

SEQ ID NO: 16205 - DNA, 16 bp, H. sapiens
aagagttattttaaaa

SEQ ID NO: 16206 - DNA, 16 bp, H. sapiens
aagagttatttttaaa

SEQ ID NO: 16207 - DNA, 16 bp, H. sapiens
aagagttcaagaccaa

SEQ ID NO: 16208 - DNA, 16 bp, H. sapiens
aagagttctggagatg

SEQ ID NO: 16209 - DNA, 16 bp, H. sapiens
aagagttcttttgaaa

SEQ ID NO: 16210 - DNA, 16 bp, H. sapiens
aagagttgaggcttgg

SEQ ID NO: 16211 - DNA, 16 bp, H. sapiens
aagagtttacatttta

SEQ ID NO: 16212 - DNA, 16 bp, H. sapiens
aagagtttatgaccaa

SEQ ID NO: 16213 - DNA, 16 bp, H. sapiens
aagagtttgaaaataa

SEQ ID NO: 16214 - DNA, 16 bp, H. sapiens
aagagtttgagaaaga

SEQ ID NO: 16215 - DNA, 16 bp, H. sapiens
aagagtttgagacctg

SEQ ID NO: 16216 - DNA, 16 bp, H. sapiens
aagagttttatagttt

SEQ ID NO: 16217 - DNA, 16 bp, H. sapiens
aagataaaaattacat

SEQ ID NO: 16218 - DNA, 16 bp, H. sapiens
aagataaaagcagaga

SEQ ID NO: 16219 - DNA, 16 bp, H. sapiens
aagataaaataacatt

SEQ ID NO: 16220 - DNA, 16 bp, H. sapiens
aagataaacaaaattg

SEQ ID NO: 16221 - DNA, 16 bp, H. sapiens
aagataaacattcaaa

SEQ ID NO: 16222 - DNA, 16 bp, H. sapiens
aagataaactcaaaga

SEQ ID NO: 16223 - DNA, 16 bp, H. sapiens
aagataaacttttaaa

SEQ ID NO: 16224 - DNA, 16 bp, H. sapiens
aagataaaggcagaga

SEQ ID NO: 16225 - DNA, 16 bp, H. sapiens
aagataaagtaagcat

SEQ ID NO: 16226 - DNA, 16 bp, H. sapiens
aagataaatttctaaa

SEQ ID NO: 16227 - DNA, 16 bp, H. sapiens
aagataaatttgtgtt

SEQ ID NO: 16228 - DNA, 16 bp, H. sapiens
aagataacattttttt

SEQ ID NO: 16229 - DNA, 16 bp, H. sapiens
aagataactgaaaaca

SEQ ID NO: 16230 - DNA, 16 bp, H. sapiens
aagataactggaaaat

SEQ ID NO: 16231 - DNA, 16 bp, H. sapiens
aagataactttttaaa

SEQ ID NO: 16232 - DNA, 16 bp, H. sapiens
aagataagcctggagc

SEQ ID NO: 16233 - DNA, 17 bp, H. sapiens
aagataataaaatacct

SEQ ID NO: 16234 - DNA, 16 bp, H. sapiens
aagataataaatgtgt

SEQ ID NO: 16235 - DNA, 16 bp, H. sapiens
aagataatattggaaa

SEQ ID NO: 16236 - DNA, 16 bp, H. sapiens
aagataatatttcatt

SEQ ID NO: 16237 - DNA, 16 bp, H. sapiens
aagataatatttcttt

SEQ ID NO: 16238 - DNA, 16 bp, H. sapiens
aagataatgaccttca

SEQ ID NO: 16239 - DNA, 16 bp, H. sapiens
aagataatgttttaat

SEQ ID NO: 16240 - DNA, 16 bp, H. sapiens
aagataattatttacc

SEQ ID NO: 16241 - DNA, 16 bp, H. sapiens
aagataattcttcttc

SEQ ID NO: 16242 - DNA, 16 bp, H. sapiens
aagataatttcagata

SEQ ID NO: 16243 - DNA, 16 bp, H. sapiens
aagataattttataca

SEQ ID NO: 16244 - DNA, 16 bp, H. sapiens
aagataattttcaaaa

SEQ ID NO: 16245 - DNA, 16 bp, H. sapiens
aagataattttgaaga

SEQ ID NO: 16246 - DNA, 16 bp, H. sapiens
aagataatttttaaag

SEQ ID NO: 16247 - DNA, 16 bp, H. sapiens
aagatacacaaatggc

SEQ ID NO: 16248 - DNA, 16 bp, H. sapiens
aagatacagagaaaat

SEQ ID NO: 16249 - DNA, 16 bp, H. sapiens
aagatacaggtcatga

SEQ ID NO: 16250 - DNA, 16 bp, H. sapiens
aagatactacacaaga

SEQ ID NO: 16251 - DNA, 16 bp, H. sapiens
aagatactgcctgaga

SEQ ID NO: 16252 - DNA, 16 bp, H. sapiens
aagatacttctttttt

SEQ ID NO: 16253 - DNA, 16 bp, H. sapiens
aagatagagaacattt

SEQ ID NO: 16254 - DNA, 16 bp, H. sapiens
aagatagattaacaag

SEQ ID NO: 16255 - DNA, 16 bp, H. sapiens
aagatagtcttgaatt

SEQ ID NO: 16256 - DNA, 16 bp, H. sapiens
aagatatagaaactct

SEQ ID NO: 16257 - DNA, 16 bp, H. sapiens
aagatatataaagcaa

SEQ ID NO: 16258 - DNA, 16 bp, H. sapiens
aagatatatgcttaaa

SEQ ID NO: 16259 - DNA, 16 bp, H. sapiens
aagatatcatctcaca

SEQ ID NO: 16260 - DNA, 16 bp, H. sapiens
aagatatgaaattaac

SEQ ID NO: 16261 - DNA, 16 bp, H. sapiens
aagatatgaagaaatt

SEQ ID NO: 16262 - DNA, 16 bp, H. sapiens
aagatattacaagaaa

SEQ ID NO: 16263 - DNA, 16 bp, H. sapiens
aagatattatttgaaa

SEQ ID NO: 16264 - DNA, 16 bp, H. sapiens
aagatattcatatttt

SEQ ID NO: 16265 - DNA, 16 bp, H. sapiens
aagatattctttattt

SEQ ID NO: 16266 - DNA, 16 bp, H. sapiens
aagatattgccaaatt

SEQ ID NO: 16267 - DNA, 16 bp, H. sapiens
aagatatttaagatat

SEQ ID NO: 16268 - DNA, 16 bp, H. sapiens
aagatatttcattttt

SEQ ID NO: 16269 - DNA, 16 bp, H. sapiens
aagatatttcctcttt

SEQ ID NO: 16270 - DNA, 16 bp, H. sapiens
aagatatttctaattt

SEQ ID NO: 16271 - DNA, 16 bp, H. sapiens
aagatattttaaatca

SEQ ID NO: 16272 - DNA, 16 bp, H. sapiens
aagatattttaagaga

SEQ ID NO: 16273 - DNA, 16 bp, H. sapiens
aagatattttcagata

SEQ ID NO: 16274 - DNA, 16 bp, H. sapiens
aagatattttcataaa

SEQ ID NO: 16275 - DNA, 16 bp, H. sapiens
aagatattttcctttc

SEQ ID NO: 16276 - DNA, 16 bp, H. sapiens
aagatattttctttaa

SEQ ID NO: 16277 - DNA, 16 bp, H. sapiens
aagatattttcttttt

SEQ ID NO: 16278 - DNA, 16 bp, H. sapiens
aagatattttgtagat

SEQ ID NO: 16279 - DNA, 16 bp, H. sapiens
aagatatttttctttt

SEQ ID NO: 16280 - DNA, 16 bp, H. sapiens
aagatcaaaggtagat

SEQ ID NO: 16281 - DNA, 16 bp, H. sapiens
aagatcaaagtgctgg

SEQ ID NO: 16282 - DNA, 16 bp, H. sapiens
aagatcaacaaaatgg

SEQ ID NO: 16283 - DNA, 16 bp, H. sapiens
aagatcaacaaaatta

SEQ ID NO: 16284 - DNA, 16 bp, H. sapiens
aagatcaaccccaaga

SEQ ID NO: 16285 - DNA, 18 bp, H. sapiens
aagatcaacttactgaaa

SEQ ID NO: 16286 - DNA, 16 bp, H. sapiens
aagatcaagaataaga

SEQ ID NO: 16287 - DNA, 16 bp, H. sapiens
aagatcaagatgttgg

SEQ ID NO: 16288 - DNA, 16 bp, H. sapiens
aagatcaaggccctgg

SEQ ID NO: 16289 - DNA, 16 bp, H. sapiens
aagatcaaggctccag

SEQ ID NO: 16290 - DNA, 16 bp, H. sapiens
aagatcaaggctgcag

SEQ ID NO: 16291 - DNA, 16 bp, H. sapiens
aagatcaatattaaaa

SEQ ID NO: 16292 - DNA, 16 bp, H. sapiens
aagatcaatgaaatga

SEQ ID NO: 16293 - DNA, 16 bp, H. sapiens
aagatcacaaagattt

SEQ ID NO: 16294 - DNA, 16 bp, H. sapiens
aagatcacaaggcaga

SEQ ID NO: 16295 - DNA, 16 bp, H. sapiens
aagatcacagagctgg

SEQ ID NO: 16296 - DNA, 20 bp, H. sapiens
aagatcacgccactgcattc

SEQ ID NO: 16297 - DNA, 16 bp, H. sapiens
aagatcacgccagtgc

SEQ ID NO: 16298 - DNA, 16 bp, H. sapiens
aagatcagaccactgc

SEQ ID NO: 16299 - DNA, 16 bp, H. sapiens
aagatcagagcagaag

SEQ ID NO: 16300 - DNA, 16 bp, H. sapiens
aagatcagagcagagc

SEQ ID NO: 16301 - DNA, 16 bp, H. sapiens
aagatcagagcaggtg

SEQ ID NO: 16302 - DNA, 16 bp, H. sapiens
aagatcagatgattgt

SEQ ID NO: 16303 - DNA, 16 bp, H. sapiens
aagatcagatgcttgt

SEQ ID NO: 16304 - DNA, 16 bp, H. sapiens
aagatcagcctggcca

SEQ ID NO: 16305 - DNA, 16 bp, H. sapiens
aagatcaggaaaaaca

SEQ ID NO: 16306 - DNA, 16 bp, H. sapiens
aagatcaggaacaaag

SEQ ID NO: 16307 - DNA, 16 bp, H. sapiens
aagatcaggaacaaga

SEQ ID NO: 16308 - DNA, 16 bp, H. sapiens
aagatcaggaacaagg

SEQ ID NO: 16309 - DNA, 16 bp, H. sapiens
aagatcaggttaccca

SEQ ID NO: 16310 - DNA, 16 bp, H. sapiens
aagatcatcaatgcta

SEQ ID NO: 16311 - DNA, 16 bp, H. sapiens
aagatcatgaaaaata

SEQ ID NO: 16312 - DNA, 16 bp, H. sapiens
aagatcatgcagtatt

SEQ ID NO: 16313 - DNA, 16 bp, H. sapiens
aagatcatggatcaag

SEQ ID NO: 16314 - DNA, 16 bp, H. sapiens
aagatcatttcctttg

SEQ ID NO: 16315 - DNA, 16 bp, H. sapiens
aagatccaggtgctgg

SEQ ID NO: 16316 - DNA, 16 bp, H. sapiens
aagatccagtcatttg

SEQ ID NO: 16317 - DNA, 16 bp, H. sapiens
aagatcccatctccac

SEQ ID NO: 16318 - DNA, 16 bp, H. sapiens
aagatccccagatgat

SEQ ID NO: 16319 - DNA, 16 bp, H. sapiens
aagatcctgggggagg

SEQ ID NO: 16320 - DNA, 16 bp, H. sapiens
aagatcctgtttctac

SEQ ID NO: 16321 - DNA, 16 bp, H. sapiens
aagatcctttcttata

SEQ ID NO: 16322 - DNA, 16 bp, H. sapiens
aagatcgagccactgc

SEQ ID NO: 16323 - DNA, 18 bp, H. sapiens
aagatcgcaccactgcat

SEQ ID NO: 16324 - DNA, 16 bp, H. sapiens
aagatctagaacaaga

SEQ ID NO: 16325 - DNA, 16 bp, H. sapiens
aagatctcaaagagat

SEQ ID NO: 16326 - DNA, 16 bp, H. sapiens
aagatctcatcactgc

SEQ ID NO: 16327 - DNA, 16 bp, H. sapiens
aagatctgaaatcaac

SEQ ID NO: 16328 - DNA, 16 bp, H. sapiens
aagatctgaaggtttt

SEQ ID NO: 16329 - DNA, 23 bp, H. sapiens
aagatctgcagcttcactcctga

SEQ ID NO: 16330 - DNA, 16 bp, H. sapiens
aagatctggaaaaaga

SEQ ID NO: 16331 - DNA, 16 bp, H. sapiens
aagatctggaacaaga

SEQ ID NO: 16332 - DNA, 16 bp, H. sapiens
aagatctggaagaatt

SEQ ID NO: 16333 - DNA, 16 bp, H. sapiens
aagatctggtatttga

SEQ ID NO: 16334 - DNA, 16 bp, H. sapiens
aagatcttgttgttta

SEQ ID NO: 16335 - DNA, 16 bp, H. sapiens
aagatcttttgcccat

SEQ ID NO: 16336 - DNA, 16 bp, H. sapiens
aagatgaaaaaggcat

SEQ ID NO: 16337 - DNA, 16 bp, H. sapiens
aagatgaaaaagttct

SEQ ID NO: 16338 - DNA, 16 bp, H. sapiens
aagatgaaaaatttct

SEQ ID NO: 16339 - DNA, 16 bp, H. sapiens
aagatgaaaatattct

SEQ ID NO: 16340 - DNA, 16 bp, H. sapiens
aagatgaaaatgtttt

SEQ ID NO: 16341 - DNA, 16 bp, H. sapiens
aagatgaaagcagaaa

SEQ ID NO: 16342 - DNA, 16 bp, H. sapiens
aagatgaaataaagac

SEQ ID NO: 16343 - DNA, 16 bp, H. sapiens
aagatgaaattaatga

SEQ ID NO: 16344 - DNA, 16 bp, H. sapiens
aagatgaacaaaatga

SEQ ID NO: 16345 - DNA, 16 bp, H. sapiens
aagatgaactcaaaga

SEQ ID NO: 16346 - DNA, 16 bp, H. sapiens
aagatgaagaaaaacc

SEQ ID NO: 16347 - DNA, 16 bp, H. sapiens
aagatgaagaaaacat

SEQ ID NO: 16348 - DNA, 16 bp, H. sapiens
aagatgaagaaaccaa

SEQ ID NO: 16349 - DNA, 16 bp, H. sapiens
aagatgaagaaattga

SEQ ID NO: 16350 - DNA, 16 bp, H. sapiens
aagatgaaggaagagc

SEQ ID NO: 16351 - DNA, 16 bp, H. sapiens
aagatgaaggaggagc

SEQ ID NO: 16352 - DNA, 16 bp, H. sapiens
aagatgaaggcagaaa

SEQ ID NO: 16353 - DNA, 16 bp, H. sapiens
aagatgaaggcagaga

SEQ ID NO: 16354 - DNA, 16 bp, H. sapiens
aagatgaagtcaaatt

SEQ ID NO: 16355 - DNA, 16 bp, H. sapiens
aagatgaatattttaa

SEQ ID NO: 16356 - DNA, 16 bp, H. sapiens
aagatgaattaaaaac

SEQ ID NO: 16357 - DNA, 16 bp, H. sapiens
aagatgacaaggatga

SEQ ID NO: 16358 - DNA, 16 bp, H. sapiens
aagatgacaggaaaat

SEQ ID NO: 16359 - DNA, 16 bp, H. sapiens
aagatgacataaaaat

SEQ ID NO: 16360 - DNA, 16 bp, H. sapiens
aagatgacataaataa

SEQ ID NO: 16361 - DNA, 16 bp, H. sapiens
aagatgaggaaaagtt

SEQ ID NO: 16362 - DNA, 16 bp, H. sapiens
aagatgaggaaattga

SEQ ID NO: 16363 - DNA, 16 bp, H. sapiens
aagatgaggatgaaga

SEQ ID NO: 16364 - DNA, 16 bp, H. sapiens
aagatgaggtcatact

SEQ ID NO: 16365 - DNA, 16 bp, H. sapiens
aagatgaggtcatcct

SEQ ID NO: 16366 - DNA, 16 bp, H. sapiens
aagatgaggttttttt

SEQ ID NO: 16367 - DNA, 16 bp, H. sapiens
aagatgataatgatga

SEQ ID NO: 16368 - DNA, 16 bp, H. sapiens
aagatgatatcccatt

SEQ ID NO: 16369 - DNA, 16 bp, H. sapiens
aagatgatcatgtgat

SEQ ID NO: 16370 - DNA, 16 bp, H. sapiens
aagatgatgaaacccc

SEQ ID NO: 16371 - DNA, 16 bp, H. sapiens
aagatgatgaagatga

SEQ ID NO: 16372 - DNA, 16 bp, H. sapiens
aagatgatgaggataa

SEQ ID NO: 16373 - DNA, 16 bp, H. sapiens
aagatgatgaggatga

SEQ ID NO: 16374 - DNA, 16 bp, H. sapiens
aagatgatgagttcat

SEQ ID NO: 16375 - DNA, 16 bp, H. sapiens
aagatgatgatgataa

SEQ ID NO: 16376 - DNA, 16 bp, H. sapiens
aagatgatgatgatgg

SEQ ID NO: 16377 - DNA, 16 bp, H. sapiens
aagatgatgatggtga

SEQ ID NO: 16378 - DNA, 16 bp, H. sapiens
aagatgattctaaaat

SEQ ID NO: 16379 - DNA, 16 bp, H. sapiens
aagatgcaaagatgaa

SEQ ID NO: 16380 - DNA, 16 bp, H. sapiens
aagatgcagaatggca

SEQ ID NO: 16381 - DNA, 16 bp, H. sapiens
aagatgctcaacattg

SEQ ID NO: 16382 - DNA, 16 bp, H. sapiens
aagatgctcaacctca

SEQ ID NO: 16383 - DNA, 16 bp, H. sapiens
aagatgctcaagtccc

SEQ ID NO: 16384 - DNA, 16 bp, H. sapiens
aagatgctcagcctca

SEQ ID NO: 16385 - DNA, 16 bp, H. sapiens
aagatgctgaacatca

SEQ ID NO: 16386 - DNA, 16 bp, H. sapiens
aagatgctggcagatt

SEQ ID NO: 16387 - DNA, 16 bp, H. sapiens
aagatgctgtgaatat

SEQ ID NO: 16388 - DNA, 16 bp, H. sapiens
aagatgctttttaaaa

SEQ ID NO: 16389 - DNA, 17 bp, H. sapiens
aagatggaaaccatcat

SEQ ID NO: 16390 - DNA, 16 bp, H. sapiens
aagatggaagcagaga

SEQ ID NO: 16391 - DNA, 16 bp, H. sapiens
aagatggagctgccat

SEQ ID NO: 16392 - DNA, 16 bp, H. sapiens
aagatggagtcagcta

SEQ ID NO: 16393 - DNA, 16 bp, H. sapiens
aagatggagtcttact

SEQ ID NO: 16394 - DNA, 16 bp, H. sapiens
aagatggattaaaggc

SEQ ID NO: 16395 - DNA, 16 bp, H. sapiens
aagatggattgaagac

SEQ ID NO: 16396 - DNA, 16 bp, H. sapiens
aagatggatttaagac

SEQ ID NO: 16397 - DNA, 16 bp, H. sapiens
aagatggcaatgaaag

SEQ ID NO: 16398 - DNA, 16 bp, H. sapiens
aagatggcaggagaga

SEQ ID NO: 16399 - DNA, 23 bp, H. sapiens
aagatggccaaataggaacagct

SEQ ID NO: 16400 - DNA, 16 bp, H. sapiens
aagatggccatctatg

SEQ ID NO: 16401 - DNA, 16 bp, H. sapiens
aagatggccccagtga

SEQ ID NO: 16402 - DNA, 24 bp, H. sapiens
aagatggccgaataggaacagctc

SEQ ID NO: 16403 - DNA, 16 bp, H. sapiens
aagatggctccactgc

SEQ ID NO: 16404 - DNA, 23 bp, H. sapiens
aagatggctgaataggaacagct

SEQ ID NO: 16405 - DNA, 16 bp, H. sapiens
aagatggctgactaaa

SEQ ID NO: 16406 - DNA, 16 bp, H. sapiens
aagatggcttgaaccc

SEQ ID NO: 16407 - DNA, 16 bp, H. sapiens
aagatgggaaaaaaca

SEQ ID NO: 16408 - DNA, 19 bp, H. sapiens
aagatggggaaaaaacaga

SEQ ID NO: 16409 - DNA, 16 bp, H. sapiens
aagatggggaaactga

SEQ ID NO: 16410 - DNA, 16 bp, H. sapiens
aagatggggagaaacc

SEQ ID NO: 16411 - DNA, 16 bp, H. sapiens
aagatggggataatga

SEQ ID NO: 16412 - DNA, 16 bp, H. sapiens
aagatggggtttcact

SEQ ID NO: 16413 - DNA, 16 bp, H. sapiens
aagatggggttttgtc

SEQ ID NO: 16414 - DNA, 16 bp, H. sapiens
aagatgggtctcctga

SEQ ID NO: 16415 - DNA, 16 bp, H. sapiens
aagatggtaaaacccc

SEQ ID NO: 16416 - DNA, 16 bp, H. sapiens
aagatggtaacagccc

SEQ ID NO: 16417 - DNA, 16 bp, H. sapiens
aagatggtctttgaaa

SEQ ID NO: 16418 - DNA, 18 bp, H. sapiens
aagatggtgaaaccctgt

SEQ ID NO: 16419 - DNA, 16 bp, H. sapiens
aagatggtgaaataga

SEQ ID NO: 16420 - DNA, 16 bp, H. sapiens
aagatggtgagacctc

SEQ ID NO: 16421 - DNA, 16 bp, H. sapiens
aagatggtgatgatga

SEQ ID NO: 16422 - DNA, 16 bp, H. sapiens
aagatggtgccactgc

SEQ ID NO: 16423 - DNA, 16 bp, H. sapiens
aagatggtggaatagg

SEQ ID NO: 16424 - DNA, 16 bp, H. sapiens
aagatggtggtggtgg

SEQ ID NO: 16425 - DNA, 16 bp, H. sapiens
aagatgtaatttgtga

SEQ ID NO: 16426 - DNA, 16 bp, H. sapiens
aagatgtaatttttaa

SEQ ID NO: 16427 - DNA, 16 bp, H. sapiens
aagatgtacagaaatg

SEQ ID NO: 16428 - DNA, 16 bp, H. sapiens
aagatgtagaatattt

SEQ ID NO: 16429 - DNA, 16 bp, H. sapiens
aagatgtagctatttt

SEQ ID NO: 16430 - DNA, 16 bp, H. sapiens
aagatgtcagttctcc

SEQ ID NO: 16431 - DNA, 16 bp, H. sapiens
aagatgtcagttcttc

SEQ ID NO: 16432 - DNA, 16 bp, H. sapiens
aagatgtccacaccct

SEQ ID NO: 16433 - DNA, 16 bp, H. sapiens
aagatgtccacgtcct

SEQ ID NO: 16434 - DNA, 16 bp, H. sapiens
aagatgtctttttttt

SEQ ID NO: 16435 - DNA, 16 bp, H. sapiens
aagatgtgacttgggt

SEQ ID NO: 16436 - DNA, 16 bp, H. sapiens
aagatgtgagtgaatt

SEQ ID NO: 16437 - DNA, 16 bp, H. sapiens
aagatgtgatggtttt

SEQ ID NO: 16438 - DNA, 16 bp, H. sapiens
aagatgtgcctgcttc

SEQ ID NO: 16439 - DNA, 16 bp, H. sapiens
aagatgtgcctgtttc

SEQ ID NO: 16440 - DNA, 16 bp, H. sapiens
aagatgtggaatcaac

SEQ ID NO: 16441 - DNA, 16 bp, H. sapiens
aagatgtggtatttgg

SEQ ID NO: 16442 - DNA, 16 bp, H. sapiens
aagatgttaaaatgtg

SEQ ID NO: 16443 - DNA, 16 bp, H. sapiens
aagatgttaacatttg

SEQ ID NO: 16444 - DNA, 16 bp, H. sapiens
aagatgttaataatag

SEQ ID NO: 16445 - DNA, 16 bp, H. sapiens
aagatgttcaacttca

SEQ ID NO: 16446 - DNA, 16 bp, H. sapiens
aagatgtttccttttt

SEQ ID NO: 16447 - DNA, 16 bp, H. sapiens
aagatgtttcttagaa

SEQ ID NO: 16448 - DNA, 16 bp, H. sapiens
aagatgtttgatatta

SEQ ID NO: 16449 - DNA, 16 bp, H. sapiens
aagattaaatgatgaa

SEQ ID NO: 16450 - DNA, 16 bp, H. sapiens
aagattaaattatgtt

SEQ ID NO: 16451 - DNA, 16 bp, H. sapiens
aagattaacaaaatta

SEQ ID NO: 16452 - DNA, 16 bp, H. sapiens
aagattaatgaaaaca

SEQ ID NO: 16453 - DNA, 16 bp, H. sapiens
aagattacaaaaatta

SEQ ID NO: 16454 - DNA, 16 bp, H. sapiens
aagattagagtcctgc

SEQ ID NO: 16455 - DNA, 16 bp, H. sapiens
aagattatcagagact

SEQ ID NO: 16456 - DNA, 16 bp, H. sapiens
aagattatgacagtga

SEQ ID NO: 16457 - DNA, 16 bp, H. sapiens
aagattatgtctcaaa

SEQ ID NO: 16458 - DNA, 16 bp, H. sapiens
aagattattttgacta

SEQ ID NO: 16459 - DNA, 16 bp, H. sapiens
aagattcaaacccaga

SEQ ID NO: 16460 - DNA, 16 bp, H. sapiens
aagattcacttgaacc

SEQ ID NO: 16461 - DNA, 16 bp, H. sapiens
aagattcatttgatga

SEQ ID NO: 16462 - DNA, 16 bp, H. sapiens
aagattccatctcaaa

SEQ ID NO: 16463 - DNA, 16 bp, H. sapiens
aagattccctatttaa

SEQ ID NO: 16464 - DNA, 16 bp, H. sapiens
aagattccctcttttt

SEQ ID NO: 16465 - DNA, 16 bp, H. sapiens
aagattctcccacctc

SEQ ID NO: 16466 - DNA, 16 bp, H. sapiens
aagattctgtctttaa

SEQ ID NO: 16467 - DNA, 16 bp, H. sapiens
aagattctgtttcaaa

SEQ ID NO: 16468 - DNA, 16 bp, H. sapiens
aagattcttaatcaca

SEQ ID NO: 16469 - DNA, 16 bp, H. sapiens
aagattcttctttttt

SEQ ID NO: 16470 - DNA, 16 bp, H. sapiens
aagattcttttaaaat

SEQ ID NO: 16471 - DNA, 16 bp, H. sapiens
aagattgaatcagtaa

SEQ ID NO: 16472 - DNA, 16 bp, H. sapiens
aagattgagaccatcc

SEQ ID NO: 16473 - DNA, 16 bp, H. sapiens
aagattgctgcctttt

SEQ ID NO: 16474 - DNA, 16 bp, H. sapiens
aagattgtcttttcaa

SEQ ID NO: 16475 - DNA, 16 bp, H. sapiens
aagattgtgccactac

SEQ ID NO: 16476 - DNA, 16 bp, H. sapiens
aagattgtgccacttc

SEQ ID NO: 16477 - DNA, 16 bp, H. sapiens
aagattgtgtgtgtgt

SEQ ID NO: 16478 - DNA, 16 bp, H. sapiens
aagattgttgtgagga

SEQ ID NO: 16479 - DNA, 16 bp, H. sapiens
aagatttaacattgtt

SEQ ID NO: 16480 - DNA, 16 bp, H. sapiens
aagatttaagaaagga

SEQ ID NO: 16481 - DNA, 16 bp, H. sapiens
aagatttaatattgtt

SEQ ID NO: 16482 - DNA, 17 bp, H. sapiens
aagatttaccaagcaaa

SEQ ID NO: 16483 - DNA, 16 bp, H. sapiens
aagatttatccatatt

SEQ ID NO: 16484 - DNA, 16 bp, H. sapiens
aagatttatggacaga

SEQ ID NO: 16485 - DNA, 16 bp, H. sapiens
aagatttattttcttt

SEQ ID NO: 16486 - DNA, 16 bp, H. sapiens
aagatttcaaaaaaat

SEQ ID NO: 16487 - DNA, 16 bp, H. sapiens
aagatttcactctgtc

SEQ ID NO: 16488 - DNA, 16 bp, H. sapiens
aagatttcattaaaaa

SEQ ID NO: 16489 - DNA, 16 bp, H. sapiens
aagatttctcaaataa

SEQ ID NO: 16490 - DNA, 16 bp, H. sapiens
aagatttcttagatat

SEQ ID NO: 16491 - DNA, 16 bp, H. sapiens
aagatttctttaaaaa

SEQ ID NO: 16492 - DNA, 16 bp, H. sapiens
aagatttgaaatgttc

SEQ ID NO: 16493 - DNA, 16 bp, H. sapiens
aagatttgaaatgttt

SEQ ID NO: 16494 - DNA, 16 bp, H. sapiens
aagatttgaacccagg

SEQ ID NO: 16495 - DNA, 16 bp, H. sapiens
aagatttgactgcctt

SEQ ID NO: 16496 - DNA, 16 bp, H. sapiens
aagatttgggaaagtt

SEQ ID NO: 16497 - DNA, 16 bp, H. sapiens
aagatttgtctcttct

SEQ ID NO: 16498 - DNA, 16 bp, H. sapiens
aagatttgttgatttt

SEQ ID NO: 16499 - DNA, 16 bp, H. sapiens
aagattttaaacattt

SEQ ID NO: 16500 - DNA, 16 bp, H. sapiens
aagattttatgatgaa

SEQ ID NO: 16501 - DNA, 16 bp, H. sapiens
aagattttattttcct

SEQ ID NO: 16502 - DNA, 16 bp, H. sapiens
aagattttcagatttt

SEQ ID NO: 16503 - DNA, 16 bp, H. sapiens
aagattttcctttttt

SEQ ID NO: 16504 - DNA, 16 bp, H. sapiens
aagattttctttgaaa

SEQ ID NO: 16505 - DNA, 16 bp, H. sapiens
aagattttgaagcaac

SEQ ID NO: 16506 - DNA, 16 bp, H. sapiens
aagattttgaatgttg

SEQ ID NO: 16507 - DNA, 16 bp, H. sapiens
aagatttttaaaaaca

SEQ ID NO: 16508 - DNA, 16 bp, H. sapiens
aagatttttaaagata

SEQ ID NO: 16509 - DNA, 16 bp, H. sapiens
aagatttttcaacttt

SEQ ID NO: 16510 - DNA, 16 bp, H. sapiens
aagatttttgtctttt

SEQ ID NO: 16511 - DNA, 16 bp, H. sapiens
aagattttttaaaaga

SEQ ID NO: 16512 - DNA, 16 bp, H. sapiens
aagattttttaaaagt

SEQ ID NO: 16513 - DNA, 16 bp, H. sapiens
aagattttttaagatt

SEQ ID NO: 16514 - DNA, 16 bp, H. sapiens
aagattttttctttgt

SEQ ID NO: 16515 - DNA, 16 bp, H. sapiens
aagatttttttaaagc

SEQ ID NO: 16516 - DNA, 16 bp, H. sapiens
aagatttttttcctcc

SEQ ID NO: 16517 - DNA, 16 bp, H. sapiens
aagatttttttctctt

SEQ ID NO: 16518 - DNA, 16 bp, H. sapiens
aagatttttttgtctt

SEQ ID NO: 16519 - DNA, 16 bp, H. sapiens
aagatttttttttcat

SEQ ID NO: 16520 - DNA, 16 bp, H. sapiens
aagcaaaaactgaagg

SEQ ID NO: 16521 - DNA, 16 bp, H. sapiens
aagcaaaaagagaatt

SEQ ID NO: 16522 - DNA, 16 bp, H. sapiens
aagcaaaaagcaatca

SEQ ID NO: 16523 - DNA, 16 bp, H. sapiens
aagcaaaaattaatga

SEQ ID NO: 16524 - DNA, 16 bp, H. sapiens
aagcaaaaattgacaa

SEQ ID NO: 16525 - DNA, 16 bp, H. sapiens
aagcaaaaattgatga

SEQ ID NO: 16526 - DNA, 16 bp, H. sapiens
aagcaaaaattttgtt

SEQ ID NO: 16527 - DNA, 16 bp, H. sapiens
aagcaaaacaaaactt

SEQ ID NO: 16528 - DNA, 16 bp, H. sapiens
aagcaaaacaagaatt

SEQ ID NO: 16529 - DNA, 16 bp, H. sapiens
aagcaaaactatctct

SEQ ID NO: 16530 - DNA, 16 bp, H. sapiens
aagcaaaactgaaaat

SEQ ID NO: 16531 - DNA, 16 bp, H. sapiens
aagcaaaagctggaag

SEQ ID NO: 16532 - DNA, 16 bp, H. sapiens
aagcaaaaggggcagg

SEQ ID NO: 16533 - DNA, 16 bp, H. sapiens
aagcaaaaggggtttc

SEQ ID NO: 16534 - DNA, 16 bp, H. sapiens
aagcaaaagtggacaa

SEQ ID NO: 16535 - DNA, 16 bp, H. sapiens
aagcaaaatgaaattt

SEQ ID NO: 16536 - DNA, 16 bp, H. sapiens
aagcaaaatgtgatat

SEQ ID NO: 16537 - DNA, 16 bp, H. sapiens
aagcaaaattgacaaa

SEQ ID NO: 16538 - DNA, 16 bp, H. sapiens
aagcaaaatttcaaaa

SEQ ID NO: 16539 - DNA, 16 bp, H. sapiens
aagcaaaattttaaaa

SEQ ID NO: 16540 - DNA, 16 bp, H. sapiens
aagcaaacatttcctt

SEQ ID NO: 16541 - DNA, 16 bp, H. sapiens
aagcaaacattttaaa

SEQ ID NO: 16542 - DNA, 16 bp, H. sapiens
aagcaaacgtgtcctt

SEQ ID NO: 16543 - DNA, 16 bp, H. sapiens
aagcaaagaaagtggt

SEQ ID NO: 16544 - DNA, 18 bp, H. sapiens
aagcaaagaaatctccaa

SEQ ID NO: 16545 - DNA, 16 bp, H. sapiens
aagcaaagattgacaa

SEQ ID NO: 16546 - DNA, 16 bp, H. sapiens
aagcaaaggctgagag

SEQ ID NO: 16547 - DNA, 16 bp, H. sapiens
aagcaaataaaacttt

SEQ ID NO: 16548 - DNA, 16 bp, H. sapiens
aagcaaataggagaaa

SEQ ID NO: 16549 - DNA, 16 bp, H. sapiens
aagcaaatatcccagg

SEQ ID NO: 16550 - DNA, 16 bp, H. sapiens
aagcaaatgctgaaga

SEQ ID NO: 16551 - DNA, 39 bp, H. sapiens
aagcaaatgctgagagattttgtcaccaccaggcctgcc

SEQ ID NO: 16552 - DNA, 35 bp, H. sapiens
aagcaaatgctgagagattttgtcaccaccaggct

SEQ ID NO: 16553 - DNA, 38 bp, H. sapiens
aagcaaatgctgagagattttgtcaccaccagtcctgc

SEQ ID NO: 16554 - DNA, 16 bp, H. sapiens
aagcaaatggaaaaat

SEQ ID NO: 16555 - DNA, 16 bp, H. sapiens
aagcaaatggaaaata

SEQ ID NO: 16556 - DNA, 16 bp, H. sapiens
aagcaaatggaagaac

SEQ ID NO: 16557 - DNA, 16 bp, H. sapiens
aagcaaatgtaataaa

SEQ ID NO: 16558 - DNA, 16 bp, H. sapiens
aagcaaattaaagcag

SEQ ID NO: 16559 - DNA, 16 bp, H. sapiens
aagcaaattaaatcca

SEQ ID NO: 16560 - DNA, 16 bp, H. sapiens
aagcaaattaattttc

SEQ ID NO: 16561 - DNA, 16 bp, H. sapiens
aagcaaattgaaaaca

SEQ ID NO: 16562 - DNA, 16 bp, H. sapiens
aagcaaatttggaact

SEQ ID NO: 16563 - DNA, 16 bp, H. sapiens
aagcaaatttttaaaa

SEQ ID NO: 16564 - DNA, 16 bp, H. sapiens
aagcaacaacagcagc

SEQ ID NO: 16565 - DNA, 16 bp, H. sapiens
aagcaacagaaactga

SEQ ID NO: 16566 - DNA, 16 bp, H. sapiens
aagcaacagaaatcaa

SEQ ID NO: 16567 - DNA, 16 bp, H. sapiens
aagcaacagaaatgta

SEQ ID NO: 16568 - DNA, 16 bp, H. sapiens
aagcaacagaagttta

SEQ ID NO: 16569 - DNA, 16 bp, H. sapiens
aagcaacagatgttgg

SEQ ID NO: 16570 - DNA, 16 bp, H. sapiens
aagcaacagcagttta

SEQ ID NO: 16571 - DNA, 16 bp, H. sapiens
aagcaacatagtgaga

SEQ ID NO: 16572 - DNA, 16 bp, H. sapiens
aagcaacccaagtgtc

SEQ ID NO: 16573 - DNA, 37 bp, H. sapiens
aagcaactccaagacacataattgtcagattcaccaa

SEQ ID NO: 16574 - DNA, 16 bp, H. sapiens
aagcaactccttatct

SEQ ID NO: 16575 - DNA, 16 bp, H. sapiens
aagcaactgcagcaaa

SEQ ID NO: 16576 - DNA, 16 bp, H. sapiens
aagcaacttcagtgaa

SEQ ID NO: 16577 - DNA, 16 bp, H. sapiens
aagcaagaaaagaatg

SEQ ID NO: 16578 - DNA, 16 bp, H. sapiens
aagcaagaaatgggga

SEQ ID NO: 16579 - DNA, 16 bp, H. sapiens
aagcaagacacatctt

SEQ ID NO: 16580 - DNA, 16 bp, H. sapiens
aagcaagaccccatct

SEQ ID NO: 16581 - DNA, 16 bp, H. sapiens
aagcaagaccttgtct

SEQ ID NO: 16582 - DNA, 16 bp, H. sapiens
aagcaagactccatct

SEQ ID NO: 16583 - DNA, 16 bp, H. sapiens
aagcaagactctgtct

SEQ ID NO: 16584 - DNA, 27 bp, H. sapiens
aagcaagagcaaacacattcaaaagtt

SEQ ID NO: 16585 - DNA, 16 bp, H. sapiens
aagcaagagcaagcac

SEQ ID NO: 16586 - DNA, 16 bp, H. sapiens
aagcaagaggactgct

SEQ ID NO: 16587 - DNA, 16 bp, H. sapiens
aagcaagaggaggaat

SEQ ID NO: 16588 - DNA, 16 bp, H. sapiens
aagcaagaggattgct

SEQ ID NO: 16589 - DNA, 16 bp, H. sapiens
aagcaagcaaacaaat

SEQ ID NO: 16590 - DNA, 16 bp, H. sapiens
aagcaagcaagcaaac

SEQ ID NO: 16591 - DNA, 16 bp, H. sapiens
aagcaagcatcttctt

SEQ ID NO: 16592 - DNA, 17 bp, H. sapiens
aagcaagctggaagctt

SEQ ID NO: 16593 - DNA, 16 bp, H. sapiens
aagcaaggaaatatga

SEQ ID NO: 16594 - DNA, 16 bp, H. sapiens
aagcaagtcacatgat

SEQ ID NO: 16595 - DNA, 16 bp, H. sapiens
aagcaagtcatgtggc

SEQ ID NO: 16596 - DNA, 16 bp, H. sapiens
aagcaagttcttacag

SEQ ID NO: 16597 - DNA, 16 bp, H. sapiens
aagcaataaatatgga

SEQ ID NO: 16598 - DNA, 17 bp, H. sapiens
aagcaataacatcaaca

SEQ ID NO: 16599 - DNA, 17 bp, H. sapiens
aagcaatagggaaagga

SEQ ID NO: 16600 - DNA, 16 bp, H. sapiens
aagcaatatttattta

SEQ ID NO: 16601 - DNA, 16 bp, H. sapiens
aagcaatcctccaatc

SEQ ID NO: 16602 - DNA, 16 bp, H. sapiens
aagcaatcctccacct

SEQ ID NO: 16603 - DNA, 16 bp, H. sapiens
aagcaatcttcctgct

SEQ ID NO: 16604 - DNA, 16 bp, H. sapiens
aagcaatgaaagcaaa

SEQ ID NO: 16605 - DNA, 16 bp, H. sapiens
aagcaatgcatgactg

SEQ ID NO: 16606 - DNA, 16 bp, H. sapiens
aagcaatggagaaaaa

SEQ ID NO: 16607 - DNA, 16 bp, H. sapiens
aagcaatggggaaatg

SEQ ID NO: 16608 - DNA, 16 bp, H. sapiens
aagcaatggtaccagc

SEQ ID NO: 16609 - DNA, 16 bp, H. sapiens
aagcaatggtgaaagg

SEQ ID NO: 16610 - DNA, 16 bp, H. sapiens
aagcaattattattat

SEQ ID NO: 16611 - DNA, 16 bp, H. sapiens
aagcaattcacagatt

SEQ ID NO: 16612 - DNA, 16 bp, H. sapiens
aagcaattcagaaaat

SEQ ID NO: 16613 - DNA, 16 bp, H. sapiens
aagcaattccatttat

SEQ ID NO: 16614 - DNA, 16 bp, H. sapiens
aagcaattcccatgcc

SEQ ID NO: 16615 - DNA, 17 bp, H. sapiens
aagcaattcccttgcct

SEQ ID NO: 16616 - DNA, 16 bp, H. sapiens
aagcaattgtgagtgg

SEQ ID NO: 16617 - DNA, 16 bp, H. sapiens
aagcaatttaaaacat

SEQ ID NO: 16618 - DNA, 16 bp, H. sapiens
aagcaatttctcagat

SEQ ID NO: 16619 - DNA, 16 bp, H. sapiens
aagcaatttggaaatt

SEQ ID NO: 16620 - DNA, 16 bp, H. sapiens
aagcaattttaaaaag

SEQ ID NO: 16621 - DNA, 16 bp, H. sapiens
aagcaattttagaaaa

SEQ ID NO: 16622 - DNA, 16 bp, H. sapiens
aagcaattttcaaaat

SEQ ID NO: 16623 - DNA, 16 bp, H. sapiens
aagcacaaagctggag

SEQ ID NO: 16624 - DNA, 16 bp, H. sapiens
aagcacaaattttaaa

SEQ ID NO: 16625 - DNA, 16 bp, H. sapiens
aagcacaagtgccact

SEQ ID NO: 16626 - DNA, 16 bp, H. sapiens
aagcacaatcagaaat

SEQ ID NO: 16627 - DNA, 16 bp, H. sapiens
aagcacacacagacac

SEQ ID NO: 16628 - DNA, 16 bp, H. sapiens
aagcacagactttgga

SEQ ID NO: 16629 - DNA, 16 bp, H. sapiens
aagcacatgaaaaaga

SEQ ID NO: 16630 - DNA, 16 bp, H. sapiens
aagcacatttttaaaa

SEQ ID NO: 16631 - DNA, 16 bp, H. sapiens
aagcaccacctactgg

SEQ ID NO: 16632 - DNA, 16 bp, H. sapiens
aagcaccaggaatctg

SEQ ID NO: 16633 - DNA, 17 bp, H. sapiens
aagcacccagttcatga

SEQ ID NO: 16634 - DNA, 16 bp, H. sapiens
aagcaccgcctcccgg

SEQ ID NO: 16635 - DNA, 16 bp, H. sapiens
aagcacctactatgtg

SEQ ID NO: 16636 - DNA, 16 bp, H. sapiens
aagcactaaacaagga

SEQ ID NO: 16637 - DNA, 17 bp, H. sapiens
aagcactatcacaagga

SEQ ID NO: 16638 - DNA, 16 bp, H. sapiens
aagcactcctttttct

SEQ ID NO: 16639 - DNA, 16 bp, H. sapiens
aagcactgaataaata

SEQ ID NO: 16640 - DNA, 16 bp, H. sapiens
aagcactggaattaca

SEQ ID NO: 16641 - DNA, 16 bp, H. sapiens
aagcacttctgctgca

SEQ ID NO: 16642 - DNA, 16 bp, H. sapiens
aagcactttatatttt

SEQ ID NO: 16643 - DNA, 16 bp, H. sapiens
aagcactttctcagaa

SEQ ID NO: 16644 - DNA, 16 bp, H. sapiens
aagcactttcttcaca

SEQ ID NO: 16645 - DNA, 16 bp, H. sapiens
aagcactttgggaggc

SEQ ID NO: 16646 - DNA, 16 bp, H. sapiens
aagcagaaaagctgaa

SEQ ID NO: 16647 - DNA, 16 bp, H. sapiens
aagcagaaaataattt

SEQ ID NO: 16648 - DNA, 16 bp, H. sapiens
aagcagaaaatgtatt

SEQ ID NO: 16649 - DNA, 16 bp, H. sapiens
aagcagaaagatggaa

SEQ ID NO: 16650 - DNA, 16 bp, H. sapiens
aagcagaaataaaatt

SEQ ID NO: 16651 - DNA, 16 bp, H. sapiens
aagcagaaatccctga

SEQ ID NO: 16652 - DNA, 16 bp, H. sapiens
aagcagaaatgagaaa

SEQ ID NO: 16653 - DNA, 16 bp, H. sapiens
aagcagaaatttaaaa

SEQ ID NO: 16654 - DNA, 16 bp, H. sapiens
aagcagaacataaaag

SEQ ID NO: 16655 - DNA, 16 bp, H. sapiens
aagcagaagaaaaagt

SEQ ID NO: 16656 - DNA, 16 bp, H. sapiens
aagcagaagaaggaat

SEQ ID NO: 16657 - DNA, 16 bp, H. sapiens
aagcagaagaatgaaa

SEQ ID NO: 16658 - DNA, 16 bp, H. sapiens
aagcagaagcagcaga

SEQ ID NO: 16659 - DNA, 16 bp, H. sapiens
aagcagaaggaaaagt

SEQ ID NO: 16660 - DNA, 16 bp, H. sapiens
aagcagaaggagtctt

SEQ ID NO: 16661 - DNA, 16 bp, H. sapiens
aagcagaagggcaaga

SEQ ID NO: 16662 - DNA, 16 bp, H. sapiens
aagcagaatggtggtt

SEQ ID NO: 16663 - DNA, 16 bp, H. sapiens
aagcagacagaaaaat

SEQ ID NO: 16664 - DNA, 16 bp, H. sapiens
aagcagacagccaaat

SEQ ID NO: 16665 - DNA, 16 bp, H. sapiens
aagcagacatccttgt

SEQ ID NO: 16666 - DNA, 16 bp, H. sapiens
aagcagagaaaattat

SEQ ID NO: 16667 - DNA, 16 bp, H. sapiens
aagcagagaatagaat

SEQ ID NO: 16668 - DNA, 16 bp, H. sapiens
aagcagagagaccagt

SEQ ID NO: 16669 - DNA, 16 bp, H. sapiens
aagcagagagcaaaat

SEQ ID NO: 16670 - DNA, 16 bp, H. sapiens
aagcagagagtgagcc

SEQ ID NO: 16671 - DNA, 18 bp, H. sapiens
aagcagagcataaaagtt

SEQ ID NO: 16672 - DNA, 16 bp, H. sapiens
aagcagaggaaaatgg

SEQ ID NO: 16673 - DNA, 16 bp, H. sapiens
aagcagaggcaacaaa

SEQ ID NO: 16674 - DNA, 16 bp, H. sapiens
aagcagaggcaggtgg

SEQ ID NO: 16675 - DNA, 16 bp, H. sapiens
aagcagaggctggagg

SEQ ID NO: 16676 - DNA, 16 bp, H. sapiens
aagcagagggaatact

SEQ ID NO: 16677 - DNA, 16 bp, H. sapiens
aagcagaggtcagaga

SEQ ID NO: 16678 - DNA, 16 bp, H. sapiens
aagcagaggttacagt

SEQ ID NO: 16679 - DNA, 16 bp, H. sapiens
aagcagatcctccagc

SEQ ID NO: 16680 - DNA, 16 bp, H. sapiens
aagcagatgaaaataa

SEQ ID NO: 16681 - DNA, 16 bp, H. sapiens
aagcagatgagtggtt

SEQ ID NO: 16682 - DNA, 16 bp, H. sapiens
aagcagatgccagtgc

SEQ ID NO: 16683 - DNA, 16 bp, H. sapiens
aagcagatgctgatgc

SEQ ID NO: 16684 - DNA, 16 bp, H. sapiens
aagcagattatcctcc

SEQ ID NO: 16685 - DNA, 16 bp, H. sapiens
aagcagattttaaaat

SEQ ID NO: 16686 - DNA, 16 bp, H. sapiens
aagcagatttttcttt

SEQ ID NO: 16687 - DNA, 16 bp, H. sapiens
aagcagcaaaacattt

SEQ ID NO: 16688 - DNA, 16 bp, H. sapiens
aagcagcaaagtattc

SEQ ID NO: 16689 - DNA, 16 bp, H. sapiens
aagcagcaagattaaa

SEQ ID NO: 16690 - DNA, 16 bp, H. sapiens
aagcagcaaggccctg

SEQ ID NO: 16691 - DNA, 16 bp, H. sapiens
aagcagcaagtgctga

SEQ ID NO: 16692 - DNA, 16 bp, H. sapiens
aagcagcaagtgttga

SEQ ID NO: 16693 - DNA, 16 bp, H. sapiens
aagcagcagaaaggcc

SEQ ID NO: 16694 - DNA, 16 bp, H. sapiens
aagcagcagcaacagc

SEQ ID NO: 16695 - DNA, 16 bp, H. sapiens
aagcagcagcagcaga

SEQ ID NO: 16696 - DNA, 17 bp, H. sapiens
aagcagcagcagcagct

SEQ ID NO: 16697 - DNA, 16 bp, H. sapiens
aagcagcagcagcagg

SEQ ID NO: 16698 - DNA, 16 bp, H. sapiens
aagcagcagcagccac

SEQ ID NO: 16699 - DNA, 16 bp, H. sapiens
aagcagcagcagctgc

SEQ ID NO: 16700 - DNA, 16 bp, H. sapiens
aagcagcaggaaggag

SEQ ID NO: 16701 - DNA, 16 bp, H. sapiens
aagcagcaggagagaa

SEQ ID NO: 16702 - DNA, 16 bp, H. sapiens
aagcagcaggagagag

SEQ ID NO: 16703 - DNA, 16 bp, H. sapiens
aagcagcaggtgctga

SEQ ID NO: 16704 - DNA, 16 bp, H. sapiens
aagcagccaggaggga

SEQ ID NO: 16705 - DNA, 16 bp, H. sapiens
aagcagccaggagtgg

SEQ ID NO: 16706 - DNA, 16 bp, H. sapiens
aagcagccaggtgtgg

SEQ ID NO: 16707 - DNA, 16 bp, H. sapiens
aagcagcccagaagct

SEQ ID NO: 16708 - DNA, 16 bp, H. sapiens
aagcagcccattcctg

SEQ ID NO: 16709 - DNA, 19 bp, H. sapiens
aagcagccctgagaaacat

SEQ ID NO: 16710 - DNA, 16 bp, H. sapiens
aagcagcctcttttta

SEQ ID NO: 16711 - DNA, 16 bp, H. sapiens
aagcagctcccagctt

SEQ ID NO: 16712 - DNA, 16 bp, H. sapiens
aagcagctgaccaatc

SEQ ID NO: 16713 - DNA, 16 bp, H. sapiens
aagcagctgcaggggc

SEQ ID NO: 16714 - DNA, 16 bp, H. sapiens
aagcagctgggactat

SEQ ID NO: 16715 - DNA, 16 bp, H. sapiens
aagcagctgtagacaa

SEQ ID NO: 16716 - DNA, 16 bp, H. sapiens
aagcagctgtggccag

SEQ ID NO: 16717 - DNA, 16 bp, H. sapiens
aagcagcttcagcaaa

SEQ ID NO: 16718 - DNA, 16 bp, H. sapiens
aagcaggaaacatcca

SEQ ID NO: 16719 - DNA, 16 bp, H. sapiens
aagcaggaagactgct

SEQ ID NO: 16720 - DNA, 16 bp, H. sapiens
aagcaggagaactgct

SEQ ID NO: 16721 - DNA, 16 bp, H. sapiens
aagcaggagaatagct

SEQ ID NO: 16722 - DNA, 16 bp, H. sapiens
aagcaggagaatggtg

SEQ ID NO: 16723 - DNA, 16 bp, H. sapiens
aagcaggagaatttct

SEQ ID NO: 16724 - DNA, 16 bp, H. sapiens
aagcaggagacagatg

SEQ ID NO: 16725 - DNA, 16 bp, H. sapiens
aagcaggagcaggcac

SEQ ID NO: 16726 - DNA, 16 bp, H. sapiens
aagcaggaggaatgct

SEQ ID NO: 16727 - DNA, 16 bp, H. sapiens
aagcaggatggagaat

SEQ ID NO: 16728 - DNA, 16 bp, H. sapiens
aagcaggatgttggca

SEQ ID NO: 16729 - DNA, 16 bp, H. sapiens
aagcaggatttttttt

SEQ ID NO: 16730 - DNA, 16 bp, H. sapiens
aagcaggcagaggaac

SEQ ID NO: 16731 - DNA, 16 bp, H. sapiens
aagcaggcagaggaag

SEQ ID NO: 16732 - DNA, 16 bp, H. sapiens
aagcaggcaggcctcc

SEQ ID NO: 16733 - DNA, 16 bp, H. sapiens
aagcaggccgggcatg

SEQ ID NO: 16734 - DNA, 16 bp, H. sapiens
aagcaggcctcagaaa

SEQ ID NO: 16735 - DNA, 16 bp, H. sapiens
aagcaggctgccccag

SEQ ID NO: 16736 - DNA, 16 bp, H. sapiens
aagcagggaagatcta

SEQ ID NO: 16737 - DNA, 16 bp, H. sapiens
aagcagggaagtgaca

SEQ ID NO: 16738 - DNA, 16 bp, H. sapiens
aagcagggacaatttg

SEQ ID NO: 16739 - DNA, 24 bp, H. sapiens
aagcagggcgaggcattgcctcac

SEQ ID NO: 16740 - DNA, 16 bp, H. sapiens
aagcagtcaagagaag

SEQ ID NO: 16741 - DNA, 16 bp, H. sapiens
aagcagtcctcccact

SEQ ID NO: 16742 - DNA, 16 bp, H. sapiens
aagcagtcttctcacc

SEQ ID NO: 16743 - DNA, 16 bp, H. sapiens
aagcagtgagagaaaa

SEQ ID NO: 16744 - DNA, 16 bp, H. sapiens
aagcagtgattttcaa

SEQ ID NO: 16745 - DNA, 16 bp, H. sapiens
aagcagtggacaccag

SEQ ID NO: 16746 - DNA, 16 bp, H. sapiens
aagcagtgggaagagc

SEQ ID NO: 16747 - DNA, 17 bp, H. sapiens
aagcagttctcttgcct

SEQ ID NO: 16748 - DNA, 16 bp, H. sapiens
aagcagtttctcagaa

SEQ ID NO: 16749 - DNA, 16 bp, H. sapiens
aagcagttttaagagg

SEQ ID NO: 16750 - DNA, 16 bp, H. sapiens
aagcataaaaatggat

SEQ ID NO: 16751 - DNA, 16 bp, H. sapiens
aagcataaaactcaca

SEQ ID NO: 16752 - DNA, 16 bp, H. sapiens
aagcataaaatatgta

SEQ ID NO: 16753 - DNA, 16 bp, H. sapiens
aagcataaatgaattt

SEQ ID NO: 16754 - DNA, 16 bp, H. sapiens
aagcataatataaaat

SEQ ID NO: 16755 - DNA, 16 bp, H. sapiens
aagcatagaagaaaat

SEQ ID NO: 16756 - DNA, 16 bp, H. sapiens
aagcatataaaaatgc

SEQ ID NO: 16757 - DNA, 16 bp, H. sapiens
aagcatatgaagaaat

SEQ ID NO: 16758 - DNA, 16 bp, H. sapiens
aagcatatgagaagat

SEQ ID NO: 16759 - DNA, 16 bp, H. sapiens
aagcatatgataaaaa

SEQ ID NO: 16760 - DNA, 16 bp, H. sapiens
aagcatatgataaaat

SEQ ID NO: 16761 - DNA, 16 bp, H. sapiens
aagcatatgggaaaat

SEQ ID NO: 16762 - DNA, 16 bp, H. sapiens
aagcatattaaaatat

SEQ ID NO: 16763 - DNA, 16 bp, H. sapiens
aagcatattcaaatag

SEQ ID NO: 16764 - DNA, 16 bp, H. sapiens
aagcatattttaaaaa

SEQ ID NO: 16765 - DNA, 16 bp, H. sapiens
aagcatccagcaaggg

SEQ ID NO: 16766 - DNA, 16 bp, H. sapiens
aagcatccagtctttc

SEQ ID NO: 16767 - DNA, 16 bp, H. sapiens
aagcatctttttaaaa

SEQ ID NO: 16768 - DNA, 16 bp, H. sapiens
aagcatgaaggagaaa

SEQ ID NO: 16769 - DNA, 16 bp, H. sapiens
aagcatgagccactgc

SEQ ID NO: 16770 - DNA, 16 bp, H. sapiens
aagcatgattttaaaa

SEQ ID NO: 16771 - DNA, 16 bp, H. sapiens
aagcatgcaataaata

SEQ ID NO: 16772 - DNA, 16 bp, H. sapiens
aagcatgcagagaaaa

SEQ ID NO: 16773 - DNA, 16 bp, H. sapiens
aagcatggaaaagaaa

SEQ ID NO: 16774 - DNA, 16 bp, H. sapiens
aagcatggatttttat

SEQ ID NO: 16775 - DNA, 16 bp, H. sapiens
aagcatgggagtgcag

SEQ ID NO: 16776 - DNA, 16 bp, H. sapiens
aagcatggtggcttct

SEQ ID NO: 16777 - DNA, 16 bp, H. sapiens
aagcatgtacagctac

SEQ ID NO: 16778 - DNA, 16 bp, H. sapiens
aagcatgtgaagaaaa

SEQ ID NO: 16779 - DNA, 17 bp, H. sapiens
aagcatgtgatctttgt

SEQ ID NO: 16780 - DNA, 16 bp, H. sapiens
aagcattaaataaatg

SEQ ID NO: 16781 - DNA, 16 bp, H. sapiens
aagcattaccacctga

SEQ ID NO: 16782 - DNA, 16 bp, H. sapiens
aagcattaccttttct

SEQ ID NO: 16783 - DNA, 16 bp, H. sapiens
aagcattaggattaca

SEQ ID NO: 16784 - DNA, 16 bp, H. sapiens
aagcattatatatata

SEQ ID NO: 16785 - DNA, 16 bp, H. sapiens
aagcattatttcattt

SEQ ID NO: 16786 - DNA, 16 bp, H. sapiens
aagcattcaagaccag

SEQ ID NO: 16787 - DNA, 16 bp, H. sapiens
aagcattccctcttct

SEQ ID NO: 16788 - DNA, 16 bp, H. sapiens
aagcattcctttctct

SEQ ID NO: 16789 - DNA, 16 bp, H. sapiens
aagcattcctttttct

SEQ ID NO: 16790 - DNA, 16 bp, H. sapiens
aagcattctaagtcac

SEQ ID NO: 16791 - DNA, 16 bp, H. sapiens
aagcattctcaggaac

SEQ ID NO: 16792 - DNA, 16 bp, H. sapiens
aagcattctccaaaac

SEQ ID NO: 16793 - DNA, 16 bp, H. sapiens
aagcattctctttgaa

SEQ ID NO: 16794 - DNA, 16 bp, H. sapiens
aagcattcttctacac

SEQ ID NO: 16795 - DNA, 16 bp, H. sapiens
aagcattgacttctct

SEQ ID NO: 16796 - DNA, 16 bp, H. sapiens
aagcatttaataaata

SEQ ID NO: 16797 - DNA, 16 bp, H. sapiens
aagcatttatccttca

SEQ ID NO: 16798 - DNA, 16 bp, H. sapiens
aagcatttattctttt

SEQ ID NO: 16799 - DNA, 16 bp, H. sapiens
aagcatttatttttca

SEQ ID NO: 16800 - DNA, 16 bp, H. sapiens
aagcatttcccttgag

SEQ ID NO: 16801 - DNA, 16 bp, H. sapiens
aagcatttctaaaatg

SEQ ID NO: 16802 - DNA, 16 bp, H. sapiens
aagcatttcttcaaag

SEQ ID NO: 16803 - DNA, 16 bp, H. sapiens
aagcatttctttttct

SEQ ID NO: 16804 - DNA, 16 bp, H. sapiens
aagcatttgaaaaaaa

SEQ ID NO: 16805 - DNA, 16 bp, H. sapiens
aagcatttgaaaaatt

SEQ ID NO: 16806 - DNA, 16 bp, H. sapiens
aagcatttgaaaacat

SEQ ID NO: 16807 - DNA, 16 bp, H. sapiens
aagcatttgaccaaat

SEQ ID NO: 16808 - DNA, 16 bp, H. sapiens
aagcattttaaaataa

SEQ ID NO: 16809 - DNA, 16 bp, H. sapiens
aagcattttaaagaaa

SEQ ID NO: 16810 - DNA, 16 bp, H. sapiens
aagcattttaaataat

SEQ ID NO: 16811 - DNA, 16 bp, H. sapiens
aagcattttaaatatt

SEQ ID NO: 16812 - DNA, 16 bp, H. sapiens
aagcattttagtttga

SEQ ID NO: 16813 - DNA, 16 bp, H. sapiens
aagcattttataaaaa

SEQ ID NO: 16814 - DNA, 16 bp, H. sapiens
aagcattttatattta

SEQ ID NO: 16815 - DNA, 16 bp, H. sapiens
aagcattttattaaaa

SEQ ID NO: 16816 - DNA, 16 bp, H. sapiens
aagcatttttaaaata

SEQ ID NO: 16817 - DNA, 16 bp, H. sapiens
aagcatttttaagtgt

SEQ ID NO: 16818 - DNA, 16 bp, H. sapiens
aagcattttttaaaat

SEQ ID NO: 16819 - DNA, 16 bp, H. sapiens
aagcattttttcatat

SEQ ID NO: 16820 - DNA, 16 bp, H. sapiens
aagcattttttccttt

SEQ ID NO: 16821 - DNA, 16 bp, H. sapiens
aagccaaaaagcttct

SEQ ID NO: 16822 - DNA, 16 bp, H. sapiens
aagccaaaagattgga

SEQ ID NO: 16823 - DNA, 16 bp, H. sapiens
aagccaaaatacacaa

SEQ ID NO: 16824 - DNA, 16 bp, H. sapiens
aagccaaaattgacca

SEQ ID NO: 16825 - DNA, 16 bp, H. sapiens
aagccaaagactggga

SEQ ID NO: 16826 - DNA, 16 bp, H. sapiens
aagccaaataaacctc

SEQ ID NO: 16827 - DNA, 16 bp, H. sapiens
aagccaaatgaagaaa

SEQ ID NO: 16828 - DNA, 16 bp, H. sapiens
aagccaacatcaccct

SEQ ID NO: 16829 - DNA, 16 bp, H. sapiens
aagccaagaagaatct

SEQ ID NO: 16830 - DNA, 16 bp, H. sapiens
aagccaagaagatctg

SEQ ID NO: 16831 - DNA, 16 bp, H. sapiens
aagccaagacaggagg

SEQ ID NO: 16832 - DNA, 17 bp, H. sapiens
aagccaagatcacgcca

SEQ ID NO: 16833 - DNA, 17 bp, H. sapiens
aagccaagatcatgcca

SEQ ID NO: 16834 - DNA, 17 bp, H. sapiens
aagccaagatcgcgcca

SEQ ID NO: 16835 - DNA, 22 bp, H. sapiens
aagccaagctccccaggcccag

SEQ ID NO: 16836 - DNA, 16 bp, H. sapiens
aagccaaggaactacc

SEQ ID NO: 16837 - DNA, 16 bp, H. sapiens
aagccaaggacagagg

SEQ ID NO: 16838 - DNA, 16 bp, H. sapiens
aagccaaggagacagg

SEQ ID NO: 16839 - DNA, 16 bp, H. sapiens
aagccaaggagagaga

SEQ ID NO: 16840 - DNA, 16 bp, H. sapiens
aagccaaggagccaag

SEQ ID NO: 16841 - DNA, 16 bp, H. sapiens
aagccaaggcagatgg

SEQ ID NO: 16842 - DNA, 16 bp, H. sapiens
aagccaagggaagaga

SEQ ID NO: 16843 - DNA, 16 bp, H. sapiens
aagccaaggtgggagg

SEQ ID NO: 16844 - DNA, 16 bp, H. sapiens
aagccaagtaaagaaa

SEQ ID NO: 16845 - DNA, 16 bp, H. sapiens
aagccaagtacagaaa

SEQ ID NO: 16846 - DNA, 16 bp, H. sapiens
aagccaatgggccagg

SEQ ID NO: 16847 - DNA, 16 bp, H. sapiens
aagccaattaaatctc

SEQ ID NO: 16848 - DNA, 16 bp, H. sapiens
aagccaattaacatat

SEQ ID NO: 16849 - DNA, 16 bp, H. sapiens
aagccaattaagatct

SEQ ID NO: 16850 - DNA, 16 bp, H. sapiens
aagccacactgcctgg

SEQ ID NO: 16851 - DNA, 16 bp, H. sapiens
aagccacagaatggga

SEQ ID NO: 16852 - DNA, 16 bp, H. sapiens
aagccacagcagaaga

SEQ ID NO: 16853 - DNA, 16 bp, H. sapiens
aagccacagctcccag

SEQ ID NO: 16854 - DNA, 16 bp, H. sapiens
aagccacattttgaaa

SEQ ID NO: 16855 - DNA, 16 bp, H. sapiens
aagccaccacccctgg

SEQ ID NO: 16856 - DNA, 16 bp, H. sapiens
aagccaccatgcctgg

SEQ ID NO: 16857 - DNA, 16 bp, H. sapiens
aagccaccatgctggg

SEQ ID NO: 16858 - DNA, 16 bp, H. sapiens
aagccacccaatttat

SEQ ID NO: 16859 - DNA, 16 bp, H. sapiens
aagccacccagactgt

SEQ ID NO: 16860 - DNA, 16 bp, H. sapiens
aagccaccgagcctgg

SEQ ID NO: 16861 - DNA, 19 bp, H. sapiens
aagccaccgtgcccagcca

SEQ ID NO: 16862 - DNA, 16 bp, H. sapiens
aagccacggcccaagc

SEQ ID NO: 16863 - DNA, 16 bp, H. sapiens
aagccactattgtctg

SEQ ID NO: 16864 - DNA, 16 bp, H. sapiens
aagccactgaattttg

SEQ ID NO: 16865 - DNA, 16 bp, H. sapiens
aagccactgagaaaat

SEQ ID NO: 16866 - DNA, 16 bp, H. sapiens
aagccactgagtctgt

SEQ ID NO: 16867 - DNA, 17 bp, H. sapiens
aagccactgcaaaaaca

SEQ ID NO: 16868 - DNA, 16 bp, H. sapiens
aagccactgcacctgg

SEQ ID NO: 16869 - DNA, 16 bp, H. sapiens
aagccactgtgccagg

SEQ ID NO: 16870 - DNA, 19 bp, H. sapiens
aagccactgtgcctggccc

SEQ ID NO: 16871 - DNA, 16 bp, H. sapiens
aagccactgtgctggg

SEQ ID NO: 16872 - DNA, 16 bp, H. sapiens
aagccactgtgcttgg

SEQ ID NO: 16873 - DNA, 16 bp, H. sapiens
aagccagaaaagactg

SEQ ID NO: 16874 - DNA, 16 bp, H. sapiens
aagccagaaatccaga

SEQ ID NO: 16875 - DNA, 16 bp, H. sapiens
aagccagaagagactg

SEQ ID NO: 16876 - DNA, 41 bp, H. sapiens
aagccagaagagagtgggggccaatattcaacattcttaaa

SEQ ID NO: 16877 - DNA, 16 bp, H. sapiens
aagccagaagatattg

SEQ ID NO: 16878 - DNA, 16 bp, H. sapiens
aagccagacaaagaca

SEQ ID NO: 16879 - DNA, 16 bp, H. sapiens
aagccagacagaaaag

SEQ ID NO: 16880 - DNA, 16 bp, H. sapiens
aagccagactgcctgg

SEQ ID NO: 16881 - DNA, 16 bp, H. sapiens
aagccagagacagaaa

SEQ ID NO: 16882 - DNA, 16 bp, H. sapiens
aagccagattttaaaa

SEQ ID NO: 16883 - DNA, 16 bp, H. sapiens
aagccagcaagaccac

SEQ ID NO: 16884 - DNA, 16 bp, H. sapiens
aagccagcaattgttt

SEQ ID NO: 16885 - DNA, 16 bp, H. sapiens
aagccagcacagtact

SEQ ID NO: 16886 - DNA, 16 bp, H. sapiens
aagccagcagtcccca

SEQ ID NO: 16887 - DNA, 16 bp, H. sapiens
aagccagccaagccag

SEQ ID NO: 16888 - DNA, 16 bp, H. sapiens
aagccagccagccagc

SEQ ID NO: 16889 - DNA, 16 bp, H. sapiens
aagccagccaggcagc

SEQ ID NO: 16890 - DNA, 16 bp, H. sapiens
aagccagcctggacaa

SEQ ID NO: 16891 - DNA, 16 bp, H. sapiens
aagccagctgcaaaaa

SEQ ID NO: 16892 - DNA, 16 bp, H. sapiens
aagccagctgccatgt

SEQ ID NO: 16893 - DNA, 21 bp, H. sapiens
aagccagctgggctcctgagt

SEQ ID NO: 16894 - DNA, 16 bp, H. sapiens
aagccaggaagaaagc

SEQ ID NO: 16895 - DNA, 16 bp, H. sapiens
aagccaggaagaaggc

SEQ ID NO: 16896 - DNA, 16 bp, H. sapiens
aagccaggaagacagc

SEQ ID NO: 16897 - DNA, 16 bp, H. sapiens
aagccaggactcaaac

SEQ ID NO: 16898 - DNA, 16 bp, H. sapiens
aagccaggaggtcaag

SEQ ID NO: 16899 - DNA, 16 bp, H. sapiens
aagccaggatggtctc

SEQ ID NO: 16900 - DNA, 16 bp, H. sapiens
aagccaggcacaaaag

SEQ ID NO: 16901 - DNA, 16 bp, H. sapiens
aagccaggcacagaag

SEQ ID NO: 16902 - DNA, 16 bp, H. sapiens
aagccaggcaccatgg

SEQ ID NO: 16903 - DNA, 16 bp, H. sapiens
aagccaggcatggtgg

SEQ ID NO: 16904 - DNA, 16 bp, H. sapiens
aagccagggacagaaa

SEQ ID NO: 16905 - DNA, 16 bp, H. sapiens
aagccagggcacccag

SEQ ID NO: 16906 - DNA, 16 bp, H. sapiens
aagccagggccatgcc

SEQ ID NO: 16907 - DNA, 16 bp, H. sapiens
aagccaggtgtcagga

SEQ ID NO: 16908 - DNA, 16 bp, H. sapiens
aagccaggtgtggtgg

SEQ ID NO: 16909 - DNA, 16 bp, H. sapiens
aagccagtacagcact

SEQ ID NO: 16910 - DNA, 17 bp, H. sapiens
aagccagtagtggctca

SEQ ID NO: 16911 - DNA, 16 bp, H. sapiens
aagccagtccctggtg

SEQ ID NO: 16912 - DNA, 16 bp, H. sapiens
aagccagtcctgcctc

SEQ ID NO: 16913 - DNA, 16 bp, H. sapiens
aagccagtctgaaaag

SEQ ID NO: 16914 - DNA, 16 bp, H. sapiens
aagccagtggtgtaat

SEQ ID NO: 16915 - DNA, 16 bp, H. sapiens
aagccagttggctgaa

SEQ ID NO: 16916 - DNA, 16 bp, H. sapiens
aagccataaaaaatga

SEQ ID NO: 16917 - DNA, 27 bp, H. sapiens
aagccatcatatcccctgtgacctgca

SEQ ID NO: 16918 - DNA, 16 bp, H. sapiens
aagccatcctcccact

SEQ ID NO: 16919 - DNA, 16 bp, H. sapiens
aagccatctataacaa

SEQ ID NO: 16920 - DNA, 16 bp, H. sapiens
aagccatcttcctgcc

SEQ ID NO: 16921 - DNA, 16 bp, H. sapiens
aagccatcttggtaaa

SEQ ID NO: 16922 - DNA, 16 bp, H. sapiens
aagccatcttttaaaa

SEQ ID NO: 16923 - DNA, 16 bp, H. sapiens
aagccatgagaagaca

SEQ ID NO: 16924 - DNA, 16 bp, H. sapiens
aagccatgagggatcc

SEQ ID NO: 16925 - DNA, 16 bp, H. sapiens
aagccattcaacaagt

SEQ ID NO: 16926 - DNA, 16 bp, H. sapiens
aagccattctccagcc

SEQ ID NO: 16927 - DNA, 16 bp, H. sapiens
aagccatttatttatt

SEQ ID NO: 16928 - DNA, 16 bp, H. sapiens
aagccattttaactgg

SEQ ID NO: 16929 - DNA, 16 bp, H. sapiens
aagccattttcttttt

SEQ ID NO: 16930 - DNA, 16 bp, H. sapiens
aagcccaaaatcaagg

SEQ ID NO: 16931 - DNA, 16 bp, H. sapiens
aagcccaaaccccagc

SEQ ID NO: 16932 - DNA, 16 bp, H. sapiens
aagcccaaaggctgga

SEQ ID NO: 16933 - DNA, 16 bp, H. sapiens
aagcccaacactttgg

SEQ ID NO: 16934 - DNA, 16 bp, H. sapiens
aagcccaagaggtcaa

SEQ ID NO: 16935 - DNA, 16 bp, H. sapiens
aagcccagaacctgat

SEQ ID NO: 16936 - DNA, 16 bp, H. sapiens
aagcccagaaggttga

SEQ ID NO: 16937 - DNA, 16 bp, H. sapiens
aagcccagagctccag

SEQ ID NO: 16938 - DNA, 16 bp, H. sapiens
aagcccagattgtgcc

SEQ ID NO: 16939 - DNA, 16 bp, H. sapiens
aagcccagcccagcca

SEQ ID NO: 16940 - DNA, 16 bp, H. sapiens
aagcccagcctggaca

SEQ ID NO: 16941 - DNA, 16 bp, H. sapiens
aagcccagcctgggca

SEQ ID NO: 16942 - DNA, 16 bp, H. sapiens
aagcccagctctgcca

SEQ ID NO: 16943 - DNA, 16 bp, H. sapiens
aagcccaggaagtcaa

SEQ ID NO: 16944 - DNA, 16 bp, H. sapiens
aagcccaggaatttga

SEQ ID NO: 16945 - DNA, 16 bp, H. sapiens
aagcccaggaggctga

SEQ ID NO: 16946 - DNA, 18 bp, H. sapiens
aagcccaggagtttgaga

SEQ ID NO: 16947 - DNA, 16 bp, H. sapiens
aagcccaggcaggagg

SEQ ID NO: 16948 - DNA, 16 bp, H. sapiens
aagcccagggaggtca

SEQ ID NO: 16949 - DNA, 16 bp, H. sapiens
aagcccatcaaaaagt

SEQ ID NO: 16950 - DNA, 16 bp, H. sapiens
aagcccatcagactac

SEQ ID NO: 16951 - DNA, 16 bp, H. sapiens
aagccccacccagtga

SEQ ID NO: 16952 - DNA, 16 bp, H. sapiens
aagccccaccctcaag

SEQ ID NO: 16953 - DNA, 16 bp, H. sapiens
aagccccacctcctgg

SEQ ID NO: 16954 - DNA, 16 bp, H. sapiens
aagccccaccttcagg

SEQ ID NO: 16955 - DNA, 16 bp, H. sapiens
aagccccatctctgct

SEQ ID NO: 16956 - DNA, 16 bp, H. sapiens
aagccccctccctgct

SEQ ID NO: 16957 - DNA, 16 bp, H. sapiens
aagcccctcactgcct

SEQ ID NO: 16958 - DNA, 16 bp, H. sapiens
aagcccctgaagtata

SEQ ID NO: 16959 - DNA, 16 bp, H. sapiens
aagccccttagaaaac

SEQ ID NO: 16960 - DNA, 16 bp, H. sapiens
aagcccggctagtttt

SEQ ID NO: 16961 - DNA, 16 bp, H. sapiens
aagccctcaccagaag

SEQ ID NO: 16962 - DNA, 19 bp, H. sapiens
aagccctctatcaatactg

SEQ ID NO: 16963 - DNA, 16 bp, H. sapiens
aagccctgcctcccgg

SEQ ID NO: 16964 - DNA, 16 bp, H. sapiens
aagccctggctgcctc

SEQ ID NO: 16965 - DNA, 16 bp, H. sapiens
aagccctgggccctga

SEQ ID NO: 16966 - DNA, 16 bp, H. sapiens
aagccctgggtctggg

SEQ ID NO: 16967 - DNA, 16 bp, H. sapiens
aagccctttatttctt

SEQ ID NO: 16968 - DNA, 17 bp, H. sapiens
aagccgagatcatgcca

SEQ ID NO: 16969 - DNA, 16 bp, H. sapiens
aagccgagatcctgcc

SEQ ID NO: 16970 - DNA, 17 bp, H. sapiens
aagccgagatcgcacca

SEQ ID NO: 16971 - DNA, 17 bp, H. sapiens
aagccgagatcgtgcca

SEQ ID NO: 16972 - DNA, 16 bp, H. sapiens
aagccgggcatggtgg

SEQ ID NO: 16973 - DNA, 16 bp, H. sapiens
aagccgggtgtggtgg

SEQ ID NO: 16974 - DNA, 16 bp, H. sapiens
aagccgtcctgggcca

SEQ ID NO: 16975 - DNA, 16 bp, H. sapiens
aagcctattgtgaact

SEQ ID NO: 16976 - DNA, 16 bp, H. sapiens
aagcctattttctttt

SEQ ID NO: 16977 - DNA, 16 bp, H. sapiens
aagcctcaaagcactg

SEQ ID NO: 16978 - DNA, 16 bp, H. sapiens
aagcctcagctcttgc

SEQ ID NO: 16979 - DNA, 16 bp, H. sapiens
aagcctcagcttcctc

SEQ ID NO: 16980 - DNA, 16 bp, H. sapiens
aagcctcaggctgctt

SEQ ID NO: 16981 - DNA, 16 bp, H. sapiens
aagcctcagttccctc

SEQ ID NO: 16982 - DNA, 16 bp, H. sapiens
aagcctcagtttctcc

SEQ ID NO: 16983 - DNA, 16 bp, H. sapiens
aagcctcattttcctc

SEQ ID NO: 16984 - DNA, 16 bp, H. sapiens
aagcctcatttttctc

SEQ ID NO: 16985 - DNA, 16 bp, H. sapiens
aagcctccatctcaaa

SEQ ID NO: 16986 - DNA, 17 bp, H. sapiens
aagcctcccaagtagct

SEQ ID NO: 16987 - DNA, 16 bp, H. sapiens
aagcctccccagaagc

SEQ ID NO: 16988 - DNA, 16 bp, H. sapiens
aagcctcctttgcgtc

SEQ ID NO: 16989 - DNA, 16 bp, H. sapiens
aagcctctgcttgtgt

SEQ ID NO: 16990 - DNA, 16 bp, H. sapiens
aagcctgaaatattta

SEQ ID NO: 16991 - DNA, 16 bp, H. sapiens
aagcctgcagcagcag

SEQ ID NO: 16992 - DNA, 16 bp, H. sapiens
aagcctgctgcagaaa

SEQ ID NO: 16993 - DNA, 16 bp, H. sapiens
aagcctggctaatttt

SEQ ID NO: 16994 - DNA, 16 bp, H. sapiens
aagcctgggggctggg

SEQ ID NO: 16995 - DNA, 16 bp, H. sapiens
aagcctgtctataaaa

SEQ ID NO: 16996 - DNA, 16 bp, H. sapiens
aagcctgtgggtgcac

SEQ ID NO: 16997 - DNA, 16 bp, H. sapiens
aagcctgtgtgtgtgt

SEQ ID NO: 16998 - DNA, 16 bp, H. sapiens
aagccttaattttctc

SEQ ID NO: 16999 - DNA, 16 bp, H. sapiens
aagccttaccaataat

SEQ ID NO: 17000 - DNA, 16 bp, H. sapiens
aagccttcccagccat

SEQ ID NO: 17001 - DNA, 16 bp, H. sapiens
aagccttccctgattc

SEQ ID NO: 17002 - DNA, 16 bp, H. sapiens
aagccttctctcaact

SEQ ID NO: 17003 - DNA, 16 bp, H. sapiens
aagccttctctgacca

SEQ ID NO: 17004 - DNA, 18 bp, H. sapiens
aagccttggcagcttcca

SEQ ID NO: 17005 - DNA, 16 bp, H. sapiens
aagccttggcagcttt

SEQ ID NO: 17006 - DNA, 16 bp, H. sapiens
aagcctttctcctgcc

SEQ ID NO: 17007 - DNA, 16 bp, H. sapiens
aagcctttgtcattaa

SEQ ID NO: 17008 - DNA, 16 bp, H. sapiens
aagcctttgtttcctt

SEQ ID NO: 17009 - DNA, 16 bp, H. sapiens
aagccttttctctaag

SEQ ID NO: 17010 - DNA, 17 bp, H. sapiens
aagcgatccttccacct

SEQ ID NO: 17011 - DNA, 17 bp, H. sapiens
aagcgatctgcccacct

SEQ ID NO: 17012 - DNA, 16 bp, H. sapiens
aagcgatcttcccgcc

SEQ ID NO: 17013 - DNA, 16 bp, H. sapiens
aagcgcttctcctgcc

SEQ ID NO: 17014 - DNA, 16 bp, H. sapiens
aagcggcagagctggg

SEQ ID NO: 17015 - DNA, 16 bp, H. sapiens
aagcggttcttctgcc

SEQ ID NO: 17016 - DNA, 16 bp, H. sapiens
aagcgtgagccaccac

SEQ ID NO: 17017 - DNA, 16 bp, H. sapiens
aagctaaaaaaaattg

SEQ ID NO: 17018 - DNA, 16 bp, H. sapiens
aagctaaaaatagagc

SEQ ID NO: 17019 - DNA, 16 bp, H. sapiens
aagctaaaaatgaaga

SEQ ID NO: 17020 - DNA, 16 bp, H. sapiens
aagctaaaaggaaaag

SEQ ID NO: 17021 - DNA, 16 bp, H. sapiens
aagctaaaagttcaaa

SEQ ID NO: 17022 - DNA, 16 bp, H. sapiens
aagctaaagggaaaat

SEQ ID NO: 17023 - DNA, 16 bp, H. sapiens
aagctaaattttaaaa

SEQ ID NO: 17024 - DNA, 16 bp, H. sapiens
aagctaacaaattagc

SEQ ID NO: 17025 - DNA, 16 bp, H. sapiens
aagctaagaaccttga

SEQ ID NO: 17026 - DNA, 16 bp, H. sapiens
aagctaagaatgtttt

SEQ ID NO: 17027 - DNA, 16 bp, H. sapiens
aagctaaggcaggcag

SEQ ID NO: 17028 - DNA, 16 bp, H. sapiens
aagctaattcaaaatt

SEQ ID NO: 17029 - DNA, 16 bp, H. sapiens
aagctacaggttacaa

SEQ ID NO: 17030 - DNA, 16 bp, H. sapiens
aagctaccaagtttgt

SEQ ID NO: 17031 - DNA, 16 bp, H. sapiens
aagctaccattgattt

SEQ ID NO: 17032 - DNA, 16 bp, H. sapiens
aagctacttttttttt

SEQ ID NO: 17033 - DNA, 16 bp, H. sapiens
aagctagaagaagaaa

SEQ ID NO: 17034 - DNA, 16 bp, H. sapiens
aagctagaagacaatg

SEQ ID NO: 17035 - DNA, 16 bp, H. sapiens
aagctagaatttgaac

SEQ ID NO: 17036 - DNA, 16 bp, H. sapiens
aagctagagaaaatat

SEQ ID NO: 17037 - DNA, 16 bp, H. sapiens
aagctagcagaggttg

SEQ ID NO: 17038 - DNA, 16 bp, H. sapiens
aagctagtagaagaaa

SEQ ID NO: 17039 - DNA, 16 bp, H. sapiens
aagctagtctcccaaa

SEQ ID NO: 17040 - DNA, 16 bp, H. sapiens
aagctatcagaagaaa

SEQ ID NO: 17041 - DNA, 16 bp, H. sapiens
aagctatctgtaaaaa

SEQ ID NO: 17042 - DNA, 16 bp, H. sapiens
aagctatctgtgaaaa

SEQ ID NO: 17043 - DNA, 16 bp, H. sapiens
aagctattggtggatc

SEQ ID NO: 17044 - DNA, 16 bp, H. sapiens
aagctattttaaaagt

SEQ ID NO: 17045 - DNA, 16 bp, H. sapiens
aagctcagaaagacaa

SEQ ID NO: 17046 - DNA, 16 bp, H. sapiens
aagctcagagccaaat

SEQ ID NO: 17047 - DNA, 16 bp, H. sapiens
aagctcagggcccttg

SEQ ID NO: 17048 - DNA, 16 bp, H. sapiens
aagctcatctcacaag

SEQ ID NO: 17049 - DNA, 16 bp, H. sapiens
aagctcatgtggttgt

SEQ ID NO: 17050 - DNA, 16 bp, H. sapiens
aagctccaactcctgg

SEQ ID NO: 17051 - DNA, 16 bp, H. sapiens
aagctccacaaggaca

SEQ ID NO: 17052 - DNA, 16 bp, H. sapiens
aagctccacctccctg

SEQ ID NO: 17053 - DNA, 16 bp, H. sapiens
aagctccaccttctgg

SEQ ID NO: 17054 - DNA, 16 bp, H. sapiens
aagctccagctttaag

SEQ ID NO: 17055 - DNA, 16 bp, H. sapiens
aagctccatctctact

SEQ ID NO: 17056 - DNA, 16 bp, H. sapiens
aagctccatgaggaca

SEQ ID NO: 17057 - DNA, 16 bp, H. sapiens
aagctccattcatggc

SEQ ID NO: 17058 - DNA, 16 bp, H. sapiens
aagctcccaaggacat

SEQ ID NO: 17059 - DNA, 16 bp, H. sapiens
aagctcccaggtgatt

SEQ ID NO: 17060 - DNA, 16 bp, H. sapiens
aagctccccagatgat

SEQ ID NO: 17061 - DNA, 16 bp, H. sapiens
aagctccctgaagccc

SEQ ID NO: 17062 - DNA, 18 bp, H. sapiens
aagctccgcctcctgagt

SEQ ID NO: 17063 - DNA, 16 bp, H. sapiens
aagctcggcctcctgg

SEQ ID NO: 17064 - DNA, 16 bp, H. sapiens
aagctctccaggtgat

SEQ ID NO: 17065 - DNA, 17 bp, H. sapiens
aagctctctttttgcct

SEQ ID NO: 17066 - DNA, 16 bp, H. sapiens
aagctctgaaaacaga

SEQ ID NO: 17067 - DNA, 16 bp, H. sapiens
aagctctgaagttctt

SEQ ID NO: 17068 - DNA, 16 bp, H. sapiens
aagctctgccccctgg

SEQ ID NO: 17069 - DNA, 16 bp, H. sapiens
aagctctttgaggaca

SEQ ID NO: 17070 - DNA, 16 bp, H. sapiens
aagctctttgttggag

SEQ ID NO: 17071 - DNA, 16 bp, H. sapiens
aagctcttttggctca

SEQ ID NO: 17072 - DNA, 16 bp, H. sapiens
aagctgaaaaagaaat

SEQ ID NO: 17073 - DNA, 16 bp, H. sapiens
aagctgaaaaaggcaa

SEQ ID NO: 17074 - DNA, 16 bp, H. sapiens
aagctgaaaagcaact

SEQ ID NO: 17075 - DNA, 16 bp, H. sapiens
aagctgaaaaggctga

SEQ ID NO: 17076 - DNA, 16 bp, H. sapiens
aagctgaaaattataa

SEQ ID NO: 17077 - DNA, 16 bp, H. sapiens
aagctgaaaattctga

SEQ ID NO: 17078 - DNA, 16 bp, H. sapiens
aagctgaaacaggaga

SEQ ID NO: 17079 - DNA, 16 bp, H. sapiens
aagctgaaactgtatc

SEQ ID NO: 17080 - DNA, 16 bp, H. sapiens
aagctgaaagaacaaa

SEQ ID NO: 17081 - DNA, 16 bp, H. sapiens
aagctgaaagctgagt

SEQ ID NO: 17082 - DNA, 16 bp, H. sapiens
aagctgaacatcactg

SEQ ID NO: 17083 - DNA, 16 bp, H. sapiens
aagctgaagaacctgg

SEQ ID NO: 17084 - DNA, 16 bp, H. sapiens
aagctgaagaagttgg

SEQ ID NO: 17085 - DNA, 16 bp, H. sapiens
aagctgacaaaaacaa

SEQ ID NO: 17086 - DNA, 16 bp, H. sapiens
aagctgagaaccttga

SEQ ID NO: 17087 - DNA, 16 bp, H. sapiens
aagctgagaataaaat

SEQ ID NO: 17088 - DNA, 16 bp, H. sapiens
aagctgagaatcaaat

SEQ ID NO: 17089 - DNA, 16 bp, H. sapiens
aagctgagaatgaaat

SEQ ID NO: 17090 - DNA, 16 bp, H. sapiens
aagctgagacacagag

SEQ ID NO: 17091 - DNA, 16 bp, H. sapiens
aagctgagacaggaaa

SEQ ID NO: 17092 - DNA, 16 bp, H. sapiens
aagctgagagaagaaa

SEQ ID NO: 17093 - DNA, 16 bp, H. sapiens
aagctgagagccaaat

SEQ ID NO: 17094 - DNA, 16 bp, H. sapiens
aagctgagaggccaaa

SEQ ID NO: 17095 - DNA, 16 bp, H. sapiens
aagctgagattgtgcc

SEQ ID NO: 17096 - DNA, 16 bp, H. sapiens
aagctgaggcagaagg

SEQ ID NO: 17097 - DNA, 16 bp, H. sapiens
aagctgaggcaggagc

SEQ ID NO: 17098 - DNA, 16 bp, H. sapiens
aagctgaggcaggcgg

SEQ ID NO: 17099 - DNA, 16 bp, H. sapiens
aagctgaggcagggga

SEQ ID NO: 17100 - DNA, 16 bp, H. sapiens
aagctgaggcccagaa

SEQ ID NO: 17101 - DNA, 16 bp, H. sapiens
aagctgaggcccagag

SEQ ID NO: 17102 - DNA, 16 bp, H. sapiens
aagctgaggctcaaag

SEQ ID NO: 17103 - DNA, 16 bp, H. sapiens
aagctgaggctcagag

SEQ ID NO: 17104 - DNA, 16 bp, H. sapiens
aagctgaggctctgag

SEQ ID NO: 17105 - DNA, 16 bp, H. sapiens
aagctgaggcttagag

SEQ ID NO: 17106 - DNA, 16 bp, H. sapiens
aagctgagggagttca

SEQ ID NO: 17107 - DNA, 16 bp, H. sapiens
aagctgaggtggcagg

SEQ ID NO: 17108 - DNA, 17 bp, H. sapiens
aagctgataagcaagtt

SEQ ID NO: 17109 - DNA, 18 bp, H. sapiens
aagctgatcctcttacaa

SEQ ID NO: 17110 - DNA, 16 bp, H. sapiens
aagctgatgacaactt

SEQ ID NO: 17111 - DNA, 16 bp, H. sapiens
aagctgattctaaagt

SEQ ID NO: 17112 - DNA, 16 bp, H. sapiens
aagctgcaaaaccagc

SEQ ID NO: 17113 - DNA, 16 bp, H. sapiens
aagctgcacacctaca

SEQ ID NO: 17114 - DNA, 16 bp, H. sapiens
aagctgcagaagaaaa

SEQ ID NO: 17115 - DNA, 16 bp, H. sapiens
aagctgcagaccttcg

SEQ ID NO: 17116 - DNA, 16 bp, H. sapiens
aagctgcagatctttg

SEQ ID NO: 17117 - DNA, 16 bp, H. sapiens
aagctgcggcaggaga

SEQ ID NO: 17118 - DNA, 16 bp, H. sapiens
aagctgctcaacatca

SEQ ID NO: 17119 - DNA, 16 bp, H. sapiens
aagctgctctgtgtga

SEQ ID NO: 17120 - DNA, 16 bp, H. sapiens
aagctgctgaatgaaa

SEQ ID NO: 17121 - DNA, 16 bp, H. sapiens
aagctgctgatgagag

SEQ ID NO: 17122 - DNA, 16 bp, H. sapiens
aagctgctgggactga

SEQ ID NO: 17123 - DNA, 16 bp, H. sapiens
aagctggaaaagacaa

SEQ ID NO: 17124 - DNA, 16 bp, H. sapiens
aagctggaaagaaaaa

SEQ ID NO: 17125 - DNA, 16 bp, H. sapiens
aagctggaagagacaa

SEQ ID NO: 17126 - DNA, 16 bp, H. sapiens
aagctggaagaggaaa

SEQ ID NO: 17127 - DNA, 16 bp, H. sapiens
aagctggaagcatttc

SEQ ID NO: 17128 - DNA, 16 bp, H. sapiens
aagctggaagccacca

SEQ ID NO: 17129 - DNA, 16 bp, H. sapiens
aagctggaccctttcc

SEQ ID NO: 17130 - DNA, 25 bp, H. sapiens
aagctggactgtactgctgccatct

SEQ ID NO: 17131 - DNA, 16 bp, H. sapiens
aagctggactgtgctg

SEQ ID NO: 17132 - DNA, 16 bp, H. sapiens
aagctggagaacctgg

SEQ ID NO: 17133 - DNA, 16 bp, H. sapiens
aagctggagaaggcaa

SEQ ID NO: 17134 - DNA, 16 bp, H. sapiens
aagctggagacccaag

SEQ ID NO: 17135 - DNA, 16 bp, H. sapiens
aagctggagacccagg

SEQ ID NO: 17136 - DNA, 16 bp, H. sapiens
aagctggagatccagg

SEQ ID NO: 17137 - DNA, 16 bp, H. sapiens
aagctggaggcagcat

SEQ ID NO: 17138 - DNA, 16 bp, H. sapiens
aagctggaggcccagg

SEQ ID NO: 17139 - DNA, 16 bp, H. sapiens
aagctggaggctgaga

SEQ ID NO: 17140 - DNA, 16 bp, H. sapiens
aagctggagtggagtg

SEQ ID NO: 17141 - DNA, 16 bp, H. sapiens
aagctggccaacatgg

SEQ ID NO: 17142 - DNA, 16 bp, H. sapiens
aagctggccctggctg

SEQ ID NO: 17143 - DNA, 16 bp, H. sapiens
aagctgggactacagg

SEQ ID NO: 17144 - DNA, 16 bp, H. sapiens
aagctgggagcttgca

SEQ ID NO: 17145 - DNA, 16 bp, H. sapiens
aagctgggatcacagg

SEQ ID NO: 17146 - DNA, 16 bp, H. sapiens
aagctgggatgacagg

SEQ ID NO: 17147 - DNA, 16 bp, H. sapiens
aagctgggatttgaac

SEQ ID NO: 17148 - DNA, 16 bp, H. sapiens
aagctgggcatccagg

SEQ ID NO: 17149 - DNA, 17 bp, H. sapiens
aagctgggcatccgggg

SEQ ID NO: 17150 - DNA, 17 bp, H. sapiens
aagctgggcatggtggt

SEQ ID NO: 17151 - DNA, 16 bp, H. sapiens
aagctgggcctggtgg

SEQ ID NO: 17152 - DNA, 18 bp, H. sapiens
aagctgggcgcggtggct

SEQ ID NO: 17153 - DNA, 16 bp, H. sapiens
aagctgggcgtggtgg

SEQ ID NO: 17154 - DNA, 18 bp, H. sapiens
aagctgggtgtggtggca

SEQ ID NO: 17155 - DNA, 16 bp, H. sapiens
aagctggtcctgaact

SEQ ID NO: 17156 - DNA, 16 bp, H. sapiens
aagctggttctaaaat

SEQ ID NO: 17157 - DNA, 16 bp, H. sapiens
aagctgtagaagaaaa

SEQ ID NO: 17158 - DNA, 16 bp, H. sapiens
aagctgtatgaccttg

SEQ ID NO: 17159 - DNA, 16 bp, H. sapiens
aagctgtcctcttgtg

SEQ ID NO: 17160 - DNA, 16 bp, H. sapiens
aagctgtctttaaaaa

SEQ ID NO: 17161 - DNA, 16 bp, H. sapiens
aagctgtgaatgcaaa

SEQ ID NO: 17162 - DNA, 17 bp, H. sapiens
aagctgtgatcatgcca

SEQ ID NO: 17163 - DNA, 16 bp, H. sapiens
aagctgtgattgcacc

SEQ ID NO: 17164 - DNA, 17 bp, H. sapiens
aagctgtgccccaacca

SEQ ID NO: 17165 - DNA, 16 bp, H. sapiens
aagctgtggaccctcg

SEQ ID NO: 17166 - DNA, 16 bp, H. sapiens
aagctgtggcaggaga

SEQ ID NO: 17167 - DNA, 16 bp, H. sapiens
aagctgttaaaaagaa

SEQ ID NO: 17168 - DNA, 16 bp, H. sapiens
aagctgttaaaatatt

SEQ ID NO: 17169 - DNA, 16 bp, H. sapiens
aagctgtttctctttc

SEQ ID NO: 17170 - DNA, 16 bp, H. sapiens
aagctgtttcttaaaa

SEQ ID NO: 17171 - DNA, 16 bp, H. sapiens
aagctgtttttatttt

SEQ ID NO: 17172 - DNA, 16 bp, H. sapiens
aagctgttttttaaaa

SEQ ID NO: 17173 - DNA, 16 bp, H. sapiens
aagcttaaaagcaaga

SEQ ID NO: 17174 - DNA, 27 bp, H. sapiens
aagcttagtttggttggatatgaaatt

SEQ ID NO: 17175 - DNA, 16 bp, H. sapiens
aagcttattttaaaag

SEQ ID NO: 17176 - DNA, 16 bp, H. sapiens
aagcttattttaaaat

SEQ ID NO: 17177 - DNA, 16 bp, H. sapiens
aagcttcataaatgaa

SEQ ID NO: 17178 - DNA, 16 bp, H. sapiens
aagcttcatcagtgaa

SEQ ID NO: 17179 - DNA, 16 bp, H. sapiens
aagcttcatctgtatt

SEQ ID NO: 17180 - DNA, 16 bp, H. sapiens
aagcttcatgagggca

SEQ ID NO: 17181 - DNA, 16 bp, H. sapiens
aagcttccagaggaag

SEQ ID NO: 17182 - DNA, 16 bp, H. sapiens
aagcttccagttaagg

SEQ ID NO: 17183 - DNA, 16 bp, H. sapiens
aagcttccatttcctc

SEQ ID NO: 17184 - DNA, 16 bp, H. sapiens
aagcttcccaagtgat

SEQ ID NO: 17185 - DNA, 16 bp, H. sapiens
aagcttcctaaggcct

SEQ ID NO: 17186 - DNA, 16 bp, H. sapiens
aagcttcctgaggcct

SEQ ID NO: 17187 - DNA, 16 bp, H. sapiens
aagcttcctgaggtcc

SEQ ID NO: 17188 - DNA, 16 bp, H. sapiens
aagcttcctggccact

SEQ ID NO: 17189 - DNA, 16 bp, H. sapiens
aagcttctaattaaag

SEQ ID NO: 17190 - DNA, 16 bp, H. sapiens
aagcttctgcatggca

SEQ ID NO: 17191 - DNA, 16 bp, H. sapiens
aagcttctgtacaaca

SEQ ID NO: 17192 - DNA, 16 bp, H. sapiens
aagcttcttgaaggca

SEQ ID NO: 17193 - DNA, 19 bp, H. sapiens
aagcttgagcatcccaggt

SEQ ID NO: 17194 - DNA, 16 bp, H. sapiens
aagcttgggcaacaga

SEQ ID NO: 17195 - DNA, 16 bp, H. sapiens
aagctttaaaaagaaa

SEQ ID NO: 17196 - DNA, 16 bp, H. sapiens
aagctttattttcttt

SEQ ID NO: 17197 - DNA, 16 bp, H. sapiens
aagctttcatttctct

SEQ ID NO: 17198 - DNA, 16 bp, H. sapiens
aagctttcccactaag

SEQ ID NO: 17199 - DNA, 16 bp, H. sapiens
aagctttctcagaaaa

SEQ ID NO: 17200 - DNA, 16 bp, H. sapiens
aagctttctgtgaaac

SEQ ID NO: 17201 - DNA, 16 bp, H. sapiens
aagctttcttgcctgc

SEQ ID NO: 17202 - DNA, 16 bp, H. sapiens
aagctttctttacctg

SEQ ID NO: 17203 - DNA, 16 bp, H. sapiens
aagctttcttttcatt

SEQ ID NO: 17204 - DNA, 18 bp, H. sapiens
aagctttgtactgtcact

SEQ ID NO: 17205 - DNA, 16 bp, H. sapiens
aagctttgttttgatt

SEQ ID NO: 17206 - DNA, 16 bp, H. sapiens
aagcttttatttaaaa

SEQ ID NO: 17207 - DNA, 16 bp, H. sapiens
aagcttttcccttatg

SEQ ID NO: 17208 - DNA, 16 bp, H. sapiens
aagcttttcttttaaa

SEQ ID NO: 17209 - DNA, 16 bp, H. sapiens
aagcttttcttttcct

SEQ ID NO: 17210 - DNA, 16 bp, H. sapiens
aagcttttcttttctt

SEQ ID NO: 17211 - DNA, 16 bp, H. sapiens
aagctttttaacttga

SEQ ID NO: 17212 - DNA, 16 bp, H. sapiens
aagctttttattttga

SEQ ID NO: 17213 - DNA, 16 bp, H. sapiens
aagctttttgtttgtt

SEQ ID NO: 17214 - DNA, 16 bp, H. sapiens
aaggaaaaaaaccttt

SEQ ID NO: 17215 - DNA, 16 bp, H. sapiens
aaggaaaaaaatcttt

SEQ ID NO: 17216 - DNA, 16 bp, H. sapiens
aaggaaaaaaatgttt

SEQ ID NO: 17217 - DNA, 16 bp, H. sapiens
aaggaaaaaatgattt

SEQ ID NO: 17218 - DNA, 16 bp, H. sapiens
aaggaaaaaattaatc

SEQ ID NO: 17219 - DNA, 16 bp, H. sapiens
aaggaaaaacataatt

SEQ ID NO: 17220 - DNA, 16 bp, H. sapiens
aaggaaaaacattttt

SEQ ID NO: 17221 - DNA, 16 bp, H. sapiens
aaggaaaaagaaagct

SEQ ID NO: 17222 - DNA, 16 bp, H. sapiens
aaggaaaaataaagct

SEQ ID NO: 17223 - DNA, 16 bp, H. sapiens
aaggaaaaatattttt

SEQ ID NO: 17224 - DNA, 16 bp, H. sapiens
aaggaaaaatgtttta

SEQ ID NO: 17225 - DNA, 16 bp, H. sapiens
aaggaaaaattattga

SEQ ID NO: 17226 - DNA, 16 bp, H. sapiens
aaggaaaacaaagttg

SEQ ID NO: 17227 - DNA, 16 bp, H. sapiens
aaggaaaacaaatttt

SEQ ID NO: 17228 - DNA, 16 bp, H. sapiens
aaggaaaacagaaatg

SEQ ID NO: 17229 - DNA, 16 bp, H. sapiens
aaggaaaacagatcat

SEQ ID NO: 17230 - DNA, 16 bp, H. sapiens
aaggaaaacagctctc

SEQ ID NO: 17231 - DNA, 16 bp, H. sapiens
aaggaaaacatggaac

SEQ ID NO: 17232 - DNA, 16 bp, H. sapiens
aaggaaaacatttaaa

SEQ ID NO: 17233 - DNA, 16 bp, H. sapiens
aaggaaaactaacaga

SEQ ID NO: 17234 - DNA, 16 bp, H. sapiens
aaggaaaactatgaaa

SEQ ID NO: 17235 - DNA, 16 bp, H. sapiens
aaggaaaactggaaaa

SEQ ID NO: 17236 - DNA, 16 bp, H. sapiens
aaggaaaactggaaat

SEQ ID NO: 17237 - DNA, 16 bp, H. sapiens
aaggaaaacttcaaaa

SEQ ID NO: 17238 - DNA, 16 bp, H. sapiens
aaggaaaactttaaaa

SEQ ID NO: 17239 - DNA, 16 bp, H. sapiens
aaggaaaagaaatctt

SEQ ID NO: 17240 - DNA, 16 bp, H. sapiens
aaggaaaagaaattgt

SEQ ID NO: 17241 - DNA, 16 bp, H. sapiens
aaggaaaagaagccat

SEQ ID NO: 17242 - DNA, 16 bp, H. sapiens
aaggaaaagaattttc

SEQ ID NO: 17243 - DNA, 16 bp, H. sapiens
aaggaaaagattgata

SEQ ID NO: 17244 - DNA, 16 bp, H. sapiens
aaggaaaagtggtggg

SEQ ID NO: 17245 - DNA, 16 bp, H. sapiens
aaggaaaagttattga

SEQ ID NO: 17246 - DNA, 16 bp, H. sapiens
aaggaaaataaattgt

SEQ ID NO: 17247 - DNA, 16 bp, H. sapiens
aaggaaaataacattt

SEQ ID NO: 17248 - DNA, 16 bp, H. sapiens
aaggaaaataatgttt

SEQ ID NO: 17249 - DNA, 16 bp, H. sapiens
aaggaaaatattcaaa

SEQ ID NO: 17250 - DNA, 16 bp, H. sapiens
aaggaaaatatttaga

SEQ ID NO: 17251 - DNA, 16 bp, H. sapiens
aaggaaaatatttcag

SEQ ID NO: 17252 - DNA, 16 bp, H. sapiens
aaggaaaatatttgaa

SEQ ID NO: 17253 - DNA, 16 bp, H. sapiens
aaggaaaatcttttca

SEQ ID NO: 17254 - DNA, 16 bp, H. sapiens
aaggaaaatgagaaac

SEQ ID NO: 17255 - DNA, 16 bp, H. sapiens
aaggaaaatgctaact

SEQ ID NO: 17256 - DNA, 16 bp, H. sapiens
aaggaaaatgtggcat

SEQ ID NO: 17257 - DNA, 16 bp, H. sapiens
aaggaaaatgtggtgt

SEQ ID NO: 17258 - DNA, 16 bp, H. sapiens
aaggaaaatgttttct

SEQ ID NO: 17259 - DNA, 16 bp, H. sapiens
aaggaaaattacaaag

SEQ ID NO: 17260 - DNA, 16 bp, H. sapiens
aaggaaaattacaggc

SEQ ID NO: 17261 - DNA, 16 bp, H. sapiens
aaggaaacaaaattat

SEQ ID NO: 17262 - DNA, 16 bp, H. sapiens
aaggaaacagattctt

SEQ ID NO: 17263 - DNA, 16 bp, H. sapiens
aaggaaacagattttt

SEQ ID NO: 17264 - DNA, 16 bp, H. sapiens
aaggaaacagtcaaca

SEQ ID NO: 17265 - DNA, 16 bp, H. sapiens
aaggaaactccatctc

SEQ ID NO: 17266 - DNA, 16 bp, H. sapiens
aaggaaactgaggctc

SEQ ID NO: 17267 - DNA, 16 bp, H. sapiens
aaggaaagaaaatgca

SEQ ID NO: 17268 - DNA, 16 bp, H. sapiens
aaggaaagaaaatgtt

SEQ ID NO: 17269 - DNA, 16 bp, H. sapiens
aaggaaagaaaatttt

SEQ ID NO: 17270 - DNA, 16 bp, H. sapiens
aaggaaagaaatacag

SEQ ID NO: 17271 - DNA, 16 bp, H. sapiens
aaggaaagaactattg

SEQ ID NO: 17272 - DNA, 16 bp, H. sapiens
aaggaaagaagtcatc

SEQ ID NO: 17273 - DNA, 16 bp, H. sapiens
aaggaaagaatatttg

SEQ ID NO: 17274 - DNA, 16 bp, H. sapiens
aaggaaagaatcaaga

SEQ ID NO: 17275 - DNA, 16 bp, H. sapiens
aaggaaagaatcttaa

SEQ ID NO: 17276 - DNA, 16 bp, H. sapiens
aaggaaagaatttagt

SEQ ID NO: 17277 - DNA, 16 bp, H. sapiens
aaggaaagactgaaaa

SEQ ID NO: 17278 - DNA, 16 bp, H. sapiens
aaggaaagactgggaa

SEQ ID NO: 17279 - DNA, 16 bp, H. sapiens
aaggaaagaggtttaa

SEQ ID NO: 17280 - DNA, 16 bp, H. sapiens
aaggaaagcccaggac

SEQ ID NO: 17281 - DNA, 16 bp, H. sapiens
aaggaaagctgagaaa

SEQ ID NO: 17282 - DNA, 16 bp, H. sapiens
aaggaaaggaaatcat

SEQ ID NO: 17283 - DNA, 16 bp, H. sapiens
aaggaaaggaaatttt

SEQ ID NO: 17284 - DNA, 16 bp, H. sapiens
aaggaaagggctttat

SEQ ID NO: 17285 - DNA, 16 bp, H. sapiens
aaggaaagtaaaatgt

SEQ ID NO: 17286 - DNA, 16 bp, H. sapiens
aaggaaagttttaaaa

SEQ ID NO: 17287 - DNA, 16 bp, H. sapiens
aaggaaataaaatatc

SEQ ID NO: 17288 - DNA, 16 bp, H. sapiens
aaggaaataaaatcag

SEQ ID NO: 17289 - DNA, 16 bp, H. sapiens
aaggaaataaaatgtt

SEQ ID NO: 17290 - DNA, 16 bp, H. sapiens
aaggaaataacttcac

SEQ ID NO: 17291 - DNA, 16 bp, H. sapiens
aaggaaataatgcaaa

SEQ ID NO: 17292 - DNA, 16 bp, H. sapiens
aaggaaatatacaaat

SEQ ID NO: 17293 - DNA, 16 bp, H. sapiens
aaggaaatatttaatt

SEQ ID NO: 17294 - DNA, 16 bp, H. sapiens
aaggaaatatttttgt

SEQ ID NO: 17295 - DNA, 16 bp, H. sapiens
aaggaaatcaagacat

SEQ ID NO: 17296 - DNA, 16 bp, H. sapiens
aaggaaatcaatgaaa

SEQ ID NO: 17297 - DNA, 16 bp, H. sapiens
aaggaaatcagtatat

SEQ ID NO: 17298 - DNA, 16 bp, H. sapiens
aaggaaatcattttgg

SEQ ID NO: 17299 - DNA, 16 bp, H. sapiens
aaggaaatccaaaata

SEQ ID NO: 17300 - DNA, 16 bp, H. sapiens
aaggaaatcccatcag

SEQ ID NO: 17301 - DNA, 16 bp, H. sapiens
aaggaaatgaaaagac

SEQ ID NO: 17302 - DNA, 16 bp, H. sapiens
aaggaaatgaaattat

SEQ ID NO: 17303 - DNA, 16 bp, H. sapiens
aaggaaatgaaattgg

SEQ ID NO: 17304 - DNA, 16 bp, H. sapiens
aaggaaatgagatcag

SEQ ID NO: 17305 - DNA, 16 bp, H. sapiens
aaggaaatgagcaaag

SEQ ID NO: 17306 - DNA, 16 bp, H. sapiens
aaggaaatgataaatg

SEQ ID NO: 17307 - DNA, 16 bp, H. sapiens
aaggaaatgcagcagt

SEQ ID NO: 17308 - DNA, 16 bp, H. sapiens
aaggaaatgctcaaaa

SEQ ID NO: 17309 - DNA, 16 bp, H. sapiens
aaggaaatggaaaaca

SEQ ID NO: 17310 - DNA, 16 bp, H. sapiens
aaggaaatgtaaatta

SEQ ID NO: 17311 - DNA, 16 bp, H. sapiens
aaggaaatgtattttg

SEQ ID NO: 17312 - DNA, 16 bp, H. sapiens
aaggaaatgtggcaaa

SEQ ID NO: 17313 - DNA, 16 bp, H. sapiens
aaggaaatgttttaaa

SEQ ID NO: 17314 - DNA, 16 bp, H. sapiens
aaggaaattaagaact

SEQ ID NO: 17315 - DNA, 16 bp, H. sapiens
aaggaaattaatgttt

SEQ ID NO: 17316 - DNA, 16 bp, H. sapiens
aaggaaattagaagtg

SEQ ID NO: 17317 - DNA, 16 bp, H. sapiens
aaggaaattcagaaaa

SEQ ID NO: 17318 - DNA, 16 bp, H. sapiens
aaggaaattcccaaag

SEQ ID NO: 17319 - DNA, 16 bp, H. sapiens
aaggaaattcttcaaa

SEQ ID NO: 17320 - DNA, 16 bp, H. sapiens
aaggaaattttctttt

SEQ ID NO: 17321 - DNA, 16 bp, H. sapiens
aaggaaattttttaaa

SEQ ID NO: 17322 - DNA, 16 bp, H. sapiens
aaggaacacagtcctg

SEQ ID NO: 17323 - DNA, 16 bp, H. sapiens
aaggaacacctggcct

SEQ ID NO: 17324 - DNA, 16 bp, H. sapiens
aaggaacagaaattat

SEQ ID NO: 17325 - DNA, 16 bp, H. sapiens
aaggaacataaagttg

SEQ ID NO: 17326 - DNA, 16 bp, H. sapiens
aaggaacattttaaaa

SEQ ID NO: 17327 - DNA, 16 bp, H. sapiens
aaggaaccagtaagta

SEQ ID NO: 17328 - DNA, 16 bp, H. sapiens
aaggaacccccaaagg

SEQ ID NO: 17329 - DNA, 16 bp, H. sapiens
aaggaacctttttttt

SEQ ID NO: 17330 - DNA, 16 bp, H. sapiens
aaggaactcaaatcag

SEQ ID NO: 17331 - DNA, 16 bp, H. sapiens
aaggaactcagataaa

SEQ ID NO: 17332 - DNA, 16 bp, H. sapiens
aaggaactgaaacaaa

SEQ ID NO: 17333 - DNA, 16 bp, H. sapiens
aaggaactgatggagc

SEQ ID NO: 17334 - DNA, 16 bp, H. sapiens
aaggaactggatcacc

SEQ ID NO: 17335 - DNA, 16 bp, H. sapiens
aaggaactgtcaaaca

SEQ ID NO: 17336 - DNA, 16 bp, H. sapiens
aaggaacttaaaacaa

SEQ ID NO: 17337 - DNA, 16 bp, H. sapiens
aaggaacttaagcaaa

SEQ ID NO: 17338 - DNA, 16 bp, H. sapiens
aaggaactttaaaaat

SEQ ID NO: 17339 - DNA, 16 bp, H. sapiens
aaggaagaaaaatttt

SEQ ID NO: 17340 - DNA, 16 bp, H. sapiens
aaggaagaaaatgaca

SEQ ID NO: 17341 - DNA, 16 bp, H. sapiens
aaggaagaaactgaga

SEQ ID NO: 17342 - DNA, 16 bp, H. sapiens
aaggaagaaatctgaa

SEQ ID NO: 17343 - DNA, 16 bp, H. sapiens
aaggaagaacagtgtg

SEQ ID NO: 17344 - DNA, 16 bp, H. sapiens
aaggaagaactaaaac

SEQ ID NO: 17345 - DNA, 16 bp, H. sapiens
aaggaagaagcaaaat

SEQ ID NO: 17346 - DNA, 16 bp, H. sapiens
aaggaagaagctgagg

SEQ ID NO: 17347 - DNA, 16 bp, H. sapiens
aaggaagaagtaaaac

SEQ ID NO: 17348 - DNA, 16 bp, H. sapiens
aaggaagaataaaatc

SEQ ID NO: 17349 - DNA, 16 bp, H. sapiens
aaggaagaattttaaa

SEQ ID NO: 17350 - DNA, 16 bp, H. sapiens
aaggaagacaaagatt

SEQ ID NO: 17351 - DNA, 16 bp, H. sapiens
aaggaagacagaaaat

SEQ ID NO: 17352 - DNA, 16 bp, H. sapiens
aaggaagacatacaaa

SEQ ID NO: 17353 - DNA, 16 bp, H. sapiens
aaggaagagaaaatac

SEQ ID NO: 17354 - DNA, 16 bp, H. sapiens
aaggaagagatagact

SEQ ID NO: 17355 - DNA, 16 bp, H. sapiens
aaggaagaggagctgg

SEQ ID NO: 17356 - DNA, 16 bp, H. sapiens
aaggaagagtcaactg

SEQ ID NO: 17357 - DNA, 16 bp, H. sapiens
aaggaagagttgcatg

SEQ ID NO: 17358 - DNA, 16 bp, H. sapiens
aaggaagagtttttca

SEQ ID NO: 17359 - DNA, 16 bp, H. sapiens
aaggaagcagctttag

SEQ ID NO: 17360 - DNA, 16 bp, H. sapiens
aaggaagcatccagca

SEQ ID NO: 17361 - DNA, 16 bp, H. sapiens
aaggaagccaaaagat

SEQ ID NO: 17362 - DNA, 16 bp, H. sapiens
aaggaagccagacaca

SEQ ID NO: 17363 - DNA, 16 bp, H. sapiens
aaggaagcccatcaga

SEQ ID NO: 17364 - DNA, 16 bp, H. sapiens
aaggaagctaagaaca

SEQ ID NO: 17365 - DNA, 16 bp, H. sapiens
aaggaagctgcagaag

SEQ ID NO: 17366 - DNA, 16 bp, H. sapiens
aaggaaggaaactctg

SEQ ID NO: 17367 - DNA, 16 bp, H. sapiens
aaggaaggaaagtaca

SEQ ID NO: 17368 - DNA, 16 bp, H. sapiens
aaggaaggaaatattt

SEQ ID NO: 17369 - DNA, 16 bp, H. sapiens
aaggaaggaagcaagc

SEQ ID NO: 17370 - DNA, 16 bp, H. sapiens
aaggaaggagatcatg

SEQ ID NO: 17371 - DNA, 16 bp, H. sapiens
aaggaaggcaagtttt

SEQ ID NO: 17372 - DNA, 16 bp, H. sapiens
aaggaaggcagcaaga

SEQ ID NO: 17373 - DNA, 16 bp, H. sapiens
aaggaaggcatccagt

SEQ ID NO: 17374 - DNA, 16 bp, H. sapiens
aaggaagggatccaga

SEQ ID NO: 17375 - DNA, 18 bp, H. sapiens
aaggaaggggtccagttt

SEQ ID NO: 17376 - DNA, 16 bp, H. sapiens
aaggaaggtgtccagt

SEQ ID NO: 17377 - DNA, 16 bp, H. sapiens
aaggaagtcaaattgt

SEQ ID NO: 17378 - DNA, 16 bp, H. sapiens
aaggaagtcaaggctg

SEQ ID NO: 17379 - DNA, 16 bp, H. sapiens
aaggaagtctgggaaa

SEQ ID NO: 17380 - DNA, 16 bp, H. sapiens
aaggaagtgatgtcag

SEQ ID NO: 17381 - DNA, 18 bp, H. sapiens
aaggaagtgctaaacatg

SEQ ID NO: 17382 - DNA, 16 bp, H. sapiens
aaggaagtttaaaaat

SEQ ID NO: 17383 - DNA, 16 bp, H. sapiens
aaggaataaattaatg

SEQ ID NO: 17384 - DNA, 16 bp, H. sapiens
aaggaataaattccag

SEQ ID NO: 17385 - DNA, 16 bp, H. sapiens
aaggaatataaatcat

SEQ ID NO: 17386 - DNA, 16 bp, H. sapiens
aaggaatataaatcct

SEQ ID NO: 17387 - DNA, 16 bp, H. sapiens
aaggaatatagatcat

SEQ ID NO: 17388 - DNA, 16 bp, H. sapiens
aaggaatatctttttt

SEQ ID NO: 17389 - DNA, 16 bp, H. sapiens
aaggaatccacaaaaa

SEQ ID NO: 17390 - DNA, 16 bp, H. sapiens
aaggaatcctcctgtc

SEQ ID NO: 17391 - DNA, 16 bp, H. sapiens
aaggaatgaaatcatg

SEQ ID NO: 17392 - DNA, 16 bp, H. sapiens
aaggaatgaaatcttg

SEQ ID NO: 17393 - DNA, 16 bp, H. sapiens
aaggaatgaactattg

SEQ ID NO: 17394 - DNA, 16 bp, H. sapiens
aaggaatgaagtacta

SEQ ID NO: 17395 - DNA, 16 bp, H. sapiens
aaggaatgacttaaag

SEQ ID NO: 17396 - DNA, 16 bp, H. sapiens
aaggaatgagttaatg

SEQ ID NO: 17397 - DNA, 16 bp, H. sapiens
aaggaatgatggaatt

SEQ ID NO: 17398 - DNA, 16 bp, H. sapiens
aaggaatgcagtcctg

SEQ ID NO: 17399 - DNA, 16 bp, H. sapiens
aaggaatgcattcctg

SEQ ID NO: 17400 - DNA, 16 bp, H. sapiens
aaggaatgccaaagat

SEQ ID NO: 17401 - DNA, 16 bp, H. sapiens
aaggaatggaattgaa

SEQ ID NO: 17402 - DNA, 16 bp, H. sapiens
aaggaatggagacaga

SEQ ID NO: 17403 - DNA, 16 bp, H. sapiens
aaggaatgtgggaaag

SEQ ID NO: 17404 - DNA, 16 bp, H. sapiens
aaggaattaatatcca

SEQ ID NO: 17405 - DNA, 16 bp, H. sapiens
aaggaattaatattca

SEQ ID NO: 17406 - DNA, 16 bp, H. sapiens
aaggaattattgttaa

SEQ ID NO: 17407 - DNA, 16 bp, H. sapiens
aaggaattatttttat

SEQ ID NO: 17408 - DNA, 16 bp, H. sapiens
aaggaattcaaggatg

SEQ ID NO: 17409 - DNA, 16 bp, H. sapiens
aaggaattcagaatct

SEQ ID NO: 17410 - DNA, 16 bp, H. sapiens
aaggaattctgggaaa

SEQ ID NO: 17411 - DNA, 16 bp, H. sapiens
aaggaattggttcaca

SEQ ID NO: 17412 - DNA, 16 bp, H. sapiens
aaggaatttatttctc

SEQ ID NO: 17413 - DNA, 16 bp, H. sapiens
aaggaatttgaaaata

SEQ ID NO: 17414 - DNA, 16 bp, H. sapiens
aaggaatttgagaaat

SEQ ID NO: 17415 - DNA, 16 bp, H. sapiens
aaggacaaagatgaga

SEQ ID NO: 17416 - DNA, 16 bp, H. sapiens
aaggacaagatctcat

SEQ ID NO: 17417 - DNA, 16 bp, H. sapiens
aaggacaatttttaaa

SEQ ID NO: 17418 - DNA, 16 bp, H. sapiens
aaggacacaagcctgg

SEQ ID NO: 17419 - DNA, 16 bp, H. sapiens
aaggacacacacacac

SEQ ID NO: 17420 - DNA, 16 bp, H. sapiens
aaggacacaggcctgg

SEQ ID NO: 17421 - DNA, 16 bp, H. sapiens
aaggacaccagttata

SEQ ID NO: 17422 - DNA, 16 bp, H. sapiens
aaggacacttgtgatt

SEQ ID NO: 17423 - DNA, 16 bp, H. sapiens
aaggacagaaaatcaa

SEQ ID NO: 17424 - DNA, 16 bp, H. sapiens
aaggacagaccatatg

SEQ ID NO: 17425 - DNA, 16 bp, H. sapiens
aaggacagcaccaagc

SEQ ID NO: 17426 - DNA, 16 bp, H. sapiens
aaggacagcagtgaag

SEQ ID NO: 17427 - DNA, 17 bp, H. sapiens
aaggacagccagagaga

SEQ ID NO: 17428 - DNA, 16 bp, H. sapiens
aaggacagctttgcag

SEQ ID NO: 17429 - DNA, 16 bp, H. sapiens
aaggacagtttcacat

SEQ ID NO: 17430 - DNA, 16 bp, H. sapiens
aaggacagttttacat

SEQ ID NO: 17431 - DNA, 16 bp, H. sapiens
aaggacataaccaaaa

SEQ ID NO: 17432 - DNA, 16 bp, H. sapiens
aaggacataatttcat

SEQ ID NO: 17433 - DNA, 16 bp, H. sapiens
aaggacatacctgaga

SEQ ID NO: 17434 - DNA, 16 bp, H. sapiens
aaggacatcatcaaga

SEQ ID NO: 17435 - DNA, 16 bp, H. sapiens
aaggacatctacacca

SEQ ID NO: 17436 - DNA, 16 bp, H. sapiens
aaggacatgaaaagat

SEQ ID NO: 17437 - DNA, 16 bp, H. sapiens
aaggacatgaacaaac

SEQ ID NO: 17438 - DNA, 16 bp, H. sapiens
aaggacatgattttat

SEQ ID NO: 17439 - DNA, 16 bp, H. sapiens
aaggacatgcctgtga

SEQ ID NO: 17440 - DNA, 16 bp, H. sapiens
aaggacatggatgaaa

SEQ ID NO: 17441 - DNA, 16 bp, H. sapiens
aaggacatggatgaag

SEQ ID NO: 17442 - DNA, 16 bp, H. sapiens
aaggacattaggaaaa

SEQ ID NO: 17443 - DNA, 16 bp, H. sapiens
aaggacattatcaaga

SEQ ID NO: 17444 - DNA, 16 bp, H. sapiens
aaggacattttaaaat

SEQ ID NO: 17445 - DNA, 20 bp, H. sapiens
aaggaccagatggattcaca

SEQ ID NO: 17446 - DNA, 16 bp, H. sapiens
aaggaccagccattta

SEQ ID NO: 17447 - DNA, 16 bp, H. sapiens
aaggaccaggaaaggg

SEQ ID NO: 17448 - DNA, 16 bp, H. sapiens
aaggacctcttccagg

SEQ ID NO: 17449 - DNA, 17 bp, H. sapiens
aaggacgtgaacagaca

SEQ ID NO: 17450 - DNA, 16 bp, H. sapiens
aaggactgcagctcct

SEQ ID NO: 17451 - DNA, 16 bp, H. sapiens
aaggacttagaaaagt

SEQ ID NO: 17452 - DNA, 19 bp, H. sapiens
aaggacttcatgtctaaac

SEQ ID NO: 17453 - DNA, 16 bp, H. sapiens
aaggacttcttcaaga

SEQ ID NO: 17454 - DNA, 16 bp, H. sapiens
aaggacttgcatttct

SEQ ID NO: 17455 - DNA, 16 bp, H. sapiens
aaggacttgctttttg

SEQ ID NO: 17456 - DNA, 16 bp, H. sapiens
aaggactttctccagg

SEQ ID NO: 17457 - DNA, 16 bp, H. sapiens
aaggactttggctttt

SEQ ID NO: 17458 - DNA, 16 bp, H. sapiens
aaggactttggttttt

SEQ ID NO: 17459 - DNA, 16 bp, H. sapiens
aaggacttttttttaa

SEQ ID NO: 17460 - DNA, 16 bp, H. sapiens
aaggactttttttttt

SEQ ID NO: 17461 - DNA, 16 bp, H. sapiens
aaggagaaaaaccata

SEQ ID NO: 17462 - DNA, 16 bp, H. sapiens
aaggagaaaaatgttt

SEQ ID NO: 17463 - DNA, 16 bp, H. sapiens
aaggagaaaatatatg

SEQ ID NO: 17464 - DNA, 16 bp, H. sapiens
aaggagaaactgtcaa

SEQ ID NO: 17465 - DNA, 16 bp, H. sapiens
aaggagaaatactttc

SEQ ID NO: 17466 - DNA, 16 bp, H. sapiens
aaggagaaatgaaatt

SEQ ID NO: 17467 - DNA, 16 bp, H. sapiens
aaggagaactacaaaa

SEQ ID NO: 17468 - DNA, 16 bp, H. sapiens
aaggagaactgcaaac

SEQ ID NO: 17469 - DNA, 16 bp, H. sapiens
aaggagaagcaggcac

SEQ ID NO: 17470 - DNA, 16 bp, H. sapiens
aaggagaaggggttga

SEQ ID NO: 17471 - DNA, 16 bp, H. sapiens
aaggagaagtaaaatc

SEQ ID NO: 17472 - DNA, 16 bp, H. sapiens
aaggagaagtgcagag

SEQ ID NO: 17473 - DNA, 16 bp, H. sapiens
aaggagaatgaatgca

SEQ ID NO: 17474 - DNA, 16 bp, H. sapiens
aaggagaattgcttga

SEQ ID NO: 17475 - DNA, 16 bp, H. sapiens
aaggagaattttaaaa

SEQ ID NO: 17476 - DNA, 16 bp, H. sapiens
aaggagacaagagcct

SEQ ID NO: 17477 - DNA, 16 bp, H. sapiens
aaggagacagagacag

SEQ ID NO: 17478 - DNA, 16 bp, H. sapiens
aaggagaccccagaaa

SEQ ID NO: 17479 - DNA, 16 bp, H. sapiens
aaggagactgagaaga

SEQ ID NO: 17480 - DNA, 16 bp, H. sapiens
aaggagactgggaggt

SEQ ID NO: 17481 - DNA, 16 bp, H. sapiens
aaggagagaaaaacat

SEQ ID NO: 17482 - DNA, 16 bp, H. sapiens
aaggagagagaggtgc

SEQ ID NO: 17483 - DNA, 16 bp, H. sapiens
aaggagagagtctttg

SEQ ID NO: 17484 - DNA, 16 bp, H. sapiens
aaggagagcattagga

SEQ ID NO: 17485 - DNA, 16 bp, H. sapiens
aaggagaggccaggca

SEQ ID NO: 17486 - DNA, 17 bp, H. sapiens
aaggagagtagttatct

SEQ ID NO: 17487 - DNA, 16 bp, H. sapiens
aaggagatacagacac

SEQ ID NO: 17488 - DNA, 16 bp, H. sapiens
aaggagatatatatat

SEQ ID NO: 17489 - DNA, 16 bp, H. sapiens
aaggagatcaacattt

SEQ ID NO: 17490 - DNA, 16 bp, H. sapiens
aaggagatcattctgg

SEQ ID NO: 17491 - DNA, 16 bp, H. sapiens
aaggagatcatttgga

SEQ ID NO: 17492 - DNA, 16 bp, H. sapiens
aaggagatgccatcta

SEQ ID NO: 17493 - DNA, 16 bp, H. sapiens
aaggagattttttttt

SEQ ID NO: 17494 - DNA, 16 bp, H. sapiens
aaggagcaggcaacct

SEQ ID NO: 17495 - DNA, 17 bp, H. sapiens
aaggagcaggcagcaat

SEQ ID NO: 17496 - DNA, 16 bp, H. sapiens
aaggagccaaatgtta

SEQ ID NO: 17497 - DNA, 16 bp, H. sapiens
aaggagccaagaacat

SEQ ID NO: 17498 - DNA, 16 bp, H. sapiens
aaggagccatgagcca

SEQ ID NO: 17499 - DNA, 16 bp, H. sapiens
aaggagctctggttcc

SEQ ID NO: 17500 - DNA, 16 bp, H. sapiens
aaggagctgaaaaaca

SEQ ID NO: 17501 - DNA, 16 bp, H. sapiens
aaggagctgagaaacc

SEQ ID NO: 17502 - DNA, 16 bp, H. sapiens
aaggagctgcaatcct

SEQ ID NO: 17503 - DNA, 16 bp, H. sapiens
aaggagctgggtgtgg

SEQ ID NO: 17504 - DNA, 16 bp, H. sapiens
aaggaggaaatcaaat

SEQ ID NO: 17505 - DNA, 16 bp, H. sapiens
aaggaggaactggcac

SEQ ID NO: 17506 - DNA, 16 bp, H. sapiens
aaggaggaaggggccc

SEQ ID NO: 17507 - DNA, 16 bp, H. sapiens
aaggaggagcaaaggc

SEQ ID NO: 17508 - DNA, 16 bp, H. sapiens
aaggaggagcaggcat

SEQ ID NO: 17509 - DNA, 16 bp, H. sapiens
aaggaggagctggcac

SEQ ID NO: 17510 - DNA, 16 bp, H. sapiens
aaggaggaggaggctg

SEQ ID NO: 17511 - DNA, 16 bp, H. sapiens
aaggaggatgtggctg

SEQ ID NO: 17512 - DNA, 16 bp, H. sapiens
aaggaggattcaaagg

SEQ ID NO: 17513 - DNA, 16 bp, H. sapiens
aaggaggcagtgacct

SEQ ID NO: 17514 - DNA, 16 bp, H. sapiens
aaggaggccaaggaga

SEQ ID NO: 17515 - DNA, 16 bp, H. sapiens
aaggaggccaggtgca

SEQ ID NO: 17516 - DNA, 16 bp, H. sapiens
aaggaggccagtatgg

SEQ ID NO: 17517 - DNA, 16 bp, H. sapiens
aaggaggccagtgtgg

SEQ ID NO: 17518 - DNA, 16 bp, H. sapiens
aaggaggcctgccagc

SEQ ID NO: 17519 - DNA, 16 bp, H. sapiens
aaggaggctaaagaga

SEQ ID NO: 17520 - DNA, 16 bp, H. sapiens
aaggaggctgagaaag

SEQ ID NO: 17521 - DNA, 16 bp, H. sapiens
aaggaggctgaggtgg

SEQ ID NO: 17522 - DNA, 16 bp, H. sapiens
aaggaggctggagagc

SEQ ID NO: 17523 - DNA, 16 bp, H. sapiens
aaggaggctgggaaag

SEQ ID NO: 17524 - DNA, 16 bp, H. sapiens
aaggaggctggtgtgg

SEQ ID NO: 17525 - DNA, 16 bp, H. sapiens
aaggagggaggcctca

SEQ ID NO: 17526 - DNA, 16 bp, H. sapiens
aaggagggcaccaagc

SEQ ID NO: 17527 - DNA, 16 bp, H. sapiens
aaggagggcttcctgg

SEQ ID NO: 17528 - DNA, 16 bp, H. sapiens
aaggaggggatccagt

SEQ ID NO: 17529 - DNA, 16 bp, H. sapiens
aaggaggttaagtaac

SEQ ID NO: 17530 - DNA, 16 bp, H. sapiens
aaggagtaattttgat

SEQ ID NO: 17531 - DNA, 16 bp, H. sapiens
aaggagtacaagtgca

SEQ ID NO: 17532 - DNA, 16 bp, H. sapiens
aaggagtagctatact

SEQ ID NO: 17533 - DNA, 16 bp, H. sapiens
aaggagtcatttcaac

SEQ ID NO: 17534 - DNA, 16 bp, H. sapiens
aaggagttcgagacca

SEQ ID NO: 17535 - DNA, 16 bp, H. sapiens
aaggagttctgggctg

SEQ ID NO: 17536 - DNA, 16 bp, H. sapiens
aaggagttgaaagacc

SEQ ID NO: 17537 - DNA, 16 bp, H. sapiens
aaggagtttatttctc

SEQ ID NO: 17538 - DNA, 16 bp, H. sapiens
aaggagtttctctctt

SEQ ID NO: 17539 - DNA, 18 bp, H. sapiens
aaggagtttgagaccagc

SEQ ID NO: 17540 - DNA, 16 bp, H. sapiens
aaggagtttgggcttt

SEQ ID NO: 17541 - DNA, 16 bp, H. sapiens
aaggagtttgttatta

SEQ ID NO: 17542 - DNA, 16 bp, H. sapiens
aaggataaaaattaca

SEQ ID NO: 17543 - DNA, 16 bp, H. sapiens
aaggataatctcttca

SEQ ID NO: 17544 - DNA, 16 bp, H. sapiens
aaggataattcaacat

SEQ ID NO: 17545 - DNA, 16 bp, H. sapiens
aaggatacaaaattat

SEQ ID NO: 17546 - DNA, 16 bp, H. sapiens
aaggatacaaacaaat

SEQ ID NO: 17547 - DNA, 16 bp, H. sapiens
aaggatagtttggtgg

SEQ ID NO: 17548 - DNA, 16 bp, H. sapiens
aaggatataaaatcaa

SEQ ID NO: 17549 - DNA, 16 bp, H. sapiens
aaggatataaagtatt

SEQ ID NO: 17550 - DNA, 16 bp, H. sapiens
aaggatatgcacagac

SEQ ID NO: 17551 - DNA, 16 bp, H. sapiens
aaggatatggacagac

SEQ ID NO: 17552 - DNA, 29 bp, H. sapiens
aaggatattatccaggagaacttccccaa

SEQ ID NO: 17553 - DNA, 16 bp, H. sapiens
aaggatatttatttat

SEQ ID NO: 17554 - DNA, 16 bp, H. sapiens
aaggatatttttgttg

SEQ ID NO: 17555 - DNA, 16 bp, H. sapiens
aaggatcaaaagagac

SEQ ID NO: 17556 - DNA, 16 bp, H. sapiens
aaggatcaaatgagat

SEQ ID NO: 17557 - DNA, 16 bp, H. sapiens
aaggatcactgtttat

SEQ ID NO: 17558 - DNA, 16 bp, H. sapiens
aaggatcttatttctc

SEQ ID NO: 17559 - DNA, 16 bp, H. sapiens
aaggatgacttcatgt

SEQ ID NO: 17560 - DNA, 16 bp, H. sapiens
aaggatgaggcaggag

SEQ ID NO: 17561 - DNA, 16 bp, H. sapiens
aaggatgaggtcatgt

SEQ ID NO: 17562 - DNA, 16 bp, H. sapiens
aaggatgagtttggcc

SEQ ID NO: 17563 - DNA, 16 bp, H. sapiens
aaggatgatggagaag

SEQ ID NO: 17564 - DNA, 16 bp, H. sapiens
aaggatgatttaacat

SEQ ID NO: 17565 - DNA, 16 bp, H. sapiens
aaggatgcaaggatgg

SEQ ID NO: 17566 - DNA, 16 bp, H. sapiens
aaggatgccaagaaaa

SEQ ID NO: 17567 - DNA, 16 bp, H. sapiens
aaggatgccaagacca

SEQ ID NO: 17568 - DNA, 16 bp, H. sapiens
aaggatgcccgctctc

SEQ ID NO: 17569 - DNA, 17 bp, H. sapiens
aaggatgccctctctca

SEQ ID NO: 17570 - DNA, 16 bp, H. sapiens
aaggatggaaggatgg

SEQ ID NO: 17571 - DNA, 16 bp, H. sapiens
aaggatggcctttcct

SEQ ID NO: 17572 - DNA, 16 bp, H. sapiens
aaggatggtctcaatc

SEQ ID NO: 17573 - DNA, 16 bp, H. sapiens
aaggatgtcctctctc

SEQ ID NO: 17574 - DNA, 16 bp, H. sapiens
aaggatgtggagaaag

SEQ ID NO: 17575 - DNA, 16 bp, H. sapiens
aaggatgtggagaaat

SEQ ID NO: 17576 - DNA, 16 bp, H. sapiens
aaggatgtggggaaac

SEQ ID NO: 17577 - DNA, 16 bp, H. sapiens
aaggattaaatgagat

SEQ ID NO: 17578 - DNA, 16 bp, H. sapiens
aaggattaaatgtgat

SEQ ID NO: 17579 - DNA, 16 bp, H. sapiens
aaggattaagtgagat

SEQ ID NO: 17580 - DNA, 16 bp, H. sapiens
aaggattaattttctt

SEQ ID NO: 17581 - DNA, 16 bp, H. sapiens
aaggattacatgagat

SEQ ID NO: 17582 - DNA, 16 bp, H. sapiens
aaggattataaatgat

SEQ ID NO: 17583 - DNA, 16 bp, H. sapiens
aaggattctccagtgt

SEQ ID NO: 17584 - DNA, 16 bp, H. sapiens
aaggattctcctgtct

SEQ ID NO: 17585 - DNA, 16 bp, H. sapiens
aaggattcttttaaaa

SEQ ID NO: 17586 - DNA, 16 bp, H. sapiens
aaggattgctttttta

SEQ ID NO: 17587 - DNA, 16 bp, H. sapiens
aaggattgttttaaat

SEQ ID NO: 17588 - DNA, 16 bp, H. sapiens
aaggattttaaagcag

SEQ ID NO: 17589 - DNA, 16 bp, H. sapiens
aaggattttcttcctt

SEQ ID NO: 17590 - DNA, 16 bp, H. sapiens
aaggattttgagatgg

SEQ ID NO: 17591 - DNA, 16 bp, H. sapiens
aaggatttttgtttgt

SEQ ID NO: 17592 - DNA, 16 bp, H. sapiens
aaggcaaaggggaggc

SEQ ID NO: 17593 - DNA, 16 bp, H. sapiens
aaggcaaatgaagagc

SEQ ID NO: 17594 - DNA, 16 bp, H. sapiens
aaggcaaatggagtga

SEQ ID NO: 17595 - DNA, 16 bp, H. sapiens
aaggcaacttggaagt

SEQ ID NO: 17596 - DNA, 16 bp, H. sapiens
aaggcaagaaatgact

SEQ ID NO: 17597 - DNA, 16 bp, H. sapiens
aaggcaagaatgccca

SEQ ID NO: 17598 - DNA, 16 bp, H. sapiens
aaggcaagaccttcca

SEQ ID NO: 17599 - DNA, 16 bp, H. sapiens
aaggcaagagttgagg

SEQ ID NO: 17600 - DNA, 18 bp, H. sapiens
aaggcaagccaacattca

SEQ ID NO: 17601 - DNA, 16 bp, H. sapiens
aaggcaaggagaagca

SEQ ID NO: 17602 - DNA, 17 bp, H. sapiens
aaggcaaggaggagcaa

SEQ ID NO: 17603 - DNA, 16 bp, H. sapiens
aaggcaagggcaaaat

SEQ ID NO: 17604 - DNA, 16 bp, H. sapiens
aaggcaatcctaagca

SEQ ID NO: 17605 - DNA, 16 bp, H. sapiens
aaggcaatctcattta

SEQ ID NO: 17606 - DNA, 16 bp, H. sapiens
aaggcacaaacaaatg

SEQ ID NO: 17607 - DNA, 16 bp, H. sapiens
aaggcaccatctatga

SEQ ID NO: 17608 - DNA, 16 bp, H. sapiens
aaggcaccatcttgaa

SEQ ID NO: 17609 - DNA, 16 bp, H. sapiens
aaggcagaaaatattt

SEQ ID NO: 17610 - DNA, 16 bp, H. sapiens
aaggcagaaaccaaga

SEQ ID NO: 17611 - DNA, 16 bp, H. sapiens
aaggcagaaataaaca

SEQ ID NO: 17612 - DNA, 16 bp, H. sapiens
aaggcagaaatcaata

SEQ ID NO: 17613 - DNA, 16 bp, H. sapiens
aaggcagaaattaaaa

SEQ ID NO: 17614 - DNA, 16 bp, H. sapiens
aaggcagacactccca

SEQ ID NO: 17615 - DNA, 16 bp, H. sapiens
aaggcagagagcagag

SEQ ID NO: 17616 - DNA, 16 bp, H. sapiens
aaggcagagaggcagg

SEQ ID NO: 17617 - DNA, 16 bp, H. sapiens
aaggcagagattgggg

SEQ ID NO: 17618 - DNA, 34 bp, H. sapiens
aaggcagagccaggtgtacaggatggaacatgaa

SEQ ID NO: 17619 - DNA, 16 bp, H. sapiens
aaggcagagcctgcag

SEQ ID NO: 17620 - DNA, 16 bp, H. sapiens
aaggcagagctgggat

SEQ ID NO: 17621 - DNA, 16 bp, H. sapiens
aaggcagaggcaggaa

SEQ ID NO: 17622 - DNA, 22 bp, H. sapiens
aaggcagaggttgcagtgagct

SEQ ID NO: 17623 - DNA, 16 bp, H. sapiens
aaggcagattttaaaa

SEQ ID NO: 17624 - DNA, 16 bp, H. sapiens
aaggcagcagaaacct

SEQ ID NO: 17625 - DNA, 16 bp, H. sapiens
aaggcagcagaaactt

SEQ ID NO: 17626 - DNA, 16 bp, H. sapiens
aaggcagcagaaatct

SEQ ID NO: 17627 - DNA, 16 bp, H. sapiens
aaggcagcagccaggc

SEQ ID NO: 17628 - DNA, 16 bp, H. sapiens
aaggcagcagccccaa

SEQ ID NO: 17629 - DNA, 16 bp, H. sapiens
aaggcagcagtgagcc

SEQ ID NO: 17630 - DNA, 16 bp, H. sapiens
aaggcagccaggaggg

SEQ ID NO: 17631 - DNA, 16 bp, H. sapiens
aaggcagctctctgca

SEQ ID NO: 17632 - DNA, 16 bp, H. sapiens
aaggcagctctctgga

SEQ ID NO: 17633 - DNA, 16 bp, H. sapiens
aaggcagctgtctgca

SEQ ID NO: 17634 - DNA, 16 bp, H. sapiens
aaggcaggaacaggcc

SEQ ID NO: 17635 - DNA, 16 bp, H. sapiens
aaggcaggaggaccac

SEQ ID NO: 17636 - DNA, 21 bp, H. sapiens
aaggcaggaggatcacttgaa

SEQ ID NO: 17637 - DNA, 16 bp, H. sapiens
aaggcaggaggcagag

SEQ ID NO: 17638 - DNA, 16 bp, H. sapiens
aaggcaggaggcagga

SEQ ID NO: 17639 - DNA, 16 bp, H. sapiens
aaggcaggcacttctg

SEQ ID NO: 17640 - DNA, 25 bp, H. sapiens
aaggcaggcagatcacctgaggtca

SEQ ID NO: 17641 - DNA, 16 bp, H. sapiens
aaggcaggcatggtgg

SEQ ID NO: 17642 - DNA, 23 bp, H. sapiens
aaggcaggcggatcacttgaggt

SEQ ID NO: 17643 - DNA, 16 bp, H. sapiens
aaggcaggcggatcat

SEQ ID NO: 17644 - DNA, 16 bp, H. sapiens
aaggcaggcggattac

SEQ ID NO: 17645 - DNA, 16 bp, H. sapiens
aaggcagggccagggc

SEQ ID NO: 17646 - DNA, 16 bp, H. sapiens
aaggcagggggatggc

SEQ ID NO: 17647 - DNA, 16 bp, H. sapiens
aaggcagggtccctgg

SEQ ID NO: 17648 - DNA, 16 bp, H. sapiens
aaggcaggtctggtgg

SEQ ID NO: 17649 - DNA, 16 bp, H. sapiens
aaggcagtggttgcag

SEQ ID NO: 17650 - DNA, 16 bp, H. sapiens
aaggcagtgtgtagag

SEQ ID NO: 17651 - DNA, 16 bp, H. sapiens
aaggcataaaaatgta

SEQ ID NO: 17652 - DNA, 17 bp, H. sapiens
aaggcataacgaagaaa

SEQ ID NO: 17653 - DNA, 16 bp, H. sapiens
aaggcatacatgcagc

SEQ ID NO: 17654 - DNA, 16 bp, H. sapiens
aaggcatataaagaaa

SEQ ID NO: 17655 - DNA, 16 bp, H. sapiens
aaggcatcatcttgga

SEQ ID NO: 17656 - DNA, 16 bp, H. sapiens
aaggcatccttgtctt

SEQ ID NO: 17657 - DNA, 16 bp, H. sapiens
aaggcatgggaatgta

SEQ ID NO: 17658 - DNA, 16 bp, H. sapiens
aaggcatgtgggaagg

SEQ ID NO: 17659 - DNA, 16 bp, H. sapiens
aaggcattggtcaagg

SEQ ID NO: 17660 - DNA, 16 bp, H. sapiens
aaggcatttaacaaaa

SEQ ID NO: 17661 - DNA, 16 bp, H. sapiens
aaggcatttctatttt

SEQ ID NO: 17662 - DNA, 16 bp, H. sapiens
aaggcattttcttttc

SEQ ID NO: 17663 - DNA, 16 bp, H. sapiens
aaggcattttgtagat

SEQ ID NO: 17664 - DNA, 16 bp, H. sapiens
aaggcatttttcaaaa

SEQ ID NO: 17665 - DNA, 16 bp, H. sapiens
aaggccaaggagggag

SEQ ID NO: 17666 - DNA, 16 bp, H. sapiens
aaggccaaggcagggg

SEQ ID NO: 17667 - DNA, 16 bp, H. sapiens
aaggccaaggtgggag

SEQ ID NO: 17668 - DNA, 16 bp, H. sapiens
aaggccaataactctt

SEQ ID NO: 17669 - DNA, 16 bp, H. sapiens
aaggccacacagccag

SEQ ID NO: 17670 - DNA, 16 bp, H. sapiens
aaggccagcctgggaa

SEQ ID NO: 17671 - DNA, 16 bp, H. sapiens
aaggccagcctgggga

SEQ ID NO: 17672 - DNA, 16 bp, H. sapiens
aaggccaggcacagtg

SEQ ID NO: 17673 - DNA, 16 bp, H. sapiens
aaggccaggcatggtg

SEQ ID NO: 17674 - DNA, 16 bp, H. sapiens
aaggccaggctgagga

SEQ ID NO: 17675 - DNA, 16 bp, H. sapiens
aaggccatatttcaga

SEQ ID NO: 17676 - DNA, 16 bp, H. sapiens
aaggccatccccatca

SEQ ID NO: 17677 - DNA, 16 bp, H. sapiens
aaggccatctatgaca

SEQ ID NO: 17678 - DNA, 16 bp, H. sapiens
aaggcccaagagcccc

SEQ ID NO: 17679 - DNA, 16 bp, H. sapiens
aaggcccagctctgcc

SEQ ID NO: 17680 - DNA, 16 bp, H. sapiens
aaggccccaccttcta

SEQ ID NO: 17681 - DNA, 16 bp, H. sapiens
aaggccctcttcctgg

SEQ ID NO: 17682 - DNA, 16 bp, H. sapiens
aaggccctgaggcaga

SEQ ID NO: 17683 - DNA, 16 bp, H. sapiens
aaggcccttgccagat

SEQ ID NO: 17684 - DNA, 16 bp, H. sapiens
aaggccgggcgaggtg

SEQ ID NO: 17685 - DNA, 16 bp, H. sapiens
aaggccgggggcagtg

SEQ ID NO: 17686 - DNA, 16 bp, H. sapiens
aaggcctcagaagaaa

SEQ ID NO: 17687 - DNA, 16 bp, H. sapiens
aaggcctccctagcca

SEQ ID NO: 17688 - DNA, 16 bp, H. sapiens
aaggcctcctggagga

SEQ ID NO: 17689 - DNA, 16 bp, H. sapiens
aaggcctctctgaaga

SEQ ID NO: 17690 - DNA, 16 bp, H. sapiens
aaggcctgaagcctgg

SEQ ID NO: 17691 - DNA, 16 bp, H. sapiens
aaggcctgagagtccc

SEQ ID NO: 17692 - DNA, 16 bp, H. sapiens
aaggcctggaatcagg

SEQ ID NO: 17693 - DNA, 16 bp, H. sapiens
aaggcctggaggcagg

SEQ ID NO: 17694 - DNA, 16 bp, H. sapiens
aaggccttgaagacat

SEQ ID NO: 17695 - DNA, 16 bp, H. sapiens
aaggccttttctgaat

SEQ ID NO: 17696 - DNA, 16 bp, H. sapiens
aaggcctttttaaaaa

SEQ ID NO: 17697 - DNA, 16 bp, H. sapiens
aaggcggagtttgcag

SEQ ID NO: 17698 - DNA, 16 bp, H. sapiens
aaggctaaggcaggag

SEQ ID NO: 17699 - DNA, 16 bp, H. sapiens
aaggctaaggtaggag

SEQ ID NO: 17700 - DNA, 16 bp, H. sapiens
aaggctacagctgcca

SEQ ID NO: 17701 - DNA, 16 bp, H. sapiens
aaggctacctgggggc

SEQ ID NO: 17702 - DNA, 16 bp, H. sapiens
aaggctataactgcca

SEQ ID NO: 17703 - DNA, 16 bp, H. sapiens
aaggctatttcacttt

SEQ ID NO: 17704 - DNA, 16 bp, H. sapiens
aaggctattttatcta

SEQ ID NO: 17705 - DNA, 16 bp, H. sapiens
aaggctattttttaaa

SEQ ID NO: 17706 - DNA, 16 bp, H. sapiens
aaggctgaataatatt

SEQ ID NO: 17707 - DNA, 16 bp, H. sapiens
aaggctgaatattatt

SEQ ID NO: 17708 - DNA, 16 bp, H. sapiens
aaggctgagagatttt

SEQ ID NO: 17709 - DNA, 16 bp, H. sapiens
aaggctgaggcagaaa

SEQ ID NO: 17710 - DNA, 16 bp, H. sapiens
aaggctgaggcaggca

SEQ ID NO: 17711 - DNA, 16 bp, H. sapiens
aaggctgaggcgggag

SEQ ID NO: 17712 - DNA, 16 bp, H. sapiens
aaggctgaggctgagg

SEQ ID NO: 17713 - DNA, 18 bp, H. sapiens
aaggctgaggtaggagaa

SEQ ID NO: 17714 - DNA, 16 bp, H. sapiens
aaggctgaggtggaag

SEQ ID NO: 17715 - DNA, 16 bp, H. sapiens
aaggctgaggtggcag

SEQ ID NO: 17716 - DNA, 21 bp, H. sapiens
aaggctgaggtgggaggatct

SEQ ID NO: 17717 - DNA, 20 bp, H. sapiens
aaggctgaggtgggaggatg

SEQ ID NO: 17718 - DNA, 16 bp, H. sapiens
aaggctgagtaatatt

SEQ ID NO: 17719 - DNA, 16 bp, H. sapiens
aaggctgcaatgagcc

SEQ ID NO: 17720 - DNA, 16 bp, H. sapiens
aaggctgcagatggaa

SEQ ID NO: 17721 - DNA, 16 bp, H. sapiens
aaggctgcagtgaatt

SEQ ID NO: 17722 - DNA, 16 bp, H. sapiens
aaggctgcagtgagcc

SEQ ID NO: 17723 - DNA, 16 bp, H. sapiens
aaggctgcagtgaggc

SEQ ID NO: 17724 - DNA, 16 bp, H. sapiens
aaggctgccagttttg

SEQ ID NO: 17725 - DNA, 16 bp, H. sapiens
aaggctgcctggagga

SEQ ID NO: 17726 - DNA, 16 bp, H. sapiens
aaggctgctgtgagga

SEQ ID NO: 17727 - DNA, 16 bp, H. sapiens
aaggctgctgtggcca

SEQ ID NO: 17728 - DNA, 16 bp, H. sapiens
aaggctgctgttcaga

SEQ ID NO: 17729 - DNA, 16 bp, H. sapiens
aaggctggaaagtcca

SEQ ID NO: 17730 - DNA, 16 bp, H. sapiens
aaggctggacacagtg

SEQ ID NO: 17731 - DNA, 17 bp, H. sapiens
aaggctggagtgcagtg

SEQ ID NO: 17732 - DNA, 16 bp, H. sapiens
aaggctgggcagggtg

SEQ ID NO: 17733 - DNA, 16 bp, H. sapiens
aaggctgggggcggtg

SEQ ID NO: 17734 - DNA, 16 bp, H. sapiens
aaggctggggtgggag

SEQ ID NO: 17735 - DNA, 16 bp, H. sapiens
aaggctgggtgtggtg

SEQ ID NO: 17736 - DNA, 17 bp, H. sapiens
aaggctggtcttgaact

SEQ ID NO: 17737 - DNA, 16 bp, H. sapiens
aaggctgtcagacagg

SEQ ID NO: 17738 - DNA, 17 bp, H. sapiens
aaggctgttgttcagat

SEQ ID NO: 17739 - DNA, 16 bp, H. sapiens
aaggcttcacagagaa

SEQ ID NO: 17740 - DNA, 16 bp, H. sapiens
aaggcttcactgagaa

SEQ ID NO: 17741 - DNA, 16 bp, H. sapiens
aaggcttccctgagga

SEQ ID NO: 17742 - DNA, 16 bp, H. sapiens
aaggcttcccttggct

SEQ ID NO: 17743 - DNA, 16 bp, H. sapiens
aaggcttcctggaaga

SEQ ID NO: 17744 - DNA, 16 bp, H. sapiens
aaggcttcttggaaga

SEQ ID NO: 17745 - DNA, 16 bp, H. sapiens
aaggcttgagaaccag

SEQ ID NO: 17746 - DNA, 16 bp, H. sapiens
aaggctttcaattttt

SEQ ID NO: 17747 - DNA, 16 bp, H. sapiens
aaggctttcagttttc

SEQ ID NO: 17748 - DNA, 16 bp, H. sapiens
aaggctttccagatat

SEQ ID NO: 17749 - DNA, 16 bp, H. sapiens
aaggctttctggaaga

SEQ ID NO: 17750 - DNA, 16 bp, H. sapiens
aaggctttgataaaat

SEQ ID NO: 17751 - DNA, 16 bp, H. sapiens
aaggctttgccacatt

SEQ ID NO: 17752 - DNA, 16 bp, H. sapiens
aaggctttgggggact

SEQ ID NO: 17753 - DNA, 16 bp, H. sapiens
aaggcttttgaattaa

SEQ ID NO: 17754 - DNA, 16 bp, H. sapiens
aaggcttttttaaaaa

SEQ ID NO: 17755 - DNA, 16 bp, H. sapiens
aagggaaaatatattt

SEQ ID NO: 17756 - DNA, 16 bp, H. sapiens
aagggaaacaggccct

SEQ ID NO: 17757 - DNA, 16 bp, H. sapiens
aagggaaacccatcag

SEQ ID NO: 17758 - DNA, 16 bp, H. sapiens
aagggaaactttcaca

SEQ ID NO: 17759 - DNA, 16 bp, H. sapiens
aagggaaagcaaggca

SEQ ID NO: 17760 - DNA, 16 bp, H. sapiens
aagggaaatgcaaagc

SEQ ID NO: 17761 - DNA, 16 bp, H. sapiens
aagggaaatgtgggat

SEQ ID NO: 17762 - DNA, 16 bp, H. sapiens
aagggaaatgtggggt

SEQ ID NO: 17763 - DNA, 16 bp, H. sapiens
aagggaacagcatgtg

SEQ ID NO: 17764 - DNA, 16 bp, H. sapiens
aagggaacatttatat

SEQ ID NO: 17765 - DNA, 47 bp, H. sapiens
aagggaactcagaggctggcgggatcctccatatgctgaacgctggt

SEQ ID NO: 17766 - DNA, 16 bp, H. sapiens
aagggaagatggagcc

SEQ ID NO: 17767 - DNA, 16 bp, H. sapiens
aagggaagcaaagcat

SEQ ID NO: 17768 - DNA, 16 bp, H. sapiens
aagggaagcagagcat

SEQ ID NO: 17769 - DNA, 16 bp, H. sapiens
aagggaagcccatcaa

SEQ ID NO: 17770 - DNA, 16 bp, H. sapiens
aagggaaggaaattct

SEQ ID NO: 17771 - DNA, 16 bp, H. sapiens
aagggaaggaagccag

SEQ ID NO: 17772 - DNA, 16 bp, H. sapiens
aagggaaggagattct

SEQ ID NO: 17773 - DNA, 18 bp, H. sapiens
aagggaaggctgccttcc

SEQ ID NO: 17774 - DNA, 16 bp, H. sapiens
aagggaataacagaca

SEQ ID NO: 17775 - DNA, 16 bp, H. sapiens
aagggacaaacactca

SEQ ID NO: 17776 - DNA, 16 bp, H. sapiens
aagggacataccttaa

SEQ ID NO: 17777 - DNA, 16 bp, H. sapiens
aagggaccttagagat

SEQ ID NO: 17778 - DNA, 16 bp, H. sapiens
aagggacttgaataga

SEQ ID NO: 17779 - DNA, 16 bp, H. sapiens
aagggactttgcaggt

SEQ ID NO: 17780 - DNA, 16 bp, H. sapiens
aagggagaaaagcatt

SEQ ID NO: 17781 - DNA, 16 bp, H. sapiens
aagggagaaattagcc

SEQ ID NO: 17782 - DNA, 16 bp, H. sapiens
aagggagagaaatgca

SEQ ID NO: 17783 - DNA, 16 bp, H. sapiens
aagggagcttgtgcag

SEQ ID NO: 17784 - DNA, 16 bp, H. sapiens
aagggaggcctggtgg

SEQ ID NO: 17785 - DNA, 16 bp, H. sapiens
aagggaggctgagaag

SEQ ID NO: 17786 - DNA, 16 bp, H. sapiens
aagggagggacctagt

SEQ ID NO: 17787 - DNA, 16 bp, H. sapiens
aagggagtcttgctct

SEQ ID NO: 17788 - DNA, 16 bp, H. sapiens
aagggagttcttcaag

SEQ ID NO: 17789 - DNA, 16 bp, H. sapiens
aagggatatttgagag

SEQ ID NO: 17790 - DNA, 16 bp, H. sapiens
aagggatattttgaag

SEQ ID NO: 17791 - DNA, 16 bp, H. sapiens
aagggatattttggag

SEQ ID NO: 17792 - DNA, 16 bp, H. sapiens
aagggatggacttgtg

SEQ ID NO: 17793 - DNA, 16 bp, H. sapiens
aagggattaaaaacca

SEQ ID NO: 17794 - DNA, 16 bp, H. sapiens
aagggattttttaaaa

SEQ ID NO: 17795 - DNA, 16 bp, H. sapiens
aagggcaaatctaaaa

SEQ ID NO: 17796 - DNA, 16 bp, H. sapiens
aagggcaagaaggctg

SEQ ID NO: 17797 - DNA, 16 bp, H. sapiens
aagggcaaggccaggg

SEQ ID NO: 17798 - DNA, 22 bp, H. sapiens
aagggcacccatcccgttcccc

SEQ ID NO: 17799 - DNA, 16 bp, H. sapiens
aagggcagagtcctca

SEQ ID NO: 17800 - DNA, 16 bp, H. sapiens
aagggcagccagaaag

SEQ ID NO: 17801 - DNA, 17 bp, H. sapiens
aagggcagccagagaaa

SEQ ID NO: 17802 - DNA, 16 bp, H. sapiens
aagggcaggagaagac

SEQ ID NO: 17803 - DNA, 16 bp, H. sapiens
aagggcagttcctctg

SEQ ID NO: 17804 - DNA, 16 bp, H. sapiens
aagggcatttttaaaa

SEQ ID NO: 17805 - DNA, 16 bp, H. sapiens
aagggccagatggtaa

SEQ ID NO: 17806 - DNA, 16 bp, H. sapiens
aagggccctcaccaga

SEQ ID NO: 17807 - DNA, 16 bp, H. sapiens
aagggctatgaagaaa

SEQ ID NO: 17808 - DNA, 16 bp, H. sapiens
aagggctatgggagtt

SEQ ID NO: 17809 - DNA, 23 bp, H. sapiens
aagggctgaggagtgcgggcgca

SEQ ID NO: 17810 - DNA, 16 bp, H. sapiens
aagggctgcgagggct

SEQ ID NO: 17811 - DNA, 16 bp, H. sapiens
aagggctgggaataca

SEQ ID NO: 17812 - DNA, 16 bp, H. sapiens
aaggggaaaaaaatca

SEQ ID NO: 17813 - DNA, 16 bp, H. sapiens
aaggggaaaaaaatcc

SEQ ID NO: 17814 - DNA, 16 bp, H. sapiens
aaggggaaaataattt

SEQ ID NO: 17815 - DNA, 16 bp, H. sapiens
aaggggaaaatatttt

SEQ ID NO: 17816 - DNA, 16 bp, H. sapiens
aaggggaaaatgtgaa

SEQ ID NO: 17817 - DNA, 16 bp, H. sapiens
aaggggaaacaaggca

SEQ ID NO: 17818 - DNA, 16 bp, H. sapiens
aaggggaagcaaggca

SEQ ID NO: 17819 - DNA, 16 bp, H. sapiens
aaggggaatacttcca

SEQ ID NO: 17820 - DNA, 16 bp, H. sapiens
aaggggacccaagcag

SEQ ID NO: 17821 - DNA, 16 bp, H. sapiens
aaggggaccccagaga

SEQ ID NO: 17822 - DNA, 16 bp, H. sapiens
aaggggacttcaaaaa

SEQ ID NO: 17823 - DNA, 16 bp, H. sapiens
aaggggatgcttccag

SEQ ID NO: 17824 - DNA, 16 bp, H. sapiens
aaggggatggcgctaa

SEQ ID NO: 17825 - DNA, 16 bp, H. sapiens
aaggggcaaggaagct

SEQ ID NO: 17826 - DNA, 16 bp, H. sapiens
aaggggcagactgcct

SEQ ID NO: 17827 - DNA, 17 bp, H. sapiens
aaggggcagggtaaaga

SEQ ID NO: 17828 - DNA, 16 bp, H. sapiens
aaggggccaggagcca

SEQ ID NO: 17829 - DNA, 16 bp, H. sapiens
aaggggccaggtgtgg

SEQ ID NO: 17830 - DNA, 31 bp, H. sapiens
aaggggccctgctcaacctggcagaagggtt

SEQ ID NO: 17831 - DNA, 16 bp, H. sapiens
aaggggctacatgccc

SEQ ID NO: 17832 - DNA, 16 bp, H. sapiens
aaggggcttcctcctt

SEQ ID NO: 17833 - DNA, 16 bp, H. sapiens
aaggggcttctccctt

SEQ ID NO: 17834 - DNA, 16 bp, H. sapiens
aagggggccagcccct

SEQ ID NO: 17835 - DNA, 16 bp, H. sapiens
aagggggccaggcaca

SEQ ID NO: 17836 - DNA, 17 bp, H. sapiens
aagggggcctgcccctc

SEQ ID NO: 17837 - DNA, 16 bp, H. sapiens
aaggggggaaaagccc

SEQ ID NO: 17838 - DNA, 16 bp, H. sapiens
aaggggtggaaaaata

SEQ ID NO: 17839 - DNA, 16 bp, H. sapiens
aaggggtggctgtggg

SEQ ID NO: 17840 - DNA, 16 bp, H. sapiens
aaggggtggggctgac

SEQ ID NO: 17841 - DNA, 16 bp, H. sapiens
aaggggttaatatcca

SEQ ID NO: 17842 - DNA, 16 bp, H. sapiens
aagggtcaactgtaca

SEQ ID NO: 17843 - DNA, 16 bp, H. sapiens
aagggtcagctgtact

SEQ ID NO: 17844 - DNA, 16 bp, H. sapiens
aagggtctcactctgt

SEQ ID NO: 17845 - DNA, 16 bp, H. sapiens
aagggtctgctttgtg

SEQ ID NO: 17846 - DNA, 16 bp, H. sapiens
aagggtgaaggaccaa

SEQ ID NO: 17847 - DNA, 16 bp, H. sapiens
aagggtgaatttggag

SEQ ID NO: 17848 - DNA, 16 bp, H. sapiens
aagggtgagactccat

SEQ ID NO: 17849 - DNA, 16 bp, H. sapiens
aagggtgagccaggca

SEQ ID NO: 17850 - DNA, 16 bp, H. sapiens
aagggtgcaagcccca

SEQ ID NO: 17851 - DNA, 20 bp, H. sapiens
aagggtggaaggctaccctg

SEQ ID NO: 17852 - DNA, 16 bp, H. sapiens
aagggtggggtccctg

SEQ ID NO: 17853 - DNA, 16 bp, H. sapiens
aagggttctcattgtt

SEQ ID NO: 17854 - DNA, 16 bp, H. sapiens
aagggtttttcttttt

SEQ ID NO: 17855 - DNA, 16 bp, H. sapiens
aagggtttttggtgtc

SEQ ID NO: 17856 - DNA, 16 bp, H. sapiens
aagggttttttttctt

SEQ ID NO: 17857 - DNA, 16 bp, H. sapiens
aaggtaaaagctattg

SEQ ID NO: 17858 - DNA, 16 bp, H. sapiens
aaggtaagctccatga

SEQ ID NO: 17859 - DNA, 16 bp, H. sapiens
aaggtaatttttttaa

SEQ ID NO: 17860 - DNA, 16 bp, H. sapiens
aaggtagaaacaaccc

SEQ ID NO: 17861 - DNA, 16 bp, H. sapiens
aaggtagagtaaaaat

SEQ ID NO: 17862 - DNA, 21 bp, H. sapiens
aaggtaggaggattgcttgag

SEQ ID NO: 17863 - DNA, 16 bp, H. sapiens
aaggtaggtactgtta

SEQ ID NO: 17864 - DNA, 16 bp, H. sapiens
aaggtatgtgggaagg

SEQ ID NO: 17865 - DNA, 16 bp, H. sapiens
aaggtattttatttct

SEQ ID NO: 17866 - DNA, 16 bp, H. sapiens
aaggtcaagagatcaa

SEQ ID NO: 17867 - DNA, 17 bp, H. sapiens
aaggtcaagctgcagga

SEQ ID NO: 17868 - DNA, 16 bp, H. sapiens
aaggtcaaggggccac

SEQ ID NO: 17869 - DNA, 16 bp, H. sapiens
aaggtcaagtaacttg

SEQ ID NO: 17870 - DNA, 16 bp, H. sapiens
aaggtcaatgggaaac

SEQ ID NO: 17871 - DNA, 16 bp, H. sapiens
aaggtcaatgtgaaag

SEQ ID NO: 17872 - DNA, 16 bp, H. sapiens
aaggtcacacaactgg

SEQ ID NO: 17873 - DNA, 16 bp, H. sapiens
aaggtcacagagctgc

SEQ ID NO: 17874 - DNA, 16 bp, H. sapiens
aaggtcacatagctag

SEQ ID NO: 17875 - DNA, 16 bp, H. sapiens
aaggtcacattctgag

SEQ ID NO: 17876 - DNA, 16 bp, H. sapiens
aaggtcacgtgggtca

SEQ ID NO: 17877 - DNA, 18 bp, H. sapiens
aaggtcagaagttcaaga

SEQ ID NO: 17878 - DNA, 16 bp, H. sapiens
aaggtcagcagatcaa

SEQ ID NO: 17879 - DNA, 20 bp, H. sapiens
aaggtcaggagttcaagaca

SEQ ID NO: 17880 - DNA, 16 bp, H. sapiens
aaggtcagttgaagtc

SEQ ID NO: 17881 - DNA, 16 bp, H. sapiens
aaggtcatacagctaa

SEQ ID NO: 17882 - DNA, 16 bp, H. sapiens
aaggtcatacagctag

SEQ ID NO: 17883 - DNA, 16 bp, H. sapiens
aaggtccaggctgagg

SEQ ID NO: 17884 - DNA, 16 bp, H. sapiens
aaggtcccacttctca

SEQ ID NO: 17885 - DNA, 16 bp, H. sapiens
aaggtcccatctccaa

SEQ ID NO: 17886 - DNA, 16 bp, H. sapiens
aaggtccctgtcctca

SEQ ID NO: 17887 - DNA, 16 bp, H. sapiens
aaggtcctggaagaca

SEQ ID NO: 17888 - DNA, 16 bp, H. sapiens
aaggtcctggaagagg

SEQ ID NO: 17889 - DNA, 23 bp, H. sapiens
aaggtcgcgccactgcactccag

SEQ ID NO: 17890 - DNA, 16 bp, H. sapiens
aaggtcgggcatggtg

SEQ ID NO: 17891 - DNA, 16 bp, H. sapiens
aaggtctcagatgaaa

SEQ ID NO: 17892 - DNA, 16 bp, H. sapiens
aaggtctctctctctc

SEQ ID NO: 17893 - DNA, 16 bp, H. sapiens
aaggtctctctgtgtt

SEQ ID NO: 17894 - DNA, 16 bp, H. sapiens
aaggtctctggttttc

SEQ ID NO: 17895 - DNA, 16 bp, H. sapiens
aaggtctgatttttca

SEQ ID NO: 17896 - DNA, 16 bp, H. sapiens
aaggtctgcagcttca

SEQ ID NO: 17897 - DNA, 16 bp, H. sapiens
aaggtctgtagcttca

SEQ ID NO: 17898 - DNA, 16 bp, H. sapiens
aaggtgaaaaagttct

SEQ ID NO: 17899 - DNA, 16 bp, H. sapiens
aaggtgaagagggagc

SEQ ID NO: 17900 - DNA, 16 bp, H. sapiens
aaggtgaaggaggagc

SEQ ID NO: 17901 - DNA, 16 bp, H. sapiens
aaggtgaagggaaagc

SEQ ID NO: 17902 - DNA, 16 bp, H. sapiens
aaggtgaaggggaaac

SEQ ID NO: 17903 - DNA, 16 bp, H. sapiens
aaggtgaggagattga

SEQ ID NO: 17904 - DNA, 16 bp, H. sapiens
aaggtgatgctggcct

SEQ ID NO: 17905 - DNA, 16 bp, H. sapiens
aaggtgatggtgatga

SEQ ID NO: 17906 - DNA, 16 bp, H. sapiens
aaggtgattcttgcta

SEQ ID NO: 17907 - DNA, 16 bp, H. sapiens
aaggtgattttaaaaa

SEQ ID NO: 17908 - DNA, 16 bp, H. sapiens
aaggtgattttctttg

SEQ ID NO: 17909 - DNA, 16 bp, H. sapiens
aaggtgcaaaacaaag

SEQ ID NO: 17910 - DNA, 16 bp, H. sapiens
aaggtgccaccagcca

SEQ ID NO: 17911 - DNA, 16 bp, H. sapiens
aaggtgctcagcaggg

SEQ ID NO: 17912 - DNA, 16 bp, H. sapiens
aaggtgctgagattac

SEQ ID NO: 17913 - DNA, 16 bp, H. sapiens
aaggtgctgagggaag

SEQ ID NO: 17914 - DNA, 16 bp, H. sapiens
aaggtgctggcagatc

SEQ ID NO: 17915 - DNA, 16 bp, H. sapiens
aaggtgctggggttac

SEQ ID NO: 17916 - DNA, 16 bp, H. sapiens
aaggtggaaaaggcaa

SEQ ID NO: 17917 - DNA, 16 bp, H. sapiens
aaggtggagaggagct

SEQ ID NO: 17918 - DNA, 16 bp, H. sapiens
aaggtggagggtgcag

SEQ ID NO: 17919 - DNA, 16 bp, H. sapiens
aaggtggaggtggcag

SEQ ID NO: 17920 - DNA, 19 bp, H. sapiens
aaggtggaggttgcagtga

SEQ ID NO: 17921 - DNA, 16 bp, H. sapiens
aaggtggatggaagag

SEQ ID NO: 17922 - DNA, 16 bp, H. sapiens
aaggtggcagcagggc

SEQ ID NO: 17923 - DNA, 16 bp, H. sapiens
aaggtggcaggagtgg

SEQ ID NO: 17924 - DNA, 16 bp, H. sapiens
aaggtggcatggaccc

SEQ ID NO: 17925 - DNA, 16 bp, H. sapiens
aaggtgggaggaccac

SEQ ID NO: 17926 - DNA, 23 bp, H. sapiens
aaggtgggcggatcacttgaggt

SEQ ID NO: 17927 - DNA, 16 bp, H. sapiens
aaggtgggtggactgc

SEQ ID NO: 17928 - DNA, 24 bp, H. sapiens
aaggtgggtggatcacaaggtcaa

SEQ ID NO: 17929 - DNA, 16 bp, H. sapiens
aaggtggtttagtttt

SEQ ID NO: 17930 - DNA, 16 bp, H. sapiens
aaggtgtaagaaaggg

SEQ ID NO: 17931 - DNA, 16 bp, H. sapiens
aaggtgtatggaaggg

SEQ ID NO: 17932 - DNA, 16 bp, H. sapiens
aaggtgtcaacagggt

SEQ ID NO: 17933 - DNA, 16 bp, H. sapiens
aaggtgtcagaccacg

SEQ ID NO: 17934 - DNA, 16 bp, H. sapiens
aaggtgtcagactctc

SEQ ID NO: 17935 - DNA, 16 bp, H. sapiens
aaggtgtccaagaaga

SEQ ID NO: 17936 - DNA, 16 bp, H. sapiens
aaggtgttgggattat

SEQ ID NO: 17937 - DNA, 16 bp, H. sapiens
aaggttaagtgaggtc

SEQ ID NO: 17938 - DNA, 16 bp, H. sapiens
aaggttacagtgagct

SEQ ID NO: 17939 - DNA, 16 bp, H. sapiens
aaggttcatttatgtt

SEQ ID NO: 17940 - DNA, 16 bp, H. sapiens
aaggttgcagtgaacc

SEQ ID NO: 17941 - DNA, 16 bp, H. sapiens
aaggttgcagtgagcc

SEQ ID NO: 17942 - DNA, 16 bp, H. sapiens
aaggttgcagtgagtt

SEQ ID NO: 17943 - DNA, 16 bp, H. sapiens
aaggttgcagtgggcc

SEQ ID NO: 17944 - DNA, 16 bp, H. sapiens
aaggttggttcaacat

SEQ ID NO: 17945 - DNA, 16 bp, H. sapiens
aaggtttatttctcat

SEQ ID NO: 17946 - DNA, 16 bp, H. sapiens
aaggtttctccatgtc

SEQ ID NO: 17947 - DNA, 16 bp, H. sapiens
aaggtttgaacaagtt

SEQ ID NO: 17948 - DNA, 16 bp, H. sapiens
aaggtttgctgagggc

SEQ ID NO: 17949 - DNA, 16 bp, H. sapiens
aaggtttgtaaaggca

SEQ ID NO: 17950 - DNA, 16 bp, H. sapiens
aaggtttgttcaacat

SEQ ID NO: 17951 - DNA, 16 bp, H. sapiens
aaggttttctcttttt

SEQ ID NO: 17952 - DNA, 16 bp, H. sapiens
aaggtttttctggggt

SEQ ID NO: 17953 - DNA, 16 bp, H. sapiens
aaggtttttgctgaga

SEQ ID NO: 17954 - DNA, 16 bp, H. sapiens
aagtaaaaacagcctt

SEQ ID NO: 17955 - DNA, 16 bp, H. sapiens
aagtaaaacaattttt

SEQ ID NO: 17956 - DNA, 16 bp, H. sapiens
aagtaaaacatttaaa

SEQ ID NO: 17957 - DNA, 16 bp, H. sapiens
aagtaaaactgtcttt

SEQ ID NO: 17958 - DNA, 16 bp, H. sapiens
aagtaaaactttttat

SEQ ID NO: 17959 - DNA, 16 bp, H. sapiens
aagtaaaagttgaaat

SEQ ID NO: 17960 - DNA, 16 bp, H. sapiens
aagtaaaagttgctaa

SEQ ID NO: 17961 - DNA, 16 bp, H. sapiens
aagtaaaagttggaaa

SEQ ID NO: 17962 - DNA, 16 bp, H. sapiens
aagtaaaattaacttt

SEQ ID NO: 17963 - DNA, 16 bp, H. sapiens
aagtaaaattgtattt

SEQ ID NO: 17964 - DNA, 16 bp, H. sapiens
aagtaaaatttcaaaa

SEQ ID NO: 17965 - DNA, 16 bp, H. sapiens
aagtaaacatttaaaa

SEQ ID NO: 17966 - DNA, 16 bp, H. sapiens
aagtaaagaaaatgtg

SEQ ID NO: 17967 - DNA, 17 bp, H. sapiens
aagtaaagaataagcca

SEQ ID NO: 17968 - DNA, 16 bp, H. sapiens
aagtaaagaggagctg

SEQ ID NO: 17969 - DNA, 16 bp, H. sapiens
aagtaaaggcctttcc

SEQ ID NO: 17970 - DNA, 16 bp, H. sapiens
aagtaaatatcttcat

SEQ ID NO: 17971 - DNA, 16 bp, H. sapiens
aagtaaatgaatggaa

SEQ ID NO: 17972 - DNA, 16 bp, H. sapiens
aagtaaatgacagaat

SEQ ID NO: 17973 - DNA, 16 bp, H. sapiens
aagtaaatgcaaatta

SEQ ID NO: 17974 - DNA, 16 bp, H. sapiens
aagtaaatttggaaaa

SEQ ID NO: 17975 - DNA, 16 bp, H. sapiens
aagtaacaaagatcag

SEQ ID NO: 17976 - DNA, 16 bp, H. sapiens
aagtaacagaagaggt

SEQ ID NO: 17977 - DNA, 16 bp, H. sapiens
aagtaacctgatgtta

SEQ ID NO: 17978 - DNA, 16 bp, H. sapiens
aagtaactaacttgat

SEQ ID NO: 17979 - DNA, 16 bp, H. sapiens
aagtaacttaacctct

SEQ ID NO: 17980 - DNA, 16 bp, H. sapiens
aagtaacttgccaaag

SEQ ID NO: 17981 - DNA, 16 bp, H. sapiens
aagtaacttgcctgaa

SEQ ID NO: 17982 - DNA, 16 bp, H. sapiens
aagtaacttggccaag

SEQ ID NO: 17983 - DNA, 16 bp, H. sapiens
aagtaacttttaaaaa

SEQ ID NO: 17984 - DNA, 16 bp, H. sapiens
aagtaagcctcttccc

SEQ ID NO: 17985 - DNA, 16 bp, H. sapiens
aagtaagctagagaaa

SEQ ID NO: 17986 - DNA, 16 bp, H. sapiens
aagtaaggagcccctc

SEQ ID NO: 17987 - DNA, 16 bp, H. sapiens
aagtaaggctcagaga

SEQ ID NO: 17988 - DNA, 16 bp, H. sapiens
aagtaagttctttgaa

SEQ ID NO: 17989 - DNA, 16 bp, H. sapiens
aagtaataagattgaa

SEQ ID NO: 17990 - DNA, 16 bp, H. sapiens
aagtaataataacaat

SEQ ID NO: 17991 - DNA, 16 bp, H. sapiens
aagtaatacatactca

SEQ ID NO: 17992 - DNA, 16 bp, H. sapiens
aagtaataggatatat

SEQ ID NO: 17993 - DNA, 16 bp, H. sapiens
aagtaatctacctgcc

SEQ ID NO: 17994 - DNA, 16 bp, H. sapiens
aagtaatctagagata

SEQ ID NO: 17995 - DNA, 16 bp, H. sapiens
aagtaatctagagatg

SEQ ID NO: 17996 - DNA, 16 bp, H. sapiens
aagtaatgaaattgaa

SEQ ID NO: 17997 - DNA, 16 bp, H. sapiens
aagtaattgcaggttt

SEQ ID NO: 17998 - DNA, 16 bp, H. sapiens
aagtaatttgcccaag

SEQ ID NO: 17999 - DNA, 16 bp, H. sapiens
aagtaattttcttttt

SEQ ID NO: 18000 - DNA, 16 bp, H. sapiens
aagtaatttttttcta

SEQ ID NO: 18001 - DNA, 16 bp, H. sapiens
aagtacaagaagatta

SEQ ID NO: 18002 - DNA, 16 bp, H. sapiens
aagtacaaggtgaagc

SEQ ID NO: 18003 - DNA, 16 bp, H. sapiens
aagtacacactcaaga

SEQ ID NO: 18004 - DNA, 16 bp, H. sapiens
aagtacagaaaaatat

SEQ ID NO: 18005 - DNA, 16 bp, H. sapiens
aagtacagaaagacaa

SEQ ID NO: 18006 - DNA, 16 bp, H. sapiens
aagtacataaagcaaa

SEQ ID NO: 18007 - DNA, 16 bp, H. sapiens
aagtacattctcaagg

SEQ ID NO: 18008 - DNA, 16 bp, H. sapiens
aagtacattttttaaa

SEQ ID NO: 18009 - DNA, 16 bp, H. sapiens
aagtaccacaaactgg

SEQ ID NO: 18010 - DNA, 17 bp, H. sapiens
aagtacccagagacaca

SEQ ID NO: 18011 - DNA, 16 bp, H. sapiens
aagtacctactatgtg

SEQ ID NO: 18012 - DNA, 16 bp, H. sapiens
aagtactgaaagaaaa

SEQ ID NO: 18013 - DNA, 16 bp, H. sapiens
aagtactgacacatgc

SEQ ID NO: 18014 - DNA, 16 bp, H. sapiens
aagtactgatacatgc

SEQ ID NO: 18015 - DNA, 17 bp, H. sapiens
aagtactgggattacaa

SEQ ID NO: 18016 - DNA, 16 bp, H. sapiens
aagtactgggggttag

SEQ ID NO: 18017 - DNA, 16 bp, H. sapiens
aagtacttaaaacaga

SEQ ID NO: 18018 - DNA, 16 bp, H. sapiens
aagtactttattcttt

SEQ ID NO: 18019 - DNA, 16 bp, H. sapiens
aagtactttttaaaaa

SEQ ID NO: 18020 - DNA, 16 bp, H. sapiens
aagtagaaggtcatca

SEQ ID NO: 18021 - DNA, 16 bp, H. sapiens
aagtagagagaatagt

SEQ ID NO: 18022 - DNA, 16 bp, H. sapiens
aagtagagataataat

SEQ ID NO: 18023 - DNA, 17 bp, H. sapiens
aagtagagatggggttt

SEQ ID NO: 18024 - DNA, 16 bp, H. sapiens
aagtagattagtggtt

SEQ ID NO: 18025 - DNA, 16 bp, H. sapiens
aagtagcagaacatgt

SEQ ID NO: 18026 - DNA, 16 bp, H. sapiens
aagtagccagaaagag

SEQ ID NO: 18027 - DNA, 16 bp, H. sapiens
aagtagccttcagaag

SEQ ID NO: 18028 - DNA, 16 bp, H. sapiens
aagtagctgaaattac

SEQ ID NO: 18029 - DNA, 17 bp, H. sapiens
aagtagctggaattaca

SEQ ID NO: 18030 - DNA, 16 bp, H. sapiens
aagtagctgggaccat

SEQ ID NO: 18031 - DNA, 20 bp, H. sapiens
aagtagctgggataacaggt

SEQ ID NO: 18032 - DNA, 16 bp, H. sapiens
aagtaggaagtgggga

SEQ ID NO: 18033 - DNA, 24 bp, H. sapiens
aagtaggcttcagaaggtgggtaa

SEQ ID NO: 18034 - DNA, 16 bp, H. sapiens
aagtagggaagatatt

SEQ ID NO: 18035 - DNA, 16 bp, H. sapiens
aagtagttgagactat

SEQ ID NO: 18036 - DNA, 16 bp, H. sapiens
aagtagtttctgagaa

SEQ ID NO: 18037 - DNA, 16 bp, H. sapiens
aagtagtttttttttc

SEQ ID NO: 18038 - DNA, 16 bp, H. sapiens
aagtataacatacata

SEQ ID NO: 18039 - DNA, 16 bp, H. sapiens
aagtataatattagct

SEQ ID NO: 18040 - DNA, 16 bp, H. sapiens
aagtataattttgtta

SEQ ID NO: 18041 - DNA, 16 bp, H. sapiens
aagtatacaattaaat

SEQ ID NO: 18042 - DNA, 16 bp, H. sapiens
aagtatacagttcaat

SEQ ID NO: 18043 - DNA, 16 bp, H. sapiens
aagtatactttttttt

SEQ ID NO: 18044 - DNA, 16 bp, H. sapiens
aagtatagattttaaa

SEQ ID NO: 18045 - DNA, 16 bp, H. sapiens
aagtatataatgcaaa

SEQ ID NO: 18046 - DNA, 16 bp, H. sapiens
aagtatatgaaaaagt

SEQ ID NO: 18047 - DNA, 16 bp, H. sapiens
aagtatattccttcaa

SEQ ID NO: 18048 - DNA, 16 bp, H. sapiens
aagtatattttaaaag

SEQ ID NO: 18049 - DNA, 16 bp, H. sapiens
aagtatcaaaatatca

SEQ ID NO: 18050 - DNA, 17 bp, H. sapiens
aagtatcaatagccgaa

SEQ ID NO: 18051 - DNA, 16 bp, H. sapiens
aagtatcatgagatct

SEQ ID NO: 18052 - DNA, 16 bp, H. sapiens
aagtatcatttaaaaa

SEQ ID NO: 18053 - DNA, 18 bp, H. sapiens
aagtatctgggattacag

SEQ ID NO: 18054 - DNA, 16 bp, H. sapiens
aagtatctgggattat

SEQ ID NO: 18055 - DNA, 16 bp, H. sapiens
aagtatctgttcatat

SEQ ID NO: 18056 - DNA, 16 bp, H. sapiens
aagtatctgttcatgt

SEQ ID NO: 18057 - DNA, 16 bp, H. sapiens
aagtatctgtttatat

SEQ ID NO: 18058 - DNA, 16 bp, H. sapiens
aagtatgcttggaaga

SEQ ID NO: 18059 - DNA, 16 bp, H. sapiens
aagtatgggattatgt

SEQ ID NO: 18060 - DNA, 16 bp, H. sapiens
aagtatgtctttatca

SEQ ID NO: 18061 - DNA, 16 bp, H. sapiens
aagtatgtgaagaaaa

SEQ ID NO: 18062 - DNA, 16 bp, H. sapiens
aagtatgtggaaatta

SEQ ID NO: 18063 - DNA, 16 bp, H. sapiens
aagtatgtgtatgtat

SEQ ID NO: 18064 - DNA, 16 bp, H. sapiens
aagtatgtgtgtgtat

SEQ ID NO: 18065 - DNA, 16 bp, H. sapiens
aagtatgttgaatatt

SEQ ID NO: 18066 - DNA, 16 bp, H. sapiens
aagtatgtttcagttt

SEQ ID NO: 18067 - DNA, 16 bp, H. sapiens
aagtatgttttctgat

SEQ ID NO: 18068 - DNA, 16 bp, H. sapiens
aagtattaacttacac

SEQ ID NO: 18069 - DNA, 16 bp, H. sapiens
aagtattagggcagca

SEQ ID NO: 18070 - DNA, 16 bp, H. sapiens
aagtattattacaaaa

SEQ ID NO: 18071 - DNA, 16 bp, H. sapiens
aagtattcatttttaa

SEQ ID NO: 18072 - DNA, 16 bp, H. sapiens
aagtattcattttttt

SEQ ID NO: 18073 - DNA, 16 bp, H. sapiens
aagtattccattatca

SEQ ID NO: 18074 - DNA, 16 bp, H. sapiens
aagtattcccagaaac

SEQ ID NO: 18075 - DNA, 16 bp, H. sapiens
aagtattccctctgct

SEQ ID NO: 18076 - DNA, 16 bp, H. sapiens
aagtattcccttttct

SEQ ID NO: 18077 - DNA, 16 bp, H. sapiens
aagtattctctcctct

SEQ ID NO: 18078 - DNA, 16 bp, H. sapiens
aagtattctgttataa

SEQ ID NO: 18079 - DNA, 16 bp, H. sapiens
aagtattgccaaggaa

SEQ ID NO: 18080 - DNA, 16 bp, H. sapiens
aagtatttacaaaaca

SEQ ID NO: 18081 - DNA, 16 bp, H. sapiens
aagtatttagcacagt

SEQ ID NO: 18082 - DNA, 16 bp, H. sapiens
aagtatttagggataa

SEQ ID NO: 18083 - DNA, 16 bp, H. sapiens
aagtatttattgaata

SEQ ID NO: 18084 - DNA, 16 bp, H. sapiens
aagtatttattgagca

SEQ ID NO: 18085 - DNA, 16 bp, H. sapiens
aagtatttattgggca

SEQ ID NO: 18086 - DNA, 16 bp, H. sapiens
aagtatttcaaaagaa

SEQ ID NO: 18087 - DNA, 16 bp, H. sapiens
aagtatttcatttctc

SEQ ID NO: 18088 - DNA, 16 bp, H. sapiens
aagtatttctatttct

SEQ ID NO: 18089 - DNA, 16 bp, H. sapiens
aagtatttctgatttt

SEQ ID NO: 18090 - DNA, 16 bp, H. sapiens
aagtatttgaaaatat

SEQ ID NO: 18091 - DNA, 16 bp, H. sapiens
aagtatttgaagaaaa

SEQ ID NO: 18092 - DNA, 16 bp, H. sapiens
aagtatttgcaaaaca

SEQ ID NO: 18093 - DNA, 16 bp, H. sapiens
aagtatttgcaaatta

SEQ ID NO: 18094 - DNA, 16 bp, H. sapiens
aagtatttgctgaatg

SEQ ID NO: 18095 - DNA, 16 bp, H. sapiens
aagtatttggaaaaaa

SEQ ID NO: 18096 - DNA, 16 bp, H. sapiens
aagtatttgtgtacct

SEQ ID NO: 18097 - DNA, 16 bp, H. sapiens
aagtatttgtttaata

SEQ ID NO: 18098 - DNA, 16 bp, H. sapiens
aagtattttaaagtat

SEQ ID NO: 18099 - DNA, 16 bp, H. sapiens
aagtattttaaatgtg

SEQ ID NO: 18100 - DNA, 16 bp, H. sapiens
aagtattttatctttt

SEQ ID NO: 18101 - DNA, 16 bp, H. sapiens
aagtattttctgattt

SEQ ID NO: 18102 - DNA, 16 bp, H. sapiens
aagtattttcttaaaa

SEQ ID NO: 18103 - DNA, 16 bp, H. sapiens
aagtattttctttttc

SEQ ID NO: 18104 - DNA, 16 bp, H. sapiens
aagtattttgttgagg

SEQ ID NO: 18105 - DNA, 16 bp, H. sapiens
aagtattttttattct

SEQ ID NO: 18106 - DNA, 16 bp, H. sapiens
aagtatttttttctct

SEQ ID NO: 18107 - DNA, 16 bp, H. sapiens
aagtcaaaatgaagaa

SEQ ID NO: 18108 - DNA, 16 bp, H. sapiens
aagtcaaataccacat

SEQ ID NO: 18109 - DNA, 16 bp, H. sapiens
aagtcaaatactgcat

SEQ ID NO: 18110 - DNA, 16 bp, H. sapiens
aagtcaaatatcacat

SEQ ID NO: 18111 - DNA, 16 bp, H. sapiens
aagtcaaattatctgt

SEQ ID NO: 18112 - DNA, 16 bp, H. sapiens
aagtcaaattgtctgt

SEQ ID NO: 18113 - DNA, 16 bp, H. sapiens
aagtcaacaaatattt

SEQ ID NO: 18114 - DNA, 16 bp, H. sapiens
aagtcaacaagcaaaa

SEQ ID NO: 18115 - DNA, 16 bp, H. sapiens
aagtcaagaaaatgaa

SEQ ID NO: 18116 - DNA, 16 bp, H. sapiens
aagtcaagaacctgaa

SEQ ID NO: 18117 - DNA, 16 bp, H. sapiens
aagtcaagactgcagt

SEQ ID NO: 18118 - DNA, 16 bp, H. sapiens
aagtcaagtaactcag

SEQ ID NO: 18119 - DNA, 16 bp, H. sapiens
aagtcaagtcacctct

SEQ ID NO: 18120 - DNA, 16 bp, H. sapiens
aagtcaataaacatga

SEQ ID NO: 18121 - DNA, 16 bp, H. sapiens
aagtcaataaatgtta

SEQ ID NO: 18122 - DNA, 16 bp, H. sapiens
aagtcacaaagattta

SEQ ID NO: 18123 - DNA, 16 bp, H. sapiens
aagtcacacagctaat

SEQ ID NO: 18124 - DNA, 16 bp, H. sapiens
aagtcacacagctagt

SEQ ID NO: 18125 - DNA, 16 bp, H. sapiens
aagtcacagaagaaaa

SEQ ID NO: 18126 - DNA, 16 bp, H. sapiens
aagtcacagagtggaa

SEQ ID NO: 18127 - DNA, 16 bp, H. sapiens
aagtcacatcttacat

SEQ ID NO: 18128 - DNA, 16 bp, H. sapiens
aagtcacctgcccaag

SEQ ID NO: 18129 - DNA, 16 bp, H. sapiens
aagtcactgtgcccag

SEQ ID NO: 18130 - DNA, 16 bp, H. sapiens
aagtcacttaaccttt

SEQ ID NO: 18131 - DNA, 16 bp, H. sapiens
aagtcacttaacttct

SEQ ID NO: 18132 - DNA, 16 bp, H. sapiens
aagtcacttaatctct

SEQ ID NO: 18133 - DNA, 16 bp, H. sapiens
aagtcacttaatcttt

SEQ ID NO: 18134 - DNA, 16 bp, H. sapiens
aagtcacttagcctct

SEQ ID NO: 18135 - DNA, 16 bp, H. sapiens
aagtcacttatcctct

SEQ ID NO: 18136 - DNA, 16 bp, H. sapiens
aagtcacttcccttct

SEQ ID NO: 18137 - DNA, 16 bp, H. sapiens
aagtcacttgcccaag

SEQ ID NO: 18138 - DNA, 16 bp, H. sapiens
aagtcagaaagatctc

SEQ ID NO: 18139 - DNA, 16 bp, H. sapiens
aagtcagaagacctgg

SEQ ID NO: 18140 - DNA, 16 bp, H. sapiens
aagtcagaaggagcca

SEQ ID NO: 18141 - DNA, 16 bp, H. sapiens
aagtcagaagttcaag

SEQ ID NO: 18142 - DNA, 16 bp, H. sapiens
aagtcagattatgtca

SEQ ID NO: 18143 - DNA, 16 bp, H. sapiens
aagtcagcaaactttt

SEQ ID NO: 18144 - DNA, 16 bp, H. sapiens
aagtcagccattcttt

SEQ ID NO: 18145 - DNA, 16 bp, H. sapiens
aagtcaggaattcaag

SEQ ID NO: 18146 - DNA, 18 bp, H. sapiens
aagtcaggagattgagac

SEQ ID NO: 18147 - DNA, 16 bp, H. sapiens
aagtcaggagttcagg

SEQ ID NO: 18148 - DNA, 16 bp, H. sapiens
aagtcaggcacaaaag

SEQ ID NO: 18149 - DNA, 16 bp, H. sapiens
aagtcagggactgtct

SEQ ID NO: 18150 - DNA, 16 bp, H. sapiens
aagtcagtggtagttt

SEQ ID NO: 18151 - DNA, 16 bp, H. sapiens
aagtcagtgtggccat

SEQ ID NO: 18152 - DNA, 16 bp, H. sapiens
aagtcagttcctgggt

SEQ ID NO: 18153 - DNA, 16 bp, H. sapiens
aagtcatcattctcag

SEQ ID NO: 18154 - DNA, 16 bp, H. sapiens
aagtcatccatgagag

SEQ ID NO: 18155 - DNA, 18 bp, H. sapiens
aagtcatcgccattctcc

SEQ ID NO: 18156 - DNA, 16 bp, H. sapiens
aagtcatgaaacaaca

SEQ ID NO: 18157 - DNA, 16 bp, H. sapiens
aagtcatgaagatatt

SEQ ID NO: 18158 - DNA, 16 bp, H. sapiens
aagtcattcatttaac

SEQ ID NO: 18159 - DNA, 16 bp, H. sapiens
aagtcattggaatttt

SEQ ID NO: 18160 - DNA, 16 bp, H. sapiens
aagtcatttaacctct

SEQ ID NO: 18161 - DNA, 16 bp, H. sapiens
aagtcatttaacttct

SEQ ID NO: 18162 - DNA, 16 bp, H. sapiens
aagtcatttaatctct

SEQ ID NO: 18163 - DNA, 16 bp, H. sapiens
aagtcatttagcctct

SEQ ID NO: 18164 - DNA, 16 bp, H. sapiens
aagtcatttatttgct

SEQ ID NO: 18165 - DNA, 16 bp, H. sapiens
aagtcatttttcacag

SEQ ID NO: 18166 - DNA, 16 bp, H. sapiens
aagtcatttttcttct

SEQ ID NO: 18167 - DNA, 16 bp, H. sapiens
aagtcatttttttaaa

SEQ ID NO: 18168 - DNA, 16 bp, H. sapiens
aagtccaaaatctgca

SEQ ID NO: 18169 - DNA, 16 bp, H. sapiens
aagtccaaatccaaag

SEQ ID NO: 18170 - DNA, 16 bp, H. sapiens
aagtccaagaccaagg

SEQ ID NO: 18171 - DNA, 16 bp, H. sapiens
aagtccaagagagaca

SEQ ID NO: 18172 - DNA, 16 bp, H. sapiens
aagtccaagatggagg

SEQ ID NO: 18173 - DNA, 16 bp, H. sapiens
aagtccaagattaagg

SEQ ID NO: 18174 - DNA, 16 bp, H. sapiens
aagtccaagctcaagg

SEQ ID NO: 18175 - DNA, 16 bp, H. sapiens
aagtccacagtcaaaa

SEQ ID NO: 18176 - DNA, 16 bp, H. sapiens
aagtccagcccacact

SEQ ID NO: 18177 - DNA, 16 bp, H. sapiens
aagtccaggaccaggc

SEQ ID NO: 18178 - DNA, 16 bp, H. sapiens
aagtccaggagtttga

SEQ ID NO: 18179 - DNA, 16 bp, H. sapiens
aagtccagtgtttctt

SEQ ID NO: 18180 - DNA, 16 bp, H. sapiens
aagtccattaaacctt

SEQ ID NO: 18181 - DNA, 16 bp, H. sapiens
aagtccatttgttgta

SEQ ID NO: 18182 - DNA, 16 bp, H. sapiens
aagtccattttttttt

SEQ ID NO: 18183 - DNA, 16 bp, H. sapiens
aagtcccagccagagc

SEQ ID NO: 18184 - DNA, 16 bp, H. sapiens
aagtccccaaagccca

SEQ ID NO: 18185 - DNA, 16 bp, H. sapiens
aagtccccaccccacc

SEQ ID NO: 18186 - DNA, 16 bp, H. sapiens
aagtccctaggctgca

SEQ ID NO: 18187 - DNA, 16 bp, H. sapiens
aagtccctcccacaac

SEQ ID NO: 18188 - DNA, 16 bp, H. sapiens
aagtccctgatataaa

SEQ ID NO: 18189 - DNA, 16 bp, H. sapiens
aagtcccttatataaa

SEQ ID NO: 18190 - DNA, 16 bp, H. sapiens
aagtcccttattagat

SEQ ID NO: 18191 - DNA, 16 bp, H. sapiens
aagtcctagagtccaa

SEQ ID NO: 18192 - DNA, 16 bp, H. sapiens
aagtcctagccacagc

SEQ ID NO: 18193 - DNA, 16 bp, H. sapiens
aagtcctcagagacct

SEQ ID NO: 18194 - DNA, 16 bp, H. sapiens
aagtcctccaggtgat

SEQ ID NO: 18195 - DNA, 16 bp, H. sapiens
aagtcctgacccccag

SEQ ID NO: 18196 - DNA, 16 bp, H. sapiens
aagtcctgcagtaaag

SEQ ID NO: 18197 - DNA, 16 bp, H. sapiens
aagtcctgcttttctg

SEQ ID NO: 18198 - DNA, 16 bp, H. sapiens
aagtcctggctctgcc

SEQ ID NO: 18199 - DNA, 16 bp, H. sapiens
aagtcctgggattgca

SEQ ID NO: 18200 - DNA, 16 bp, H. sapiens
aagtccttcaacaaaa

SEQ ID NO: 18201 - DNA, 16 bp, H. sapiens
aagtccttcatcagat

SEQ ID NO: 18202 - DNA, 16 bp, H. sapiens
aagtcctttcccatgc

SEQ ID NO: 18203 - DNA, 16 bp, H. sapiens
aagtcgaggctgcagt

SEQ ID NO: 18204 - DNA, 16 bp, H. sapiens
aagtcggcctctccag

SEQ ID NO: 18205 - DNA, 16 bp, H. sapiens
aagtcgtcctcaagtc

SEQ ID NO: 18206 - DNA, 16 bp, H. sapiens
aagtctaaacacaaaa

SEQ ID NO: 18207 - DNA, 16 bp, H. sapiens
aagtctaatttttaaa

SEQ ID NO: 18208 - DNA, 16 bp, H. sapiens
aagtctaggctgaggt

SEQ ID NO: 18209 - DNA, 16 bp, H. sapiens
aagtctatttcatttt

SEQ ID NO: 18210 - DNA, 16 bp, H. sapiens
aagtctcacaagacct

SEQ ID NO: 18211 - DNA, 16 bp, H. sapiens
aagtctcactctgtca

SEQ ID NO: 18212 - DNA, 16 bp, H. sapiens
aagtctcactctgttg

SEQ ID NO: 18213 - DNA, 16 bp, H. sapiens
aagtctcagaaaagaa

SEQ ID NO: 18214 - DNA, 16 bp, H. sapiens
aagtctcagatcaagg

SEQ ID NO: 18215 - DNA, 16 bp, H. sapiens
aagtctccaccccaaa

SEQ ID NO: 18216 - DNA, 16 bp, H. sapiens
aagtctccatttacca

SEQ ID NO: 18217 - DNA, 16 bp, H. sapiens
aagtctcccactatta

SEQ ID NO: 18218 - DNA, 16 bp, H. sapiens
aagtctcgctcttgtc

SEQ ID NO: 18219 - DNA, 16 bp, H. sapiens
aagtctcgctgtgtca

SEQ ID NO: 18220 - DNA, 16 bp, H. sapiens
aagtctctgctcagtt

SEQ ID NO: 18221 - DNA, 16 bp, H. sapiens
aagtctcttttcttta

SEQ ID NO: 18222 - DNA, 16 bp, H. sapiens
aagtctgaaatgctcc

SEQ ID NO: 18223 - DNA, 16 bp, H. sapiens
aagtctgaataaccat

SEQ ID NO: 18224 - DNA, 16 bp, H. sapiens
aagtctgagattgagg

SEQ ID NO: 18225 - DNA, 16 bp, H. sapiens
aagtctgcagagatta

SEQ ID NO: 18226 - DNA, 16 bp, H. sapiens
aagtctgctgcaggag

SEQ ID NO: 18227 - DNA, 16 bp, H. sapiens
aagtctggagttcaag

SEQ ID NO: 18228 - DNA, 16 bp, H. sapiens
aagtctgtatatgttc

SEQ ID NO: 18229 - DNA, 16 bp, H. sapiens
aagtcttacatttaaa

SEQ ID NO: 18230 - DNA, 16 bp, H. sapiens
aagtcttcaaaataat

SEQ ID NO: 18231 - DNA, 16 bp, H. sapiens
aagtcttcaactatta

SEQ ID NO: 18232 - DNA, 16 bp, H. sapiens
aagtcttcctggagga

SEQ ID NO: 18233 - DNA, 16 bp, H. sapiens
aagtcttgaagtcaga

SEQ ID NO: 18234 - DNA, 16 bp, H. sapiens
aagtcttgaagttggg

SEQ ID NO: 18235 - DNA, 16 bp, H. sapiens
aagtcttgctctgtca

SEQ ID NO: 18236 - DNA, 16 bp, H. sapiens
aagtcttggccaggca

SEQ ID NO: 18237 - DNA, 16 bp, H. sapiens
aagtctttaaaattta

SEQ ID NO: 18238 - DNA, 16 bp, H. sapiens
aagtctttctctctct

SEQ ID NO: 18239 - DNA, 16 bp, H. sapiens
aagtctttcttcaaag

SEQ ID NO: 18240 - DNA, 16 bp, H. sapiens
aagtctttgctcaaat

SEQ ID NO: 18241 - DNA, 16 bp, H. sapiens
aagtctttgctcagat

SEQ ID NO: 18242 - DNA, 16 bp, H. sapiens
aagtctttttcttcct

SEQ ID NO: 18243 - DNA, 16 bp, H. sapiens
aagtgaaaaacagaag

SEQ ID NO: 18244 - DNA, 16 bp, H. sapiens
aagtgaaaaatcaaga

SEQ ID NO: 18245 - DNA, 16 bp, H. sapiens
aagtgaaaacaaatct

SEQ ID NO: 18246 - DNA, 16 bp, H. sapiens
aagtgaaaacatgtgg

SEQ ID NO: 18247 - DNA, 16 bp, H. sapiens
aagtgaaaagaaaact

SEQ ID NO: 18248 - DNA, 16 bp, H. sapiens
aagtgaaaatagccag

SEQ ID NO: 18249 - DNA, 16 bp, H. sapiens
aagtgaaaatattttc

SEQ ID NO: 18250 - DNA, 16 bp, H. sapiens
aagtgaaacacagttt

SEQ ID NO: 18251 - DNA, 16 bp, H. sapiens
aagtgaaactatctct

SEQ ID NO: 18252 - DNA, 16 bp, H. sapiens
aagtgaaactcaaaga

SEQ ID NO: 18253 - DNA, 16 bp, H. sapiens
aagtgaaagaagccgg

SEQ ID NO: 18254 - DNA, 16 bp, H. sapiens
aagtgaaagaagctaa

SEQ ID NO: 18255 - DNA, 16 bp, H. sapiens
aagtgaaagaaggcaa

SEQ ID NO: 18256 - DNA, 16 bp, H. sapiens
aagtgaaagaagtcaa

SEQ ID NO: 18257 - DNA, 16 bp, H. sapiens
aagtgaaagaattcag

SEQ ID NO: 18258 - DNA, 17 bp, H. sapiens
aagtgaaagatttctat

SEQ ID NO: 18259 - DNA, 16 bp, H. sapiens
aagtgaaagcaagtgt

SEQ ID NO: 18260 - DNA, 16 bp, H. sapiens
aagtgaaagcaagttt

SEQ ID NO: 18261 - DNA, 16 bp, H. sapiens
aagtgaaaggaggagt

SEQ ID NO: 18262 - DNA, 16 bp, H. sapiens
aagtgaaaggatcact

SEQ ID NO: 18263 - DNA, 16 bp, H. sapiens
aagtgaaataattttt

SEQ ID NO: 18264 - DNA, 16 bp, H. sapiens
aagtgaaattgctgga

SEQ ID NO: 18265 - DNA, 16 bp, H. sapiens
aagtgaaatttaaatg

SEQ ID NO: 18266 - DNA, 16 bp, H. sapiens
aagtgaaatttagaag

SEQ ID NO: 18267 - DNA, 16 bp, H. sapiens
aagtgaaattttattt

SEQ ID NO: 18268 - DNA, 25 bp, H. sapiens
aagtgaactcccattcacaattgct

SEQ ID NO: 18269 - DNA, 16 bp, H. sapiens
aagtgaagaaactcag

SEQ ID NO: 18270 - DNA, 16 bp, H. sapiens
aagtgaagaaatattt

SEQ ID NO: 18271 - DNA, 16 bp, H. sapiens
aagtgaagagaggctg

SEQ ID NO: 18272 - DNA, 16 bp, H. sapiens
aagtgaaggagaaaca

SEQ ID NO: 18273 - DNA, 16 bp, H. sapiens
aagtgaaggggaaata

SEQ ID NO: 18274 - DNA, 16 bp, H. sapiens
aagtgaaggttgcagt

SEQ ID NO: 18275 - DNA, 16 bp, H. sapiens
aagtgaagtgacttgc

SEQ ID NO: 18276 - DNA, 16 bp, H. sapiens
aagtgaatgaagccag

SEQ ID NO: 18277 - DNA, 16 bp, H. sapiens
aagtgaattattttaa

SEQ ID NO: 18278 - DNA, 16 bp, H. sapiens
aagtgacagagctggg

SEQ ID NO: 18279 - DNA, 16 bp, H. sapiens
aagtgacagaggcagg

SEQ ID NO: 18280 - DNA, 16 bp, H. sapiens
aagtgacagagggaga

SEQ ID NO: 18281 - DNA, 16 bp, H. sapiens
aagtgactcttctgcc

SEQ ID NO: 18282 - DNA, 16 bp, H. sapiens
aagtgactgttcatgt

SEQ ID NO: 18283 - DNA, 16 bp, H. sapiens
aagtgacttgaccaag

SEQ ID NO: 18284 - DNA, 16 bp, H. sapiens
aagtgacttgcccaag

SEQ ID NO: 18285 - DNA, 16 bp, H. sapiens
aagtgacttgcctgag

SEQ ID NO: 18286 - DNA, 16 bp, H. sapiens
aagtgacttgtccagg

SEQ ID NO: 18287 - DNA, 16 bp, H. sapiens
aagtgactttggaagt

SEQ ID NO: 18288 - DNA, 16 bp, H. sapiens
aagtgacttttatttt

SEQ ID NO: 18289 - DNA, 16 bp, H. sapiens
aagtgacttttccaaa

SEQ ID NO: 18290 - DNA, 16 bp, H. sapiens
aagtgagaaacagaaa

SEQ ID NO: 18291 - DNA, 16 bp, H. sapiens
aagtgagactccgtct

SEQ ID NO: 18292 - DNA, 16 bp, H. sapiens
aagtgagagacatgtg

SEQ ID NO: 18293 - DNA, 16 bp, H. sapiens
aagtgagagctaaaca

SEQ ID NO: 18294 - DNA, 16 bp, H. sapiens
aagtgagaggtgacag

SEQ ID NO: 18295 - DNA, 16 bp, H. sapiens
aagtgagatcattcag

SEQ ID NO: 18296 - DNA, 17 bp, H. sapiens
aagtgagccaagatcgc

SEQ ID NO: 18297 - DNA, 16 bp, H. sapiens
aagtgagccgagatcg

SEQ ID NO: 18298 - DNA, 16 bp, H. sapiens
aagtgagctcttgctc

SEQ ID NO: 18299 - DNA, 16 bp, H. sapiens
aagtgaggagtttgag

SEQ ID NO: 18300 - DNA, 16 bp, H. sapiens
aagtgaggtttttttt

SEQ ID NO: 18301 - DNA, 16 bp, H. sapiens
aagtgatacatgactg

SEQ ID NO: 18302 - DNA, 16 bp, H. sapiens
aagtgatcaaaattaa

SEQ ID NO: 18303 - DNA, 16 bp, H. sapiens
aagtgatcatcccatc

SEQ ID NO: 18304 - DNA, 16 bp, H. sapiens
aagtgatcctcagcct

SEQ ID NO: 18305 - DNA, 16 bp, H. sapiens
aagtgatcctccatct

SEQ ID NO: 18306 - DNA, 16 bp, H. sapiens
aagtgatcctcccact

SEQ ID NO: 18307 - DNA, 16 bp, H. sapiens
aagtgatccttctccc

SEQ ID NO: 18308 - DNA, 17 bp, H. sapiens
aagtgatgctcccgcct

SEQ ID NO: 18309 - DNA, 16 bp, H. sapiens
aagtgatgctgaattt

SEQ ID NO: 18310 - DNA, 16 bp, H. sapiens
aagtgatgctggattt

SEQ ID NO: 18311 - DNA, 16 bp, H. sapiens
aagtgatgctgggaaa

SEQ ID NO: 18312 - DNA, 16 bp, H. sapiens
aagtgattatttaaaa

SEQ ID NO: 18313 - DNA, 16 bp, H. sapiens
aagtgattctcatgcc

SEQ ID NO: 18314 - DNA, 16 bp, H. sapiens
aagtgattcttctccc

SEQ ID NO: 18315 - DNA, 16 bp, H. sapiens
aagtgattcttttgcc

SEQ ID NO: 18316 - DNA, 16 bp, H. sapiens
aagtgattgaaatcat

SEQ ID NO: 18317 - DNA, 16 bp, H. sapiens
aagtgatttctggcta

SEQ ID NO: 18318 - DNA, 16 bp, H. sapiens
aagtgatttcttctta

SEQ ID NO: 18319 - DNA, 16 bp, H. sapiens
aagtgatttgctcaag

SEQ ID NO: 18320 - DNA, 16 bp, H. sapiens
aagtgatttttctaaa

SEQ ID NO: 18321 - DNA, 16 bp, H. sapiens
aagtgattttttccca

SEQ ID NO: 18322 - DNA, 16 bp, H. sapiens
aagtgattttttttct

SEQ ID NO: 18323 - DNA, 16 bp, H. sapiens
aagtgatttttttttc

SEQ ID NO: 18324 - DNA, 16 bp, H. sapiens
aagtgcaaaggccttg

SEQ ID NO: 18325 - DNA, 16 bp, H. sapiens
aagtgcaaatcaaaac

SEQ ID NO: 18326 - DNA, 16 bp, H. sapiens
aagtgcaagaaggctg

SEQ ID NO: 18327 - DNA, 16 bp, H. sapiens
aagtgcaattgctggg

SEQ ID NO: 18328 - DNA, 16 bp, H. sapiens
aagtgcacaattcagt

SEQ ID NO: 18329 - DNA, 16 bp, H. sapiens
aagtgcactaatccca

SEQ ID NO: 18330 - DNA, 16 bp, H. sapiens
aagtgcagagaagaaa

SEQ ID NO: 18331 - DNA, 16 bp, H. sapiens
aagtgcagaggaaatg

SEQ ID NO: 18332 - DNA, 16 bp, H. sapiens
aagtgcagagtgaaga

SEQ ID NO: 18333 - DNA, 16 bp, H. sapiens
aagtgcagattctgat

SEQ ID NO: 18334 - DNA, 16 bp, H. sapiens
aagtgcagggctgtgc

SEQ ID NO: 18335 - DNA, 19 bp, H. sapiens
aagtgcagtggcatgatca

SEQ ID NO: 18336 - DNA, 16 bp, H. sapiens
aagtgcagttgtgtta

SEQ ID NO: 18337 - DNA, 16 bp, H. sapiens
aagtgcagttttatta

SEQ ID NO: 18338 - DNA, 16 bp, H. sapiens
aagtgccacctcctgg

SEQ ID NO: 18339 - DNA, 16 bp, H. sapiens
aagtgccagcagggga

SEQ ID NO: 18340 - DNA, 16 bp, H. sapiens
aagtgccatgaagaaa

SEQ ID NO: 18341 - DNA, 16 bp, H. sapiens
aagtgcctgctcctgc

SEQ ID NO: 18342 - DNA, 16 bp, H. sapiens
aagtgcctggcacata

SEQ ID NO: 18343 - DNA, 16 bp, H. sapiens
aagtgcctgtaatccc

SEQ ID NO: 18344 - DNA, 16 bp, H. sapiens
aagtgccttgcttccc

SEQ ID NO: 18345 - DNA, 16 bp, H. sapiens
aagtgctaaataaata

SEQ ID NO: 18346 - DNA, 16 bp, H. sapiens
aagtgctagaagaaaa

SEQ ID NO: 18347 - DNA, 16 bp, H. sapiens
aagtgctcaataaatg

SEQ ID NO: 18348 - DNA, 16 bp, H. sapiens
aagtgctcagtagtca

SEQ ID NO: 18349 - DNA, 16 bp, H. sapiens
aagtgctcatcaacag

SEQ ID NO: 18350 - DNA, 16 bp, H. sapiens
aagtgctccaaatatt

SEQ ID NO: 18351 - DNA, 16 bp, H. sapiens
aagtgctctgaagaaa

SEQ ID NO: 18352 - DNA, 16 bp, H. sapiens
aagtgctctgcctgcc

SEQ ID NO: 18353 - DNA, 16 bp, H. sapiens
aagtgctgaaggaaaa

SEQ ID NO: 18354 - DNA, 16 bp, H. sapiens
aagtgctgagcaaagt

SEQ ID NO: 18355 - DNA, 16 bp, H. sapiens
aagtgctgcacacttt

SEQ ID NO: 18356 - DNA, 19 bp, H. sapiens
aagtgctggaattacaggt

SEQ ID NO: 18357 - DNA, 16 bp, H. sapiens
aagtgctggatttaca

SEQ ID NO: 18358 - DNA, 16 bp, H. sapiens
aagtgctgggagccac

SEQ ID NO: 18359 - DNA, 16 bp, H. sapiens
aagtgctgggatcagg

SEQ ID NO: 18360 - DNA, 18 bp, H. sapiens
aagtgctgggattacaaa

SEQ ID NO: 18361 - DNA, 16 bp, H. sapiens
aagtgctgggattgag

SEQ ID NO: 18362 - DNA, 16 bp, H. sapiens
aagtgctgggcttgca

SEQ ID NO: 18363 - DNA, 16 bp, H. sapiens
aagtgctgggtttata

SEQ ID NO: 18364 - DNA, 16 bp, H. sapiens
aagtgctgtaattaca

SEQ ID NO: 18365 - DNA, 16 bp, H. sapiens
aagtgctgtgattata

SEQ ID NO: 18366 - DNA, 16 bp, H. sapiens
aagtgcttagcatagt

SEQ ID NO: 18367 - DNA, 16 bp, H. sapiens
aagtgcttggattaca

SEQ ID NO: 18368 - DNA, 16 bp, H. sapiens
aagtgctttatgcata

SEQ ID NO: 18369 - DNA, 16 bp, H. sapiens
aagtgctttttaaaaa

SEQ ID NO: 18370 - DNA, 16 bp, H. sapiens
aagtggaaaaacattt

SEQ ID NO: 18371 - DNA, 16 bp, H. sapiens
aagtggaacctaatta

SEQ ID NO: 18372 - DNA, 16 bp, H. sapiens
aagtggaactgctgga

SEQ ID NO: 18373 - DNA, 16 bp, H. sapiens
aagtggaagaaaaggt

SEQ ID NO: 18374 - DNA, 16 bp, H. sapiens
aagtggaagaagacag

SEQ ID NO: 18375 - DNA, 16 bp, H. sapiens
aagtggaagacagtga

SEQ ID NO: 18376 - DNA, 16 bp, H. sapiens
aagtggaagcagcctg

SEQ ID NO: 18377 - DNA, 16 bp, H. sapiens
aagtggaaggagaaat

SEQ ID NO: 18378 - DNA, 16 bp, H. sapiens
aagtggaagttgcagt

SEQ ID NO: 18379 - DNA, 16 bp, H. sapiens
aagtggaatcatacat

SEQ ID NO: 18380 - DNA, 16 bp, H. sapiens
aagtggaatttctggg

SEQ ID NO: 18381 - DNA, 16 bp, H. sapiens
aagtggaattttaaaa

SEQ ID NO: 18382 - DNA, 16 bp, H. sapiens
aagtggacattttaaa

SEQ ID NO: 18383 - DNA, 16 bp, H. sapiens
aagtggagaatttaat

SEQ ID NO: 18384 - DNA, 16 bp, H. sapiens
aagtggatcatagacc

SEQ ID NO: 18385 - DNA, 16 bp, H. sapiens
aagtggatttttaaag

SEQ ID NO: 18386 - DNA, 19 bp, H. sapiens
aagtggcaccactcaccat

SEQ ID NO: 18387 - DNA, 16 bp, H. sapiens
aagtggcagagccaga

SEQ ID NO: 18388 - DNA, 16 bp, H. sapiens
aagtggcagagctaga

SEQ ID NO: 18389 - DNA, 16 bp, H. sapiens
aagtggcagagtcaga

SEQ ID NO: 18390 - DNA, 16 bp, H. sapiens
aagtggcagagtcagg

SEQ ID NO: 18391 - DNA, 16 bp, H. sapiens
aagtggcagatccagg

SEQ ID NO: 18392 - DNA, 16 bp, H. sapiens
aagtggcagctaaaca

SEQ ID NO: 18393 - DNA, 16 bp, H. sapiens
aagtggcagggctggg

SEQ ID NO: 18394 - DNA, 16 bp, H. sapiens
aagtggccaagaagca

SEQ ID NO: 18395 - DNA, 16 bp, H. sapiens
aagtggccaggcatgg

SEQ ID NO: 18396 - DNA, 16 bp, H. sapiens
aagtggctgcatcatt

SEQ ID NO: 18397 - DNA, 17 bp, H. sapiens
aagtggctgggaccaca

SEQ ID NO: 18398 - DNA, 16 bp, H. sapiens
aagtggctttggaatt

SEQ ID NO: 18399 - DNA, 16 bp, H. sapiens
aagtgggagaaggata

SEQ ID NO: 18400 - DNA, 16 bp, H. sapiens
aagtgggagctaaatg

SEQ ID NO: 18401 - DNA, 16 bp, H. sapiens
aagtgggagctgaaca

SEQ ID NO: 18402 - DNA, 16 bp, H. sapiens
aagtgggaggatcgcc

SEQ ID NO: 18403 - DNA, 16 bp, H. sapiens
aagtgggatttatttc

SEQ ID NO: 18404 - DNA, 16 bp, H. sapiens
aagtgggatttgaaca

SEQ ID NO: 18405 - DNA, 16 bp, H. sapiens
aagtgggctaaagaca

SEQ ID NO: 18406 - DNA, 39 bp, H. sapiens
aagtgggctcaggaggtctggatctgtgatgagatgggg

SEQ ID NO: 18407 - DNA, 16 bp, H. sapiens
aagtggggaaaagaca

SEQ ID NO: 18408 - DNA, 16 bp, H. sapiens
aagtggggagggggct

SEQ ID NO: 18409 - DNA, 16 bp, H. sapiens
aagtggggatttatag

SEQ ID NO: 18410 - DNA, 16 bp, H. sapiens
aagtggggcctggtgg

SEQ ID NO: 18411 - DNA, 16 bp, H. sapiens
aagtgggtggagccca

SEQ ID NO: 18412 - DNA, 16 bp, H. sapiens
aagtgggtggatcaca

SEQ ID NO: 18413 - DNA, 16 bp, H. sapiens
aagtgggtggattact

SEQ ID NO: 18414 - DNA, 16 bp, H. sapiens
aagtggtaaaagtggg

SEQ ID NO: 18415 - DNA, 16 bp, H. sapiens
aagtggtactgggaaa

SEQ ID NO: 18416 - DNA, 16 bp, H. sapiens
aagtggtagttgaaca

SEQ ID NO: 18417 - DNA, 16 bp, H. sapiens
aagtggtcaaaggaca

SEQ ID NO: 18418 - DNA, 16 bp, H. sapiens
aagtggtcctcctgct

SEQ ID NO: 18419 - DNA, 16 bp, H. sapiens
aagtggtgctggaaaa

SEQ ID NO: 18420 - DNA, 16 bp, H. sapiens
aagtggtggagctgag

SEQ ID NO: 18421 - DNA, 17 bp, H. sapiens
aagtggtgggattacag

SEQ ID NO: 18422 - DNA, 18 bp, H. sapiens
aagtggtgggattacaga

SEQ ID NO: 18423 - DNA, 16 bp, H. sapiens
aagtggttctcccagc

SEQ ID NO: 18424 - DNA, 16 bp, H. sapiens
aagtggttgtgccatt

SEQ ID NO: 18425 - DNA, 16 bp, H. sapiens
aagtgtaattttgtta

SEQ ID NO: 18426 - DNA, 16 bp, H. sapiens
aagtgtacaattcagt

SEQ ID NO: 18427 - DNA, 16 bp, H. sapiens
aagtgtacaggaggat

SEQ ID NO: 18428 - DNA, 16 bp, H. sapiens
aagtgtacatttcagt

SEQ ID NO: 18429 - DNA, 16 bp, H. sapiens
aagtgtataaaaccaa

SEQ ID NO: 18430 - DNA, 16 bp, H. sapiens
aagtgtatagttcagt

SEQ ID NO: 18431 - DNA, 16 bp, H. sapiens
aagtgtatatatatat

SEQ ID NO: 18432 - DNA, 16 bp, H. sapiens
aagtgtatgattcagt

SEQ ID NO: 18433 - DNA, 16 bp, H. sapiens
aagtgtattttaaaat

SEQ ID NO: 18434 - DNA, 16 bp, H. sapiens
aagtgtcatttttatt

SEQ ID NO: 18435 - DNA, 16 bp, H. sapiens
aagtgtccaggaattt

SEQ ID NO: 18436 - DNA, 16 bp, H. sapiens
aagtgtctattccagt

SEQ ID NO: 18437 - DNA, 16 bp, H. sapiens
aagtgtctgcttatgt

SEQ ID NO: 18438 - DNA, 16 bp, H. sapiens
aagtgtctgtcattta

SEQ ID NO: 18439 - DNA, 16 bp, H. sapiens
aagtgtctgtccatgt

SEQ ID NO: 18440 - DNA, 16 bp, H. sapiens
aagtgtctgtgcatgt

SEQ ID NO: 18441 - DNA, 16 bp, H. sapiens
aagtgtcttttagcat

SEQ ID NO: 18442 - DNA, 16 bp, H. sapiens
aagtgtgaagaatgtg

SEQ ID NO: 18443 - DNA, 16 bp, H. sapiens
aagtgtgagccactga

SEQ ID NO: 18444 - DNA, 16 bp, H. sapiens
aagtgtgatgtctcca

SEQ ID NO: 18445 - DNA, 16 bp, H. sapiens
aagtgtgcaatagcat

SEQ ID NO: 18446 - DNA, 16 bp, H. sapiens
aagtgtgcattcatct

SEQ ID NO: 18447 - DNA, 16 bp, H. sapiens
aagtgtggcacctccc

SEQ ID NO: 18448 - DNA, 16 bp, H. sapiens
aagtgtggcacttcct

SEQ ID NO: 18449 - DNA, 16 bp, H. sapiens
aagtgtgggattatag

SEQ ID NO: 18450 - DNA, 16 bp, H. sapiens
aagtgtggtccccaga

SEQ ID NO: 18451 - DNA, 17 bp, H. sapiens
aagtgtgtataaaagtc

SEQ ID NO: 18452 - DNA, 16 bp, H. sapiens
aagtgtgtgccactgt

SEQ ID NO: 18453 - DNA, 16 bp, H. sapiens
aagtgtgtggaacctc

SEQ ID NO: 18454 - DNA, 16 bp, H. sapiens
aagtgtgtgtgtgttt

SEQ ID NO: 18455 - DNA, 16 bp, H. sapiens
aagtgtgttgtttaat

SEQ ID NO: 18456 - DNA, 16 bp, H. sapiens
aagtgtgtttttcttt

SEQ ID NO: 18457 - DNA, 16 bp, H. sapiens
aagtgttacagttctt

SEQ ID NO: 18458 - DNA, 21 bp, H. sapiens
aagtgttaggattacaggcgt

SEQ ID NO: 18459 - DNA, 16 bp, H. sapiens
aagtgttatctcattg

SEQ ID NO: 18460 - DNA, 16 bp, H. sapiens
aagtgttcaacaaata

SEQ ID NO: 18461 - DNA, 16 bp, H. sapiens
aagtgttcaatagcca

SEQ ID NO: 18462 - DNA, 16 bp, H. sapiens
aagtgttcatttaaaa

SEQ ID NO: 18463 - DNA, 16 bp, H. sapiens
aagtgttcatttggag

SEQ ID NO: 18464 - DNA, 16 bp, H. sapiens
aagtgttccataaatg

SEQ ID NO: 18465 - DNA, 16 bp, H. sapiens
aagtgttcccttttca

SEQ ID NO: 18466 - DNA, 16 bp, H. sapiens
aagtgttccctttttc

SEQ ID NO: 18467 - DNA, 16 bp, H. sapiens
aagtgttgacaaggat

SEQ ID NO: 18468 - DNA, 16 bp, H. sapiens
aagtgtttacatcaga

SEQ ID NO: 18469 - DNA, 16 bp, H. sapiens
aagtgtttatttaaat

SEQ ID NO: 18470 - DNA, 16 bp, H. sapiens
aagtgtttattttaaa

SEQ ID NO: 18471 - DNA, 16 bp, H. sapiens
aagtgtttattttctt

SEQ ID NO: 18472 - DNA, 16 bp, H. sapiens
aagtgtttcaaatttt

SEQ ID NO: 18473 - DNA, 16 bp, H. sapiens
aagtgtttccttttct

SEQ ID NO: 18474 - DNA, 16 bp, H. sapiens
aagtgtttgaagattt

SEQ ID NO: 18475 - DNA, 16 bp, H. sapiens
aagtgtttggaagttc

SEQ ID NO: 18476 - DNA, 16 bp, H. sapiens
aagtgtttgtttatgt

SEQ ID NO: 18477 - DNA, 16 bp, H. sapiens
aagtgtttttaaaaag

SEQ ID NO: 18478 - DNA, 16 bp, H. sapiens
aagttaaaaagcaagg

SEQ ID NO: 18479 - DNA, 16 bp, H. sapiens
aagttaaaaagctttt

SEQ ID NO: 18480 - DNA, 16 bp, H. sapiens
aagttaaaaatcttga

SEQ ID NO: 18481 - DNA, 16 bp, H. sapiens
aagttaaaaccacaat

SEQ ID NO: 18482 - DNA, 16 bp, H. sapiens
aagttaaaagtcaaaa

SEQ ID NO: 18483 - DNA, 16 bp, H. sapiens
aagttaaacatacagt

SEQ ID NO: 18484 - DNA, 16 bp, H. sapiens
aagttaaataagccag

SEQ ID NO: 18485 - DNA, 16 bp, H. sapiens
aagttaaatatttttg

SEQ ID NO: 18486 - DNA, 16 bp, H. sapiens
aagttaactcaagatg

SEQ ID NO: 18487 - DNA, 16 bp, H. sapiens
aagttaatatttcaaa

SEQ ID NO: 18488 - DNA, 16 bp, H. sapiens
aagttaattttccaaa

SEQ ID NO: 18489 - DNA, 16 bp, H. sapiens
aagttacagtgagcca

SEQ ID NO: 18490 - DNA, 16 bp, H. sapiens
aagttacatttttaaa

SEQ ID NO: 18491 - DNA, 16 bp, H. sapiens
aagttacatttttatt

SEQ ID NO: 18492 - DNA, 16 bp, H. sapiens
aagttactaaacttct

SEQ ID NO: 18493 - DNA, 16 bp, H. sapiens
aagttactcaacctct

SEQ ID NO: 18494 - DNA, 16 bp, H. sapiens
aagttacttaaactct

SEQ ID NO: 18495 - DNA, 16 bp, H. sapiens
aagttacttcacctct

SEQ ID NO: 18496 - DNA, 16 bp, H. sapiens
aagttactttgcctct

SEQ ID NO: 18497 - DNA, 16 bp, H. sapiens
aagttactttttttcc

SEQ ID NO: 18498 - DNA, 16 bp, H. sapiens
aagttagaagctagca

SEQ ID NO: 18499 - DNA, 16 bp, H. sapiens
aagttagccaaagctt

SEQ ID NO: 18500 - DNA, 16 bp, H. sapiens
aagttagccaggcatg

SEQ ID NO: 18501 - DNA, 16 bp, H. sapiens
aagttaggttgcagtt

SEQ ID NO: 18502 - DNA, 16 bp, H. sapiens
aagttaggttttcagt

SEQ ID NO: 18503 - DNA, 16 bp, H. sapiens
aagttagtagaagaaa

SEQ ID NO: 18504 - DNA, 16 bp, H. sapiens
aagttatagattcaat

SEQ ID NO: 18505 - DNA, 16 bp, H. sapiens
aagttatatttttcta

SEQ ID NO: 18506 - DNA, 16 bp, H. sapiens
aagttatcaaaatatt

SEQ ID NO: 18507 - DNA, 16 bp, H. sapiens
aagttatctaattttt

SEQ ID NO: 18508 - DNA, 16 bp, H. sapiens
aagttatctttaaaaa

SEQ ID NO: 18509 - DNA, 16 bp, H. sapiens
aagttatgaaatattt

SEQ ID NO: 18510 - DNA, 16 bp, H. sapiens
aagttatgtgcttcca

SEQ ID NO: 18511 - DNA, 16 bp, H. sapiens
aagttatgttaaatta

SEQ ID NO: 18512 - DNA, 16 bp, H. sapiens
aagttatgtttacact

SEQ ID NO: 18513 - DNA, 16 bp, H. sapiens
aagttattgcagtttt

SEQ ID NO: 18514 - DNA, 16 bp, H. sapiens
aagttattgctatcag

SEQ ID NO: 18515 - DNA, 16 bp, H. sapiens
aagttattgtttaatg

SEQ ID NO: 18516 - DNA, 16 bp, H. sapiens
aagttatttaacattt

SEQ ID NO: 18517 - DNA, 16 bp, H. sapiens
aagttatttaacctct

SEQ ID NO: 18518 - DNA, 16 bp, H. sapiens
aagttatttgaaaaat

SEQ ID NO: 18519 - DNA, 16 bp, H. sapiens
aagttattttaaaatg

SEQ ID NO: 18520 - DNA, 16 bp, H. sapiens
aagttattttgtggat

SEQ ID NO: 18521 - DNA, 16 bp, H. sapiens
aagttatttttcaaaa

SEQ ID NO: 18522 - DNA, 16 bp, H. sapiens
aagttcaaaaccagcc

SEQ ID NO: 18523 - DNA, 16 bp, H. sapiens
aagttcaaagagaaaa

SEQ ID NO: 18524 - DNA, 16 bp, H. sapiens
aagttcaaagctgcag

SEQ ID NO: 18525 - DNA, 16 bp, H. sapiens
aagttcaagaccaccc

SEQ ID NO: 18526 - DNA, 16 bp, H. sapiens
aagttcaagaccagca

SEQ ID NO: 18527 - DNA, 16 bp, H. sapiens
aagttcaagagatcta

SEQ ID NO: 18528 - DNA, 16 bp, H. sapiens
aagttcaagatcaaga

SEQ ID NO: 18529 - DNA, 16 bp, H. sapiens
aagttcaagatcaggg

SEQ ID NO: 18530 - DNA, 17 bp, H. sapiens
aagttcaaggccagcct

SEQ ID NO: 18531 - DNA, 16 bp, H. sapiens
aagttcagaaaaatta

SEQ ID NO: 18532 - DNA, 16 bp, H. sapiens
aagttcagagaggtga

SEQ ID NO: 18533 - DNA, 16 bp, H. sapiens
aagttcattaatcttt

SEQ ID NO: 18534 - DNA, 16 bp, H. sapiens
aagttcattttatttt

SEQ ID NO: 18535 - DNA, 16 bp, H. sapiens
aagttccaaaataatc

SEQ ID NO: 18536 - DNA, 18 bp, H. sapiens
aagttccacaaatctcta

SEQ ID NO: 18537 - DNA, 16 bp, H. sapiens
aagttccagaaataaa

SEQ ID NO: 18538 - DNA, 16 bp, H. sapiens
aagttccagagcagga

SEQ ID NO: 18539 - DNA, 16 bp, H. sapiens
aagttccatgaagaca

SEQ ID NO: 18540 - DNA, 16 bp, H. sapiens
aagttcccaggtgatg

SEQ ID NO: 18541 - DNA, 16 bp, H. sapiens
aagttccttttgttat

SEQ ID NO: 18542 - DNA, 16 bp, H. sapiens
aagttcgaggctgcag

SEQ ID NO: 18543 - DNA, 20 bp, H. sapiens
aagttctacaatgaacccat

SEQ ID NO: 18544 - DNA, 16 bp, H. sapiens
aagttctagagatcta

SEQ ID NO: 18545 - DNA, 16 bp, H. sapiens
aagttctatttcttga

SEQ ID NO: 18546 - DNA, 16 bp, H. sapiens
aagttctattttaaaa

SEQ ID NO: 18547 - DNA, 16 bp, H. sapiens
aagttctcaataaatg

SEQ ID NO: 18548 - DNA, 16 bp, H. sapiens
aagttctcacttataa

SEQ ID NO: 18549 - DNA, 16 bp, H. sapiens
aagttctccaactttg

SEQ ID NO: 18550 - DNA, 16 bp, H. sapiens
aagttctctgtagatt

SEQ ID NO: 18551 - DNA, 16 bp, H. sapiens
aagttctgagattctt

SEQ ID NO: 18552 - DNA, 16 bp, H. sapiens
aagttctgcttccctt

SEQ ID NO: 18553 - DNA, 16 bp, H. sapiens
aagttctggagatgaa

SEQ ID NO: 18554 - DNA, 16 bp, H. sapiens
aagttctggaggctgg

SEQ ID NO: 18555 - DNA, 16 bp, H. sapiens
aagttctggccaggaa

SEQ ID NO: 18556 - DNA, 19 bp, H. sapiens
aagttctggccagggcaac

SEQ ID NO: 18557 - DNA, 16 bp, H. sapiens
aagttctggggtacat

SEQ ID NO: 18558 - DNA, 16 bp, H. sapiens
aagttcttaaaacatt

SEQ ID NO: 18559 - DNA, 16 bp, H. sapiens
aagttcttcagttttt

SEQ ID NO: 18560 - DNA, 16 bp, H. sapiens
aagttctttacatatt

SEQ ID NO: 18561 - DNA, 16 bp, H. sapiens
aagttctttgaaacca

SEQ ID NO: 18562 - DNA, 16 bp, H. sapiens
aagttctttgagaagt

SEQ ID NO: 18563 - DNA, 16 bp, H. sapiens
aagttctttgcagatt

SEQ ID NO: 18564 - DNA, 16 bp, H. sapiens
aagttctttgtgaaat

SEQ ID NO: 18565 - DNA, 16 bp, H. sapiens
aagttcttttaaaaat

SEQ ID NO: 18566 - DNA, 16 bp, H. sapiens
aagttcttttgaagtc

SEQ ID NO: 18567 - DNA, 16 bp, H. sapiens
aagttgaaaataccat

SEQ ID NO: 18568 - DNA, 16 bp, H. sapiens
aagttgaaaatactgt

SEQ ID NO: 18569 - DNA, 16 bp, H. sapiens
aagttgaaaatattgt

SEQ ID NO: 18570 - DNA, 16 bp, H. sapiens
aagttgaaaatgcatt

SEQ ID NO: 18571 - DNA, 16 bp, H. sapiens
aagttgaagccaatgt

SEQ ID NO: 18572 - DNA, 17 bp, H. sapiens
aagttgaatgagctgat

SEQ ID NO: 18573 - DNA, 16 bp, H. sapiens
aagttgaattgcttga

SEQ ID NO: 18574 - DNA, 16 bp, H. sapiens
aagttgaatttttaaa

SEQ ID NO: 18575 - DNA, 16 bp, H. sapiens
aagttgatttttgtgt

SEQ ID NO: 18576 - DNA, 16 bp, H. sapiens
aagttgcagaatataa

SEQ ID NO: 18577 - DNA, 16 bp, H. sapiens
aagttgcagcgagcca

SEQ ID NO: 18578 - DNA, 16 bp, H. sapiens
aagttgcaggatacaa

SEQ ID NO: 18579 - DNA, 16 bp, H. sapiens
aagttgcaggatgcaa

SEQ ID NO: 18580 - DNA, 16 bp, H. sapiens
aagttgcatttagaaa

SEQ ID NO: 18581 - DNA, 16 bp, H. sapiens
aagttgctctgggtga

SEQ ID NO: 18582 - DNA, 16 bp, H. sapiens
aagttgcttcacctct

SEQ ID NO: 18583 - DNA, 17 bp, H. sapiens
aagttggagaccaacct

SEQ ID NO: 18584 - DNA, 16 bp, H. sapiens
aagttggagttgaaca

SEQ ID NO: 18585 - DNA, 16 bp, H. sapiens
aagttggattcctggg

SEQ ID NO: 18586 - DNA, 16 bp, H. sapiens
aagttggctgggcatg

SEQ ID NO: 18587 - DNA, 16 bp, H. sapiens
aagttggctgggtgcg

SEQ ID NO: 18588 - DNA, 16 bp, H. sapiens
aagttgggaggctgag

SEQ ID NO: 18589 - DNA, 16 bp, H. sapiens
aagttgtatatattta

SEQ ID NO: 18590 - DNA, 16 bp, H. sapiens
aagttgtccttaaaaa

SEQ ID NO: 18591 - DNA, 16 bp, H. sapiens
aagttgtcttttcact

SEQ ID NO: 18592 - DNA, 16 bp, H. sapiens
aagttgtgagttgttt

SEQ ID NO: 18593 - DNA, 16 bp, H. sapiens
aagttgtgtttccatt

SEQ ID NO: 18594 - DNA, 16 bp, H. sapiens
aagttgtttacttttt

SEQ ID NO: 18595 - DNA, 16 bp, H. sapiens
aagttgtttatcaatt

SEQ ID NO: 18596 - DNA, 16 bp, H. sapiens
aagttgtttccaattt

SEQ ID NO: 18597 - DNA, 16 bp, H. sapiens
aagttgtttgagaaat

SEQ ID NO: 18598 - DNA, 16 bp, H. sapiens
aagttgtttgctttct

SEQ ID NO: 18599 - DNA, 16 bp, H. sapiens
aagtttaaaaacataa

SEQ ID NO: 18600 - DNA, 16 bp, H. sapiens
aagtttaaataaaaca

SEQ ID NO: 18601 - DNA, 16 bp, H. sapiens
aagtttaacataaaaa

SEQ ID NO: 18602 - DNA, 16 bp, H. sapiens
aagtttaactttttaa

SEQ ID NO: 18603 - DNA, 16 bp, H. sapiens
aagtttaattgtctca

SEQ ID NO: 18604 - DNA, 16 bp, H. sapiens
aagtttaatttactca

SEQ ID NO: 18605 - DNA, 16 bp, H. sapiens
aagtttacattttatt

SEQ ID NO: 18606 - DNA, 16 bp, H. sapiens
aagtttactgaatttg

SEQ ID NO: 18607 - DNA, 16 bp, H. sapiens
aagtttactttttaat

SEQ ID NO: 18608 - DNA, 16 bp, H. sapiens
aagtttacttttttct

SEQ ID NO: 18609 - DNA, 16 bp, H. sapiens
aagtttagattattga

SEQ ID NO: 18610 - DNA, 16 bp, H. sapiens
aagtttagcctaaagc

SEQ ID NO: 18611 - DNA, 16 bp, H. sapiens
aagtttaggctgggtg

SEQ ID NO: 18612 - DNA, 16 bp, H. sapiens
aagtttagggaaaaaa

SEQ ID NO: 18613 - DNA, 26 bp, H. sapiens
aagtttatcactcagtcagctgcaga

SEQ ID NO: 18614 - DNA, 16 bp, H. sapiens
aagtttatgtgagtct

SEQ ID NO: 18615 - DNA, 16 bp, H. sapiens
aagtttattaagaaag

SEQ ID NO: 18616 - DNA, 16 bp, H. sapiens
aagtttatttacaaaa

SEQ ID NO: 18617 - DNA, 16 bp, H. sapiens
aagtttattttccttt

SEQ ID NO: 18618 - DNA, 16 bp, H. sapiens
aagtttattttgccaa

SEQ ID NO: 18619 - DNA, 16 bp, H. sapiens
aagtttattttgccga

SEQ ID NO: 18620 - DNA, 16 bp, H. sapiens
aagtttatttttcctt

SEQ ID NO: 18621 - DNA, 16 bp, H. sapiens
aagtttattttttcta

SEQ ID NO: 18622 - DNA, 16 bp, H. sapiens
aagtttcaaaaaatat

SEQ ID NO: 18623 - DNA, 16 bp, H. sapiens
aagtttcaagttttaa

SEQ ID NO: 18624 - DNA, 16 bp, H. sapiens
aagtttcagaataaaa

SEQ ID NO: 18625 - DNA, 16 bp, H. sapiens
aagtttcaggaaaaaa

SEQ ID NO: 18626 - DNA, 16 bp, H. sapiens
aagtttcagtgagctg

SEQ ID NO: 18627 - DNA, 16 bp, H. sapiens
aagtttcatctctgtg

SEQ ID NO: 18628 - DNA, 16 bp, H. sapiens
aagtttcatttctttt

SEQ ID NO: 18629 - DNA, 16 bp, H. sapiens
aagtttcccaggctgg

SEQ ID NO: 18630 - DNA, 16 bp, H. sapiens
aagtttcctcctgccc

SEQ ID NO: 18631 - DNA, 16 bp, H. sapiens
aagtttcctgaagtct

SEQ ID NO: 18632 - DNA, 16 bp, H. sapiens
aagtttcctgacgcct

SEQ ID NO: 18633 - DNA, 16 bp, H. sapiens
aagtttcctgaggcct

SEQ ID NO: 18634 - DNA, 17 bp, H. sapiens
aagtttcctgaggcctt

SEQ ID NO: 18635 - DNA, 16 bp, H. sapiens
aagtttcctgaggctt

SEQ ID NO: 18636 - DNA, 16 bp, H. sapiens
aagtttcctttttaaa

SEQ ID NO: 18637 - DNA, 16 bp, H. sapiens
aagtttgaaaacattt

SEQ ID NO: 18638 - DNA, 16 bp, H. sapiens
aagtttgaaaaccact

SEQ ID NO: 18639 - DNA, 16 bp, H. sapiens
aagtttgaaaattatt

SEQ ID NO: 18640 - DNA, 16 bp, H. sapiens
aagtttgaaagccact

SEQ ID NO: 18641 - DNA, 16 bp, H. sapiens
aagtttgagaaaaatt

SEQ ID NO: 18642 - DNA, 16 bp, H. sapiens
aagtttgagaaccact

SEQ ID NO: 18643 - DNA, 20 bp, H. sapiens
aagtttgagaccagcctggt

SEQ ID NO: 18644 - DNA, 16 bp, H. sapiens
aagtttgagacctgcc

SEQ ID NO: 18645 - DNA, 18 bp, H. sapiens
aagtttgagactagcctg

SEQ ID NO: 18646 - DNA, 16 bp, H. sapiens
aagtttgaggaccact

SEQ ID NO: 18647 - DNA, 16 bp, H. sapiens
aagtttgattggaaca

SEQ ID NO: 18648 - DNA, 16 bp, H. sapiens
aagtttgcatttttga

SEQ ID NO: 18649 - DNA, 16 bp, H. sapiens
aagtttgccaaccctt

SEQ ID NO: 18650 - DNA, 16 bp, H. sapiens
aagtttgctgacctct

SEQ ID NO: 18651 - DNA, 16 bp, H. sapiens
aagtttgctgcaggga

SEQ ID NO: 18652 - DNA, 16 bp, H. sapiens
aagtttgctgcagggg

SEQ ID NO: 18653 - DNA, 16 bp, H. sapiens
aagtttgggaagtttt

SEQ ID NO: 18654 - DNA, 17 bp, H. sapiens
aagtttgggattatgtt

SEQ ID NO: 18655 - DNA, 16 bp, H. sapiens
aagtttgtgaatttgt

SEQ ID NO: 18656 - DNA, 16 bp, H. sapiens
aagtttgttgaataaa

SEQ ID NO: 18657 - DNA, 16 bp, H. sapiens
aagtttgttttaaaaa

SEQ ID NO: 18658 - DNA, 16 bp, H. sapiens
aagttttaaaaacttt

SEQ ID NO: 18659 - DNA, 16 bp, H. sapiens
aagttttaaaaagaga

SEQ ID NO: 18660 - DNA, 16 bp, H. sapiens
aagttttaaatttcca

SEQ ID NO: 18661 - DNA, 16 bp, H. sapiens
aagttttaaattttga

SEQ ID NO: 18662 - DNA, 16 bp, H. sapiens
aagttttaagaaaaag

SEQ ID NO: 18663 - DNA, 16 bp, H. sapiens
aagttttagaaataga

SEQ ID NO: 18664 - DNA, 16 bp, H. sapiens
aagttttagaagaaaa

SEQ ID NO: 18665 - DNA, 16 bp, H. sapiens
aagttttattgaaaaa

SEQ ID NO: 18666 - DNA, 16 bp, H. sapiens
aagttttatttcaaaa

SEQ ID NO: 18667 - DNA, 16 bp, H. sapiens
aagttttcaaataaaa

SEQ ID NO: 18668 - DNA, 16 bp, H. sapiens
aagttttcaaatattt

SEQ ID NO: 18669 - DNA, 16 bp, H. sapiens
aagttttcaaatgtat

SEQ ID NO: 18670 - DNA, 16 bp, H. sapiens
aagttttcaacttttt

SEQ ID NO: 18671 - DNA, 16 bp, H. sapiens
aagttttcatttgtaa

SEQ ID NO: 18672 - DNA, 16 bp, H. sapiens
aagttttcattttatt

SEQ ID NO: 18673 - DNA, 16 bp, H. sapiens
aagttttctaaaaatt

SEQ ID NO: 18674 - DNA, 16 bp, H. sapiens
aagttttctaattttt

SEQ ID NO: 18675 - DNA, 16 bp, H. sapiens
aagttttctttgaaaa

SEQ ID NO: 18676 - DNA, 16 bp, H. sapiens
aagttttgaaattaga

SEQ ID NO: 18677 - DNA, 16 bp, H. sapiens
aagttttgaaattgga

SEQ ID NO: 18678 - DNA, 16 bp, H. sapiens
aagttttgaagtcagg

SEQ ID NO: 18679 - DNA, 16 bp, H. sapiens
aagttttgaatgcaaa

SEQ ID NO: 18680 - DNA, 16 bp, H. sapiens
aagttttgcaaaggag

SEQ ID NO: 18681 - DNA, 16 bp, H. sapiens
aagttttgctatgttg

SEQ ID NO: 18682 - DNA, 16 bp, H. sapiens
aagttttgcttttgtt

SEQ ID NO: 18683 - DNA, 16 bp, H. sapiens
aagttttggcaaggat

SEQ ID NO: 18684 - DNA, 16 bp, H. sapiens
aagttttgggattaca

SEQ ID NO: 18685 - DNA, 16 bp, H. sapiens
aagttttgttggaaca

SEQ ID NO: 18686 - DNA, 16 bp, H. sapiens
aagttttgtttcattt

SEQ ID NO: 18687 - DNA, 16 bp, H. sapiens
aagtttttaaaaaatg

SEQ ID NO: 18688 - DNA, 16 bp, H. sapiens
aagtttttaaacattt

SEQ ID NO: 18689 - DNA, 16 bp, H. sapiens
aagtttttaaatttac

SEQ ID NO: 18690 - DNA, 16 bp, H. sapiens
aagtttttattttcct

SEQ ID NO: 18691 - DNA, 16 bp, H. sapiens
aagtttttcaaatttt

SEQ ID NO: 18692 - DNA, 16 bp, H. sapiens
aagtttttcattttgt

SEQ ID NO: 18693 - DNA, 16 bp, H. sapiens
aagtttttctcctttt

SEQ ID NO: 18694 - DNA, 16 bp, H. sapiens
aagtttttctctgacc

SEQ ID NO: 18695 - DNA, 16 bp, H. sapiens
aagtttttgttaaaaa

SEQ ID NO: 18696 - DNA, 16 bp, H. sapiens
aataaaaaaatgagct

SEQ ID NO: 18697 - DNA, 16 bp, H. sapiens
aataaaaaacatttgt

SEQ ID NO: 18698 - DNA, 16 bp, H. sapiens
aataaaaaagacattt

SEQ ID NO: 18699 - DNA, 16 bp, H. sapiens
aataaaaaagttagct

SEQ ID NO: 18700 - DNA, 16 bp, H. sapiens
aataaaaaatgttttg

SEQ ID NO: 18701 - DNA, 16 bp, H. sapiens
aataaaaaattcagta

SEQ ID NO: 18702 - DNA, 16 bp, H. sapiens
aataaaaaatttagcc

SEQ ID NO: 18703 - DNA, 16 bp, H. sapiens
aataaaaacaaatgct

SEQ ID NO: 18704 - DNA, 16 bp, H. sapiens
aataaaaacactttca

SEQ ID NO: 18705 - DNA, 16 bp, H. sapiens
aataaaaacatcttca

SEQ ID NO: 18706 - DNA, 16 bp, H. sapiens
aataaaaacatttctt

SEQ ID NO: 18707 - DNA, 16 bp, H. sapiens
aataaaaactgtatat

SEQ ID NO: 18708 - DNA, 16 bp, H. sapiens
aataaaaacttaaatg

SEQ ID NO: 18709 - DNA, 16 bp, H. sapiens
aataaaaactttcttt

SEQ ID NO: 18710 - DNA, 16 bp, H. sapiens
aataaaaactttgaaa

SEQ ID NO: 18711 - DNA, 16 bp, H. sapiens
aataaaaacttttctt

SEQ ID NO: 18712 - DNA, 16 bp, H. sapiens
aataaaaacttttttg

SEQ ID NO: 18713 - DNA, 16 bp, H. sapiens
aataaaaagatcagtg

SEQ ID NO: 18714 - DNA, 16 bp, H. sapiens
aataaaaagcaagtta

SEQ ID NO: 18715 - DNA, 16 bp, H. sapiens
aataaaaagcataatt

SEQ ID NO: 18716 - DNA, 16 bp, H. sapiens
aataaaaagcatttat

SEQ ID NO: 18717 - DNA, 16 bp, H. sapiens
aataaaaagctgaaat

SEQ ID NO: 18718 - DNA, 16 bp, H. sapiens
aataaaaagtatttgt

SEQ ID NO: 18719 - DNA, 16 bp, H. sapiens
aataaaaagttcagag

SEQ ID NO: 18720 - DNA, 16 bp, H. sapiens
aataaaaataaactgc

SEQ ID NO: 18721 - DNA, 16 bp, H. sapiens
aataaaaataaatctg

SEQ ID NO: 18722 - DNA, 16 bp, H. sapiens
aataaaaataacagct

SEQ ID NO: 18723 - DNA, 16 bp, H. sapiens
aataaaaataactgca

SEQ ID NO: 18724 - DNA, 16 bp, H. sapiens
aataaaaataattagc

SEQ ID NO: 18725 - DNA, 16 bp, H. sapiens
aataaaaatatctcca

SEQ ID NO: 18726 - DNA, 16 bp, H. sapiens
aataaaaatatgacat

SEQ ID NO: 18727 - DNA, 16 bp, H. sapiens
aataaaaatatgtgtt

SEQ ID NO: 18728 - DNA, 16 bp, H. sapiens
aataaaaatattgaca

SEQ ID NO: 18729 - DNA, 16 bp, H. sapiens
aataaaaatcacagca

SEQ ID NO: 18730 - DNA, 16 bp, H. sapiens
aataaaaatccttttt

SEQ ID NO: 18731 - DNA, 16 bp, H. sapiens
aataaaaatgaacttt

SEQ ID NO: 18732 - DNA, 16 bp, H. sapiens
aataaaaatgaattct

SEQ ID NO: 18733 - DNA, 16 bp, H. sapiens
aataaaaatgatgtga

SEQ ID NO: 18734 - DNA, 16 bp, H. sapiens
aataaaaatggtttta

SEQ ID NO: 18735 - DNA, 16 bp, H. sapiens
aataaaaatgtcagaa

SEQ ID NO: 18736 - DNA, 16 bp, H. sapiens
aataaaaatgtgtttg

SEQ ID NO: 18737 - DNA, 16 bp, H. sapiens
aataaaaatgttatgt

SEQ ID NO: 18738 - DNA, 16 bp, H. sapiens
aataaaaatgtttcta

SEQ ID NO: 18739 - DNA, 16 bp, H. sapiens
aataaaaatgttttga

SEQ ID NO: 18740 - DNA, 16 bp, H. sapiens
aataaaaattacagta

SEQ ID NO: 18741 - DNA, 16 bp, H. sapiens
aataaaaattatgcaa

SEQ ID NO: 18742 - DNA, 16 bp, H. sapiens
aataaaaattccagaa

SEQ ID NO: 18743 - DNA, 16 bp, H. sapiens
aataaaaatttgttga

SEQ ID NO: 18744 - DNA, 16 bp, H. sapiens
aataaaacaaagagtt

SEQ ID NO: 18745 - DNA, 16 bp, H. sapiens
aataaaacaaatgagt

SEQ ID NO: 18746 - DNA, 16 bp, H. sapiens
aataaaacaaatgatt

SEQ ID NO: 18747 - DNA, 16 bp, H. sapiens
aataaaacaatgtttt

SEQ ID NO: 18748 - DNA, 16 bp, H. sapiens
aataaaacaattttga

SEQ ID NO: 18749 - DNA, 16 bp, H. sapiens
aataaaacacaaatgt

SEQ ID NO: 18750 - DNA, 16 bp, H. sapiens
aataaaacactttatt

SEQ ID NO: 18751 - DNA, 16 bp, H. sapiens
aataaaacagaatatt

SEQ ID NO: 18752 - DNA, 16 bp, H. sapiens
aataaaacagacacag

SEQ ID NO: 18753 - DNA, 16 bp, H. sapiens
aataaaacatttctct

SEQ ID NO: 18754 - DNA, 16 bp, H. sapiens
aataaaaccatattca

SEQ ID NO: 18755 - DNA, 16 bp, H. sapiens
aataaaaccatgtttt

SEQ ID NO: 18756 - DNA, 16 bp, H. sapiens
aataaaacctacctca

SEQ ID NO: 18757 - DNA, 16 bp, H. sapiens
aataaaacctatattt

SEQ ID NO: 18758 - DNA, 16 bp, H. sapiens
aataaaacctctgaga

SEQ ID NO: 18759 - DNA, 16 bp, H. sapiens
aataaaaccttattta

SEQ ID NO: 18760 - DNA, 16 bp, H. sapiens
aataaaaccttgcatt

SEQ ID NO: 18761 - DNA, 16 bp, H. sapiens
aataaaacctttattt

SEQ ID NO: 18762 - DNA, 16 bp, H. sapiens
aataaaactacatttc

SEQ ID NO: 18763 - DNA, 16 bp, H. sapiens
aataaaactacatttt

SEQ ID NO: 18764 - DNA, 16 bp, H. sapiens
aataaaactactagaa

SEQ ID NO: 18765 - DNA, 16 bp, H. sapiens
aataaaactgaaatat

SEQ ID NO: 18766 - DNA, 16 bp, H. sapiens
aataaaactgaagttt

SEQ ID NO: 18767 - DNA, 16 bp, H. sapiens
aataaaactgcatttt

SEQ ID NO: 18768 - DNA, 16 bp, H. sapiens
aataaaactgctaaaa

SEQ ID NO: 18769 - DNA, 16 bp, H. sapiens
aataaaactgctttaa

SEQ ID NO: 18770 - DNA, 16 bp, H. sapiens
aataaaactgttatga

SEQ ID NO: 18771 - DNA, 16 bp, H. sapiens
aataaaactgttattt

SEQ ID NO: 18772 - DNA, 16 bp, H. sapiens
aataaaacttgtattt

SEQ ID NO: 18773 - DNA, 16 bp, H. sapiens
aataaaacttgtttta

SEQ ID NO: 18774 - DNA, 16 bp, H. sapiens
aataaaactttaaaag

SEQ ID NO: 18775 - DNA, 16 bp, H. sapiens
aataaaactttatgta

SEQ ID NO: 18776 - DNA, 16 bp, H. sapiens
aataaaactttattga

SEQ ID NO: 18777 - DNA, 16 bp, H. sapiens
aataaaagacacattt

SEQ ID NO: 18778 - DNA, 16 bp, H. sapiens
aataaaagacattttc

SEQ ID NO: 18779 - DNA, 16 bp, H. sapiens
aataaaagaggtttat

SEQ ID NO: 18780 - DNA, 16 bp, H. sapiens
aataaaagatattttg

SEQ ID NO: 18781 - DNA, 16 bp, H. sapiens
aataaaagatttctaa

SEQ ID NO: 18782 - DNA, 16 bp, H. sapiens
aataaaagcaatattt

SEQ ID NO: 18783 - DNA, 16 bp, H. sapiens
aataaaagcattgttt

SEQ ID NO: 18784 - DNA, 16 bp, H. sapiens
aataaaagcatttttt

SEQ ID NO: 18785 - DNA, 16 bp, H. sapiens
aataaaagcccaggac

SEQ ID NO: 18786 - DNA, 16 bp, H. sapiens
aataaaagctctttgg

SEQ ID NO: 18787 - DNA, 16 bp, H. sapiens
aataaaaggaaccaga

SEQ ID NO: 18788 - DNA, 16 bp, H. sapiens
aataaaaggcatattt

SEQ ID NO: 18789 - DNA, 16 bp, H. sapiens
aataaaaggcatgcaa

SEQ ID NO: 18790 - DNA, 16 bp, H. sapiens
aataaaaggcattaaa

SEQ ID NO: 18791 - DNA, 16 bp, H. sapiens
aataaaaggtattttt

SEQ ID NO: 18792 - DNA, 16 bp, H. sapiens
aataaaagtaatccat

SEQ ID NO: 18793 - DNA, 16 bp, H. sapiens
aataaaagtatgtttt

SEQ ID NO: 18794 - DNA, 16 bp, H. sapiens
aataaaagtgatgaga

SEQ ID NO: 18795 - DNA, 16 bp, H. sapiens
aataaaagtggcaaaa

SEQ ID NO: 18796 - DNA, 16 bp, H. sapiens
aataaaagttattttc

SEQ ID NO: 18797 - DNA, 16 bp, H. sapiens
aataaaagttggaaag

SEQ ID NO: 18798 - DNA, 16 bp, H. sapiens
aataaaagtttaaaca

SEQ ID NO: 18799 - DNA, 16 bp, H. sapiens
aataaaagtttgtttt

SEQ ID NO: 18800 - DNA, 16 bp, H. sapiens
aataaaagtttttgaa

SEQ ID NO: 18801 - DNA, 16 bp, H. sapiens
aataaaataaaactgg

SEQ ID NO: 18802 - DNA, 16 bp, H. sapiens
aataaaataaaggcag

SEQ ID NO: 18803 - DNA, 16 bp, H. sapiens
aataaaataaatgcat

SEQ ID NO: 18804 - DNA, 16 bp, H. sapiens
aataaaataaatgctt

SEQ ID NO: 18805 - DNA, 16 bp, H. sapiens
aataaaataagaattc

SEQ ID NO: 18806 - DNA, 16 bp, H. sapiens
aataaaataagccagg

SEQ ID NO: 18807 - DNA, 16 bp, H. sapiens
aataaaataatgcata

SEQ ID NO: 18808 - DNA, 16 bp, H. sapiens
aataaaataatggcta

SEQ ID NO: 18809 - DNA, 16 bp, H. sapiens
aataaaatacaatgat

SEQ ID NO: 18810 - DNA, 16 bp, H. sapiens
aataaaatacagtttt

SEQ ID NO: 18811 - DNA, 16 bp, H. sapiens
aataaaatacctagaa

SEQ ID NO: 18812 - DNA, 18 bp, H. sapiens
aataaaatacctaggaat

SEQ ID NO: 18813 - DNA, 16 bp, H. sapiens
aataaaatactgatat

SEQ ID NO: 18814 - DNA, 16 bp, H. sapiens
aataaaatactggcac

SEQ ID NO: 18815 - DNA, 16 bp, H. sapiens
aataaaatacttgaaa

SEQ ID NO: 18816 - DNA, 16 bp, H. sapiens
aataaaatagctgaaa

SEQ ID NO: 18817 - DNA, 16 bp, H. sapiens
aataaaataggccagg

SEQ ID NO: 18818 - DNA, 16 bp, H. sapiens
aataaaatagttgttt

SEQ ID NO: 18819 - DNA, 16 bp, H. sapiens
aataaaatatgacatt

SEQ ID NO: 18820 - DNA, 16 bp, H. sapiens
aataaaatattctcta

SEQ ID NO: 18821 - DNA, 16 bp, H. sapiens
aataaaatattgacaa

SEQ ID NO: 18822 - DNA, 16 bp, H. sapiens
aataaaatatttcagg

SEQ ID NO: 18823 - DNA, 16 bp, H. sapiens
aataaaatatttctct

SEQ ID NO: 18824 - DNA, 16 bp, H. sapiens
aataaaatcatctttc

SEQ ID NO: 18825 - DNA, 16 bp, H. sapiens
aataaaatcattatct

SEQ ID NO: 18826 - DNA, 16 bp, H. sapiens
aataaaatcattttca

SEQ ID NO: 18827 - DNA, 16 bp, H. sapiens
aataaaatcattttgt

SEQ ID NO: 18828 - DNA, 16 bp, H. sapiens
aataaaatcctgtaat

SEQ ID NO: 18829 - DNA, 16 bp, H. sapiens
aataaaatcctgtcat

SEQ ID NO: 18830 - DNA, 16 bp, H. sapiens
aataaaatcctttcag

SEQ ID NO: 18831 - DNA, 16 bp, H. sapiens
aataaaatctgtcttt

SEQ ID NO: 18832 - DNA, 16 bp, H. sapiens
aataaaatcttaagaa

SEQ ID NO: 18833 - DNA, 16 bp, H. sapiens
aataaaatcttgaaaa

SEQ ID NO: 18834 - DNA, 16 bp, H. sapiens
aataaaatgaaaactt

SEQ ID NO: 18835 - DNA, 16 bp, H. sapiens
aataaaatgaaactag

SEQ ID NO: 18836 - DNA, 16 bp, H. sapiens
aataaaatgaaatttc

SEQ ID NO: 18837 - DNA, 16 bp, H. sapiens
aataaaatgacattaa

SEQ ID NO: 18838 - DNA, 16 bp, H. sapiens
aataaaatgagatcat

SEQ ID NO: 18839 - DNA, 16 bp, H. sapiens
aataaaatgattgttt

SEQ ID NO: 18840 - DNA, 16 bp, H. sapiens
aataaaatgatttctt

SEQ ID NO: 18841 - DNA, 16 bp, H. sapiens
aataaaatgcacatat

SEQ ID NO: 18842 - DNA, 16 bp, H. sapiens
aataaaatgcagtaaa

SEQ ID NO: 18843 - DNA, 16 bp, H. sapiens
aataaaatgcattaaa

SEQ ID NO: 18844 - DNA, 16 bp, H. sapiens
aataaaatgctaattt

SEQ ID NO: 18845 - DNA, 16 bp, H. sapiens
aataaaatggaatgga

SEQ ID NO: 18846 - DNA, 16 bp, H. sapiens
aataaaatggcatttt

SEQ ID NO: 18847 - DNA, 16 bp, H. sapiens
aataaaatggctttta

SEQ ID NO: 18848 - DNA, 16 bp, H. sapiens
aataaaatgggaggca

SEQ ID NO: 18849 - DNA, 16 bp, H. sapiens
aataaaatgtagagat

SEQ ID NO: 18850 - DNA, 16 bp, H. sapiens
aataaaatgtattttg

SEQ ID NO: 18851 - DNA, 16 bp, H. sapiens
aataaaatgtgaagac

SEQ ID NO: 18852 - DNA, 16 bp, H. sapiens
aataaaatgtgaattt

SEQ ID NO: 18853 - DNA, 16 bp, H. sapiens
aataaaatgtgttcaa

SEQ ID NO: 18854 - DNA, 16 bp, H. sapiens
aataaaatgtgttttt

SEQ ID NO: 18855 - DNA, 16 bp, H. sapiens
aataaaatgttaggaa

SEQ ID NO: 18856 - DNA, 16 bp, H. sapiens
aataaaatgtttatca

SEQ ID NO: 18857 - DNA, 16 bp, H. sapiens
aataaaatgtttcaaa

SEQ ID NO: 18858 - DNA, 16 bp, H. sapiens
aataaaatgtttccat

SEQ ID NO: 18859 - DNA, 16 bp, H. sapiens
aataaaatgtttgctg

SEQ ID NO: 18860 - DNA, 16 bp, H. sapiens
aataaaatgtttgttg

SEQ ID NO: 18861 - DNA, 16 bp, H. sapiens
aataaaatgttttctg

SEQ ID NO: 18862 - DNA, 16 bp, H. sapiens
aataaaattacttcta

SEQ ID NO: 18863 - DNA, 16 bp, H. sapiens
aataaaattagagatg

SEQ ID NO: 18864 - DNA, 16 bp, H. sapiens
aataaaattatctttg

SEQ ID NO: 18865 - DNA, 16 bp, H. sapiens
aataaaattatttgca

SEQ ID NO: 18866 - DNA, 16 bp, H. sapiens
aataaaattcactctt

SEQ ID NO: 18867 - DNA, 16 bp, H. sapiens
aataaaattcagaatt

SEQ ID NO: 18868 - DNA, 16 bp, H. sapiens
aataaaattcagcatt

SEQ ID NO: 18869 - DNA, 16 bp, H. sapiens
aataaaattctgaaat

SEQ ID NO: 18870 - DNA, 16 bp, H. sapiens
aataaaattctgttta

SEQ ID NO: 18871 - DNA, 16 bp, H. sapiens
aataaaattgaacaag

SEQ ID NO: 18872 - DNA, 16 bp, H. sapiens
aataaaattgtcattt

SEQ ID NO: 18873 - DNA, 16 bp, H. sapiens
aataaaattgtttctt

SEQ ID NO: 18874 - DNA, 16 bp, H. sapiens
aataaaatttacttca

SEQ ID NO: 18875 - DNA, 16 bp, H. sapiens
aataaacaaaatatgg

SEQ ID NO: 18876 - DNA, 16 bp, H. sapiens
aataaacaaaatgtgg

SEQ ID NO: 18877 - DNA, 16 bp, H. sapiens
aataaacaaacatgtg

SEQ ID NO: 18878 - DNA, 16 bp, H. sapiens
aataaacaataaatgt

SEQ ID NO: 18879 - DNA, 16 bp, H. sapiens
aataaacaatattttc

SEQ ID NO: 18880 - DNA, 16 bp, H. sapiens
aataaacacatttctt

SEQ ID NO: 18881 - DNA, 16 bp, H. sapiens
aataaacacattttta

SEQ ID NO: 18882 - DNA, 16 bp, H. sapiens
aataaacacttactga

SEQ ID NO: 18883 - DNA, 16 bp, H. sapiens
aataaacagaatatac

SEQ ID NO: 18884 - DNA, 16 bp, H. sapiens
aataaacagacaacct

SEQ ID NO: 18885 - DNA, 16 bp, H. sapiens
aataaacaggaaaatg

SEQ ID NO: 18886 - DNA, 16 bp, H. sapiens
aataaacataaatgtg

SEQ ID NO: 18887 - DNA, 16 bp, H. sapiens
aataaacatacctgtg

SEQ ID NO: 18888 - DNA, 16 bp, H. sapiens
aataaacatatatgtg

SEQ ID NO: 18889 - DNA, 16 bp, H. sapiens
aataaacatctgtgtg

SEQ ID NO: 18890 - DNA, 16 bp, H. sapiens
aataaacatctttttt

SEQ ID NO: 18891 - DNA, 16 bp, H. sapiens
aataaacatgcatgtg

SEQ ID NO: 18892 - DNA, 16 bp, H. sapiens
aataaacatttaaaga

SEQ ID NO: 18893 - DNA, 16 bp, H. sapiens
aataaacatttaagaa

SEQ ID NO: 18894 - DNA, 16 bp, H. sapiens
aataaacatttattga

SEQ ID NO: 18895 - DNA, 16 bp, H. sapiens
aataaacatttcattt

SEQ ID NO: 18896 - DNA, 16 bp, H. sapiens
aataaacatttctcaa

SEQ ID NO: 18897 - DNA, 16 bp, H. sapiens
aataaacatttgctga

SEQ ID NO: 18898 - DNA, 16 bp, H. sapiens
aataaacatttggaaa

SEQ ID NO: 18899 - DNA, 16 bp, H. sapiens
aataaacatttgtgaa

SEQ ID NO: 18900 - DNA, 16 bp, H. sapiens
aataaacatttgttaa

SEQ ID NO: 18901 - DNA, 16 bp, H. sapiens
aataaacatttgttat

SEQ ID NO: 18902 - DNA, 16 bp, H. sapiens
aataaacatttttcca

SEQ ID NO: 18903 - DNA, 16 bp, H. sapiens
aataaacattttttga

SEQ ID NO: 18904 - DNA, 16 bp, H. sapiens
aataaaccatttttct

SEQ ID NO: 18905 - DNA, 16 bp, H. sapiens
aataaacccatcataa

SEQ ID NO: 18906 - DNA, 16 bp, H. sapiens
aataaaccccttcctt

SEQ ID NO: 18907 - DNA, 16 bp, H. sapiens
aataaacctcttcttt

SEQ ID NO: 18908 - DNA, 16 bp, H. sapiens
aataaacctctttata

SEQ ID NO: 18909 - DNA, 16 bp, H. sapiens
aataaacctcttttcc

SEQ ID NO: 18910 - DNA, 16 bp, H. sapiens
aataaacctgcttttc

SEQ ID NO: 18911 - DNA, 16 bp, H. sapiens
aataaaccttgctact

SEQ ID NO: 18912 - DNA, 16 bp, H. sapiens
aataaactagtaaatg

SEQ ID NO: 18913 - DNA, 16 bp, H. sapiens
aataaactatatttct

SEQ ID NO: 18914 - DNA, 16 bp, H. sapiens
aataaactgtttttaa

SEQ ID NO: 18915 - DNA, 16 bp, H. sapiens
aataaacttaaccaag

SEQ ID NO: 18916 - DNA, 16 bp, H. sapiens
aataaacttgaaaata

SEQ ID NO: 18917 - DNA, 16 bp, H. sapiens
aataaactttgaaaaa

SEQ ID NO: 18918 - DNA, 16 bp, H. sapiens
aataaactttttaatg

SEQ ID NO: 18919 - DNA, 16 bp, H. sapiens
aataaagaaaatgtgg

SEQ ID NO: 18920 - DNA, 16 bp, H. sapiens
aataaagaaaatttct

SEQ ID NO: 18921 - DNA, 16 bp, H. sapiens
aataaagaaattcaga

SEQ ID NO: 18922 - DNA, 16 bp, H. sapiens
aataaagaagacattt

SEQ ID NO: 18923 - DNA, 16 bp, H. sapiens
aataaagaaggcagaa

SEQ ID NO: 18924 - DNA, 16 bp, H. sapiens
aataaagaagttcttt

SEQ ID NO: 18925 - DNA, 16 bp, H. sapiens
aataaagacatacttg

SEQ ID NO: 18926 - DNA, 16 bp, H. sapiens
aataaagacattttca

SEQ ID NO: 18927 - DNA, 16 bp, H. sapiens
aataaagacattttta

SEQ ID NO: 18928 - DNA, 16 bp, H. sapiens
aataaagacttttaaa

SEQ ID NO: 18929 - DNA, 16 bp, H. sapiens
aataaagacttttttt

SEQ ID NO: 18930 - DNA, 16 bp, H. sapiens
aataaagagaacacca

SEQ ID NO: 18931 - DNA, 16 bp, H. sapiens
aataaagagagaagac

SEQ ID NO: 18932 - DNA, 16 bp, H. sapiens
aataaagatgctcttt

SEQ ID NO: 18933 - DNA, 16 bp, H. sapiens
aataaagattcatttt

SEQ ID NO: 18934 - DNA, 16 bp, H. sapiens
aataaagatttgttga

SEQ ID NO: 18935 - DNA, 16 bp, H. sapiens
aataaagcaaaatact

SEQ ID NO: 18936 - DNA, 16 bp, H. sapiens
aataaagcaaaatttt

SEQ ID NO: 18937 - DNA, 16 bp, H. sapiens
aataaagcaagaagat

SEQ ID NO: 18938 - DNA, 16 bp, H. sapiens
aataaagcaagtcaca

SEQ ID NO: 18939 - DNA, 16 bp, H. sapiens
aataaagcagatattt

SEQ ID NO: 18940 - DNA, 16 bp, H. sapiens
aataaagcagttaaaa

SEQ ID NO: 18941 - DNA, 16 bp, H. sapiens
aataaagcatataaat

SEQ ID NO: 18942 - DNA, 16 bp, H. sapiens
aataaagcattaaaat

SEQ ID NO: 18943 - DNA, 16 bp, H. sapiens
aataaagcattttaaa

SEQ ID NO: 18944 - DNA, 16 bp, H. sapiens
aataaagccacatact

SEQ ID NO: 18945 - DNA, 16 bp, H. sapiens
aataaagccttttttt

SEQ ID NO: 18946 - DNA, 16 bp, H. sapiens
aataaagctcaacatc

SEQ ID NO: 18947 - DNA, 16 bp, H. sapiens
aataaagctgctatga

SEQ ID NO: 18948 - DNA, 16 bp, H. sapiens
aataaagctgggggaa

SEQ ID NO: 18949 - DNA, 16 bp, H. sapiens
aataaagctgtaaaat

SEQ ID NO: 18950 - DNA, 17 bp, H. sapiens
aataaagctgtttattt

SEQ ID NO: 18951 - DNA, 16 bp, H. sapiens
aataaagctgttttat

SEQ ID NO: 18952 - DNA, 16 bp, H. sapiens
aataaagcttctgtga

SEQ ID NO: 18953 - DNA, 16 bp, H. sapiens
aataaagctttattga

SEQ ID NO: 18954 - DNA, 16 bp, H. sapiens
aataaagcttttaatt

SEQ ID NO: 18955 - DNA, 16 bp, H. sapiens
aataaagcttttcttt

SEQ ID NO: 18956 - DNA, 16 bp, H. sapiens
aataaagcttttttta

SEQ ID NO: 18957 - DNA, 16 bp, H. sapiens
aataaaggaaatgtgg

SEQ ID NO: 18958 - DNA, 16 bp, H. sapiens
aataaaggaacatttt

SEQ ID NO: 18959 - DNA, 16 bp, H. sapiens
aataaaggggctacag

SEQ ID NO: 18960 - DNA, 16 bp, H. sapiens
aataaaggtaaataca

SEQ ID NO: 18961 - DNA, 16 bp, H. sapiens
aataaaggttttatta

SEQ ID NO: 18962 - DNA, 16 bp, H. sapiens
aataaagtacttttaa

SEQ ID NO: 18963 - DNA, 16 bp, H. sapiens
aataaagtcattttct

SEQ ID NO: 18964 - DNA, 16 bp, H. sapiens
aataaagtcattttta

SEQ ID NO: 18965 - DNA, 16 bp, H. sapiens
aataaagtctgttttt

SEQ ID NO: 18966 - DNA, 16 bp, H. sapiens
aataaagtctttctca

SEQ ID NO: 18967 - DNA, 16 bp, H. sapiens
aataaagtgaaaatca

SEQ ID NO: 18968 - DNA, 16 bp, H. sapiens
aataaagtgagtcaca

SEQ ID NO: 18969 - DNA, 16 bp, H. sapiens
aataaagtgcacaata

SEQ ID NO: 18970 - DNA, 16 bp, H. sapiens
aataaagtggtttaaa

SEQ ID NO: 18971 - DNA, 16 bp, H. sapiens
aataaagtgtttttaa

SEQ ID NO: 18972 - DNA, 16 bp, H. sapiens
aataaagttactataa

SEQ ID NO: 18973 - DNA, 16 bp, H. sapiens
aataaagttctttttt

SEQ ID NO: 18974 - DNA, 16 bp, H. sapiens
aataaagttgattttt

SEQ ID NO: 18975 - DNA, 16 bp, H. sapiens
aataaagttgtttaaa

SEQ ID NO: 18976 - DNA, 16 bp, H. sapiens
aataaagttgttttat

SEQ ID NO: 18977 - DNA, 16 bp, H. sapiens
aataaagtttattctt

SEQ ID NO: 18978 - DNA, 16 bp, H. sapiens
aataaagtttcatttt

SEQ ID NO: 18979 - DNA, 16 bp, H. sapiens
aataaagtttgtattt

SEQ ID NO: 18980 - DNA, 16 bp, H. sapiens
aataaagttttactga

SEQ ID NO: 18981 - DNA, 16 bp, H. sapiens
aataaagttttattgg

SEQ ID NO: 18982 - DNA, 16 bp, H. sapiens
aataaagttttctaaa

SEQ ID NO: 18983 - DNA, 16 bp, H. sapiens
aataaagtttttcttt

SEQ ID NO: 18984 - DNA, 16 bp, H. sapiens
aataaagtttttttgg

SEQ ID NO: 18985 - DNA, 16 bp, H. sapiens
aataaataaaacatgc

SEQ ID NO: 18986 - DNA, 16 bp, H. sapiens
aataaataaaactgtt

SEQ ID NO: 18987 - DNA, 16 bp, H. sapiens
aataaataaaagcctc

SEQ ID NO: 18988 - DNA, 16 bp, H. sapiens
aataaataaaagctat

SEQ ID NO: 18989 - DNA, 16 bp, H. sapiens
aataaataaaatactg

SEQ ID NO: 18990 - DNA, 16 bp, H. sapiens
aataaataaatactgt

SEQ ID NO: 18991 - DNA, 16 bp, H. sapiens
aataaataaatctgaa

SEQ ID NO: 18992 - DNA, 16 bp, H. sapiens
aataaataaatctgat

SEQ ID NO: 18993 - DNA, 16 bp, H. sapiens
aataaataaatgtaca

SEQ ID NO: 18994 - DNA, 16 bp, H. sapiens
aataaataaattagcc

SEQ ID NO: 18995 - DNA, 16 bp, H. sapiens
aataaataacagtgca

SEQ ID NO: 18996 - DNA, 16 bp, H. sapiens
aataaataagcaaatg

SEQ ID NO: 18997 - DNA, 16 bp, H. sapiens
aataaataatcatctg

SEQ ID NO: 18998 - DNA, 16 bp, H. sapiens
aataaataatgctggg

SEQ ID NO: 18999 - DNA, 16 bp, H. sapiens
aataaatacaaattga

SEQ ID NO: 19000 - DNA, 16 bp, H. sapiens
aataaatacaggaaat

SEQ ID NO: 19001 - DNA, 16 bp, H. sapiens
aataaatacatcattt

SEQ ID NO: 19002 - DNA, 16 bp, H. sapiens
aataaatacatgaata

SEQ ID NO: 19003 - DNA, 16 bp, H. sapiens
aataaatacatgaatg

SEQ ID NO: 19004 - DNA, 16 bp, H. sapiens
aataaatacatttctg

SEQ ID NO: 19005 - DNA, 16 bp, H. sapiens
aataaatacatttgat

SEQ ID NO: 19006 - DNA, 16 bp, H. sapiens
aataaatactgtttta

SEQ ID NO: 19007 - DNA, 16 bp, H. sapiens
aataaatacttgtaaa

SEQ ID NO: 19008 - DNA, 16 bp, H. sapiens
aataaatacttttgaa

SEQ ID NO: 19009 - DNA, 16 bp, H. sapiens
aataaatagcaaaatg

SEQ ID NO: 19010 - DNA, 16 bp, H. sapiens
aataaatatatgttgt

SEQ ID NO: 19011 - DNA, 16 bp, H. sapiens
aataaatatctgaaat

SEQ ID NO: 19012 - DNA, 16 bp, H. sapiens
aataaatatcttttct

SEQ ID NO: 19013 - DNA, 16 bp, H. sapiens
aataaatatgtattca

SEQ ID NO: 19014 - DNA, 16 bp, H. sapiens
aataaatatgtgctga

SEQ ID NO: 19015 - DNA, 16 bp, H. sapiens
aataaatatgtgttga

SEQ ID NO: 19016 - DNA, 16 bp, H. sapiens
aataaatattagtcat

SEQ ID NO: 19017 - DNA, 16 bp, H. sapiens
aataaatattcattga

SEQ ID NO: 19018 - DNA, 16 bp, H. sapiens
aataaatattctttga

SEQ ID NO: 19019 - DNA, 16 bp, H. sapiens
aataaatattgattca

SEQ ID NO: 19020 - DNA, 16 bp, H. sapiens
aataaatattgccaaa

SEQ ID NO: 19021 - DNA, 16 bp, H. sapiens
aataaatattgctgaa

SEQ ID NO: 19022 - DNA, 16 bp, H. sapiens
aataaatatttagtga

SEQ ID NO: 19023 - DNA, 16 bp, H. sapiens
aataaatatttatgga

SEQ ID NO: 19024 - DNA, 16 bp, H. sapiens
aataaatatttgaatg

SEQ ID NO: 19025 - DNA, 16 bp, H. sapiens
aataaatatttgccaa

SEQ ID NO: 19026 - DNA, 16 bp, H. sapiens
aataaatatttgtaga

SEQ ID NO: 19027 - DNA, 16 bp, H. sapiens
aataaatatttgtcaa

SEQ ID NO: 19028 - DNA, 16 bp, H. sapiens
aataaatatttgtgga

SEQ ID NO: 19029 - DNA, 16 bp, H. sapiens
aataaatattttccca

SEQ ID NO: 19030 - DNA, 16 bp, H. sapiens
aataaatattttgcat

SEQ ID NO: 19031 - DNA, 16 bp, H. sapiens
aataaatcacttgcac

SEQ ID NO: 19032 - DNA, 16 bp, H. sapiens
aataaatcatttccct

SEQ ID NO: 19033 - DNA, 16 bp, H. sapiens
aataaatctatgtatt

SEQ ID NO: 19034 - DNA, 16 bp, H. sapiens
aataaatctcaagaga

SEQ ID NO: 19035 - DNA, 16 bp, H. sapiens
aataaatctcatttta

SEQ ID NO: 19036 - DNA, 16 bp, H. sapiens
aataaatctctgttgt

SEQ ID NO: 19037 - DNA, 16 bp, H. sapiens
aataaatctcttcttt

SEQ ID NO: 19038 - DNA, 16 bp, H. sapiens
aataaatctctttaaa

SEQ ID NO: 19039 - DNA, 16 bp, H. sapiens
aataaatctgcttttc

SEQ ID NO: 19040 - DNA, 16 bp, H. sapiens
aataaatctgtaaaat

SEQ ID NO: 19041 - DNA, 16 bp, H. sapiens
aataaatctgtgcttt

SEQ ID NO: 19042 - DNA, 16 bp, H. sapiens
aataaatctgtgttgt

SEQ ID NO: 19043 - DNA, 16 bp, H. sapiens
aataaatctgttattt

SEQ ID NO: 19044 - DNA, 16 bp, H. sapiens
aataaatctttgccta

SEQ ID NO: 19045 - DNA, 16 bp, H. sapiens
aataaatgaaacatta

SEQ ID NO: 19046 - DNA, 16 bp, H. sapiens
aataaatgaaacattt

SEQ ID NO: 19047 - DNA, 16 bp, H. sapiens
aataaatgaaactttt

SEQ ID NO: 19048 - DNA, 16 bp, H. sapiens
aataaatgaacttgaa

SEQ ID NO: 19049 - DNA, 16 bp, H. sapiens
aataaatgaagacata

SEQ ID NO: 19050 - DNA, 16 bp, H. sapiens
aataaatgaatgattt

SEQ ID NO: 19051 - DNA, 16 bp, H. sapiens
aataaatgaatgcaca

SEQ ID NO: 19052 - DNA, 16 bp, H. sapiens
aataaatgacaaatta

SEQ ID NO: 19053 - DNA, 16 bp, H. sapiens
aataaatgactttaaa

SEQ ID NO: 19054 - DNA, 16 bp, H. sapiens
aataaatgagcatttt

SEQ ID NO: 19055 - DNA, 16 bp, H. sapiens
aataaatgagtgaatg

SEQ ID NO: 19056 - DNA, 16 bp, H. sapiens
aataaatgataaatgc

SEQ ID NO: 19057 - DNA, 16 bp, H. sapiens
aataaatgatcctggg

SEQ ID NO: 19058 - DNA, 16 bp, H. sapiens
aataaatgatgctaga

SEQ ID NO: 19059 - DNA, 16 bp, H. sapiens
aataaatgccaaataa

SEQ ID NO: 19060 - DNA, 16 bp, H. sapiens
aataaatgcctgttga

SEQ ID NO: 19061 - DNA, 16 bp, H. sapiens
aataaatgctaaaaat

SEQ ID NO: 19062 - DNA, 16 bp, H. sapiens
aataaatgctagtttt

SEQ ID NO: 19063 - DNA, 16 bp, H. sapiens
aataaatgctcaataa

SEQ ID NO: 19064 - DNA, 16 bp, H. sapiens
aataaatgctcagaaa

SEQ ID NO: 19065 - DNA, 16 bp, H. sapiens
aataaatgcttatgaa

SEQ ID NO: 19066 - DNA, 16 bp, H. sapiens
aataaatgcttatttt

SEQ ID NO: 19067 - DNA, 16 bp, H. sapiens
aataaatgctttttta

SEQ ID NO: 19068 - DNA, 16 bp, H. sapiens
aataaatggaacagaa

SEQ ID NO: 19069 - DNA, 16 bp, H. sapiens
aataaatggaagctat

SEQ ID NO: 19070 - DNA, 16 bp, H. sapiens
aataaatggagaaatg

SEQ ID NO: 19071 - DNA, 16 bp, H. sapiens
aataaatgggaaaatg

SEQ ID NO: 19072 - DNA, 16 bp, H. sapiens
aataaatggtaattat

SEQ ID NO: 19073 - DNA, 16 bp, H. sapiens
aataaatggtactggg

SEQ ID NO: 19074 - DNA, 16 bp, H. sapiens
aataaatggtagttat

SEQ ID NO: 19075 - DNA, 16 bp, H. sapiens
aataaatggtgcaggg

SEQ ID NO: 19076 - DNA, 16 bp, H. sapiens
aataaatggtgctgag

SEQ ID NO: 19077 - DNA, 16 bp, H. sapiens
aataaatggttattgt

SEQ ID NO: 19078 - DNA, 16 bp, H. sapiens
aataaatgtacatatt

SEQ ID NO: 19079 - DNA, 16 bp, H. sapiens
aataaatgtatacaat

SEQ ID NO: 19080 - DNA, 16 bp, H. sapiens
aataaatgtatcattt

SEQ ID NO: 19081 - DNA, 16 bp, H. sapiens
aataaatgtatgttga

SEQ ID NO: 19082 - DNA, 16 bp, H. sapiens
aataaatgtattttga

SEQ ID NO: 19083 - DNA, 16 bp, H. sapiens
aataaatgtattttgt

SEQ ID NO: 19084 - DNA, 16 bp, H. sapiens
aataaatgtcactttt

SEQ ID NO: 19085 - DNA, 16 bp, H. sapiens
aataaatgtcatttaa

SEQ ID NO: 19086 - DNA, 16 bp, H. sapiens
aataaatgtctattgt

SEQ ID NO: 19087 - DNA, 16 bp, H. sapiens
aataaatgtctgttga

SEQ ID NO: 19088 - DNA, 16 bp, H. sapiens
aataaatgtctgttgt

SEQ ID NO: 19089 - DNA, 16 bp, H. sapiens
aataaatgtgaaaatg

SEQ ID NO: 19090 - DNA, 16 bp, H. sapiens
aataaatgtgactcac

SEQ ID NO: 19091 - DNA, 16 bp, H. sapiens
aataaatgtgcatttt

SEQ ID NO: 19092 - DNA, 16 bp, H. sapiens
aataaatgtggaaaga

SEQ ID NO: 19093 - DNA, 16 bp, H. sapiens
aataaatgtgggaaaa

SEQ ID NO: 19094 - DNA, 16 bp, H. sapiens
aataaatgtgtgtttt

SEQ ID NO: 19095 - DNA, 16 bp, H. sapiens
aataaatgttagctct

SEQ ID NO: 19096 - DNA, 16 bp, H. sapiens
aataaatgttatttct

SEQ ID NO: 19097 - DNA, 16 bp, H. sapiens
aataaatgttcattga

SEQ ID NO: 19098 - DNA, 16 bp, H. sapiens
aataaatgttgctggg

SEQ ID NO: 19099 - DNA, 16 bp, H. sapiens
aataaatgttggcatg

SEQ ID NO: 19100 - DNA, 16 bp, H. sapiens
aataaatgttgtttta

SEQ ID NO: 19101 - DNA, 16 bp, H. sapiens
aataaatgtttacaaa

SEQ ID NO: 19102 - DNA, 16 bp, H. sapiens
aataaatgtttattga

SEQ ID NO: 19103 - DNA, 16 bp, H. sapiens
aataaatgtttcctaa

SEQ ID NO: 19104 - DNA, 16 bp, H. sapiens
aataaatgtttcctgt

SEQ ID NO: 19105 - DNA, 16 bp, H. sapiens
aataaatgtttctgga

SEQ ID NO: 19106 - DNA, 16 bp, H. sapiens
aataaatgtttcttaa

SEQ ID NO: 19107 - DNA, 16 bp, H. sapiens
aataaatgtttgcaaa

SEQ ID NO: 19108 - DNA, 16 bp, H. sapiens
aataaatgtttgtaaa

SEQ ID NO: 19109 - DNA, 16 bp, H. sapiens
aataaatgtttgttga

SEQ ID NO: 19110 - DNA, 16 bp, H. sapiens
aataaatgttttaatg

SEQ ID NO: 19111 - DNA, 16 bp, H. sapiens
aataaatgttttcttt

SEQ ID NO: 19112 - DNA, 16 bp, H. sapiens
aataaattaccccaaa

SEQ ID NO: 19113 - DNA, 16 bp, H. sapiens
aataaattactgttgt

SEQ ID NO: 19114 - DNA, 16 bp, H. sapiens
aataaattagatattg

SEQ ID NO: 19115 - DNA, 16 bp, H. sapiens
aataaattatagaaca

SEQ ID NO: 19116 - DNA, 16 bp, H. sapiens
aataaattatagtaca

SEQ ID NO: 19117 - DNA, 16 bp, H. sapiens
aataaattatggtgta

SEQ ID NO: 19118 - DNA, 16 bp, H. sapiens
aataaattatgttaca

SEQ ID NO: 19119 - DNA, 16 bp, H. sapiens
aataaattccagaaaa

SEQ ID NO: 19120 - DNA, 16 bp, H. sapiens
aataaattccattttt

SEQ ID NO: 19121 - DNA, 16 bp, H. sapiens
aataaattccttttat

SEQ ID NO: 19122 - DNA, 16 bp, H. sapiens
aataaattccttttct

SEQ ID NO: 19123 - DNA, 16 bp, H. sapiens
aataaattgaatgcag

SEQ ID NO: 19124 - DNA, 16 bp, H. sapiens
aataaattgattccag

SEQ ID NO: 19125 - DNA, 16 bp, H. sapiens
aataaattgttttact

SEQ ID NO: 19126 - DNA, 16 bp, H. sapiens
aataaatttatgctgt

SEQ ID NO: 19127 - DNA, 16 bp, H. sapiens
aataaatttatgttgt

SEQ ID NO: 19128 - DNA, 16 bp, H. sapiens
aataaatttcagtttt

SEQ ID NO: 19129 - DNA, 16 bp, H. sapiens
aataaatttctaaaag

SEQ ID NO: 19130 - DNA, 16 bp, H. sapiens
aataaatttctattgt

SEQ ID NO: 19131 - DNA, 16 bp, H. sapiens
aataaatttctcttgt

SEQ ID NO: 19132 - DNA, 16 bp, H. sapiens
aataaatttctgctgt

SEQ ID NO: 19133 - DNA, 16 bp, H. sapiens
aataaatttctgttgt

SEQ ID NO: 19134 - DNA, 16 bp, H. sapiens
aataaatttgctttca

SEQ ID NO: 19135 - DNA, 16 bp, H. sapiens
aataaatttggaaaag

SEQ ID NO: 19136 - DNA, 16 bp, H. sapiens
aataaattttagaaca

SEQ ID NO: 19137 - DNA, 16 bp, H. sapiens
aataaattttagcttt

SEQ ID NO: 19138 - DNA, 16 bp, H. sapiens
aataaattttaggcca

SEQ ID NO: 19139 - DNA, 16 bp, H. sapiens
aataaatttttcagtt

SEQ ID NO: 19140 - DNA, 16 bp, H. sapiens
aataaatttttttctg

SEQ ID NO: 19141 - DNA, 17 bp, H. sapiens
aataacaaactcctctg

SEQ ID NO: 19142 - DNA, 16 bp, H. sapiens
aataacaaagacactc

SEQ ID NO: 19143 - DNA, 16 bp, H. sapiens
aataacaaatgcttgt

SEQ ID NO: 19144 - DNA, 16 bp, H. sapiens
aataacaacagcagca

SEQ ID NO: 19145 - DNA, 16 bp, H. sapiens
aataacaagttttgaa

SEQ ID NO: 19146 - DNA, 16 bp, H. sapiens
aataacaatgataata

SEQ ID NO: 19147 - DNA, 16 bp, H. sapiens
aataacactgtatttt

SEQ ID NO: 19148 - DNA, 16 bp, H. sapiens
aataacactttattta

SEQ ID NO: 19149 - DNA, 16 bp, H. sapiens
aataacagaaatgtat

SEQ ID NO: 19150 - DNA, 16 bp, H. sapiens
aataacagacaaagag

SEQ ID NO: 19151 - DNA, 16 bp, H. sapiens
aataacagactctgaa

SEQ ID NO: 19152 - DNA, 16 bp, H. sapiens
aataacagattatttt

SEQ ID NO: 19153 - DNA, 16 bp, H. sapiens
aataacagcaatgaca

SEQ ID NO: 19154 - DNA, 16 bp, H. sapiens
aataacagctaccatt

SEQ ID NO: 19155 - DNA, 16 bp, H. sapiens
aataacaggctgggtg

SEQ ID NO: 19156 - DNA, 16 bp, H. sapiens
aataacatgaaaaatt

SEQ ID NO: 19157 - DNA, 16 bp, H. sapiens
aataacatggatgaat

SEQ ID NO: 19158 - DNA, 16 bp, H. sapiens
aataacatgttttaag

SEQ ID NO: 19159 - DNA, 16 bp, H. sapiens
aataacattacatttt

SEQ ID NO: 19160 - DNA, 16 bp, H. sapiens
aataacattgaatctg

SEQ ID NO: 19161 - DNA, 16 bp, H. sapiens
aataacattgaatgta

SEQ ID NO: 19162 - DNA, 16 bp, H. sapiens
aataacatttagaaaa

SEQ ID NO: 19163 - DNA, 16 bp, H. sapiens
aataacattttctgtt

SEQ ID NO: 19164 - DNA, 16 bp, H. sapiens
aataacatttttaagt

SEQ ID NO: 19165 - DNA, 16 bp, H. sapiens
aataacatttttcatt

SEQ ID NO: 19166 - DNA, 16 bp, H. sapiens
aataacattttttcct

SEQ ID NO: 19167 - DNA, 16 bp, H. sapiens
aataaccacatcatgg

SEQ ID NO: 19168 - DNA, 16 bp, H. sapiens
aataaccacatgaaaa

SEQ ID NO: 19169 - DNA, 16 bp, H. sapiens
aataaccagctagcat

SEQ ID NO: 19170 - DNA, 16 bp, H. sapiens
aataaccatattttaa

SEQ ID NO: 19171 - DNA, 16 bp, H. sapiens
aataactaaaaatgtg

SEQ ID NO: 19172 - DNA, 16 bp, H. sapiens
aataactataaaaagt

SEQ ID NO: 19173 - DNA, 16 bp, H. sapiens
aataactgaaatcaga

SEQ ID NO: 19174 - DNA, 16 bp, H. sapiens
aataactgagactggg

SEQ ID NO: 19175 - DNA, 16 bp, H. sapiens
aataactggaagaaaa

SEQ ID NO: 19176 - DNA, 16 bp, H. sapiens
aataactggattttaa

SEQ ID NO: 19177 - DNA, 16 bp, H. sapiens
aataacttatgggaaa

SEQ ID NO: 19178 - DNA, 16 bp, H. sapiens
aataacttcacataaa

SEQ ID NO: 19179 - DNA, 16 bp, H. sapiens
aataacttcagataaa

SEQ ID NO: 19180 - DNA, 16 bp, H. sapiens
aataacttgcccaggg

SEQ ID NO: 19181 - DNA, 16 bp, H. sapiens
aataactttaaaagta

SEQ ID NO: 19182 - DNA, 16 bp, H. sapiens
aataactttcttttct

SEQ ID NO: 19183 - DNA, 16 bp, H. sapiens
aataactttgattttt

SEQ ID NO: 19184 - DNA, 16 bp, H. sapiens
aataacttttagattt

SEQ ID NO: 19185 - DNA, 16 bp, H. sapiens
aataacttttcctttg

SEQ ID NO: 19186 - DNA, 16 bp, H. sapiens
aataagaacacatgga

SEQ ID NO: 19187 - DNA, 16 bp, H. sapiens
aataagaaccatctat

SEQ ID NO: 19188 - DNA, 16 bp, H. sapiens
aataagaatctatttt

SEQ ID NO: 19189 - DNA, 16 bp, H. sapiens
aataagacatactatt

SEQ ID NO: 19190 - DNA, 16 bp, H. sapiens
aataagacattgaaaa

SEQ ID NO: 19191 - DNA, 16 bp, H. sapiens
aataagacattttgag

SEQ ID NO: 19192 - DNA, 16 bp, H. sapiens
aataagactccatctc

SEQ ID NO: 19193 - DNA, 16 bp, H. sapiens
aataagagaaaaggca

SEQ ID NO: 19194 - DNA, 16 bp, H. sapiens
aataagaggacacaaa

SEQ ID NO: 19195 - DNA, 16 bp, H. sapiens
aataagatcatgtcct

SEQ ID NO: 19196 - DNA, 16 bp, H. sapiens
aataagattgatagac

SEQ ID NO: 19197 - DNA, 16 bp, H. sapiens
aataagatttttcaaa

SEQ ID NO: 19198 - DNA, 16 bp, H. sapiens
aataagcacaatcaaa

SEQ ID NO: 19199 - DNA, 16 bp, H. sapiens
aataagcacttaaaaa

SEQ ID NO: 19200 - DNA, 16 bp, H. sapiens
aataagcactttaaaa

SEQ ID NO: 19201 - DNA, 16 bp, H. sapiens
aataagcagaaataat

SEQ ID NO: 19202 - DNA, 16 bp, H. sapiens
aataagcatatgaaaa

SEQ ID NO: 19203 - DNA, 16 bp, H. sapiens
aataagcatattaaaa

SEQ ID NO: 19204 - DNA, 16 bp, H. sapiens
aataagccaggctcag

SEQ ID NO: 19205 - DNA, 16 bp, H. sapiens
aataagccagtcacca

SEQ ID NO: 19206 - DNA, 16 bp, H. sapiens
aataagccagttacca

SEQ ID NO: 19207 - DNA, 16 bp, H. sapiens
aataaggaaaatatgg

SEQ ID NO: 19208 - DNA, 16 bp, H. sapiens
aataaggaaattgaga

SEQ ID NO: 19209 - DNA, 16 bp, H. sapiens
aataaggacataaaga

SEQ ID NO: 19210 - DNA, 16 bp, H. sapiens
aataaggacatgaaaa

SEQ ID NO: 19211 - DNA, 16 bp, H. sapiens
aataaggatcagagca

SEQ ID NO: 19212 - DNA, 16 bp, H. sapiens
aataaggatgttcttt

SEQ ID NO: 19213 - DNA, 16 bp, H. sapiens
aataaggcaaatgcca

SEQ ID NO: 19214 - DNA, 16 bp, H. sapiens
aataagggctgggcac

SEQ ID NO: 19215 - DNA, 16 bp, H. sapiens
aataaggggatggagg

SEQ ID NO: 19216 - DNA, 16 bp, H. sapiens
aataaggtatttttaa

SEQ ID NO: 19217 - DNA, 16 bp, H. sapiens
aataagtatatggaaa

SEQ ID NO: 19218 - DNA, 16 bp, H. sapiens
aataagtctcatgaga

SEQ ID NO: 19219 - DNA, 16 bp, H. sapiens
aataagtgtgtgtgtg

SEQ ID NO: 19220 - DNA, 16 bp, H. sapiens
aataagttcacattca

SEQ ID NO: 19221 - DNA, 16 bp, H. sapiens
aataagttgcagacat

SEQ ID NO: 19222 - DNA, 16 bp, H. sapiens
aataagtttcacaaga

SEQ ID NO: 19223 - DNA, 16 bp, H. sapiens
aataataaaagcttta

SEQ ID NO: 19224 - DNA, 16 bp, H. sapiens
aataataaaatactgt

SEQ ID NO: 19225 - DNA, 16 bp, H. sapiens
aataataaaatagcag

SEQ ID NO: 19226 - DNA, 16 bp, H. sapiens
aataataaagacattt

SEQ ID NO: 19227 - DNA, 16 bp, H. sapiens
aataataacaatagca

SEQ ID NO: 19228 - DNA, 16 bp, H. sapiens
aataataacagtaata

SEQ ID NO: 19229 - DNA, 16 bp, H. sapiens
aataataaccatttta

SEQ ID NO: 19230 - DNA, 16 bp, H. sapiens
aataataactcattta

SEQ ID NO: 19231 - DNA, 16 bp, H. sapiens
aataataataggctgg

SEQ ID NO: 19232 - DNA, 16 bp, H. sapiens
aataataatagtacct

SEQ ID NO: 19233 - DNA, 16 bp, H. sapiens
aataataatattgatg

SEQ ID NO: 19234 - DNA, 16 bp, H. sapiens
aataataatctcattt

SEQ ID NO: 19235 - DNA, 16 bp, H. sapiens
aataataatgaaagct

SEQ ID NO: 19236 - DNA, 16 bp, H. sapiens
aataataatgacaata

SEQ ID NO: 19237 - DNA, 16 bp, H. sapiens
aataataatgctaata

SEQ ID NO: 19238 - DNA, 16 bp, H. sapiens
aataataatggctaac

SEQ ID NO: 19239 - DNA, 16 bp, H. sapiens
aataataatggttatt

SEQ ID NO: 19240 - DNA, 16 bp, H. sapiens
aataatacagatttta

SEQ ID NO: 19241 - DNA, 16 bp, H. sapiens
aataatagaaatcata

SEQ ID NO: 19242 - DNA, 16 bp, H. sapiens
aataatagagaacttc

SEQ ID NO: 19243 - DNA, 16 bp, H. sapiens
aataatagctaataat

SEQ ID NO: 19244 - DNA, 16 bp, H. sapiens
aataatagtaacaata

SEQ ID NO: 19245 - DNA, 16 bp, H. sapiens
aataatagtacccact

SEQ ID NO: 19246 - DNA, 16 bp, H. sapiens
aataatatatcattgt

SEQ ID NO: 19247 - DNA, 16 bp, H. sapiens
aataatatgaaataca

SEQ ID NO: 19248 - DNA, 16 bp, H. sapiens
aataatatgtcattgt

SEQ ID NO: 19249 - DNA, 16 bp, H. sapiens
aataatattccattat

SEQ ID NO: 19250 - DNA, 16 bp, H. sapiens
aataatattctgtttt

SEQ ID NO: 19251 - DNA, 16 bp, H. sapiens
aataatatttgttgaa

SEQ ID NO: 19252 - DNA, 16 bp, H. sapiens
aataatattttcaaag

SEQ ID NO: 19253 - DNA, 16 bp, H. sapiens
aataatattttcttca

SEQ ID NO: 19254 - DNA, 16 bp, H. sapiens
aataatattttgttct

SEQ ID NO: 19255 - DNA, 16 bp, H. sapiens
aataatcaaatcagga

SEQ ID NO: 19256 - DNA, 16 bp, H. sapiens
aataatcaatcaatca

SEQ ID NO: 19257 - DNA, 16 bp, H. sapiens
aataatcagaatattt

SEQ ID NO: 19258 - DNA, 16 bp, H. sapiens
aataatcagcagtgat

SEQ ID NO: 19259 - DNA, 16 bp, H. sapiens
aataatcagtacaaca

SEQ ID NO: 19260 - DNA, 16 bp, H. sapiens
aataatcagtgttcct

SEQ ID NO: 19261 - DNA, 16 bp, H. sapiens
aataatcccactaaaa

SEQ ID NO: 19262 - DNA, 16 bp, H. sapiens
aataatcctctttggc

SEQ ID NO: 19263 - DNA, 16 bp, H. sapiens
aataatcctcttttct

SEQ ID NO: 19264 - DNA, 16 bp, H. sapiens
aataatcgaggaaaac

SEQ ID NO: 19265 - DNA, 16 bp, H. sapiens
aataatctgtaaaaaa

SEQ ID NO: 19266 - DNA, 16 bp, H. sapiens
aataatgaaaacattt

SEQ ID NO: 19267 - DNA, 16 bp, H. sapiens
aataatgataacaata

SEQ ID NO: 19268 - DNA, 16 bp, H. sapiens
aataatgataattttg

SEQ ID NO: 19269 - DNA, 16 bp, H. sapiens
aataatgatgataatg

SEQ ID NO: 19270 - DNA, 16 bp, H. sapiens
aataatgatgatgata

SEQ ID NO: 19271 - DNA, 16 bp, H. sapiens
aataatgattttgaaa

SEQ ID NO: 19272 - DNA, 16 bp, H. sapiens
aataatgcaaaaatta

SEQ ID NO: 19273 - DNA, 16 bp, H. sapiens
aataatgcaaattatt

SEQ ID NO: 19274 - DNA, 16 bp, H. sapiens
aataatgcaattaaaa

SEQ ID NO: 19275 - DNA, 16 bp, H. sapiens
aataatgctaccatga

SEQ ID NO: 19276 - DNA, 17 bp, H. sapiens
aataatgctgcaataaa

SEQ ID NO: 19277 - DNA, 16 bp, H. sapiens
aataatgctgctatga

SEQ ID NO: 19278 - DNA, 16 bp, H. sapiens
aataatgctgtaatga

SEQ ID NO: 19279 - DNA, 16 bp, H. sapiens
aataatgctgtgatga

SEQ ID NO: 19280 - DNA, 16 bp, H. sapiens
aataatgctttaaaaa

SEQ ID NO: 19281 - DNA, 16 bp, H. sapiens
aataatgctttttttt

SEQ ID NO: 19282 - DNA, 16 bp, H. sapiens
aataatggcccccaaa

SEQ ID NO: 19283 - DNA, 16 bp, H. sapiens
aataatggccctcaaa

SEQ ID NO: 19284 - DNA, 16 bp, H. sapiens
aataatggcctccaat

SEQ ID NO: 19285 - DNA, 16 bp, H. sapiens
aataatggctaacatt

SEQ ID NO: 19286 - DNA, 16 bp, H. sapiens
aataatgggattgctg

SEQ ID NO: 19287 - DNA, 16 bp, H. sapiens
aataatgtatatgtat

SEQ ID NO: 19288 - DNA, 16 bp, H. sapiens
aataatgtatattctt

SEQ ID NO: 19289 - DNA, 16 bp, H. sapiens
aataatgtcctttata

SEQ ID NO: 19290 - DNA, 16 bp, H. sapiens
aataatgtcttttaaa

SEQ ID NO: 19291 - DNA, 16 bp, H. sapiens
aataatgttaacattt

SEQ ID NO: 19292 - DNA, 16 bp, H. sapiens
aataatgttgggaaaa

SEQ ID NO: 19293 - DNA, 16 bp, H. sapiens
aataatgtttgaccaa

SEQ ID NO: 19294 - DNA, 16 bp, H. sapiens
aataatgtttgcttta

SEQ ID NO: 19295 - DNA, 16 bp, H. sapiens
aataatgttttaaaac

SEQ ID NO: 19296 - DNA, 16 bp, H. sapiens
aataatgttttaaaga

SEQ ID NO: 19297 - DNA, 16 bp, H. sapiens
aataatgttttagaaa

SEQ ID NO: 19298 - DNA, 16 bp, H. sapiens
aataatgttttcaagg

SEQ ID NO: 19299 - DNA, 16 bp, H. sapiens
aataattaaacaaatg

SEQ ID NO: 19300 - DNA, 16 bp, H. sapiens
aataattacaggaaaa

SEQ ID NO: 19301 - DNA, 16 bp, H. sapiens
aataattaccttgaat

SEQ ID NO: 19302 - DNA, 16 bp, H. sapiens
aataattactgaataa

SEQ ID NO: 19303 - DNA, 16 bp, H. sapiens
aataattagaaaacat

SEQ ID NO: 19304 - DNA, 16 bp, H. sapiens
aataattagtgatgtt

SEQ ID NO: 19305 - DNA, 16 bp, H. sapiens
aataattataatagca

SEQ ID NO: 19306 - DNA, 16 bp, H. sapiens
aataattatatgccaa

SEQ ID NO: 19307 - DNA, 16 bp, H. sapiens
aataattatctggccc

SEQ ID NO: 19308 - DNA, 16 bp, H. sapiens
aataattattcttcct

SEQ ID NO: 19309 - DNA, 16 bp, H. sapiens
aataattattttgcat

SEQ ID NO: 19310 - DNA, 16 bp, H. sapiens
aataattatttttcac

SEQ ID NO: 19311 - DNA, 16 bp, H. sapiens
aataattcaggaaaat

SEQ ID NO: 19312 - DNA, 16 bp, H. sapiens
aataattccattttct

SEQ ID NO: 19313 - DNA, 16 bp, H. sapiens
aataattccattttta

SEQ ID NO: 19314 - DNA, 16 bp, H. sapiens
aataattctgaaaaaa

SEQ ID NO: 19315 - DNA, 16 bp, H. sapiens
aataattgcacatatt

SEQ ID NO: 19316 - DNA, 16 bp, H. sapiens
aataattgcattaaat

SEQ ID NO: 19317 - DNA, 16 bp, H. sapiens
aataattgctattttt

SEQ ID NO: 19318 - DNA, 16 bp, H. sapiens
aataattggtattcct

SEQ ID NO: 19319 - DNA, 16 bp, H. sapiens
aataattggtcacagc

SEQ ID NO: 19320 - DNA, 16 bp, H. sapiens
aataattgtagattca

SEQ ID NO: 19321 - DNA, 16 bp, H. sapiens
aataattgtatctatt

SEQ ID NO: 19322 - DNA, 16 bp, H. sapiens
aataatttaaaaactg

SEQ ID NO: 19323 - DNA, 16 bp, H. sapiens
aataatttaagcaaaa

SEQ ID NO: 19324 - DNA, 16 bp, H. sapiens
aataatttactgtata

SEQ ID NO: 19325 - DNA, 16 bp, H. sapiens
aataatttcaacagaa

SEQ ID NO: 19326 - DNA, 16 bp, H. sapiens
aataatttctgaaatt

SEQ ID NO: 19327 - DNA, 16 bp, H. sapiens
aataatttctgtattt

SEQ ID NO: 19328 - DNA, 16 bp, H. sapiens
aataatttgaaatttg

SEQ ID NO: 19329 - DNA, 16 bp, H. sapiens
aataatttggaaaaac

SEQ ID NO: 19330 - DNA, 16 bp, H. sapiens
aataatttggaatttt

SEQ ID NO: 19331 - DNA, 16 bp, H. sapiens
aataatttgttacaca

SEQ ID NO: 19332 - DNA, 16 bp, H. sapiens
aataatttgttccttt

SEQ ID NO: 19333 - DNA, 16 bp, H. sapiens
aataatttgttttctt

SEQ ID NO: 19334 - DNA, 16 bp, H. sapiens
aataattttaaagact

SEQ ID NO: 19335 - DNA, 16 bp, H. sapiens
aataattttaagtgaa

SEQ ID NO: 19336 - DNA, 16 bp, H. sapiens
aataattttacattga

SEQ ID NO: 19337 - DNA, 16 bp, H. sapiens
aataattttcaaaaga

SEQ ID NO: 19338 - DNA, 16 bp, H. sapiens
aataattttgaaaatg

SEQ ID NO: 19339 - DNA, 16 bp, H. sapiens
aataattttgacctca

SEQ ID NO: 19340 - DNA, 16 bp, H. sapiens
aataattttgataatg

SEQ ID NO: 19341 - DNA, 16 bp, H. sapiens
aataattttgcaaata

SEQ ID NO: 19342 - DNA, 16 bp, H. sapiens
aataattttgtctaat

SEQ ID NO: 19343 - DNA, 16 bp, H. sapiens
aataattttgttcttt

SEQ ID NO: 19344 - DNA, 16 bp, H. sapiens
aataatttttccagga

SEQ ID NO: 19345 - DNA, 16 bp, H. sapiens
aataatttttgaaaca

SEQ ID NO: 19346 - DNA, 16 bp, H. sapiens
aatacaaaaagtagat

SEQ ID NO: 19347 - DNA, 16 bp, H. sapiens
aatacaaaaatcagct

SEQ ID NO: 19348 - DNA, 16 bp, H. sapiens
aatacaaaaatgaccc

SEQ ID NO: 19349 - DNA, 16 bp, H. sapiens
aatacaaaaatgtttt

SEQ ID NO: 19350 - DNA, 16 bp, H. sapiens
aatacaaaaattacct

SEQ ID NO: 19351 - DNA, 18 bp, H. sapiens
aatacaaaaattagccca

SEQ ID NO: 19352 - DNA, 16 bp, H. sapiens
aatacaaaagaaattt

SEQ ID NO: 19353 - DNA, 16 bp, H. sapiens
aatacaaaaggtaaat

SEQ ID NO: 19354 - DNA, 16 bp, H. sapiens
aatacaaaatgtatta

SEQ ID NO: 19355 - DNA, 16 bp, H. sapiens
aatacaaagaaacatt

SEQ ID NO: 19356 - DNA, 16 bp, H. sapiens
aatacaaagagaggaa

SEQ ID NO: 19357 - DNA, 16 bp, H. sapiens
aatacaaataaaatgt

SEQ ID NO: 19358 - DNA, 16 bp, H. sapiens
aatacaaatataaatg

SEQ ID NO: 19359 - DNA, 16 bp, H. sapiens
aatacaaatattccaa

SEQ ID NO: 19360 - DNA, 16 bp, H. sapiens
aatacaaatgttaata

SEQ ID NO: 19361 - DNA, 16 bp, H. sapiens
aatacaaattctcaga

SEQ ID NO: 19362 - DNA, 16 bp, H. sapiens
aatacaacctctatgg

SEQ ID NO: 19363 - DNA, 16 bp, H. sapiens
aatacaacttacaggg

SEQ ID NO: 19364 - DNA, 16 bp, H. sapiens
aatacaatcaagttga

SEQ ID NO: 19365 - DNA, 16 bp, H. sapiens
aatacaatggcatgat

SEQ ID NO: 19366 - DNA, 16 bp, H. sapiens
aatacaatgtaaatac

SEQ ID NO: 19367 - DNA, 16 bp, H. sapiens
aatacaattttagaat

SEQ ID NO: 19368 - DNA, 16 bp, H. sapiens
aatacacacagaaaca

SEQ ID NO: 19369 - DNA, 16 bp, H. sapiens
aatacacacatttatt

SEQ ID NO: 19370 - DNA, 16 bp, H. sapiens
aatacacataacattt

SEQ ID NO: 19371 - DNA, 16 bp, H. sapiens
aatacacatatacaca

SEQ ID NO: 19372 - DNA, 16 bp, H. sapiens
aatacacatgcataca

SEQ ID NO: 19373 - DNA, 16 bp, H. sapiens
aatacacatgtacaca

SEQ ID NO: 19374 - DNA, 16 bp, H. sapiens
aatacacatttattat

SEQ ID NO: 19375 - DNA, 16 bp, H. sapiens
aatacacatttgaaaa

SEQ ID NO: 19376 - DNA, 16 bp, H. sapiens
aatacacatttgttga

SEQ ID NO: 19377 - DNA, 16 bp, H. sapiens
aatacaccaataacag

SEQ ID NO: 19378 - DNA, 16 bp, H. sapiens
aatacactgtggaaag

SEQ ID NO: 19379 - DNA, 16 bp, H. sapiens
aatacagaaaactggt

SEQ ID NO: 19380 - DNA, 16 bp, H. sapiens
aatacagaaaagtaca

SEQ ID NO: 19381 - DNA, 16 bp, H. sapiens
aatacagaaagatgga

SEQ ID NO: 19382 - DNA, 16 bp, H. sapiens
aatacagaagaaaatg

SEQ ID NO: 19383 - DNA, 16 bp, H. sapiens
aatacagaagaatgaa

SEQ ID NO: 19384 - DNA, 16 bp, H. sapiens
aatacagaagcagaaa

SEQ ID NO: 19385 - DNA, 16 bp, H. sapiens
aatacagaatgggtag

SEQ ID NO: 19386 - DNA, 16 bp, H. sapiens
aatacagacacacaca

SEQ ID NO: 19387 - DNA, 16 bp, H. sapiens
aatacagagaaacaat

SEQ ID NO: 19388 - DNA, 16 bp, H. sapiens
aatacagagaacatca

SEQ ID NO: 19389 - DNA, 16 bp, H. sapiens
aatacagagacagaaa

SEQ ID NO: 19390 - DNA, 16 bp, H. sapiens
aatacagagagaaaat

SEQ ID NO: 19391 - DNA, 16 bp, H. sapiens
aatacagagagatcct

SEQ ID NO: 19392 - DNA, 16 bp, H. sapiens
aatacagatatctctt

SEQ ID NO: 19393 - DNA, 16 bp, H. sapiens
aatacagatgaagctt

SEQ ID NO: 19394 - DNA, 16 bp, H. sapiens
aatacagattttgata

SEQ ID NO: 19395 - DNA, 16 bp, H. sapiens
aatacagcaccttcaa

SEQ ID NO: 19396 - DNA, 16 bp, H. sapiens
aatacagcagtgaaca

SEQ ID NO: 19397 - DNA, 16 bp, H. sapiens
aatacaggaacaccca

SEQ ID NO: 19398 - DNA, 16 bp, H. sapiens
aatacaggaacagaaa

SEQ ID NO: 19399 - DNA, 25 bp, H. sapiens
aatacaggagcacctagattcataa

SEQ ID NO: 19400 - DNA, 16 bp, H. sapiens
aatacaggcttctgat

SEQ ID NO: 19401 - DNA, 16 bp, H. sapiens
aatacaggttgagtat

SEQ ID NO: 19402 - DNA, 19 bp, H. sapiens
aatacagtaaattggtact

SEQ ID NO: 19403 - DNA, 16 bp, H. sapiens
aatacagtaagatatt

SEQ ID NO: 19404 - DNA, 16 bp, H. sapiens
aatacagtagccactg

SEQ ID NO: 19405 - DNA, 16 bp, H. sapiens
aatacagtattttaaa

SEQ ID NO: 19406 - DNA, 16 bp, H. sapiens
aatacagttgaccctt

SEQ ID NO: 19407 - DNA, 16 bp, H. sapiens
aatacagtttaatttt

SEQ ID NO: 19408 - DNA, 16 bp, H. sapiens
aatacagtttttaaaa

SEQ ID NO: 19409 - DNA, 16 bp, H. sapiens
aatacataaacaaatg

SEQ ID NO: 19410 - DNA, 16 bp, H. sapiens
aatacataaagaaatg

SEQ ID NO: 19411 - DNA, 16 bp, H. sapiens
aatacatacatacaca

SEQ ID NO: 19412 - DNA, 16 bp, H. sapiens
aatacatatataaatg

SEQ ID NO: 19413 - DNA, 16 bp, H. sapiens
aatacatattttaaca

SEQ ID NO: 19414 - DNA, 16 bp, H. sapiens
aatacatatttttact

SEQ ID NO: 19415 - DNA, 16 bp, H. sapiens
aatacatatttttctc

SEQ ID NO: 19416 - DNA, 16 bp, H. sapiens
aatacatatttttgaa

SEQ ID NO: 19417 - DNA, 16 bp, H. sapiens
aatacatctcatgaga

SEQ ID NO: 19418 - DNA, 16 bp, H. sapiens
aatacatgaagaaaat

SEQ ID NO: 19419 - DNA, 16 bp, H. sapiens
aatacatgaggctggg

SEQ ID NO: 19420 - DNA, 16 bp, H. sapiens
aatacatgtaaaatgt

SEQ ID NO: 19421 - DNA, 16 bp, H. sapiens
aatacatgtaaaattt

SEQ ID NO: 19422 - DNA, 16 bp, H. sapiens
aatacatgtatataat

SEQ ID NO: 19423 - DNA, 16 bp, H. sapiens
aatacatgtgaggtat

SEQ ID NO: 19424 - DNA, 16 bp, H. sapiens
aatacattaaaaagat

SEQ ID NO: 19425 - DNA, 16 bp, H. sapiens
aatacattatcttatt

SEQ ID NO: 19426 - DNA, 16 bp, H. sapiens
aatacattattactaa

SEQ ID NO: 19427 - DNA, 16 bp, H. sapiens
aatacattgaaaattt

SEQ ID NO: 19428 - DNA, 16 bp, H. sapiens
aatacattgataaatt

SEQ ID NO: 19429 - DNA, 16 bp, H. sapiens
aatacattgtggaatg

SEQ ID NO: 19430 - DNA, 16 bp, H. sapiens
aatacatttatgtata

SEQ ID NO: 19431 - DNA, 16 bp, H. sapiens
aatacatttgtattta

SEQ ID NO: 19432 - DNA, 16 bp, H. sapiens
aatacatttgtatttt

SEQ ID NO: 19433 - DNA, 16 bp, H. sapiens
aatacatttgtttttt

SEQ ID NO: 19434 - DNA, 16 bp, H. sapiens
aatacattttagaaaa

SEQ ID NO: 19435 - DNA, 16 bp, H. sapiens
aatacattttatgaaa

SEQ ID NO: 19436 - DNA, 16 bp, H. sapiens
aatacattttcaaaat

SEQ ID NO: 19437 - DNA, 16 bp, H. sapiens
aatacattttcatttc

SEQ ID NO: 19438 - DNA, 16 bp, H. sapiens
aatacattttccaaaa

SEQ ID NO: 19439 - DNA, 16 bp, H. sapiens
aatacattttgtaaaa

SEQ ID NO: 19440 - DNA, 16 bp, H. sapiens
aatacattttgttaaa

SEQ ID NO: 19441 - DNA, 16 bp, H. sapiens
aatacatttttaaaga

SEQ ID NO: 19442 - DNA, 16 bp, H. sapiens
aatacatttttaaatg

SEQ ID NO: 19443 - DNA, 16 bp, H. sapiens
aatacatttttatcaa

SEQ ID NO: 19444 - DNA, 16 bp, H. sapiens
aatacatttttgaaat

SEQ ID NO: 19445 - DNA, 16 bp, H. sapiens
aatacatttttgtatt

SEQ ID NO: 19446 - DNA, 16 bp, H. sapiens
aatacattttttgttt

SEQ ID NO: 19447 - DNA, 16 bp, H. sapiens
aataccaaatatttta

SEQ ID NO: 19448 - DNA, 16 bp, H. sapiens
aataccaacattaaca

SEQ ID NO: 19449 - DNA, 16 bp, H. sapiens
aataccacagaagtga

SEQ ID NO: 19450 - DNA, 16 bp, H. sapiens
aataccacagactgag

SEQ ID NO: 19451 - DNA, 16 bp, H. sapiens
aataccacattttctc

SEQ ID NO: 19452 - DNA, 17 bp, H. sapiens
aataccaccatcattct

SEQ ID NO: 19453 - DNA, 16 bp, H. sapiens
aataccacctgctccc

SEQ ID NO: 19454 - DNA, 16 bp, H. sapiens
aataccactactaaaa

SEQ ID NO: 19455 - DNA, 16 bp, H. sapiens
aataccatcacattag

SEQ ID NO: 19456 - DNA, 16 bp, H. sapiens
aataccatcacattgg

SEQ ID NO: 19457 - DNA, 16 bp, H. sapiens
aataccatgattgttt

SEQ ID NO: 19458 - DNA, 16 bp, H. sapiens
aataccatgctgtttt

SEQ ID NO: 19459 - DNA, 16 bp, H. sapiens
aataccattctggaca

SEQ ID NO: 19460 - DNA, 16 bp, H. sapiens
aataccattttggaca

SEQ ID NO: 19461 - DNA, 16 bp, H. sapiens
aataccctttacttct

SEQ ID NO: 19462 - DNA, 16 bp, H. sapiens
aataccctttattttc

SEQ ID NO: 19463 - DNA, 16 bp, H. sapiens
aatacctaacacaatg

SEQ ID NO: 19464 - DNA, 16 bp, H. sapiens
aatacctgagactggg

SEQ ID NO: 19465 - DNA, 16 bp, H. sapiens
aatacctgtatcccca

SEQ ID NO: 19466 - DNA, 16 bp, H. sapiens
aatacctttaaaatat

SEQ ID NO: 19467 - DNA, 16 bp, H. sapiens
aataccttttatttcc

SEQ ID NO: 19468 - DNA, 16 bp, H. sapiens
aatacgcacacacaca

SEQ ID NO: 19469 - DNA, 16 bp, H. sapiens
aatactaatgtcattt

SEQ ID NO: 19470 - DNA, 16 bp, H. sapiens
aatactacacagctgt

SEQ ID NO: 19471 - DNA, 16 bp, H. sapiens
aatactactactaata

SEQ ID NO: 19472 - DNA, 16 bp, H. sapiens
aatactatattgaata

SEQ ID NO: 19473 - DNA, 16 bp, H. sapiens
aatactatgaaaaatt

SEQ ID NO: 19474 - DNA, 22 bp, H. sapiens
aatactatgcagccataaaaag

SEQ ID NO: 19475 - DNA, 21 bp, H. sapiens
aatactatgtagccataaaaa

SEQ ID NO: 19476 - DNA, 16 bp, H. sapiens
aatactattccattgt

SEQ ID NO: 19477 - DNA, 16 bp, H. sapiens
aatactattctattgt

SEQ ID NO: 19478 - DNA, 16 bp, H. sapiens
aatactatttggcaat

SEQ ID NO: 19479 - DNA, 16 bp, H. sapiens
aatactatttggccat

SEQ ID NO: 19480 - DNA, 16 bp, H. sapiens
aatactgaaaagaaat

SEQ ID NO: 19481 - DNA, 16 bp, H. sapiens
aatactgaagaagaaa

SEQ ID NO: 19482 - DNA, 16 bp, H. sapiens
aatactgaagaagaac

SEQ ID NO: 19483 - DNA, 16 bp, H. sapiens
aatactgatataaaac

SEQ ID NO: 19484 - DNA, 16 bp, H. sapiens
aatactgatttttaaa

SEQ ID NO: 19485 - DNA, 16 bp, H. sapiens
aatactgcatgttatc

SEQ ID NO: 19486 - DNA, 16 bp, H. sapiens
aatactggagaagaga

SEQ ID NO: 19487 - DNA, 16 bp, H. sapiens
aatactgtaggcagtt

SEQ ID NO: 19488 - DNA, 16 bp, H. sapiens
aatactgtatagcaag

SEQ ID NO: 19489 - DNA, 16 bp, H. sapiens
aatactgtattgaata

SEQ ID NO: 19490 - DNA, 16 bp, H. sapiens
aatactgtattgtaca

SEQ ID NO: 19491 - DNA, 16 bp, H. sapiens
aatactgtattttcaa

SEQ ID NO: 19492 - DNA, 16 bp, H. sapiens
aatactgtcaacttga

SEQ ID NO: 19493 - DNA, 16 bp, H. sapiens
aatactgtgaagaaag

SEQ ID NO: 19494 - DNA, 16 bp, H. sapiens
aatactgttgaatgaa

SEQ ID NO: 19495 - DNA, 16 bp, H. sapiens
aatactgtttccaaac

SEQ ID NO: 19496 - DNA, 16 bp, H. sapiens
aatacttactgagcat

SEQ ID NO: 19497 - DNA, 16 bp, H. sapiens
aatacttcattgtatg

SEQ ID NO: 19498 - DNA, 16 bp, H. sapiens
aatacttctgatttct

SEQ ID NO: 19499 - DNA, 16 bp, H. sapiens
aatacttcttgaatga

SEQ ID NO: 19500 - DNA, 16 bp, H. sapiens
aatacttgtgattttt

SEQ ID NO: 19501 - DNA, 16 bp, H. sapiens
aatacttgttttaaaa

SEQ ID NO: 19502 - DNA, 16 bp, H. sapiens
aatacttgtttttctt

SEQ ID NO: 19503 - DNA, 16 bp, H. sapiens
aatacttttaaagaaa

SEQ ID NO: 19504 - DNA, 16 bp, H. sapiens
aatacttttgaaaaat

SEQ ID NO: 19505 - DNA, 16 bp, H. sapiens
aatactttttagaaaa

SEQ ID NO: 19506 - DNA, 16 bp, H. sapiens
aatactttttgaaatt

SEQ ID NO: 19507 - DNA, 16 bp, H. sapiens
aatagaaaaagaagtc

SEQ ID NO: 19508 - DNA, 16 bp, H. sapiens
aatagaaaaataagct

SEQ ID NO: 19509 - DNA, 16 bp, H. sapiens
aatagaaaaattagca

SEQ ID NO: 19510 - DNA, 16 bp, H. sapiens
aatagaaaaatttctt

SEQ ID NO: 19511 - DNA, 16 bp, H. sapiens
aatagaaaacctaaat

SEQ ID NO: 19512 - DNA, 16 bp, H. sapiens
aatagaaaacctgaaa

SEQ ID NO: 19513 - DNA, 16 bp, H. sapiens
aatagaaaatctaaac

SEQ ID NO: 19514 - DNA, 16 bp, H. sapiens
aatagaaaatgttttt

SEQ ID NO: 19515 - DNA, 16 bp, H. sapiens
aatagaaacacatttt

SEQ ID NO: 19516 - DNA, 16 bp, H. sapiens
aatagaaacgctttta

SEQ ID NO: 19517 - DNA, 16 bp, H. sapiens
aatagaaactattcaa

SEQ ID NO: 19518 - DNA, 16 bp, H. sapiens
aatagaaacttccaaa

SEQ ID NO: 19519 - DNA, 16 bp, H. sapiens
aatagaaagataattc

SEQ ID NO: 19520 - DNA, 16 bp, H. sapiens
aatagaaataaaaggc

SEQ ID NO: 19521 - DNA, 16 bp, H. sapiens
aatagaaataaatact

SEQ ID NO: 19522 - DNA, 16 bp, H. sapiens
aatagaaatactttta

SEQ ID NO: 19523 - DNA, 16 bp, H. sapiens
aatagaaatgattttt

SEQ ID NO: 19524 - DNA, 16 bp, H. sapiens
aatagaaatgcaaatt

SEQ ID NO: 19525 - DNA, 16 bp, H. sapiens
aatagaaattctaaaa

SEQ ID NO: 19526 - DNA, 16 bp, H. sapiens
aatagaagaaaaactt

SEQ ID NO: 19527 - DNA, 17 bp, H. sapiens
aatagaagaacattcca

SEQ ID NO: 19528 - DNA, 16 bp, H. sapiens
aatagaagtgacaaga

SEQ ID NO: 19529 - DNA, 16 bp, H. sapiens
aatagaatacagcaga

SEQ ID NO: 19530 - DNA, 16 bp, H. sapiens
aatagaatacatttta

SEQ ID NO: 19531 - DNA, 16 bp, H. sapiens
aatagaatcaaacaag

SEQ ID NO: 19532 - DNA, 16 bp, H. sapiens
aatagaatgggaggca

SEQ ID NO: 19533 - DNA, 16 bp, H. sapiens
aatagaattcagctgt

SEQ ID NO: 19534 - DNA, 16 bp, H. sapiens
aatagaattttatttg

SEQ ID NO: 19535 - DNA, 16 bp, H. sapiens
aatagacaaatccaca

SEQ ID NO: 19536 - DNA, 16 bp, H. sapiens
aatagacacaatagaa

SEQ ID NO: 19537 - DNA, 16 bp, H. sapiens
aatagacactggggac

SEQ ID NO: 19538 - DNA, 16 bp, H. sapiens
aatagacacttcacaa

SEQ ID NO: 19539 - DNA, 16 bp, H. sapiens
aatagacattctcaaa

SEQ ID NO: 19540 - DNA, 16 bp, H. sapiens
aatagaccaataacaa

SEQ ID NO: 19541 - DNA, 16 bp, H. sapiens
aatagacctataacaa

SEQ ID NO: 19542 - DNA, 16 bp, H. sapiens
aatagaccttattttt

SEQ ID NO: 19543 - DNA, 16 bp, H. sapiens
aatagactatttttta

SEQ ID NO: 19544 - DNA, 26 bp, H. sapiens
aatagactggattaagaaaatgtggc

SEQ ID NO: 19545 - DNA, 16 bp, H. sapiens
aatagacttttatttt

SEQ ID NO: 19546 - DNA, 16 bp, H. sapiens
aatagactttttaaaa

SEQ ID NO: 19547 - DNA, 16 bp, H. sapiens
aatagactttttaggt

SEQ ID NO: 19548 - DNA, 16 bp, H. sapiens
aatagagaaaagattt

SEQ ID NO: 19549 - DNA, 16 bp, H. sapiens
aatagagaaaatacag

SEQ ID NO: 19550 - DNA, 16 bp, H. sapiens
aatagagaatattttt

SEQ ID NO: 19551 - DNA, 16 bp, H. sapiens
aatagagacaaagttt

SEQ ID NO: 19552 - DNA, 16 bp, H. sapiens
aatagagacagaaagt

SEQ ID NO: 19553 - DNA, 16 bp, H. sapiens
aatagagagcccagaa

SEQ ID NO: 19554 - DNA, 16 bp, H. sapiens
aatagagccagactct

SEQ ID NO: 19555 - DNA, 16 bp, H. sapiens
aatagagtgaaaccct

SEQ ID NO: 19556 - DNA, 16 bp, H. sapiens
aatagagtgagactct

SEQ ID NO: 19557 - DNA, 16 bp, H. sapiens
aatagagttgtttgtt

SEQ ID NO: 19558 - DNA, 16 bp, H. sapiens
aatagagtttttaaaa

SEQ ID NO: 19559 - DNA, 16 bp, H. sapiens
aatagataaaacaatt

SEQ ID NO: 19560 - DNA, 16 bp, H. sapiens
aatagataaattcata

SEQ ID NO: 19561 - DNA, 16 bp, H. sapiens
aatagataattctcaa

SEQ ID NO: 19562 - DNA, 16 bp, H. sapiens
aatagataatttgaat

SEQ ID NO: 19563 - DNA, 16 bp, H. sapiens
aatagatactgccaaa

SEQ ID NO: 19564 - DNA, 16 bp, H. sapiens
aatagatattcaataa

SEQ ID NO: 19565 - DNA, 16 bp, H. sapiens
aatagatatttcacaa

SEQ ID NO: 19566 - DNA, 16 bp, H. sapiens
aatagatgaataaatg

SEQ ID NO: 19567 - DNA, 16 bp, H. sapiens
aatagatgcaagaaaa

SEQ ID NO: 19568 - DNA, 16 bp, H. sapiens
aatagatgcagaaaaa

SEQ ID NO: 19569 - DNA, 16 bp, H. sapiens
aatagatgctgaaaag

SEQ ID NO: 19570 - DNA, 16 bp, H. sapiens
aatagattattgttaa

SEQ ID NO: 19571 - DNA, 16 bp, H. sapiens
aatagattcagaagga

SEQ ID NO: 19572 - DNA, 16 bp, H. sapiens
aatagcaaagaataat

SEQ ID NO: 19573 - DNA, 30 bp, H. sapiens
aatagcaaagacttggaaccaacccaaatg

SEQ ID NO: 19574 - DNA, 16 bp, H. sapiens
aatagcaaataaatga

SEQ ID NO: 19575 - DNA, 16 bp, H. sapiens
aatagcaacaggaggt

SEQ ID NO: 19576 - DNA, 16 bp, H. sapiens
aatagcaatttatttt

SEQ ID NO: 19577 - DNA, 16 bp, H. sapiens
aatagcatgaacccgg

SEQ ID NO: 19578 - DNA, 16 bp, H. sapiens
aatagcatgggaaaaa

SEQ ID NO: 19579 - DNA, 16 bp, H. sapiens
aatagcattaaaaaat

SEQ ID NO: 19580 - DNA, 16 bp, H. sapiens
aatagcattatgtcta

SEQ ID NO: 19581 - DNA, 16 bp, H. sapiens
aatagcattatttata

SEQ ID NO: 19582 - DNA, 16 bp, H. sapiens
aatagccaaaaagtgg

SEQ ID NO: 19583 - DNA, 16 bp, H. sapiens
aatagccaaaagagaa

SEQ ID NO: 19584 - DNA, 16 bp, H. sapiens
aatagcctcctaactg

SEQ ID NO: 19585 - DNA, 16 bp, H. sapiens
aatagcctgccaacca

SEQ ID NO: 19586 - DNA, 16 bp, H. sapiens
aatagcctgggcaaca

SEQ ID NO: 19587 - DNA, 16 bp, H. sapiens
aatagctaatgcatgt

SEQ ID NO: 19588 - DNA, 16 bp, H. sapiens
aatagctattattaaa

SEQ ID NO: 19589 - DNA, 16 bp, H. sapiens
aatagctcattatttt

SEQ ID NO: 19590 - DNA, 16 bp, H. sapiens
aatagctccagctttg

SEQ ID NO: 19591 - DNA, 16 bp, H. sapiens
aatagctgggactaca

SEQ ID NO: 19592 - DNA, 16 bp, H. sapiens
aatagctgggactaga

SEQ ID NO: 19593 - DNA, 19 bp, H. sapiens
aatagcttaccaactaaaa

SEQ ID NO: 19594 - DNA, 16 bp, H. sapiens
aatagcttttcttttt

SEQ ID NO: 19595 - DNA, 16 bp, H. sapiens
aataggaaaaatgtct

SEQ ID NO: 19596 - DNA, 20 bp, H. sapiens
aataggaacagctccagtct

SEQ ID NO: 19597 - DNA, 16 bp, H. sapiens
aataggacctacctca

SEQ ID NO: 19598 - DNA, 16 bp, H. sapiens
aataggagctatttat

SEQ ID NO: 19599 - DNA, 16 bp, H. sapiens
aataggattcttgctg

SEQ ID NO: 19600 - DNA, 16 bp, H. sapiens
aataggcaaaagacat

SEQ ID NO: 19601 - DNA, 16 bp, H. sapiens
aataggcaaaatattt

SEQ ID NO: 19602 - DNA, 16 bp, H. sapiens
aataggctgcctgcaa

SEQ ID NO: 19603 - DNA, 19 bp, H. sapiens
aatagggaatcctttccct

SEQ ID NO: 19604 - DNA, 16 bp, H. sapiens
aatagggaatctttcc

SEQ ID NO: 19605 - DNA, 16 bp, H. sapiens
aatagggaggcccaag

SEQ ID NO: 19606 - DNA, 28 bp, H. sapiens
aatagggctgccaatcctccagttaaca

SEQ ID NO: 19607 - DNA, 16 bp, H. sapiens
aatagggtcttgctat

SEQ ID NO: 19608 - DNA, 16 bp, H. sapiens
aataggtaatttttca

SEQ ID NO: 19609 - DNA, 16 bp, H. sapiens
aataggtactcaataa

SEQ ID NO: 19610 - DNA, 16 bp, H. sapiens
aataggtgggactaca

SEQ ID NO: 19611 - DNA, 16 bp, H. sapiens
aataggtgttcaataa

SEQ ID NO: 19612 - DNA, 16 bp, H. sapiens
aatagtaactacctca

SEQ ID NO: 19613 - DNA, 16 bp, H. sapiens
aatagtattccattgt

SEQ ID NO: 19614 - DNA, 16 bp, H. sapiens
aatagtattgaatctg

SEQ ID NO: 19615 - DNA, 16 bp, H. sapiens
aatagtatttcattgt

SEQ ID NO: 19616 - DNA, 16 bp, H. sapiens
aatagtattttctttt

SEQ ID NO: 19617 - DNA, 16 bp, H. sapiens
aatagtcatttctcaa

SEQ ID NO: 19618 - DNA, 16 bp, H. sapiens
aatagtcatttttaaa

SEQ ID NO: 19619 - DNA, 16 bp, H. sapiens
aatagtcccaaactgg

SEQ ID NO: 19620 - DNA, 16 bp, H. sapiens
aatagtccctgggcct

SEQ ID NO: 19621 - DNA, 16 bp, H. sapiens
aatagtctgtcttcag

SEQ ID NO: 19622 - DNA, 16 bp, H. sapiens
aatagtgaaagactga

SEQ ID NO: 19623 - DNA, 16 bp, H. sapiens
aatagtgagaacacat

SEQ ID NO: 19624 - DNA, 16 bp, H. sapiens
aatagtgccacaataa

SEQ ID NO: 19625 - DNA, 16 bp, H. sapiens
aatagtgtacatttta

SEQ ID NO: 19626 - DNA, 16 bp, H. sapiens
aatagtgtcaataaga

SEQ ID NO: 19627 - DNA, 16 bp, H. sapiens
aatagtgtggagacca

SEQ ID NO: 19628 - DNA, 16 bp, H. sapiens
aatagtgttaggaaaa

SEQ ID NO: 19629 - DNA, 16 bp, H. sapiens
aatagttacttggttt

SEQ ID NO: 19630 - DNA, 16 bp, H. sapiens
aatagttatattttct

SEQ ID NO: 19631 - DNA, 16 bp, H. sapiens
aatagttatttgaaaa

SEQ ID NO: 19632 - DNA, 16 bp, H. sapiens
aatagttatttttttc

SEQ ID NO: 19633 - DNA, 16 bp, H. sapiens
aatagttgtatatatt

SEQ ID NO: 19634 - DNA, 16 bp, H. sapiens
aatagttgttttttct

SEQ ID NO: 19635 - DNA, 16 bp, H. sapiens
aatagtttctaaaaat

SEQ ID NO: 19636 - DNA, 16 bp, H. sapiens
aatagtttgttctttt

SEQ ID NO: 19637 - DNA, 16 bp, H. sapiens
aatagttttctttctt

SEQ ID NO: 19638 - DNA, 16 bp, H. sapiens
aatagttttgacctca

SEQ ID NO: 19639 - DNA, 16 bp, H. sapiens
aatataaaatgaacat

SEQ ID NO: 19640 - DNA, 16 bp, H. sapiens
aatataaacaaatgta

SEQ ID NO: 19641 - DNA, 16 bp, H. sapiens
aatataaaccatttta

SEQ ID NO: 19642 - DNA, 16 bp, H. sapiens
aatataaagaatttct

SEQ ID NO: 19643 - DNA, 16 bp, H. sapiens
aatataaatacatgta

SEQ ID NO: 19644 - DNA, 16 bp, H. sapiens
aatataaatatttctg

SEQ ID NO: 19645 - DNA, 16 bp, H. sapiens
aatataaatgattcta

SEQ ID NO: 19646 - DNA, 16 bp, H. sapiens
aatataaatgcaaata

SEQ ID NO: 19647 - DNA, 16 bp, H. sapiens
aatataaatgtacttt

SEQ ID NO: 19648 - DNA, 16 bp, H. sapiens
aatataaattattcca

SEQ ID NO: 19649 - DNA, 16 bp, H. sapiens
aatataaatttctgaa

SEQ ID NO: 19650 - DNA, 16 bp, H. sapiens
aatataaatttctgtt

SEQ ID NO: 19651 - DNA, 16 bp, H. sapiens
aatataaatttgtgtt

SEQ ID NO: 19652 - DNA, 16 bp, H. sapiens
aatataaattttggag

SEQ ID NO: 19653 - DNA, 16 bp, H. sapiens
aatataacatgaaaat

SEQ ID NO: 19654 - DNA, 16 bp, H. sapiens
aatataactaccatat

SEQ ID NO: 19655 - DNA, 16 bp, H. sapiens
aatataagaaggcagg

SEQ ID NO: 19656 - DNA, 16 bp, H. sapiens
aatataagtgagatca

SEQ ID NO: 19657 - DNA, 16 bp, H. sapiens
aatataatatcagaaa

SEQ ID NO: 19658 - DNA, 16 bp, H. sapiens
aatataatgaaaatgg

SEQ ID NO: 19659 - DNA, 16 bp, H. sapiens
aatataattactgata

SEQ ID NO: 19660 - DNA, 16 bp, H. sapiens
aatatacaaagaacac

SEQ ID NO: 19661 - DNA, 16 bp, H. sapiens
aatatacacaagtcaa

SEQ ID NO: 19662 - DNA, 16 bp, H. sapiens
aatatacagaatataa

SEQ ID NO: 19663 - DNA, 16 bp, H. sapiens
aatatacagataaaat

SEQ ID NO: 19664 - DNA, 16 bp, H. sapiens
aatatacatctttaat

SEQ ID NO: 19665 - DNA, 16 bp, H. sapiens
aatatacatgtgaaaa

SEQ ID NO: 19666 - DNA, 16 bp, H. sapiens
aatatacatttatatg

SEQ ID NO: 19667 - DNA, 16 bp, H. sapiens
aatatacatttccttt

SEQ ID NO: 19668 - DNA, 16 bp, H. sapiens
aatatacatttgaaaa

SEQ ID NO: 19669 - DNA, 16 bp, H. sapiens
aatatacattttgttt

SEQ ID NO: 19670 - DNA, 16 bp, H. sapiens
aatatacctcaataaa

SEQ ID NO: 19671 - DNA, 16 bp, H. sapiens
aatataccttcactgt

SEQ ID NO: 19672 - DNA, 16 bp, H. sapiens
aatatactgaaaacca

SEQ ID NO: 19673 - DNA, 16 bp, H. sapiens
aatatacttaacatta

SEQ ID NO: 19674 - DNA, 16 bp, H. sapiens
aatatagaaagaactc

SEQ ID NO: 19675 - DNA, 16 bp, H. sapiens
aatatataaagagctc

SEQ ID NO: 19676 - DNA, 16 bp, H. sapiens
aatatataaagtactt

SEQ ID NO: 19677 - DNA, 16 bp, H. sapiens
aatatataaggaactc

SEQ ID NO: 19678 - DNA, 16 bp, H. sapiens
aatatataatttcagt

SEQ ID NO: 19679 - DNA, 16 bp, H. sapiens
aatatatacacacaca

SEQ ID NO: 19680 - DNA, 16 bp, H. sapiens
aatatatacagtatat

SEQ ID NO: 19681 - DNA, 16 bp, H. sapiens
aatatatacatacaca

SEQ ID NO: 19682 - DNA, 16 bp, H. sapiens
aatatatacatagaaa

SEQ ID NO: 19683 - DNA, 16 bp, H. sapiens
aatatatacatgaaaa

SEQ ID NO: 19684 - DNA, 16 bp, H. sapiens
aatatatacattcttt

SEQ ID NO: 19685 - DNA, 16 bp, H. sapiens
aatatatacattgtat

SEQ ID NO: 19686 - DNA, 16 bp, H. sapiens
aatatatacttacata

SEQ ID NO: 19687 - DNA, 16 bp, H. sapiens
aatatatagacacata

SEQ ID NO: 19688 - DNA, 16 bp, H. sapiens
aatatatagcatttat

SEQ ID NO: 19689 - DNA, 16 bp, H. sapiens
aatatatatacatatg

SEQ ID NO: 19690 - DNA, 17 bp, H. sapiens
aatatatatatgtgtgt

SEQ ID NO: 19691 - DNA, 16 bp, H. sapiens
aatatatatgcaccaa

SEQ ID NO: 19692 - DNA, 16 bp, H. sapiens
aatatatatgcatata

SEQ ID NO: 19693 - DNA, 16 bp, H. sapiens
aatatatatgtacatg

SEQ ID NO: 19694 - DNA, 16 bp, H. sapiens
aatatatattctattc

SEQ ID NO: 19695 - DNA, 16 bp, H. sapiens
aatatatcatcattaa

SEQ ID NO: 19696 - DNA, 16 bp, H. sapiens
aatatatcttgaaaat

SEQ ID NO: 19697 - DNA, 16 bp, H. sapiens
aatatatgatttcatt

SEQ ID NO: 19698 - DNA, 16 bp, H. sapiens
aatatatgcaatttta

SEQ ID NO: 19699 - DNA, 16 bp, H. sapiens
aatatatgcttaaaat

SEQ ID NO: 19700 - DNA, 16 bp, H. sapiens
aatatatggaaatatt

SEQ ID NO: 19701 - DNA, 16 bp, H. sapiens
aatatatgtacataaa

SEQ ID NO: 19702 - DNA, 16 bp, H. sapiens
aatatatgtacataat

SEQ ID NO: 19703 - DNA, 16 bp, H. sapiens
aatatatgtgtattat

SEQ ID NO: 19704 - DNA, 16 bp, H. sapiens
aatatatgtgtgtgtg

SEQ ID NO: 19705 - DNA, 16 bp, H. sapiens
aatatattacatttct

SEQ ID NO: 19706 - DNA, 16 bp, H. sapiens
aatatattattttctg

SEQ ID NO: 19707 - DNA, 16 bp, H. sapiens
aatatattcaaagtgt

SEQ ID NO: 19708 - DNA, 16 bp, H. sapiens
aatatattcagaaaaa

SEQ ID NO: 19709 - DNA, 16 bp, H. sapiens
aatatattccatttta

SEQ ID NO: 19710 - DNA, 16 bp, H. sapiens
aatatatttaaatgca

SEQ ID NO: 19711 - DNA, 16 bp, H. sapiens
aatatatttagcaaat

SEQ ID NO: 19712 - DNA, 16 bp, H. sapiens
aatatatttgaaagct

SEQ ID NO: 19713 - DNA, 16 bp, H. sapiens
aatatatttggaaatt

SEQ ID NO: 19714 - DNA, 16 bp, H. sapiens
aatatattttacatgt

SEQ ID NO: 19715 - DNA, 16 bp, H. sapiens
aatatattttatactc

SEQ ID NO: 19716 - DNA, 16 bp, H. sapiens
aatatattttcaaact

SEQ ID NO: 19717 - DNA, 16 bp, H. sapiens
aatatattttctttgt

SEQ ID NO: 19718 - DNA, 16 bp, H. sapiens
aatatattttgaaggt

SEQ ID NO: 19719 - DNA, 16 bp, H. sapiens
aatatattttgaagtt

SEQ ID NO: 19720 - DNA, 16 bp, H. sapiens
aatatattttgcttaa

SEQ ID NO: 19721 - DNA, 16 bp, H. sapiens
aatatattttggggta

SEQ ID NO: 19722 - DNA, 16 bp, H. sapiens
aatatatttttcacat

SEQ ID NO: 19723 - DNA, 16 bp, H. sapiens
aatatatttttccatc

SEQ ID NO: 19724 - DNA, 16 bp, H. sapiens
aatatatttttgaaag

SEQ ID NO: 19725 - DNA, 16 bp, H. sapiens
aatatatttttttctg

SEQ ID NO: 19726 - DNA, 16 bp, H. sapiens
aatatcaaaaaattag

SEQ ID NO: 19727 - DNA, 16 bp, H. sapiens
aatatcaaaatacttt

SEQ ID NO: 19728 - DNA, 16 bp, H. sapiens
aatatcacagggtggg

SEQ ID NO: 19729 - DNA, 16 bp, H. sapiens
aatatcacctttctta

SEQ ID NO: 19730 - DNA, 16 bp, H. sapiens
aatatcagaaaataat

SEQ ID NO: 19731 - DNA, 16 bp, H. sapiens
aatatcagaaaataca

SEQ ID NO: 19732 - DNA, 16 bp, H. sapiens
aatatcagaaatgaga

SEQ ID NO: 19733 - DNA, 16 bp, H. sapiens
aatatcagataaaata

SEQ ID NO: 19734 - DNA, 16 bp, H. sapiens
aatatcagttttaatt

SEQ ID NO: 19735 - DNA, 16 bp, H. sapiens
aatatcataaagatat

SEQ ID NO: 19736 - DNA, 16 bp, H. sapiens
aatatcatactcaatg

SEQ ID NO: 19737 - DNA, 16 bp, H. sapiens
aatatcattgatattt

SEQ ID NO: 19738 - DNA, 16 bp, H. sapiens
aatatcattgatcatc

SEQ ID NO: 19739 - DNA, 16 bp, H. sapiens
aatatcattgatcatt

SEQ ID NO: 19740 - DNA, 16 bp, H. sapiens
aatatcatttccattt

SEQ ID NO: 19741 - DNA, 16 bp, H. sapiens
aatatccagaagagtt

SEQ ID NO: 19742 - DNA, 16 bp, H. sapiens
aatatccagaatctaa

SEQ ID NO: 19743 - DNA, 18 bp, H. sapiens
aatatccagaatctacaa

SEQ ID NO: 19744 - DNA, 16 bp, H. sapiens
aatatccagaatcttt

SEQ ID NO: 19745 - DNA, 16 bp, H. sapiens
aatatccatgtaacaa

SEQ ID NO: 19746 - DNA, 16 bp, H. sapiens
aatatcccaggaaaaa

SEQ ID NO: 19747 - DNA, 16 bp, H. sapiens
aatatcccaggataaa

SEQ ID NO: 19748 - DNA, 16 bp, H. sapiens
aatatcctgaaataaa

SEQ ID NO: 19749 - DNA, 16 bp, H. sapiens
aatatcctgcagaatg

SEQ ID NO: 19750 - DNA, 16 bp, H. sapiens
aatatccttccttttt

SEQ ID NO: 19751 - DNA, 16 bp, H. sapiens
aatatccttctttgtc

SEQ ID NO: 19752 - DNA, 16 bp, H. sapiens
aatatccttttttaaa

SEQ ID NO: 19753 - DNA, 16 bp, H. sapiens
aatatcgcagaaagtg

SEQ ID NO: 19754 - DNA, 16 bp, H. sapiens
aatatctactatgtgc

SEQ ID NO: 19755 - DNA, 16 bp, H. sapiens
aatatctatacatttt

SEQ ID NO: 19756 - DNA, 16 bp, H. sapiens
aatatctattcaaata

SEQ ID NO: 19757 - DNA, 16 bp, H. sapiens
aatatctccagataaa

SEQ ID NO: 19758 - DNA, 16 bp, H. sapiens
aatatctgaaaataaa

SEQ ID NO: 19759 - DNA, 16 bp, H. sapiens
aatatctgaagacatt

SEQ ID NO: 19760 - DNA, 16 bp, H. sapiens
aatatctgttaaattt

SEQ ID NO: 19761 - DNA, 16 bp, H. sapiens
aatatctgttatttaa

SEQ ID NO: 19762 - DNA, 16 bp, H. sapiens
aatatcttattttaca

SEQ ID NO: 19763 - DNA, 16 bp, H. sapiens
aatatcttcagagaaa

SEQ ID NO: 19764 - DNA, 16 bp, H. sapiens
aatatcttgaaaatat

SEQ ID NO: 19765 - DNA, 16 bp, H. sapiens
aatatgaaaaattagc

SEQ ID NO: 19766 - DNA, 16 bp, H. sapiens
aatatgaacagacact

SEQ ID NO: 19767 - DNA, 16 bp, H. sapiens
aatatgaaggagaaat

SEQ ID NO: 19768 - DNA, 16 bp, H. sapiens
aatatgaataaatttg

SEQ ID NO: 19769 - DNA, 16 bp, H. sapiens
aatatgaatatgtttt

SEQ ID NO: 19770 - DNA, 16 bp, H. sapiens
aatatgaatatttgct

SEQ ID NO: 19771 - DNA, 16 bp, H. sapiens
aatatgaatgtatttt

SEQ ID NO: 19772 - DNA, 16 bp, H. sapiens
aatatgaatttcagat

SEQ ID NO: 19773 - DNA, 16 bp, H. sapiens
aatatgacaccaaaag

SEQ ID NO: 19774 - DNA, 16 bp, H. sapiens
aatatgacattctgga

SEQ ID NO: 19775 - DNA, 16 bp, H. sapiens
aatatgacctcatctt

SEQ ID NO: 19776 - DNA, 16 bp, H. sapiens
aatatgatacatttta

SEQ ID NO: 19777 - DNA, 16 bp, H. sapiens
aatatgatgaaaatgg

SEQ ID NO: 19778 - DNA, 16 bp, H. sapiens
aatatgatgatgatga

SEQ ID NO: 19779 - DNA, 16 bp, H. sapiens
aatatgatggcttagc

SEQ ID NO: 19780 - DNA, 16 bp, H. sapiens
aatatgatgttgaaaa

SEQ ID NO: 19781 - DNA, 16 bp, H. sapiens
aatatgatttacattt

SEQ ID NO: 19782 - DNA, 16 bp, H. sapiens
aatatgattttgaaaa

SEQ ID NO: 19783 - DNA, 16 bp, H. sapiens
aatatgcaaagcaaaa

SEQ ID NO: 19784 - DNA, 16 bp, H. sapiens
aatatgcaaataatat

SEQ ID NO: 19785 - DNA, 16 bp, H. sapiens
aatatgcaaatatgca

SEQ ID NO: 19786 - DNA, 16 bp, H. sapiens
aatatgcaaatatttt

SEQ ID NO: 19787 - DNA, 16 bp, H. sapiens
aatatgcaagaaaata

SEQ ID NO: 19788 - DNA, 16 bp, H. sapiens
aatatgcagaagaatg

SEQ ID NO: 19789 - DNA, 16 bp, H. sapiens
aatatgcattcagtag

SEQ ID NO: 19790 - DNA, 16 bp, H. sapiens
aatatgcattttcttt

SEQ ID NO: 19791 - DNA, 16 bp, H. sapiens
aatatgccacaattta

SEQ ID NO: 19792 - DNA, 16 bp, H. sapiens
aatatgccaggcatgg

SEQ ID NO: 19793 - DNA, 16 bp, H. sapiens
aatatgctgaaaccct

SEQ ID NO: 19794 - DNA, 16 bp, H. sapiens
aatatgctgctgaatt

SEQ ID NO: 19795 - DNA, 16 bp, H. sapiens
aatatggaatcctttc

SEQ ID NO: 19796 - DNA, 16 bp, H. sapiens
aatatggacaatgaaa

SEQ ID NO: 19797 - DNA, 16 bp, H. sapiens
aatatggagataataa

SEQ ID NO: 19798 - DNA, 16 bp, H. sapiens
aatatggatttttaaa

SEQ ID NO: 19799 - DNA, 16 bp, H. sapiens
aatatggcaaaagtga

SEQ ID NO: 19800 - DNA, 16 bp, H. sapiens
aatatggccatactgc

SEQ ID NO: 19801 - DNA, 16 bp, H. sapiens
aatatggtagctacta

SEQ ID NO: 19802 - DNA, 16 bp, H. sapiens
aatatggtgaaatcct

SEQ ID NO: 19803 - DNA, 16 bp, H. sapiens
aatatggttacattta

SEQ ID NO: 19804 - DNA, 16 bp, H. sapiens
aatatggttttctttt

SEQ ID NO: 19805 - DNA, 16 bp, H. sapiens
aatatgtaaaaatcac

SEQ ID NO: 19806 - DNA, 16 bp, H. sapiens
aatatgtaaatatatg

SEQ ID NO: 19807 - DNA, 16 bp, H. sapiens
aatatgtaaatatgta

SEQ ID NO: 19808 - DNA, 16 bp, H. sapiens
aatatgtaaatatgtg

SEQ ID NO: 19809 - DNA, 16 bp, H. sapiens
aatatgtaagaaactc

SEQ ID NO: 19810 - DNA, 16 bp, H. sapiens
aatatgtaatacatat

SEQ ID NO: 19811 - DNA, 16 bp, H. sapiens
aatatgtaatatgttt

SEQ ID NO: 19812 - DNA, 16 bp, H. sapiens
aatatgtaatatttgt

SEQ ID NO: 19813 - DNA, 16 bp, H. sapiens
aatatgtacaattatt

SEQ ID NO: 19814 - DNA, 16 bp, H. sapiens
aatatgtacacaaatg

SEQ ID NO: 19815 - DNA, 16 bp, H. sapiens
aatatgtacatttttt

SEQ ID NO: 19816 - DNA, 16 bp, H. sapiens
aatatgtagaatattt

SEQ ID NO: 19817 - DNA, 16 bp, H. sapiens
aatatgtattacaaat

SEQ ID NO: 19818 - DNA, 16 bp, H. sapiens
aatatgtattacattt

SEQ ID NO: 19819 - DNA, 16 bp, H. sapiens
aatatgtattcatata

SEQ ID NO: 19820 - DNA, 16 bp, H. sapiens
aatatgtatttacttt

SEQ ID NO: 19821 - DNA, 16 bp, H. sapiens
aatatgtatttgttga

SEQ ID NO: 19822 - DNA, 16 bp, H. sapiens
aatatgtattttgtgt

SEQ ID NO: 19823 - DNA, 16 bp, H. sapiens
aatatgtcaaaattaa

SEQ ID NO: 19824 - DNA, 16 bp, H. sapiens
aatatgtcaaagagat

SEQ ID NO: 19825 - DNA, 16 bp, H. sapiens
aatatgtcaaataaat

SEQ ID NO: 19826 - DNA, 16 bp, H. sapiens
aatatgtctttaaaat

SEQ ID NO: 19827 - DNA, 16 bp, H. sapiens
aatatgtgaatatgtg

SEQ ID NO: 19828 - DNA, 16 bp, H. sapiens
aatatgtgatcttttg

SEQ ID NO: 19829 - DNA, 16 bp, H. sapiens
aatatgtgcacacaca

SEQ ID NO: 19830 - DNA, 16 bp, H. sapiens
aatatgtgcatttaaa

SEQ ID NO: 19831 - DNA, 16 bp, H. sapiens
aatatgtggctttttg

SEQ ID NO: 19832 - DNA, 16 bp, H. sapiens
aatatgtggggaaaaa

SEQ ID NO: 19833 - DNA, 16 bp, H. sapiens
aatatgtgtgtgtgtg

SEQ ID NO: 19834 - DNA, 16 bp, H. sapiens
aatatgttaaatatgt

SEQ ID NO: 19835 - DNA, 16 bp, H. sapiens
aatatgttccaagacc

SEQ ID NO: 19836 - DNA, 16 bp, H. sapiens
aatatgttctgtgtgc

SEQ ID NO: 19837 - DNA, 16 bp, H. sapiens
aatatgttctttaaaa

SEQ ID NO: 19838 - DNA, 16 bp, H. sapiens
aatatgttcttttaaa

SEQ ID NO: 19839 - DNA, 16 bp, H. sapiens
aatatgttgtcttttg

SEQ ID NO: 19840 - DNA, 16 bp, H. sapiens
aatatgttgttgaatt

SEQ ID NO: 19841 - DNA, 16 bp, H. sapiens
aatatgttttaatatc

SEQ ID NO: 19842 - DNA, 16 bp, H. sapiens
aatatgtttttattct

SEQ ID NO: 19843 - DNA, 16 bp, H. sapiens
aatattaaaaaggcaa

SEQ ID NO: 19844 - DNA, 16 bp, H. sapiens
aatattaaaatagaac

SEQ ID NO: 19845 - DNA, 16 bp, H. sapiens
aatattaaatactgaa

SEQ ID NO: 19846 - DNA, 16 bp, H. sapiens
aatattaacagaactg

SEQ ID NO: 19847 - DNA, 16 bp, H. sapiens
aatattaaccctttat

SEQ ID NO: 19848 - DNA, 16 bp, H. sapiens
aatattaacttgaaat

SEQ ID NO: 19849 - DNA, 16 bp, H. sapiens
aatattaactttacat

SEQ ID NO: 19850 - DNA, 16 bp, H. sapiens
aatattaagaaaatca

SEQ ID NO: 19851 - DNA, 16 bp, H. sapiens
aatattaatgcaaaaa

SEQ ID NO: 19852 - DNA, 16 bp, H. sapiens
aatattaattcttcca

SEQ ID NO: 19853 - DNA, 16 bp, H. sapiens
aatattaattttccaa

SEQ ID NO: 19854 - DNA, 16 bp, H. sapiens
aatattaatttttcca

SEQ ID NO: 19855 - DNA, 16 bp, H. sapiens
aatattacagaataat

SEQ ID NO: 19856 - DNA, 16 bp, H. sapiens
aatattacatttcatt

SEQ ID NO: 19857 - DNA, 16 bp, H. sapiens
aatattactcagcttt

SEQ ID NO: 19858 - DNA, 16 bp, H. sapiens
aatattagaaaacaat

SEQ ID NO: 19859 - DNA, 16 bp, H. sapiens
aatattagaaatgttt

SEQ ID NO: 19860 - DNA, 16 bp, H. sapiens
aatattagaaattatg

SEQ ID NO: 19861 - DNA, 16 bp, H. sapiens
aatattagctaacatt

SEQ ID NO: 19862 - DNA, 16 bp, H. sapiens
aatattagctgctatt

SEQ ID NO: 19863 - DNA, 16 bp, H. sapiens
aatattatcacttcaa

SEQ ID NO: 19864 - DNA, 16 bp, H. sapiens
aatattatccaggaga

SEQ ID NO: 19865 - DNA, 16 bp, H. sapiens
aatattatgcaataaa

SEQ ID NO: 19866 - DNA, 16 bp, H. sapiens
aatattatgttgaata

SEQ ID NO: 19867 - DNA, 16 bp, H. sapiens
aatattattcaatcat

SEQ ID NO: 19868 - DNA, 16 bp, H. sapiens
aatattattcatccag

SEQ ID NO: 19869 - DNA, 16 bp, H. sapiens
aatattattcttttga

SEQ ID NO: 19870 - DNA, 16 bp, H. sapiens
aatattattggtgtat

SEQ ID NO: 19871 - DNA, 16 bp, H. sapiens
aatattatttagtcat

SEQ ID NO: 19872 - DNA, 16 bp, H. sapiens
aatattatttagtctt

SEQ ID NO: 19873 - DNA, 16 bp, H. sapiens
aatattatttattctg

SEQ ID NO: 19874 - DNA, 16 bp, H. sapiens
aatattatttgttgaa

SEQ ID NO: 19875 - DNA, 16 bp, H. sapiens
aatattattttcaact

SEQ ID NO: 19876 - DNA, 16 bp, H. sapiens
aatattattttcattg

SEQ ID NO: 19877 - DNA, 16 bp, H. sapiens
aatattatttttgtct

SEQ ID NO: 19878 - DNA, 16 bp, H. sapiens
aatattcaacagtctt

SEQ ID NO: 19879 - DNA, 16 bp, H. sapiens
aatattcaacattttt

SEQ ID NO: 19880 - DNA, 16 bp, H. sapiens
aatattcaagaaaata

SEQ ID NO: 19881 - DNA, 16 bp, H. sapiens
aatattcaaggaaaaa

SEQ ID NO: 19882 - DNA, 16 bp, H. sapiens
aatattcacttttaaa

SEQ ID NO: 19883 - DNA, 16 bp, H. sapiens
aatattcagcaaagta

SEQ ID NO: 19884 - DNA, 16 bp, H. sapiens
aatattcatagcaaca

SEQ ID NO: 19885 - DNA, 16 bp, H. sapiens
aatattcatagcagca

SEQ ID NO: 19886 - DNA, 16 bp, H. sapiens
aatattcatatgaaaa

SEQ ID NO: 19887 - DNA, 16 bp, H. sapiens
aatattcatatgtttt

SEQ ID NO: 19888 - DNA, 16 bp, H. sapiens
aatattcatcagtgat

SEQ ID NO: 19889 - DNA, 16 bp, H. sapiens
aatattcatgactcct

SEQ ID NO: 19890 - DNA, 16 bp, H. sapiens
aatattcatttgaaaa

SEQ ID NO: 19891 - DNA, 16 bp, H. sapiens
aatattccaaaatttt

SEQ ID NO: 19892 - DNA, 16 bp, H. sapiens
aatattccaaacaata

SEQ ID NO: 19893 - DNA, 16 bp, H. sapiens
aatattccactgtgta

SEQ ID NO: 19894 - DNA, 16 bp, H. sapiens
aatattccagaagaaa

SEQ ID NO: 19895 - DNA, 16 bp, H. sapiens
aatattccattttaca

SEQ ID NO: 19896 - DNA, 16 bp, H. sapiens
aatattctacattctt

SEQ ID NO: 19897 - DNA, 16 bp, H. sapiens
aatattctgaaaaata

SEQ ID NO: 19898 - DNA, 16 bp, H. sapiens
aatattctggaaaaaa

SEQ ID NO: 19899 - DNA, 16 bp, H. sapiens
aatattctgtatatat

SEQ ID NO: 19900 - DNA, 16 bp, H. sapiens
aatattgaaagaatga

SEQ ID NO: 19901 - DNA, 16 bp, H. sapiens
aatattgaaatatttc

SEQ ID NO: 19902 - DNA, 16 bp, H. sapiens
aatattgaaattaggc

SEQ ID NO: 19903 - DNA, 16 bp, H. sapiens
aatattgaactttttt

SEQ ID NO: 19904 - DNA, 16 bp, H. sapiens
aatattgaagcaaaaa

SEQ ID NO: 19905 - DNA, 16 bp, H. sapiens
aatattgaatattggc

SEQ ID NO: 19906 - DNA, 16 bp, H. sapiens
aatattgaatcttcct

SEQ ID NO: 19907 - DNA, 16 bp, H. sapiens
aatattgagatatttt

SEQ ID NO: 19908 - DNA, 16 bp, H. sapiens
aatattgatagatata

SEQ ID NO: 19909 - DNA, 16 bp, H. sapiens
aatattgcaaaaatga

SEQ ID NO: 19910 - DNA, 16 bp, H. sapiens
aatattgcaataaagc

SEQ ID NO: 19911 - DNA, 27 bp, H. sapiens
aatattgcgcttttcagaccggcttaa

SEQ ID NO: 19912 - DNA, 16 bp, H. sapiens
aatattgctaaaatga

SEQ ID NO: 19913 - DNA, 16 bp, H. sapiens
aatattggctattatt

SEQ ID NO: 19914 - DNA, 16 bp, H. sapiens
aatattggcttggtgt

SEQ ID NO: 19915 - DNA, 16 bp, H. sapiens
aatattgtctttcttt

SEQ ID NO: 19916 - DNA, 16 bp, H. sapiens
aatattgttaaaatgt

SEQ ID NO: 19917 - DNA, 16 bp, H. sapiens
aatattgttaagatgg

SEQ ID NO: 19918 - DNA, 16 bp, H. sapiens
aatattgtttcatgaa

SEQ ID NO: 19919 - DNA, 16 bp, H. sapiens
aatattgttttagaaa

SEQ ID NO: 19920 - DNA, 16 bp, H. sapiens
aatattgttttcattt

SEQ ID NO: 19921 - DNA, 16 bp, H. sapiens
aatattgttttggcta

SEQ ID NO: 19922 - DNA, 16 bp, H. sapiens
aatatttaaaagaaca

SEQ ID NO: 19923 - DNA, 16 bp, H. sapiens
aatatttaaaatctac

SEQ ID NO: 19924 - DNA, 16 bp, H. sapiens
aatatttaacaactgg

SEQ ID NO: 19925 - DNA, 16 bp, H. sapiens
aatatttaagacaaaa

SEQ ID NO: 19926 - DNA, 16 bp, H. sapiens
aatatttaatgagcat

SEQ ID NO: 19927 - DNA, 16 bp, H. sapiens
aatatttaatgagtac

SEQ ID NO: 19928 - DNA, 16 bp, H. sapiens
aatatttaatgatgaa

SEQ ID NO: 19929 - DNA, 16 bp, H. sapiens
aatatttaatgctttt

SEQ ID NO: 19930 - DNA, 16 bp, H. sapiens
aatatttacaacattt

SEQ ID NO: 19931 - DNA, 16 bp, H. sapiens
aatatttacatatttg

SEQ ID NO: 19932 - DNA, 16 bp, H. sapiens
aatatttaccaaaatt

SEQ ID NO: 19933 - DNA, 16 bp, H. sapiens
aatatttactatttca

SEQ ID NO: 19934 - DNA, 16 bp, H. sapiens
aatatttactctctgg

SEQ ID NO: 19935 - DNA, 16 bp, H. sapiens
aatatttagaaatgta

SEQ ID NO: 19936 - DNA, 16 bp, H. sapiens
aatatttaggaaatat

SEQ ID NO: 19937 - DNA, 16 bp, H. sapiens
aatatttataggaata

SEQ ID NO: 19938 - DNA, 16 bp, H. sapiens
aatatttatcattttg

SEQ ID NO: 19939 - DNA, 16 bp, H. sapiens
aatatttatgaaagga

SEQ ID NO: 19940 - DNA, 16 bp, H. sapiens
aatatttatgacattt

SEQ ID NO: 19941 - DNA, 16 bp, H. sapiens
aatatttatggaagga

SEQ ID NO: 19942 - DNA, 16 bp, H. sapiens
aatatttatggagcat

SEQ ID NO: 19943 - DNA, 16 bp, H. sapiens
aatatttatggataaa

SEQ ID NO: 19944 - DNA, 16 bp, H. sapiens
aatatttattaagtgc

SEQ ID NO: 19945 - DNA, 16 bp, H. sapiens
aatatttattatgctt

SEQ ID NO: 19946 - DNA, 16 bp, H. sapiens
aatatttattgaacac

SEQ ID NO: 19947 - DNA, 16 bp, H. sapiens
aatatttattgactat

SEQ ID NO: 19948 - DNA, 16 bp, H. sapiens
aatatttatttgaaag

SEQ ID NO: 19949 - DNA, 16 bp, H. sapiens
aatatttatttgcata

SEQ ID NO: 19950 - DNA, 16 bp, H. sapiens
aatatttatttggaaa

SEQ ID NO: 19951 - DNA, 16 bp, H. sapiens
aatatttattttaagg

SEQ ID NO: 19952 - DNA, 16 bp, H. sapiens
aatatttattttgaag

SEQ ID NO: 19953 - DNA, 16 bp, H. sapiens
aatatttatttttgct

SEQ ID NO: 19954 - DNA, 16 bp, H. sapiens
aatatttcaaaaatga

SEQ ID NO: 19955 - DNA, 16 bp, H. sapiens
aatatttcaaaatgtg

SEQ ID NO: 19956 - DNA, 16 bp, H. sapiens
aatatttcaaactatt

SEQ ID NO: 19957 - DNA, 16 bp, H. sapiens
aatatttcaaagaaat

SEQ ID NO: 19958 - DNA, 16 bp, H. sapiens
aatatttcaaatatca

SEQ ID NO: 19959 - DNA, 16 bp, H. sapiens
aatatttcaacattaa

SEQ ID NO: 19960 - DNA, 16 bp, H. sapiens
aatatttcaagataaa

SEQ ID NO: 19961 - DNA, 16 bp, H. sapiens
aatatttcaatattca

SEQ ID NO: 19962 - DNA, 16 bp, H. sapiens
aatatttcagaaaaat

SEQ ID NO: 19963 - DNA, 16 bp, H. sapiens
aatatttcagaaaaga

SEQ ID NO: 19964 - DNA, 16 bp, H. sapiens
aatatttcagaaatgt

SEQ ID NO: 19965 - DNA, 16 bp, H. sapiens
aatatttcagtattta

SEQ ID NO: 19966 - DNA, 16 bp, H. sapiens
aatatttcatagtttt

SEQ ID NO: 19967 - DNA, 16 bp, H. sapiens
aatatttcatcaccca

SEQ ID NO: 19968 - DNA, 16 bp, H. sapiens
aatatttcatcatata

SEQ ID NO: 19969 - DNA, 16 bp, H. sapiens
aatatttcatcattaa

SEQ ID NO: 19970 - DNA, 16 bp, H. sapiens
aatatttcattgtttg

SEQ ID NO: 19971 - DNA, 16 bp, H. sapiens
aatatttcatttcaaa

SEQ ID NO: 19972 - DNA, 16 bp, H. sapiens
aatatttccaaataca

SEQ ID NO: 19973 - DNA, 16 bp, H. sapiens
aatatttcccaaattt

SEQ ID NO: 19974 - DNA, 16 bp, H. sapiens
aatatttctatatgta

SEQ ID NO: 19975 - DNA, 16 bp, H. sapiens
aatatttctgattttt

SEQ ID NO: 19976 - DNA, 16 bp, H. sapiens
aatatttctgtgaaaa

SEQ ID NO: 19977 - DNA, 16 bp, H. sapiens
aatatttcttaaaaag

SEQ ID NO: 19978 - DNA, 16 bp, H. sapiens
aatatttcttaaaatc

SEQ ID NO: 19979 - DNA, 16 bp, H. sapiens
aatatttcttatattg

SEQ ID NO: 19980 - DNA, 16 bp, H. sapiens
aatatttctttcaaaa

SEQ ID NO: 19981 - DNA, 16 bp, H. sapiens
aatatttgaaaaacat

SEQ ID NO: 19982 - DNA, 16 bp, H. sapiens
aatatttgaaaagatt

SEQ ID NO: 19983 - DNA, 16 bp, H. sapiens
aatatttgaaaatcca

SEQ ID NO: 19984 - DNA, 16 bp, H. sapiens
aatatttgaaacaata

SEQ ID NO: 19985 - DNA, 16 bp, H. sapiens
aatatttgaaatcaaa

SEQ ID NO: 19986 - DNA, 16 bp, H. sapiens
aatatttgaacaaata

SEQ ID NO: 19987 - DNA, 16 bp, H. sapiens
aatatttgaacataat

SEQ ID NO: 19988 - DNA, 16 bp, H. sapiens
aatatttgaagaggtt

SEQ ID NO: 19989 - DNA, 16 bp, H. sapiens
aatatttgaaggaata

SEQ ID NO: 19990 - DNA, 16 bp, H. sapiens
aatatttgagaatatt

SEQ ID NO: 19991 - DNA, 16 bp, H. sapiens
aatatttgcaaaatgt

SEQ ID NO: 19992 - DNA, 16 bp, H. sapiens
aatatttgcaaactat

SEQ ID NO: 19993 - DNA, 16 bp, H. sapiens
aatatttgcaaatgaa

SEQ ID NO: 19994 - DNA, 16 bp, H. sapiens
aatatttgcaaattat

SEQ ID NO: 19995 - DNA, 16 bp, H. sapiens
aatatttgcaacattt

SEQ ID NO: 19996 - DNA, 16 bp, H. sapiens
aatatttgcaagacat

SEQ ID NO: 19997 - DNA, 16 bp, H. sapiens
aatatttgcattatac

SEQ ID NO: 19998 - DNA, 16 bp, H. sapiens
aatatttgctatttgt

SEQ ID NO: 19999 - DNA, 16 bp, H. sapiens
aatatttgctctatat

SEQ ID NO: 20000 - DNA, 16 bp, H. sapiens
aatatttgctgaataa

SEQ ID NO: 20001 - DNA, 16 bp, H. sapiens
aatatttgctttatac

SEQ ID NO: 20002 - DNA, 16 bp, H. sapiens
aatatttgctttatat

SEQ ID NO: 20003 - DNA, 16 bp, H. sapiens
aatatttggaaaagaa

SEQ ID NO: 20004 - DNA, 16 bp, H. sapiens
aatatttggaaaatat

SEQ ID NO: 20005 - DNA, 16 bp, H. sapiens
aatatttggaacatat

SEQ ID NO: 20006 - DNA, 16 bp, H. sapiens
aatatttggaagaaaa

SEQ ID NO: 20007 - DNA, 16 bp, H. sapiens
aatatttggaatattt

SEQ ID NO: 20008 - DNA, 16 bp, H. sapiens
aatatttggaattaaa

SEQ ID NO: 20009 - DNA, 16 bp, H. sapiens
aatatttggagaaaat

SEQ ID NO: 20010 - DNA, 16 bp, H. sapiens
aatatttggatatatt

SEQ ID NO: 20011 - DNA, 16 bp, H. sapiens
aatatttggtataaaa

SEQ ID NO: 20012 - DNA, 16 bp, H. sapiens
aatatttggttttaaa

SEQ ID NO: 20013 - DNA, 16 bp, H. sapiens
aatatttgtaaaccat

SEQ ID NO: 20014 - DNA, 16 bp, H. sapiens
aatatttgtaaactgt

SEQ ID NO: 20015 - DNA, 16 bp, H. sapiens
aatatttgtaaatgaa

SEQ ID NO: 20016 - DNA, 16 bp, H. sapiens
aatatttgtaacatat

SEQ ID NO: 20017 - DNA, 16 bp, H. sapiens
aatatttgtatctttt

SEQ ID NO: 20018 - DNA, 16 bp, H. sapiens
aatatttgtcatttct

SEQ ID NO: 20019 - DNA, 16 bp, H. sapiens
aatatttgtctttctg

SEQ ID NO: 20020 - DNA, 16 bp, H. sapiens
aatatttgtctttttg

SEQ ID NO: 20021 - DNA, 16 bp, H. sapiens
aatatttgtggaaaga

SEQ ID NO: 20022 - DNA, 16 bp, H. sapiens
aatatttgttgaacac

SEQ ID NO: 20023 - DNA, 16 bp, H. sapiens
aatatttgttgtaaaa

SEQ ID NO: 20024 - DNA, 16 bp, H. sapiens
aatatttgttttcaaa

SEQ ID NO: 20025 - DNA, 16 bp, H. sapiens
aatatttgtttttctg

SEQ ID NO: 20026 - DNA, 16 bp, H. sapiens
aatattttaaaatgtg

SEQ ID NO: 20027 - DNA, 16 bp, H. sapiens
aatattttaaaggtat

SEQ ID NO: 20028 - DNA, 16 bp, H. sapiens
aatattttaagcaaaa

SEQ ID NO: 20029 - DNA, 16 bp, H. sapiens
aatattttaagtttca

SEQ ID NO: 20030 - DNA, 16 bp, H. sapiens
aatattttaatgtcat

SEQ ID NO: 20031 - DNA, 16 bp, H. sapiens
aatattttacagagtt

SEQ ID NO: 20032 - DNA, 16 bp, H. sapiens
aatattttacagtttg

SEQ ID NO: 20033 - DNA, 16 bp, H. sapiens
aatattttactgaatt

SEQ ID NO: 20034 - DNA, 16 bp, H. sapiens
aatattttactttcaa

SEQ ID NO: 20035 - DNA, 16 bp, H. sapiens
aatattttagggaaaa

SEQ ID NO: 20036 - DNA, 16 bp, H. sapiens
aatattttataccatt

SEQ ID NO: 20037 - DNA, 16 bp, H. sapiens
aatattttatactgta

SEQ ID NO: 20038 - DNA, 16 bp, H. sapiens
aatattttatcatatg

SEQ ID NO: 20039 - DNA, 16 bp, H. sapiens
aatattttatgaagat

SEQ ID NO: 20040 - DNA, 16 bp, H. sapiens
aatattttatgcaaaa

SEQ ID NO: 20041 - DNA, 16 bp, H. sapiens
aatattttatgcaata

SEQ ID NO: 20042 - DNA, 16 bp, H. sapiens
aatattttatttcaga

SEQ ID NO: 20043 - DNA, 16 bp, H. sapiens
aatattttcaaagaaa

SEQ ID NO: 20044 - DNA, 16 bp, H. sapiens
aatattttcaaagtgt

SEQ ID NO: 20045 - DNA, 16 bp, H. sapiens
aatattttcaatctgt

SEQ ID NO: 20046 - DNA, 16 bp, H. sapiens
aatattttcagaagga

SEQ ID NO: 20047 - DNA, 16 bp, H. sapiens
aatattttcagataaa

SEQ ID NO: 20048 - DNA, 16 bp, H. sapiens
aatattttcagtgaaa

SEQ ID NO: 20049 - DNA, 16 bp, H. sapiens
aatattttcatagaaa

SEQ ID NO: 20050 - DNA, 16 bp, H. sapiens
aatattttcatataca

SEQ ID NO: 20051 - DNA, 16 bp, H. sapiens
aatattttcatcaccc

SEQ ID NO: 20052 - DNA, 16 bp, H. sapiens
aatattttcattgctt

SEQ ID NO: 20053 - DNA, 16 bp, H. sapiens
aatattttccaaataa

SEQ ID NO: 20054 - DNA, 16 bp, H. sapiens
aatattttccatttgt

SEQ ID NO: 20055 - DNA, 16 bp, H. sapiens
aatattttcccccaaa

SEQ ID NO: 20056 - DNA, 16 bp, H. sapiens
aatattttctaaaaca

SEQ ID NO: 20057 - DNA, 16 bp, H. sapiens
aatattttctccaaaa

SEQ ID NO: 20058 - DNA, 16 bp, H. sapiens
aatattttctctactt

SEQ ID NO: 20059 - DNA, 16 bp, H. sapiens
aatattttctctcatc

SEQ ID NO: 20060 - DNA, 16 bp, H. sapiens
aatattttctcttagt

SEQ ID NO: 20061 - DNA, 16 bp, H. sapiens
aatattttctctttca

SEQ ID NO: 20062 - DNA, 16 bp, H. sapiens
aatattttctgagaaa

SEQ ID NO: 20063 - DNA, 16 bp, H. sapiens
aatattttctgataat

SEQ ID NO: 20064 - DNA, 16 bp, H. sapiens
aatattttctgtcatt

SEQ ID NO: 20065 - DNA, 16 bp, H. sapiens
aatattttcttatgtt

SEQ ID NO: 20066 - DNA, 16 bp, H. sapiens
aatattttcttctgca

SEQ ID NO: 20067 - DNA, 16 bp, H. sapiens
aatattttcttctggt

SEQ ID NO: 20068 - DNA, 16 bp, H. sapiens
aatattttcttgcttt

SEQ ID NO: 20069 - DNA, 16 bp, H. sapiens
aatattttcttgttta

SEQ ID NO: 20070 - DNA, 16 bp, H. sapiens
aatattttctttaatg

SEQ ID NO: 20071 - DNA, 16 bp, H. sapiens
aatattttctttgaaa

SEQ ID NO: 20072 - DNA, 16 bp, H. sapiens
aatattttctttgcct

SEQ ID NO: 20073 - DNA, 16 bp, H. sapiens
aatattttgaaaaaca

SEQ ID NO: 20074 - DNA, 16 bp, H. sapiens
aatattttgaaaaact

SEQ ID NO: 20075 - DNA, 16 bp, H. sapiens
aatattttgaaaacaa

SEQ ID NO: 20076 - DNA, 16 bp, H. sapiens
aatattttgaaaactt

SEQ ID NO: 20077 - DNA, 16 bp, H. sapiens
aatattttgaaccaaa

SEQ ID NO: 20078 - DNA, 16 bp, H. sapiens
aatattttgagaaaat

SEQ ID NO: 20079 - DNA, 16 bp, H. sapiens
aatattttgagaggaa

SEQ ID NO: 20080 - DNA, 16 bp, H. sapiens
aatattttgaggaaat

SEQ ID NO: 20081 - DNA, 16 bp, H. sapiens
aatattttgataaact

SEQ ID NO: 20082 - DNA, 16 bp, H. sapiens
aatattttgatcaaaa

SEQ ID NO: 20083 - DNA, 16 bp, H. sapiens
aatattttgcattttt

SEQ ID NO: 20084 - DNA, 16 bp, H. sapiens
aatattttgccatgtt

SEQ ID NO: 20085 - DNA, 16 bp, H. sapiens
aatattttgccttttt

SEQ ID NO: 20086 - DNA, 16 bp, H. sapiens
aatattttgctttata

SEQ ID NO: 20087 - DNA, 16 bp, H. sapiens
aatattttggaatatt

SEQ ID NO: 20088 - DNA, 16 bp, H. sapiens
aatattttggaggaaa

SEQ ID NO: 20089 - DNA, 16 bp, H. sapiens
aatattttggatatat

SEQ ID NO: 20090 - DNA, 16 bp, H. sapiens
aatattttggctttgt

SEQ ID NO: 20091 - DNA, 16 bp, H. sapiens
aatattttgggaaatg

SEQ ID NO: 20092 - DNA, 16 bp, H. sapiens
aatattttggttaaaa

SEQ ID NO: 20093 - DNA, 16 bp, H. sapiens
aatattttgtactttt

SEQ ID NO: 20094 - DNA, 16 bp, H. sapiens
aatattttgtcttaaa

SEQ ID NO: 20095 - DNA, 16 bp, H. sapiens
aatattttgtcttatt

SEQ ID NO: 20096 - DNA, 16 bp, H. sapiens
aatattttgtgctttt

SEQ ID NO: 20097 - DNA, 16 bp, H. sapiens
aatattttgttgaaaa

SEQ ID NO: 20098 - DNA, 16 bp, H. sapiens
aatatttttaaaactg

SEQ ID NO: 20099 - DNA, 16 bp, H. sapiens
aatatttttaaactac

SEQ ID NO: 20100 - DNA, 16 bp, H. sapiens
aatatttttaaagtgc

SEQ ID NO: 20101 - DNA, 16 bp, H. sapiens
aatatttttaagccca

SEQ ID NO: 20102 - DNA, 16 bp, H. sapiens
aatatttttaaggaaa

SEQ ID NO: 20103 - DNA, 16 bp, H. sapiens
aatatttttcaaaaga

SEQ ID NO: 20104 - DNA, 16 bp, H. sapiens
aatatttttcaaagtt

SEQ ID NO: 20105 - DNA, 16 bp, H. sapiens
aatatttttccaaatt

SEQ ID NO: 20106 - DNA, 16 bp, H. sapiens
aatatttttcctaata

SEQ ID NO: 20107 - DNA, 16 bp, H. sapiens
aatatttttctattgt

SEQ ID NO: 20108 - DNA, 16 bp, H. sapiens
aatatttttctgataa

SEQ ID NO: 20109 - DNA, 16 bp, H. sapiens
aatatttttctgcatt

SEQ ID NO: 20110 - DNA, 16 bp, H. sapiens
aatatttttcttaaca

SEQ ID NO: 20111 - DNA, 16 bp, H. sapiens
aatatttttcttagaa

SEQ ID NO: 20112 - DNA, 16 bp, H. sapiens
aatatttttcttgatt

SEQ ID NO: 20113 - DNA, 16 bp, H. sapiens
aatatttttgaagtat

SEQ ID NO: 20114 - DNA, 16 bp, H. sapiens
aatatttttgagaact

SEQ ID NO: 20115 - DNA, 16 bp, H. sapiens
aatatttttgagatat

SEQ ID NO: 20116 - DNA, 16 bp, H. sapiens
aatatttttgatctat

SEQ ID NO: 20117 - DNA, 16 bp, H. sapiens
aatatttttgatctgc

SEQ ID NO: 20118 - DNA, 16 bp, H. sapiens
aatatttttgcaaaaa

SEQ ID NO: 20119 - DNA, 16 bp, H. sapiens
aatattttttaaagca

SEQ ID NO: 20120 - DNA, 16 bp, H. sapiens
aatattttttctgaaa

SEQ ID NO: 20121 - DNA, 16 bp, H. sapiens
aatattttttctgtat

SEQ ID NO: 20122 - DNA, 16 bp, H. sapiens
aatattttttgaacaa

SEQ ID NO: 20123 - DNA, 16 bp, H. sapiens
aatattttttgagatg

SEQ ID NO: 20124 - DNA, 16 bp, H. sapiens
aatattttttgatgaa

SEQ ID NO: 20125 - DNA, 16 bp, H. sapiens
aatattttttgtctgt

SEQ ID NO: 20126 - DNA, 16 bp, H. sapiens
aatatttttttctgag

SEQ ID NO: 20127 - DNA, 16 bp, H. sapiens
aatcaaaaacaagtta

SEQ ID NO: 20128 - DNA, 16 bp, H. sapiens
aatcaaaaacatgata

SEQ ID NO: 20129 - DNA, 16 bp, H. sapiens
aatcaaaaattaaatg

SEQ ID NO: 20130 - DNA, 16 bp, H. sapiens
aatcaaaacaattgaa

SEQ ID NO: 20131 - DNA, 16 bp, H. sapiens
aatcaaaaccataatg

SEQ ID NO: 20132 - DNA, 16 bp, H. sapiens
aatcaaaagaaaatct

SEQ ID NO: 20133 - DNA, 16 bp, H. sapiens
aatcaaaagaaacttt

SEQ ID NO: 20134 - DNA, 16 bp, H. sapiens
aatcaaaagaatattt

SEQ ID NO: 20135 - DNA, 16 bp, H. sapiens
aatcaaaagagaaatt

SEQ ID NO: 20136 - DNA, 16 bp, H. sapiens
aatcaaaataaatgta

SEQ ID NO: 20137 - DNA, 16 bp, H. sapiens
aatcaaaataatgttt

SEQ ID NO: 20138 - DNA, 16 bp, H. sapiens
aatcaaaatatttcat

SEQ ID NO: 20139 - DNA, 16 bp, H. sapiens
aatcaaaatattttct

SEQ ID NO: 20140 - DNA, 16 bp, H. sapiens
aatcaaaatcccagca

SEQ ID NO: 20141 - DNA, 16 bp, H. sapiens
aatcaaaatgaaaatt

SEQ ID NO: 20142 - DNA, 16 bp, H. sapiens
aatcaaaatgaaatat

SEQ ID NO: 20143 - DNA, 16 bp, H. sapiens
aatcaaaatggactaa

SEQ ID NO: 20144 - DNA, 16 bp, H. sapiens
aatcaaaatggattga

SEQ ID NO: 20145 - DNA, 16 bp, H. sapiens
aatcaaaattcaaagt

SEQ ID NO: 20146 - DNA, 16 bp, H. sapiens
aatcaaaatttcagca

SEQ ID NO: 20147 - DNA, 21 bp, H. sapiens
aatcaaactgtccaatgcatt

SEQ ID NO: 20148 - DNA, 16 bp, H. sapiens
aatcaaagaagtgaaa

SEQ ID NO: 20149 - DNA, 16 bp, H. sapiens
aatcaaagacaaagag

SEQ ID NO: 20150 - DNA, 16 bp, H. sapiens
aatcaaagctaaagtg

SEQ ID NO: 20151 - DNA, 16 bp, H. sapiens
aatcaaaggaaaagtt

SEQ ID NO: 20152 - DNA, 16 bp, H. sapiens
aatcaaatagatcaaa

SEQ ID NO: 20153 - DNA, 16 bp, H. sapiens
aatcaaatagatgaaa

SEQ ID NO: 20154 - DNA, 16 bp, H. sapiens
aatcaaatgaaaattt

SEQ ID NO: 20155 - DNA, 16 bp, H. sapiens
aatcaaatggaaacac

SEQ ID NO: 20156 - DNA, 16 bp, H. sapiens
aatcaaatggaaatta

SEQ ID NO: 20157 - DNA, 16 bp, H. sapiens
aatcaaattgaatagc

SEQ ID NO: 20158 - DNA, 16 bp, H. sapiens
aatcaaattgctaaaa

SEQ ID NO: 20159 - DNA, 16 bp, H. sapiens
aatcaaatttctattt

SEQ ID NO: 20160 - DNA, 16 bp, H. sapiens
aatcaacaaaattgat

SEQ ID NO: 20161 - DNA, 16 bp, H. sapiens
aatcaacaaagaaact

SEQ ID NO: 20162 - DNA, 16 bp, H. sapiens
aatcaacaaatatttt

SEQ ID NO: 20163 - DNA, 16 bp, H. sapiens
aatcaacagccaattt

SEQ ID NO: 20164 - DNA, 16 bp, H. sapiens
aatcaacatgaagaaa

SEQ ID NO: 20165 - DNA, 16 bp, H. sapiens
aatcaacctaaatgcc

SEQ ID NO: 20166 - DNA, 16 bp, H. sapiens
aatcaacctagatacc

SEQ ID NO: 20167 - DNA, 16 bp, H. sapiens
aatcaaccttctgaat

SEQ ID NO: 20168 - DNA, 16 bp, H. sapiens
aatcaactgtttatat

SEQ ID NO: 20169 - DNA, 16 bp, H. sapiens
aatcaactttttcttt

SEQ ID NO: 20170 - DNA, 16 bp, H. sapiens
aatcaagaaacagcag

SEQ ID NO: 20171 - DNA, 16 bp, H. sapiens
aatcaagacacagaac

SEQ ID NO: 20172 - DNA, 16 bp, H. sapiens
aatcaagataaataat

SEQ ID NO: 20173 - DNA, 16 bp, H. sapiens
aatcaagataataaac

SEQ ID NO: 20174 - DNA, 16 bp, H. sapiens
aatcaagatgcagaac

SEQ ID NO: 20175 - DNA, 16 bp, H. sapiens
aatcaagatgttggca

SEQ ID NO: 20176 - DNA, 16 bp, H. sapiens
aatcaagcaagagaaa

SEQ ID NO: 20177 - DNA, 16 bp, H. sapiens
aatcaagctaattaat

SEQ ID NO: 20178 - DNA, 18 bp, H. sapiens
aatcaaggtttaagggat

SEQ ID NO: 20179 - DNA, 16 bp, H. sapiens
aatcaataaaattgaa

SEQ ID NO: 20180 - DNA, 16 bp, H. sapiens
aatcaatacatgtaat

SEQ ID NO: 20181 - DNA, 16 bp, H. sapiens
aatcaataccaagaaa

SEQ ID NO: 20182 - DNA, 16 bp, H. sapiens
aatcaatatcaagaaa

SEQ ID NO: 20183 - DNA, 16 bp, H. sapiens
aatcaatatcactaaa

SEQ ID NO: 20184 - DNA, 16 bp, H. sapiens
aatcaatcaatcaatg

SEQ ID NO: 20185 - DNA, 16 bp, H. sapiens
aatcaatcaattgaaa

SEQ ID NO: 20186 - DNA, 16 bp, H. sapiens
aatcaatcagtcagtc

SEQ ID NO: 20187 - DNA, 16 bp, H. sapiens
aatcaatgaaatataa

SEQ ID NO: 20188 - DNA, 16 bp, H. sapiens
aatcaatgaacaaaat

SEQ ID NO: 20189 - DNA, 16 bp, H. sapiens
aatcaatgaacttgaa

SEQ ID NO: 20190 - DNA, 16 bp, H. sapiens
aatcaatgaagccaaa

SEQ ID NO: 20191 - DNA, 16 bp, H. sapiens
aatcaatgaagtgaag

SEQ ID NO: 20192 - DNA, 16 bp, H. sapiens
aatcaatgtagaaaaa

SEQ ID NO: 20193 - DNA, 16 bp, H. sapiens
aatcaatgtggaaaaa

SEQ ID NO: 20194 - DNA, 16 bp, H. sapiens
aatcaatgtgtaaaaa

SEQ ID NO: 20195 - DNA, 16 bp, H. sapiens
aatcaattaatatgat

SEQ ID NO: 20196 - DNA, 16 bp, H. sapiens
aatcaatttattttca

SEQ ID NO: 20197 - DNA, 16 bp, H. sapiens
aatcaatttgtacagt

SEQ ID NO: 20198 - DNA, 16 bp, H. sapiens
aatcacaaatgttttt

SEQ ID NO: 20199 - DNA, 16 bp, H. sapiens
aatcacaacttcagga

SEQ ID NO: 20200 - DNA, 17 bp, H. sapiens
aatcacaaggtcaggag

SEQ ID NO: 20201 - DNA, 16 bp, H. sapiens
aatcacaataaaatga

SEQ ID NO: 20202 - DNA, 16 bp, H. sapiens
aatcacacaaacaagt

SEQ ID NO: 20203 - DNA, 16 bp, H. sapiens
aatcacacttattgat

SEQ ID NO: 20204 - DNA, 16 bp, H. sapiens
aatcacagaatgttag

SEQ ID NO: 20205 - DNA, 16 bp, H. sapiens
aatcacagcagtttgg

SEQ ID NO: 20206 - DNA, 16 bp, H. sapiens
aatcacaggggtggtt

SEQ ID NO: 20207 - DNA, 16 bp, H. sapiens
aatcacatcagagtaa

SEQ ID NO: 20208 - DNA, 16 bp, H. sapiens
aatcacatgagccaat

SEQ ID NO: 20209 - DNA, 16 bp, H. sapiens
aatcacatgagttctt

SEQ ID NO: 20210 - DNA, 16 bp, H. sapiens
aatcacattaaaaagt

SEQ ID NO: 20211 - DNA, 16 bp, H. sapiens
aatcacatttctacac

SEQ ID NO: 20212 - DNA, 16 bp, H. sapiens
aatcacatttttatat

SEQ ID NO: 20213 - DNA, 16 bp, H. sapiens
aatcaccacattgtct

SEQ ID NO: 20214 - DNA, 16 bp, H. sapiens
aatcaccatggcatat

SEQ ID NO: 20215 - DNA, 16 bp, H. sapiens
aatcacccttacccca

SEQ ID NO: 20216 - DNA, 16 bp, H. sapiens
aatcacctggagagct

SEQ ID NO: 20217 - DNA, 17 bp, H. sapiens
aatcacgaggtcaggag

SEQ ID NO: 20218 - DNA, 16 bp, H. sapiens
aatcactgttttgttt

SEQ ID NO: 20219 - DNA, 16 bp, H. sapiens
aatcacttaagcccgg

SEQ ID NO: 20220 - DNA, 16 bp, H. sapiens
aatcacttatatcttt

SEQ ID NO: 20221 - DNA, 16 bp, H. sapiens
aatcacttgaaaccgg

SEQ ID NO: 20222 - DNA, 16 bp, H. sapiens
aatcacttgaaccagg

SEQ ID NO: 20223 - DNA, 20 bp, H. sapiens
aatcacttgaacccgggaga

SEQ ID NO: 20224 - DNA, 16 bp, H. sapiens
aatcacttgaacctgt

SEQ ID NO: 20225 - DNA, 16 bp, H. sapiens
aatcacttgaaccttg

SEQ ID NO: 20226 - DNA, 16 bp, H. sapiens
aatcacttgaactagg

SEQ ID NO: 20227 - DNA, 17 bp, H. sapiens
aatcacttgagcccaga

SEQ ID NO: 20228 - DNA, 16 bp, H. sapiens
aatcacttgaggttag

SEQ ID NO: 20229 - DNA, 16 bp, H. sapiens
aatcacttgtgcctgg

SEQ ID NO: 20230 - DNA, 16 bp, H. sapiens
aatcagaaaagtaatt

SEQ ID NO: 20231 - DNA, 16 bp, H. sapiens
aatcagaaaccctggg

SEQ ID NO: 20232 - DNA, 16 bp, H. sapiens
aatcagaaactcttgg

SEQ ID NO: 20233 - DNA, 16 bp, H. sapiens
aatcagaaagacataa

SEQ ID NO: 20234 - DNA, 16 bp, H. sapiens
aatcagaaaggaaaag

SEQ ID NO: 20235 - DNA, 16 bp, H. sapiens
aatcagaaagtgtgat

SEQ ID NO: 20236 - DNA, 16 bp, H. sapiens
aatcagaaatgacaaa

SEQ ID NO: 20237 - DNA, 16 bp, H. sapiens
aatcagaaatgatgaa

SEQ ID NO: 20238 - DNA, 16 bp, H. sapiens
aatcagaaattttaaa

SEQ ID NO: 20239 - DNA, 16 bp, H. sapiens
aatcagaagacagaaa

SEQ ID NO: 20240 - DNA, 16 bp, H. sapiens
aatcagaagctctggg

SEQ ID NO: 20241 - DNA, 16 bp, H. sapiens
aatcagaaggaagaaa

SEQ ID NO: 20242 - DNA, 16 bp, H. sapiens
aatcagaatctccagg

SEQ ID NO: 20243 - DNA, 16 bp, H. sapiens
aatcagacaagagaaa

SEQ ID NO: 20244 - DNA, 16 bp, H. sapiens
aatcagactattctga

SEQ ID NO: 20245 - DNA, 16 bp, H. sapiens
aatcagagaagcagaa

SEQ ID NO: 20246 - DNA, 16 bp, H. sapiens
aatcagagacagaaaa

SEQ ID NO: 20247 - DNA, 16 bp, H. sapiens
aatcagagatgaaaaa

SEQ ID NO: 20248 - DNA, 16 bp, H. sapiens
aatcagagatgatgca

SEQ ID NO: 20249 - DNA, 16 bp, H. sapiens
aatcagagcagaaaag

SEQ ID NO: 20250 - DNA, 16 bp, H. sapiens
aatcagagtgcctctt

SEQ ID NO: 20251 - DNA, 16 bp, H. sapiens
aatcagataccacctc

SEQ ID NO: 20252 - DNA, 16 bp, H. sapiens
aatcagatatgcattt

SEQ ID NO: 20253 - DNA, 16 bp, H. sapiens
aatcagcaagaaaata

SEQ ID NO: 20254 - DNA, 16 bp, H. sapiens
aatcagcaagagaaaa

SEQ ID NO: 20255 - DNA, 16 bp, H. sapiens
aatcagcacacacttc

SEQ ID NO: 20256 - DNA, 16 bp, H. sapiens
aatcagcactctgtag

SEQ ID NO: 20257 - DNA, 16 bp, H. sapiens
aatcagcaggatgtag

SEQ ID NO: 20258 - DNA, 16 bp, H. sapiens
aatcagccaggtgcag

SEQ ID NO: 20259 - DNA, 16 bp, H. sapiens
aatcagcccgcctcgg

SEQ ID NO: 20260 - DNA, 16 bp, H. sapiens
aatcagcctaaatgtc

SEQ ID NO: 20261 - DNA, 16 bp, H. sapiens
aatcagcctgggcaac

SEQ ID NO: 20262 - DNA, 16 bp, H. sapiens
aatcagctacagtcca

SEQ ID NO: 20263 - DNA, 16 bp, H. sapiens
aatcagctgactttaa

SEQ ID NO: 20264 - DNA, 16 bp, H. sapiens
aatcagctgagtgtgg

SEQ ID NO: 20265 - DNA, 16 bp, H. sapiens
aatcagctgttaatct

SEQ ID NO: 20266 - DNA, 16 bp, H. sapiens
aatcagcttgtcaatt

SEQ ID NO: 20267 - DNA, 16 bp, H. sapiens
aatcaggaaaatgcaa

SEQ ID NO: 20268 - DNA, 16 bp, H. sapiens
aatcaggaagaagctg

SEQ ID NO: 20269 - DNA, 16 bp, H. sapiens
aatcaggagacacaaa

SEQ ID NO: 20270 - DNA, 16 bp, H. sapiens
aatcaggagattgaga

SEQ ID NO: 20271 - DNA, 16 bp, H. sapiens
aatcaggagtttgaga

SEQ ID NO: 20272 - DNA, 16 bp, H. sapiens
aatcaggcaagagaaa

SEQ ID NO: 20273 - DNA, 16 bp, H. sapiens
aatcaggcaggaaaaa

SEQ ID NO: 20274 - DNA, 16 bp, H. sapiens
aatcaggccaagtata

SEQ ID NO: 20275 - DNA, 16 bp, H. sapiens
aatcaggttaaaatga

SEQ ID NO: 20276 - DNA, 16 bp, H. sapiens
aatcagtaagaaaaat

SEQ ID NO: 20277 - DNA, 16 bp, H. sapiens
aatcagtaagaagaaa

SEQ ID NO: 20278 - DNA, 16 bp, H. sapiens
aatcagtaattaaaaa

SEQ ID NO: 20279 - DNA, 16 bp, H. sapiens
aatcagtagactttga

SEQ ID NO: 20280 - DNA, 16 bp, H. sapiens
aatcagtatatgaaag

SEQ ID NO: 20281 - DNA, 16 bp, H. sapiens
aatcagtatttcaaag

SEQ ID NO: 20282 - DNA, 16 bp, H. sapiens
aatcagttgactttaa

SEQ ID NO: 20283 - DNA, 16 bp, H. sapiens
aatcagttttttgttt

SEQ ID NO: 20284 - DNA, 16 bp, H. sapiens
aatcatacaatatgta

SEQ ID NO: 20285 - DNA, 16 bp, H. sapiens
aatcatacagtatgta

SEQ ID NO: 20286 - DNA, 16 bp, H. sapiens
aatcatacattatgta

SEQ ID NO: 20287 - DNA, 16 bp, H. sapiens
aatcatagctcactgt

SEQ ID NO: 20288 - DNA, 16 bp, H. sapiens
aatcatagctgactgc

SEQ ID NO: 20289 - DNA, 16 bp, H. sapiens
aatcatatatctgaaa

SEQ ID NO: 20290 - DNA, 16 bp, H. sapiens
aatcatatgatatttg

SEQ ID NO: 20291 - DNA, 16 bp, H. sapiens
aatcatatgcagaaga

SEQ ID NO: 20292 - DNA, 16 bp, H. sapiens
aatcatattccattgt

SEQ ID NO: 20293 - DNA, 16 bp, H. sapiens
aatcatatttcattgt

SEQ ID NO: 20294 - DNA, 16 bp, H. sapiens
aatcatcaaagaaata

SEQ ID NO: 20295 - DNA, 16 bp, H. sapiens
aatcatcagaaaaatg

SEQ ID NO: 20296 - DNA, 16 bp, H. sapiens
aatcatcagagtaaac

SEQ ID NO: 20297 - DNA, 16 bp, H. sapiens
aatcatcagattcacc

SEQ ID NO: 20298 - DNA, 16 bp, H. sapiens
aatcatcagggagatg

SEQ ID NO: 20299 - DNA, 16 bp, H. sapiens
aatcatctaacacaaa

SEQ ID NO: 20300 - DNA, 16 bp, H. sapiens
aatcatctctagtctt

SEQ ID NO: 20301 - DNA, 16 bp, H. sapiens
aatcatctgggaagct

SEQ ID NO: 20302 - DNA, 16 bp, H. sapiens
aatcatgaagaaatcc

SEQ ID NO: 20303 - DNA, 16 bp, H. sapiens
aatcatgaatattttt

SEQ ID NO: 20304 - DNA, 31 bp, H. sapiens
aatcatgagggaactcccattcacaattgct

SEQ ID NO: 20305 - DNA, 17 bp, H. sapiens
aatcatgaggtcaggag

SEQ ID NO: 20306 - DNA, 16 bp, H. sapiens
aatcatgataaaacaa

SEQ ID NO: 20307 - DNA, 16 bp, H. sapiens
aatcatgcaagagaaa

SEQ ID NO: 20308 - DNA, 16 bp, H. sapiens
aatcatgccttcccaa

SEQ ID NO: 20309 - DNA, 17 bp, H. sapiens
aatcatggcccctcaat

SEQ ID NO: 20310 - DNA, 16 bp, H. sapiens
aatcatgggggtggtt

SEQ ID NO: 20311 - DNA, 16 bp, H. sapiens
aatcatggtggaaagc

SEQ ID NO: 20312 - DNA, 16 bp, H. sapiens
aatcatggtggaagaa

SEQ ID NO: 20313 - DNA, 16 bp, H. sapiens
aatcatggtggcaggt

SEQ ID NO: 20314 - DNA, 16 bp, H. sapiens
aatcatgtcttttgta

SEQ ID NO: 20315 - DNA, 16 bp, H. sapiens
aatcatgtggttttgg

SEQ ID NO: 20316 - DNA, 16 bp, H. sapiens
aatcatgtgtttttgt

SEQ ID NO: 20317 - DNA, 16 bp, H. sapiens
aatcattaaaatgttt

SEQ ID NO: 20318 - DNA, 16 bp, H. sapiens
aatcattagaaaaatg

SEQ ID NO: 20319 - DNA, 16 bp, H. sapiens
aatcattgttttattt

SEQ ID NO: 20320 - DNA, 16 bp, H. sapiens
aatcattgttttcatt

SEQ ID NO: 20321 - DNA, 16 bp, H. sapiens
aatcatttaaaaatgt

SEQ ID NO: 20322 - DNA, 16 bp, H. sapiens
aatcatttaattctca

SEQ ID NO: 20323 - DNA, 16 bp, H. sapiens
aatcatttcaatctct

SEQ ID NO: 20324 - DNA, 16 bp, H. sapiens
aatcatttccccattg

SEQ ID NO: 20325 - DNA, 16 bp, H. sapiens
aatcatttctagatta

SEQ ID NO: 20326 - DNA, 16 bp, H. sapiens
aatcatttctagattt

SEQ ID NO: 20327 - DNA, 16 bp, H. sapiens
aatcatttgaaccagg

SEQ ID NO: 20328 - DNA, 16 bp, H. sapiens
aatcatttgaactcag

SEQ ID NO: 20329 - DNA, 16 bp, H. sapiens
aatcatttgaggtcag

SEQ ID NO: 20330 - DNA, 16 bp, H. sapiens
aatcatttggtttttg

SEQ ID NO: 20331 - DNA, 16 bp, H. sapiens
aatcatttgtatttct

SEQ ID NO: 20332 - DNA, 16 bp, H. sapiens
aatcatttgtctttta

SEQ ID NO: 20333 - DNA, 16 bp, H. sapiens
aatcattttcacaaaa

SEQ ID NO: 20334 - DNA, 16 bp, H. sapiens
aatcattttgaaattt

SEQ ID NO: 20335 - DNA, 16 bp, H. sapiens
aatccaaagaaagatt

SEQ ID NO: 20336 - DNA, 16 bp, H. sapiens
aatccaaagcaaaaag

SEQ ID NO: 20337 - DNA, 16 bp, H. sapiens
aatccaaaggaaagtt

SEQ ID NO: 20338 - DNA, 16 bp, H. sapiens
aatccaaatcaaaatc

SEQ ID NO: 20339 - DNA, 16 bp, H. sapiens
aatccaacagcacatc

SEQ ID NO: 20340 - DNA, 16 bp, H. sapiens
aatccaacagcatatt

SEQ ID NO: 20341 - DNA, 16 bp, H. sapiens
aatccaagaacagaaa

SEQ ID NO: 20342 - DNA, 16 bp, H. sapiens
aatccaagcactttga

SEQ ID NO: 20343 - DNA, 16 bp, H. sapiens
aatccaaggtcatgaa

SEQ ID NO: 20344 - DNA, 16 bp, H. sapiens
aatccaagtcaagtca

SEQ ID NO: 20345 - DNA, 16 bp, H. sapiens
aatccaatgcaaagaa

SEQ ID NO: 20346 - DNA, 16 bp, H. sapiens
aatccaattacattct

SEQ ID NO: 20347 - DNA, 16 bp, H. sapiens
aatccaatttaaaaac

SEQ ID NO: 20348 - DNA, 16 bp, H. sapiens
aatccaattttaaaat

SEQ ID NO: 20349 - DNA, 16 bp, H. sapiens
aatccacagatgcaga

SEQ ID NO: 20350 - DNA, 16 bp, H. sapiens
aatccacagatgtgga

SEQ ID NO: 20351 - DNA, 16 bp, H. sapiens
aatccacatatttaca

SEQ ID NO: 20352 - DNA, 16 bp, H. sapiens
aatccacattttaaaa

SEQ ID NO: 20353 - DNA, 16 bp, H. sapiens
aatccaccagcacatc

SEQ ID NO: 20354 - DNA, 16 bp, H. sapiens
aatccaccatattaac

SEQ ID NO: 20355 - DNA, 16 bp, H. sapiens
aatccaccatgatcaa

SEQ ID NO: 20356 - DNA, 19 bp, H. sapiens
aatccacccacctcagcct

SEQ ID NO: 20357 - DNA, 16 bp, H. sapiens
aatccacccacctctg

SEQ ID NO: 20358 - DNA, 16 bp, H. sapiens
aatccacccaccttgg

SEQ ID NO: 20359 - DNA, 16 bp, H. sapiens
aatccacccatctcgg

SEQ ID NO: 20360 - DNA, 18 bp, H. sapiens
aatccacccgcctcggcc

SEQ ID NO: 20361 - DNA, 16 bp, H. sapiens
aatccaccctccttgg

SEQ ID NO: 20362 - DNA, 16 bp, H. sapiens
aatccacctcttgttt

SEQ ID NO: 20363 - DNA, 16 bp, H. sapiens
aatccacctgcctcag

SEQ ID NO: 20364 - DNA, 16 bp, H. sapiens
aatccacctgcctcgg

SEQ ID NO: 20365 - DNA, 17 bp, H. sapiens
aatccacctgcctcggc

SEQ ID NO: 20366 - DNA, 16 bp, H. sapiens
aatccacctgccttag

SEQ ID NO: 20367 - DNA, 16 bp, H. sapiens
aatccacctgccttgg

SEQ ID NO: 20368 - DNA, 17 bp, H. sapiens
aatccacctgcttcggc

SEQ ID NO: 20369 - DNA, 16 bp, H. sapiens
aatccactgtcattct

SEQ ID NO: 20370 - DNA, 16 bp, H. sapiens
aatccagagagacaga

SEQ ID NO: 20371 - DNA, 16 bp, H. sapiens
aatccagatgtccttc

SEQ ID NO: 20372 - DNA, 16 bp, H. sapiens
aatccagcaacacatc

SEQ ID NO: 20373 - DNA, 16 bp, H. sapiens
aatccagcaagctaga

SEQ ID NO: 20374 - DNA, 30 bp, H. sapiens
aatccagcagcacatcaaaaagcttatcca

SEQ ID NO: 20375 - DNA, 26 bp, H. sapiens
aatccagcagcacatcaaaaagcttc

SEQ ID NO: 20376 - DNA, 16 bp, H. sapiens
aatccagcagcacatt

SEQ ID NO: 20377 - DNA, 16 bp, H. sapiens
aatccagcagcacgtc

SEQ ID NO: 20378 - DNA, 16 bp, H. sapiens
aatccagcagcagatc

SEQ ID NO: 20379 - DNA, 16 bp, H. sapiens
aatccagcagcccaga

SEQ ID NO: 20380 - DNA, 21 bp, H. sapiens
aatccagcagctcatcaaaaa

SEQ ID NO: 20381 - DNA, 16 bp, H. sapiens
aatccaggaaatgaaa

SEQ ID NO: 20382 - DNA, 16 bp, H. sapiens
aatccaggagatggtt

SEQ ID NO: 20383 - DNA, 16 bp, H. sapiens
aatccaggcacagaaa

SEQ ID NO: 20384 - DNA, 16 bp, H. sapiens
aatccaggtaagagat

SEQ ID NO: 20385 - DNA, 16 bp, H. sapiens
aatccaggtgagaaat

SEQ ID NO: 20386 - DNA, 16 bp, H. sapiens
aatccagttacactct

SEQ ID NO: 20387 - DNA, 16 bp, H. sapiens
aatccatattttgaat

SEQ ID NO: 20388 - DNA, 16 bp, H. sapiens
aatccatcagcaaatt

SEQ ID NO: 20389 - DNA, 17 bp, H. sapiens
aatccatctggtcctgg

SEQ ID NO: 20390 - DNA, 16 bp, H. sapiens
aatccatcttgaatga

SEQ ID NO: 20391 - DNA, 16 bp, H. sapiens
aatccatgaaagaaat

SEQ ID NO: 20392 - DNA, 16 bp, H. sapiens
aatccatggatgtgga

SEQ ID NO: 20393 - DNA, 16 bp, H. sapiens
aatccattatataaac

SEQ ID NO: 20394 - DNA, 16 bp, H. sapiens
aatccattcatccatt

SEQ ID NO: 20395 - DNA, 16 bp, H. sapiens
aatccattgtatcatt

SEQ ID NO: 20396 - DNA, 16 bp, H. sapiens
aatccattttgatttg

SEQ ID NO: 20397 - DNA, 16 bp, H. sapiens
aatccatttttaaaat

SEQ ID NO: 20398 - DNA, 16 bp, H. sapiens
aatcccaaatgccata

SEQ ID NO: 20399 - DNA, 16 bp, H. sapiens
aatcccaaatgttgaa

SEQ ID NO: 20400 - DNA, 16 bp, H. sapiens
aatcccaacatttttg

SEQ ID NO: 20401 - DNA, 16 bp, H. sapiens
aatcccacctctgcca

SEQ ID NO: 20402 - DNA, 17 bp, H. sapiens
aatcccactactcggga

SEQ ID NO: 20403 - DNA, 16 bp, H. sapiens
aatcccactgctgggt

SEQ ID NO: 20404 - DNA, 16 bp, H. sapiens
aatcccagaacttcag

SEQ ID NO: 20405 - DNA, 16 bp, H. sapiens
aatcccagatactctg

SEQ ID NO: 20406 - DNA, 16 bp, H. sapiens
aatcccagcaccttga

SEQ ID NO: 20407 - DNA, 22 bp, H. sapiens
aatcccagcacttcgggaggct

SEQ ID NO: 20408 - DNA, 16 bp, H. sapiens
aatcccagcatttcgg

SEQ ID NO: 20409 - DNA, 16 bp, H. sapiens
aatcccagcattttga

SEQ ID NO: 20410 - DNA, 18 bp, H. sapiens
aatcccagcgatttggga

SEQ ID NO: 20411 - DNA, 22 bp, H. sapiens
aatcccagcgctttgggaggcc

SEQ ID NO: 20412 - DNA, 22 bp, H. sapiens
aatcccagcgctttgggaggct

SEQ ID NO: 20413 - DNA, 20 bp, H. sapiens
aatcccagctactcggaagg

SEQ ID NO: 20414 - DNA, 16 bp, H. sapiens
aatcccagctacttag

SEQ ID NO: 20415 - DNA, 16 bp, H. sapiens
aatcccagctatacag

SEQ ID NO: 20416 - DNA, 16 bp, H. sapiens
aatcccagctcagcca

SEQ ID NO: 20417 - DNA, 16 bp, H. sapiens
aatcccagctctgcaa

SEQ ID NO: 20418 - DNA, 16 bp, H. sapiens
aatcccagctctgcct

SEQ ID NO: 20419 - DNA, 16 bp, H. sapiens
aatcccagctgcctgg

SEQ ID NO: 20420 - DNA, 16 bp, H. sapiens
aatcccagggatgaag

SEQ ID NO: 20421 - DNA, 16 bp, H. sapiens
aatcccaggtacttag

SEQ ID NO: 20422 - DNA, 16 bp, H. sapiens
aatcccaggtcttcag

SEQ ID NO: 20423 - DNA, 16 bp, H. sapiens
aatcccagtactttga

SEQ ID NO: 20424 - DNA, 16 bp, H. sapiens
aatcccatcaaaaagt

SEQ ID NO: 20425 - DNA, 16 bp, H. sapiens
aatcccatcaaaaatt

SEQ ID NO: 20426 - DNA, 16 bp, H. sapiens
aatcccatcaaaagtg

SEQ ID NO: 20427 - DNA, 16 bp, H. sapiens
aatcccatccaggttg

SEQ ID NO: 20428 - DNA, 21 bp, H. sapiens
aatcccattactgggtatata

SEQ ID NO: 20429 - DNA, 16 bp, H. sapiens
aatcccattcacaatt

SEQ ID NO: 20430 - DNA, 16 bp, H. sapiens
aatcccattcctgagg

SEQ ID NO: 20431 - DNA, 16 bp, H. sapiens
aatccccaagaaaatg

SEQ ID NO: 20432 - DNA, 16 bp, H. sapiens
aatccccccatctcag

SEQ ID NO: 20433 - DNA, 16 bp, H. sapiens
aatccctgaggggtag

SEQ ID NO: 20434 - DNA, 16 bp, H. sapiens
aatccctgcgctttgg

SEQ ID NO: 20435 - DNA, 16 bp, H. sapiens
aatccctggtgccaaa

SEQ ID NO: 20436 - DNA, 16 bp, H. sapiens
aatcccttgttagatg

SEQ ID NO: 20437 - DNA, 16 bp, H. sapiens
aatccgaaatctgaaa

SEQ ID NO: 20438 - DNA, 16 bp, H. sapiens
aatccgccagcctcag

SEQ ID NO: 20439 - DNA, 17 bp, H. sapiens
aatccgcccacctcagc

SEQ ID NO: 20440 - DNA, 17 bp, H. sapiens
aatccgcctgcctcggc

SEQ ID NO: 20441 - DNA, 16 bp, H. sapiens
aatccgggaggcagag

SEQ ID NO: 20442 - DNA, 16 bp, H. sapiens
aatcctaaaatttgtg

SEQ ID NO: 20443 - DNA, 16 bp, H. sapiens
aatcctaaccaaaaag

SEQ ID NO: 20444 - DNA, 16 bp, H. sapiens
aatcctacactttggg

SEQ ID NO: 20445 - DNA, 16 bp, H. sapiens
aatcctactgtgaact

SEQ ID NO: 20446 - DNA, 17 bp, H. sapiens
aatcctagcactttggc

SEQ ID NO: 20447 - DNA, 16 bp, H. sapiens
aatcctaggaccctta

SEQ ID NO: 20448 - DNA, 16 bp, H. sapiens
aatcctatgtgaggaa

SEQ ID NO: 20449 - DNA, 16 bp, H. sapiens
aatcctcaagcttggc

SEQ ID NO: 20450 - DNA, 16 bp, H. sapiens
aatcctcacagccacc

SEQ ID NO: 20451 - DNA, 16 bp, H. sapiens
aatcctcagcaaatgt

SEQ ID NO: 20452 - DNA, 16 bp, H. sapiens
aatcctccaatctcag

SEQ ID NO: 20453 - DNA, 16 bp, H. sapiens
aatcctcccatctcaa

SEQ ID NO: 20454 - DNA, 16 bp, H. sapiens
aatcctcccgcctcag

SEQ ID NO: 20455 - DNA, 16 bp, H. sapiens
aatcctcctgcatcag

SEQ ID NO: 20456 - DNA, 17 bp, H. sapiens
aatcctcctgcctcagt

SEQ ID NO: 20457 - DNA, 16 bp, H. sapiens
aatcctcctgcctcat

SEQ ID NO: 20458 - DNA, 16 bp, H. sapiens
aatcctcctgcctcgg

SEQ ID NO: 20459 - DNA, 16 bp, H. sapiens
aatcctcctgcctgag

SEQ ID NO: 20460 - DNA, 22 bp, H. sapiens
aatcctcctgccttggcctccc

SEQ ID NO: 20461 - DNA, 16 bp, H. sapiens
aatcctcctgtctctg

SEQ ID NO: 20462 - DNA, 16 bp, H. sapiens
aatcctctgacctcag

SEQ ID NO: 20463 - DNA, 19 bp, H. sapiens
aatcctgacctcaagtgat

SEQ ID NO: 20464 - DNA, 16 bp, H. sapiens
aatcctgagagatttt

SEQ ID NO: 20465 - DNA, 16 bp, H. sapiens
aatcctgcaccagcaa

SEQ ID NO: 20466 - DNA, 16 bp, H. sapiens
aatcctgcctcagctt

SEQ ID NO: 20467 - DNA, 16 bp, H. sapiens
aatcctgctgctgctc

SEQ ID NO: 20468 - DNA, 16 bp, H. sapiens
aatcctggaacagaaa

SEQ ID NO: 20469 - DNA, 16 bp, H. sapiens
aatcctggaggtggag

SEQ ID NO: 20470 - DNA, 16 bp, H. sapiens
aatcctggcactttga

SEQ ID NO: 20471 - DNA, 16 bp, H. sapiens
aatcctggctccactg

SEQ ID NO: 20472 - DNA, 18 bp, H. sapiens
aatcctgtcagctgagga

SEQ ID NO: 20473 - DNA, 16 bp, H. sapiens
aatcctgtcttttgca

SEQ ID NO: 20474 - DNA, 16 bp, H. sapiens
aatccttagaagaaaa

SEQ ID NO: 20475 - DNA, 16 bp, H. sapiens
aatccttcagtggctc

SEQ ID NO: 20476 - DNA, 17 bp, H. sapiens
aatccttccacctcagt

SEQ ID NO: 20477 - DNA, 16 bp, H. sapiens
aatccttccttgcttc

SEQ ID NO: 20478 - DNA, 16 bp, H. sapiens
aatccttctcctgtga

SEQ ID NO: 20479 - DNA, 16 bp, H. sapiens
aatccttctgccttgg

SEQ ID NO: 20480 - DNA, 16 bp, H. sapiens
aatccttgtgattttt

SEQ ID NO: 20481 - DNA, 16 bp, H. sapiens
aatcctttccagaagg

SEQ ID NO: 20482 - DNA, 16 bp, H. sapiens
aatcctttcccattgc

SEQ ID NO: 20483 - DNA, 16 bp, H. sapiens
aatcctttgtgaggga

SEQ ID NO: 20484 - DNA, 16 bp, H. sapiens
aatccttttgatttgt

SEQ ID NO: 20485 - DNA, 16 bp, H. sapiens
aatcgattctcctgtc

SEQ ID NO: 20486 - DNA, 20 bp, H. sapiens
aatcgcgccactgcactcca

SEQ ID NO: 20487 - DNA, 18 bp, H. sapiens
aatcgctggaacctggga

SEQ ID NO: 20488 - DNA, 16 bp, H. sapiens
aatcgcttgaacccaa

SEQ ID NO: 20489 - DNA, 16 bp, H. sapiens
aatcgcttgaacccag

SEQ ID NO: 20490 - DNA, 20 bp, H. sapiens
aatcgcttgaacccgagagg

SEQ ID NO: 20491 - DNA, 16 bp, H. sapiens
aatcgcttgaaccgag

SEQ ID NO: 20492 - DNA, 16 bp, H. sapiens
aatcgcttgaatccgg

SEQ ID NO: 20493 - DNA, 16 bp, H. sapiens
aatcggaattagctta

SEQ ID NO: 20494 - DNA, 16 bp, H. sapiens
aatctaaaagtttaaa

SEQ ID NO: 20495 - DNA, 16 bp, H. sapiens
aatctaaaattgctct

SEQ ID NO: 20496 - DNA, 16 bp, H. sapiens
aatctaagaatgagga

SEQ ID NO: 20497 - DNA, 16 bp, H. sapiens
aatctaatgcctaatg

SEQ ID NO: 20498 - DNA, 16 bp, H. sapiens
aatctaatggaatgga

SEQ ID NO: 20499 - DNA, 16 bp, H. sapiens
aatctacacatccaag

SEQ ID NO: 20500 - DNA, 16 bp, H. sapiens
aatctacagtgaactc

SEQ ID NO: 20501 - DNA, 16 bp, H. sapiens
aatctaccaaaaatga

SEQ ID NO: 20502 - DNA, 16 bp, H. sapiens
aatctacctgccttgg

SEQ ID NO: 20503 - DNA, 16 bp, H. sapiens
aatctacgaagaactt

SEQ ID NO: 20504 - DNA, 16 bp, H. sapiens
aatctactctgcctgt

SEQ ID NO: 20505 - DNA, 16 bp, H. sapiens
aatctactgttgatgg

SEQ ID NO: 20506 - DNA, 16 bp, H. sapiens
aatctagaaatgattt

SEQ ID NO: 20507 - DNA, 16 bp, H. sapiens
aatctagaagaaatga

SEQ ID NO: 20508 - DNA, 16 bp, H. sapiens
aatctagaatttagaa

SEQ ID NO: 20509 - DNA, 16 bp, H. sapiens
aatctagagaggcagt

SEQ ID NO: 20510 - DNA, 18 bp, H. sapiens
aatctataatctatagaa

SEQ ID NO: 20511 - DNA, 16 bp, H. sapiens
aatctataatgaagat

SEQ ID NO: 20512 - DNA, 16 bp, H. sapiens
aatctatccatttctt

SEQ ID NO: 20513 - DNA, 16 bp, H. sapiens
aatctatgaagaaaaa

SEQ ID NO: 20514 - DNA, 16 bp, H. sapiens
aatctatggatgtgga

SEQ ID NO: 20515 - DNA, 16 bp, H. sapiens
aatctattttgtctaa

SEQ ID NO: 20516 - DNA, 16 bp, H. sapiens
aatctcaaactcctgg

SEQ ID NO: 20517 - DNA, 16 bp, H. sapiens
aatctcaataaattca

SEQ ID NO: 20518 - DNA, 16 bp, H. sapiens
aatctcaataaatttt

SEQ ID NO: 20519 - DNA, 16 bp, H. sapiens
aatctcaccctgttgc

SEQ ID NO: 20520 - DNA, 16 bp, H. sapiens
aatctcactacttgtt

SEQ ID NO: 20521 - DNA, 16 bp, H. sapiens
aatctcactttgaatt

SEQ ID NO: 20522 - DNA, 16 bp, H. sapiens
aatctcagacttccag

SEQ ID NO: 20523 - DNA, 16 bp, H. sapiens
aatctcagcaccttgg

SEQ ID NO: 20524 - DNA, 18 bp, H. sapiens
aatctcagcacgttggga

SEQ ID NO: 20525 - DNA, 16 bp, H. sapiens
aatctcagcactttgt

SEQ ID NO: 20526 - DNA, 24 bp, H. sapiens
aatctcagcattttgggaggccga

SEQ ID NO: 20527 - DNA, 16 bp, H. sapiens
aatctcagctactggg

SEQ ID NO: 20528 - DNA, 16 bp, H. sapiens
aatctcagctattcgg

SEQ ID NO: 20529 - DNA, 16 bp, H. sapiens
aatctcagctccacca

SEQ ID NO: 20530 - DNA, 16 bp, H. sapiens
aatctcatcagaaaag

SEQ ID NO: 20531 - DNA, 16 bp, H. sapiens
aatctcatctggaatt

SEQ ID NO: 20532 - DNA, 16 bp, H. sapiens
aatctcatgctgaaat

SEQ ID NO: 20533 - DNA, 16 bp, H. sapiens
aatctcatgttgaaac

SEQ ID NO: 20534 - DNA, 16 bp, H. sapiens
aatctcattttgaaat

SEQ ID NO: 20535 - DNA, 16 bp, H. sapiens
aatctcatttttaaat

SEQ ID NO: 20536 - DNA, 16 bp, H. sapiens
aatctccaaactgctc

SEQ ID NO: 20537 - DNA, 16 bp, H. sapiens
aatctccagaacctgt

SEQ ID NO: 20538 - DNA, 16 bp, H. sapiens
aatctccatactgttt

SEQ ID NO: 20539 - DNA, 16 bp, H. sapiens
aatctccattctgttt

SEQ ID NO: 20540 - DNA, 16 bp, H. sapiens
aatctccctattttaa

SEQ ID NO: 20541 - DNA, 16 bp, H. sapiens
aatctcctgggctcaa

SEQ ID NO: 20542 - DNA, 17 bp, H. sapiens
aatctcgactcactgca

SEQ ID NO: 20543 - DNA, 17 bp, H. sapiens
aatctcggcactttggg

SEQ ID NO: 20544 - DNA, 16 bp, H. sapiens
aatctcggctcactgt

SEQ ID NO: 20545 - DNA, 16 bp, H. sapiens
aatctctctctcacac

SEQ ID NO: 20546 - DNA, 16 bp, H. sapiens
aatctctgagacacag

SEQ ID NO: 20547 - DNA, 16 bp, H. sapiens
aatctctgatatcttt

SEQ ID NO: 20548 - DNA, 16 bp, H. sapiens
aatctctgccttcatc

SEQ ID NO: 20549 - DNA, 19 bp, H. sapiens
aatctctgctagggcagtg

SEQ ID NO: 20550 - DNA, 16 bp, H. sapiens
aatctctgggatgcag

SEQ ID NO: 20551 - DNA, 16 bp, H. sapiens
aatctcttctatttat

SEQ ID NO: 20552 - DNA, 16 bp, H. sapiens
aatctcttctggaaat

SEQ ID NO: 20553 - DNA, 16 bp, H. sapiens
aatctctttaaaaaat

SEQ ID NO: 20554 - DNA, 16 bp, H. sapiens
aatctgaaaaatgttt

SEQ ID NO: 20555 - DNA, 16 bp, H. sapiens
aatctgaaaagaaatt

SEQ ID NO: 20556 - DNA, 16 bp, H. sapiens
aatctgaaaaggaaat

SEQ ID NO: 20557 - DNA, 16 bp, H. sapiens
aatctgaaaatgaaat

SEQ ID NO: 20558 - DNA, 16 bp, H. sapiens
aatctgaaactttctg

SEQ ID NO: 20559 - DNA, 16 bp, H. sapiens
aatctgaaatccagaa

SEQ ID NO: 20560 - DNA, 16 bp, H. sapiens
aatctgaaatctgaaa

SEQ ID NO: 20561 - DNA, 16 bp, H. sapiens
aatctgaaatgctcca

SEQ ID NO: 20562 - DNA, 16 bp, H. sapiens
aatctgaaattcaaaa

SEQ ID NO: 20563 - DNA, 16 bp, H. sapiens
aatctgaagaagaaat

SEQ ID NO: 20564 - DNA, 16 bp, H. sapiens
aatctgaataaagtct

SEQ ID NO: 20565 - DNA, 16 bp, H. sapiens
aatctgaataaagtgt

SEQ ID NO: 20566 - DNA, 16 bp, H. sapiens
aatctgaattttaaaa

SEQ ID NO: 20567 - DNA, 16 bp, H. sapiens
aatctgaatttttttt

SEQ ID NO: 20568 - DNA, 16 bp, H. sapiens
aatctgataggttttc

SEQ ID NO: 20569 - DNA, 16 bp, H. sapiens
aatctgatgaaagcta

SEQ ID NO: 20570 - DNA, 16 bp, H. sapiens
aatctgattggcccag

SEQ ID NO: 20571 - DNA, 16 bp, H. sapiens
aatctgatttaaaaat

SEQ ID NO: 20572 - DNA, 16 bp, H. sapiens
aatctgattttaaaaa

SEQ ID NO: 20573 - DNA, 16 bp, H. sapiens
aatctgattttctttt

SEQ ID NO: 20574 - DNA, 16 bp, H. sapiens
aatctgatttttccaa

SEQ ID NO: 20575 - DNA, 16 bp, H. sapiens
aatctgcagaatggga

SEQ ID NO: 20576 - DNA, 16 bp, H. sapiens
aatctgcattttaaaa

SEQ ID NO: 20577 - DNA, 16 bp, H. sapiens
aatctgcattttaaca

SEQ ID NO: 20578 - DNA, 16 bp, H. sapiens
aatctgcattttaatg

SEQ ID NO: 20579 - DNA, 16 bp, H. sapiens
aatctgcattttgaca

SEQ ID NO: 20580 - DNA, 16 bp, H. sapiens
aatctgcccacctcag

SEQ ID NO: 20581 - DNA, 16 bp, H. sapiens
aatctgcccaccttga

SEQ ID NO: 20582 - DNA, 16 bp, H. sapiens
aatctgcccaccttgg

SEQ ID NO: 20583 - DNA, 17 bp, H. sapiens
aatctgcccgccttggc

SEQ ID NO: 20584 - DNA, 16 bp, H. sapiens
aatctgcctgcctagg

SEQ ID NO: 20585 - DNA, 16 bp, H. sapiens
aatctgcctgcttcag

SEQ ID NO: 20586 - DNA, 16 bp, H. sapiens
aatctgctggcacctt

SEQ ID NO: 20587 - DNA, 16 bp, H. sapiens
aatctgctggcatctt

SEQ ID NO: 20588 - DNA, 16 bp, H. sapiens
aatctgctttttaaca

SEQ ID NO: 20589 - DNA, 16 bp, H. sapiens
aatctggaaaatattt

SEQ ID NO: 20590 - DNA, 16 bp, H. sapiens
aatctggaaggcagag

SEQ ID NO: 20591 - DNA, 16 bp, H. sapiens
aatctggaattttatt

SEQ ID NO: 20592 - DNA, 16 bp, H. sapiens
aatctggagagacagg

SEQ ID NO: 20593 - DNA, 16 bp, H. sapiens
aatctggatacctttt

SEQ ID NO: 20594 - DNA, 16 bp, H. sapiens
aatctggatgtctttt

SEQ ID NO: 20595 - DNA, 16 bp, H. sapiens
aatctggccctcaaac

SEQ ID NO: 20596 - DNA, 16 bp, H. sapiens
aatctggctgccttca

SEQ ID NO: 20597 - DNA, 16 bp, H. sapiens
aatctgggaagtggag

SEQ ID NO: 20598 - DNA, 16 bp, H. sapiens
aatctgggaggcagaa

SEQ ID NO: 20599 - DNA, 16 bp, H. sapiens
aatctgggcactttgg

SEQ ID NO: 20600 - DNA, 16 bp, H. sapiens
aatctgggtgctgctg

SEQ ID NO: 20601 - DNA, 16 bp, H. sapiens
aatctgggtggtcctg

SEQ ID NO: 20602 - DNA, 16 bp, H. sapiens
aatctggtggggactt

SEQ ID NO: 20603 - DNA, 16 bp, H. sapiens
aatctggttcaacttt

SEQ ID NO: 20604 - DNA, 16 bp, H. sapiens
aatctggttttctttt

SEQ ID NO: 20605 - DNA, 16 bp, H. sapiens
aatctgtaaaatattt

SEQ ID NO: 20606 - DNA, 16 bp, H. sapiens
aatctgtaaattactt

SEQ ID NO: 20607 - DNA, 16 bp, H. sapiens
aatctgtaattaaaaa

SEQ ID NO: 20608 - DNA, 16 bp, H. sapiens
aatctgtacaaaaaac

SEQ ID NO: 20609 - DNA, 16 bp, H. sapiens
aatctgtacatgaatg

SEQ ID NO: 20610 - DNA, 16 bp, H. sapiens
aatctgtagatggctt

SEQ ID NO: 20611 - DNA, 16 bp, H. sapiens
aatctgtagattggtt

SEQ ID NO: 20612 - DNA, 16 bp, H. sapiens
aatctgtcactgatgg

SEQ ID NO: 20613 - DNA, 16 bp, H. sapiens
aatctgtctttgtctt

SEQ ID NO: 20614 - DNA, 16 bp, H. sapiens
aatctgtcttttgtta

SEQ ID NO: 20615 - DNA, 16 bp, H. sapiens
aatctgtgaacttgaa

SEQ ID NO: 20616 - DNA, 16 bp, H. sapiens
aatctgtgaaggaaca

SEQ ID NO: 20617 - DNA, 16 bp, H. sapiens
aatctgtgtatttttt

SEQ ID NO: 20618 - DNA, 16 bp, H. sapiens
aatctgttttataatt

SEQ ID NO: 20619 - DNA, 16 bp, H. sapiens
aatctgttttccattt

SEQ ID NO: 20620 - DNA, 16 bp, H. sapiens
aatctgtttttcaaaa

SEQ ID NO: 20621 - DNA, 16 bp, H. sapiens
aatcttaaaaataaag

SEQ ID NO: 20622 - DNA, 16 bp, H. sapiens
aatcttaaagctctaa

SEQ ID NO: 20623 - DNA, 16 bp, H. sapiens
aatcttaaatgaaaaa

SEQ ID NO: 20624 - DNA, 16 bp, H. sapiens
aatcttaacattttgg

SEQ ID NO: 20625 - DNA, 16 bp, H. sapiens
aatcttatttggaaat

SEQ ID NO: 20626 - DNA, 16 bp, H. sapiens
aatcttcacaacaaca

SEQ ID NO: 20627 - DNA, 16 bp, H. sapiens
aatcttcaccacaacc

SEQ ID NO: 20628 - DNA, 16 bp, H. sapiens
aatcttcattttaaaa

SEQ ID NO: 20629 - DNA, 16 bp, H. sapiens
aatcttcccacttcag

SEQ ID NO: 20630 - DNA, 16 bp, H. sapiens
aatcttctcaccttgg

SEQ ID NO: 20631 - DNA, 16 bp, H. sapiens
aatcttctctagatta

SEQ ID NO: 20632 - DNA, 16 bp, H. sapiens
aatcttctctctcaag

SEQ ID NO: 20633 - DNA, 16 bp, H. sapiens
aatcttctgggctcaa

SEQ ID NO: 20634 - DNA, 16 bp, H. sapiens
aatcttgaaaagaaaa

SEQ ID NO: 20635 - DNA, 16 bp, H. sapiens
aatcttgccagcatct

SEQ ID NO: 20636 - DNA, 16 bp, H. sapiens
aatcttggaaaagaaa

SEQ ID NO: 20637 - DNA, 16 bp, H. sapiens
aatcttggacttccca

SEQ ID NO: 20638 - DNA, 16 bp, H. sapiens
aatcttggatttccca

SEQ ID NO: 20639 - DNA, 20 bp, H. sapiens
aatcttggctcactgcaact

SEQ ID NO: 20640 - DNA, 18 bp, H. sapiens
aatcttggctcactgcat

SEQ ID NO: 20641 - DNA, 17 bp, H. sapiens
aatcttggctcagtgca

SEQ ID NO: 20642 - DNA, 17 bp, H. sapiens
aatcttggctcgctgca

SEQ ID NO: 20643 - DNA, 16 bp, H. sapiens
aatcttgggcaagtca

SEQ ID NO: 20644 - DNA, 16 bp, H. sapiens
aatcttgggcaagtta

SEQ ID NO: 20645 - DNA, 16 bp, H. sapiens
aatcttggtctccaca

SEQ ID NO: 20646 - DNA, 16 bp, H. sapiens
aatcttgttaaaatgc

SEQ ID NO: 20647 - DNA, 16 bp, H. sapiens
aatctttaggtttttc

SEQ ID NO: 20648 - DNA, 16 bp, H. sapiens
aatctttatcaaaatt

SEQ ID NO: 20649 - DNA, 16 bp, H. sapiens
aatctttattgagtgc

SEQ ID NO: 20650 - DNA, 16 bp, H. sapiens
aatctttattttcagt

SEQ ID NO: 20651 - DNA, 16 bp, H. sapiens
aatctttcctgcctgc

SEQ ID NO: 20652 - DNA, 16 bp, H. sapiens
aatctttctcaaactc

SEQ ID NO: 20653 - DNA, 16 bp, H. sapiens
aatctttctgcttttt

SEQ ID NO: 20654 - DNA, 16 bp, H. sapiens
aatctttcttttaaaa

SEQ ID NO: 20655 - DNA, 16 bp, H. sapiens
aatctttcttttgatt

SEQ ID NO: 20656 - DNA, 16 bp, H. sapiens
aatctttgaggaaaag

SEQ ID NO: 20657 - DNA, 16 bp, H. sapiens
aatctttgctttcttt

SEQ ID NO: 20658 - DNA, 16 bp, H. sapiens
aatctttgggacacag

SEQ ID NO: 20659 - DNA, 16 bp, H. sapiens
aatcttttgtatttta

SEQ ID NO: 20660 - DNA, 16 bp, H. sapiens
aatctttttcccattg

SEQ ID NO: 20661 - DNA, 16 bp, H. sapiens
aatctttttgtagtat

SEQ ID NO: 20662 - DNA, 16 bp, H. sapiens
aatgaaaaaaaatctt

SEQ ID NO: 20663 - DNA, 16 bp, H. sapiens
aatgaaaaaaatcttt

SEQ ID NO: 20664 - DNA, 16 bp, H. sapiens
aatgaaaaaagttttt

SEQ ID NO: 20665 - DNA, 16 bp, H. sapiens
aatgaaaaaatcctca

SEQ ID NO: 20666 - DNA, 16 bp, H. sapiens
aatgaaaaacttaaat

SEQ ID NO: 20667 - DNA, 16 bp, H. sapiens
aatgaaaaagaaatct

SEQ ID NO: 20668 - DNA, 16 bp, H. sapiens
aatgaaaaagacattt

SEQ ID NO: 20669 - DNA, 16 bp, H. sapiens
aatgaaaaagcacact

SEQ ID NO: 20670 - DNA, 16 bp, H. sapiens
aatgaaaaatattttc

SEQ ID NO: 20671 - DNA, 16 bp, H. sapiens
aatgaaaaattattca

SEQ ID NO: 20672 - DNA, 16 bp, H. sapiens
aatgaaaacaaatact

SEQ ID NO: 20673 - DNA, 16 bp, H. sapiens
aatgaaaacaattttt

SEQ ID NO: 20674 - DNA, 16 bp, H. sapiens
aatgaaaacacaggtt

SEQ ID NO: 20675 - DNA, 16 bp, H. sapiens
aatgaaaacacatttt

SEQ ID NO: 20676 - DNA, 16 bp, H. sapiens
aatgaaaacaggccag

SEQ ID NO: 20677 - DNA, 16 bp, H. sapiens
aatgaaaacatttaaa

SEQ ID NO: 20678 - DNA, 16 bp, H. sapiens
aatgaaaacatttaat

SEQ ID NO: 20679 - DNA, 16 bp, H. sapiens
aatgaaaacatttgtt

SEQ ID NO: 20680 - DNA, 16 bp, H. sapiens
aatgaaaacattttca

SEQ ID NO: 20681 - DNA, 16 bp, H. sapiens
aatgaaaaccaaattt

SEQ ID NO: 20682 - DNA, 16 bp, H. sapiens
aatgaaaactgagaaa

SEQ ID NO: 20683 - DNA, 16 bp, H. sapiens
aatgaaaacttgtttt

SEQ ID NO: 20684 - DNA, 16 bp, H. sapiens
aatgaaaactttcttt

SEQ ID NO: 20685 - DNA, 16 bp, H. sapiens
aatgaaaagaaatgca

SEQ ID NO: 20686 - DNA, 16 bp, H. sapiens
aatgaaaagacaaact

SEQ ID NO: 20687 - DNA, 16 bp, H. sapiens
aatgaaaagacagaga

SEQ ID NO: 20688 - DNA, 16 bp, H. sapiens
aatgaaaagacaggtt

SEQ ID NO: 20689 - DNA, 16 bp, H. sapiens
aatgaaaagatatttt

SEQ ID NO: 20690 - DNA, 16 bp, H. sapiens
aatgaaaaggaagcag

SEQ ID NO: 20691 - DNA, 16 bp, H. sapiens
aatgaaaagtaatttt

SEQ ID NO: 20692 - DNA, 16 bp, H. sapiens
aatgaaaagttatttt

SEQ ID NO: 20693 - DNA, 16 bp, H. sapiens
aatgaaaagtttattt

SEQ ID NO: 20694 - DNA, 16 bp, H. sapiens
aatgaaaataactgaa

SEQ ID NO: 20695 - DNA, 16 bp, H. sapiens
aatgaaaataagtttt

SEQ ID NO: 20696 - DNA, 16 bp, H. sapiens
aatgaaaataatacta

SEQ ID NO: 20697 - DNA, 16 bp, H. sapiens
aatgaaaataattcat

SEQ ID NO: 20698 - DNA, 16 bp, H. sapiens
aatgaaaatacatgtt

SEQ ID NO: 20699 - DNA, 16 bp, H. sapiens
aatgaaaatatatcaa

SEQ ID NO: 20700 - DNA, 16 bp, H. sapiens
aatgaaaatatccttt

SEQ ID NO: 20701 - DNA, 16 bp, H. sapiens
aatgaaaatcaaacca

SEQ ID NO: 20702 - DNA, 16 bp, H. sapiens
aatgaaaatgacaata

SEQ ID NO: 20703 - DNA, 16 bp, H. sapiens
aatgaaaatgagaaca

SEQ ID NO: 20704 - DNA, 16 bp, H. sapiens
aatgaaaatgattttt

SEQ ID NO: 20705 - DNA, 16 bp, H. sapiens
aatgaaaatggaagca

SEQ ID NO: 20706 - DNA, 16 bp, H. sapiens
aatgaaaatgtatgtt

SEQ ID NO: 20707 - DNA, 16 bp, H. sapiens
aatgaaaatgtcctaa

SEQ ID NO: 20708 - DNA, 16 bp, H. sapiens
aatgaaaatgtgattt

SEQ ID NO: 20709 - DNA, 16 bp, H. sapiens
aatgaaaatgttattt

SEQ ID NO: 20710 - DNA, 16 bp, H. sapiens
aatgaaaatgttctga

SEQ ID NO: 20711 - DNA, 16 bp, H. sapiens
aatgaaaatgttctgt

SEQ ID NO: 20712 - DNA, 16 bp, H. sapiens
aatgaaaattccagaa

SEQ ID NO: 20713 - DNA, 16 bp, H. sapiens
aatgaaaattctagaa

SEQ ID NO: 20714 - DNA, 16 bp, H. sapiens
aatgaaaattctgaaa

SEQ ID NO: 20715 - DNA, 16 bp, H. sapiens
aatgaaaatttattct

SEQ ID NO: 20716 - DNA, 16 bp, H. sapiens
aatgaaaatttccttt

SEQ ID NO: 20717 - DNA, 16 bp, H. sapiens
aatgaaacaaaaatgt

SEQ ID NO: 20718 - DNA, 16 bp, H. sapiens
aatgaaacaaaatttt

SEQ ID NO: 20719 - DNA, 16 bp, H. sapiens
aatgaaacaaagagtt

SEQ ID NO: 20720 - DNA, 16 bp, H. sapiens
aatgaaacagaacaga

SEQ ID NO: 20721 - DNA, 16 bp, H. sapiens
aatgaaacagaatgaa

SEQ ID NO: 20722 - DNA, 16 bp, H. sapiens
aatgaaaccacatctg

SEQ ID NO: 20723 - DNA, 16 bp, H. sapiens
aatgaaaccccatctc

SEQ ID NO: 20724 - DNA, 16 bp, H. sapiens
aatgaaaccctgtttc

SEQ ID NO: 20725 - DNA, 17 bp, H. sapiens
aatgaaactaaagagct

SEQ ID NO: 20726 - DNA, 16 bp, H. sapiens
aatgaaactgaaaaat

SEQ ID NO: 20727 - DNA, 16 bp, H. sapiens
aatgaaactgaatcct

SEQ ID NO: 20728 - DNA, 16 bp, H. sapiens
aatgaaactggatctt

SEQ ID NO: 20729 - DNA, 16 bp, H. sapiens
aatgaaactgtaaacc

SEQ ID NO: 20730 - DNA, 16 bp, H. sapiens
aatgaaactttaaaaa

SEQ ID NO: 20731 - DNA, 16 bp, H. sapiens
aatgaaactttattta

SEQ ID NO: 20732 - DNA, 16 bp, H. sapiens
aatgaaagaaaaagct

SEQ ID NO: 20733 - DNA, 16 bp, H. sapiens
aatgaaagaaaatgtg

SEQ ID NO: 20734 - DNA, 16 bp, H. sapiens
aatgaaagaagacaga

SEQ ID NO: 20735 - DNA, 16 bp, H. sapiens
aatgaaagaatgaatg

SEQ ID NO: 20736 - DNA, 16 bp, H. sapiens
aatgaaagatttttgt

SEQ ID NO: 20737 - DNA, 16 bp, H. sapiens
aatgaaagcattttct

SEQ ID NO: 20738 - DNA, 16 bp, H. sapiens
aatgaaaggaaattat

SEQ ID NO: 20739 - DNA, 16 bp, H. sapiens
aatgaaaggacactag

SEQ ID NO: 20740 - DNA, 16 bp, H. sapiens
aatgaaaggccaccaa

SEQ ID NO: 20741 - DNA, 16 bp, H. sapiens
aatgaaagtgacctct

SEQ ID NO: 20742 - DNA, 16 bp, H. sapiens
aatgaaagtgagaact

SEQ ID NO: 20743 - DNA, 16 bp, H. sapiens
aatgaaagttttattt

SEQ ID NO: 20744 - DNA, 16 bp, H. sapiens
aatgaaataaaccaga

SEQ ID NO: 20745 - DNA, 16 bp, H. sapiens
aatgaaataaagcatg

SEQ ID NO: 20746 - DNA, 16 bp, H. sapiens
aatgaaataaatacat

SEQ ID NO: 20747 - DNA, 16 bp, H. sapiens
aatgaaataacatttt

SEQ ID NO: 20748 - DNA, 16 bp, H. sapiens
aatgaaataagcaaat

SEQ ID NO: 20749 - DNA, 16 bp, H. sapiens
aatgaaataatacaga

SEQ ID NO: 20750 - DNA, 16 bp, H. sapiens
aatgaaataatccaaa

SEQ ID NO: 20751 - DNA, 16 bp, H. sapiens
aatgaaataatgcatg

SEQ ID NO: 20752 - DNA, 16 bp, H. sapiens
aatgaaataatgtaca

SEQ ID NO: 20753 - DNA, 16 bp, H. sapiens
aatgaaatacctagga

SEQ ID NO: 20754 - DNA, 16 bp, H. sapiens
aatgaaatactacata

SEQ ID NO: 20755 - DNA, 16 bp, H. sapiens
aatgaaatattttaca

SEQ ID NO: 20756 - DNA, 16 bp, H. sapiens
aatgaaatcacacagt

SEQ ID NO: 20757 - DNA, 16 bp, H. sapiens
aatgaaatcatattaa

SEQ ID NO: 20758 - DNA, 16 bp, H. sapiens
aatgaaatcatcaaat

SEQ ID NO: 20759 - DNA, 16 bp, H. sapiens
aatgaaatcattttca

SEQ ID NO: 20760 - DNA, 16 bp, H. sapiens
aatgaaatcgaatgga

SEQ ID NO: 20761 - DNA, 16 bp, H. sapiens
aatgaaatgaaatgat

SEQ ID NO: 20762 - DNA, 16 bp, H. sapiens
aatgaaatggaatgaa

SEQ ID NO: 20763 - DNA, 16 bp, H. sapiens
aatgaaatgtatttct

SEQ ID NO: 20764 - DNA, 16 bp, H. sapiens
aatgaaatgtgaaaat

SEQ ID NO: 20765 - DNA, 16 bp, H. sapiens
aatgaaattaaaagct

SEQ ID NO: 20766 - DNA, 16 bp, H. sapiens
aatgaaattaaatgtt

SEQ ID NO: 20767 - DNA, 16 bp, H. sapiens
aatgaaattactttct

SEQ ID NO: 20768 - DNA, 16 bp, H. sapiens
aatgaaattcttaaaa

SEQ ID NO: 20769 - DNA, 16 bp, H. sapiens
aatgaaattgaaatga

SEQ ID NO: 20770 - DNA, 16 bp, H. sapiens
aatgaaatttcaggga

SEQ ID NO: 20771 - DNA, 16 bp, H. sapiens
aatgaaatttgagaaa

SEQ ID NO: 20772 - DNA, 16 bp, H. sapiens
aatgaaattttgatat

SEQ ID NO: 20773 - DNA, 16 bp, H. sapiens
aatgaaattttgtcat

SEQ ID NO: 20774 - DNA, 16 bp, H. sapiens
aatgaacaaacaaacc

SEQ ID NO: 20775 - DNA, 16 bp, H. sapiens
aatgaacaaatgaaag

SEQ ID NO: 20776 - DNA, 16 bp, H. sapiens
aatgaacaaatgaata

SEQ ID NO: 20777 - DNA, 16 bp, H. sapiens
aatgaacaaattaatg

SEQ ID NO: 20778 - DNA, 16 bp, H. sapiens
aatgaacaagcaaata

SEQ ID NO: 20779 - DNA, 16 bp, H. sapiens
aatgaacaaggcctcc

SEQ ID NO: 20780 - DNA, 16 bp, H. sapiens
aatgaacagttagaaa

SEQ ID NO: 20781 - DNA, 16 bp, H. sapiens
aatgaaccatgattgt

SEQ ID NO: 20782 - DNA, 16 bp, H. sapiens
aatgaaccattttaaa

SEQ ID NO: 20783 - DNA, 16 bp, H. sapiens
aatgaacgaatgaatg

SEQ ID NO: 20784 - DNA, 16 bp, H. sapiens
aatgaactcaaattta

SEQ ID NO: 20785 - DNA, 18 bp, H. sapiens
aatgaactcatccttttt

SEQ ID NO: 20786 - DNA, 16 bp, H. sapiens
aatgaactgaaaataa

SEQ ID NO: 20787 - DNA, 16 bp, H. sapiens
aatgaacttgaagaca

SEQ ID NO: 20788 - DNA, 16 bp, H. sapiens
aatgaactttaaaaaa

SEQ ID NO: 20789 - DNA, 16 bp, H. sapiens
aatgaacttttaattt

SEQ ID NO: 20790 - DNA, 16 bp, H. sapiens
aatgaagaaaaatgtg

SEQ ID NO: 20791 - DNA, 16 bp, H. sapiens
aatgaagaaaatcatt

SEQ ID NO: 20792 - DNA, 16 bp, H. sapiens
aatgaagaaaatgaca

SEQ ID NO: 20793 - DNA, 16 bp, H. sapiens
aatgaagaaaatgatg

SEQ ID NO: 20794 - DNA, 16 bp, H. sapiens
aatgaagaaaatgcag

SEQ ID NO: 20795 - DNA, 16 bp, H. sapiens
aatgaagaaactgtgg

SEQ ID NO: 20796 - DNA, 16 bp, H. sapiens
aatgaagaaagagcaa

SEQ ID NO: 20797 - DNA, 16 bp, H. sapiens
aatgaagaaagcctat

SEQ ID NO: 20798 - DNA, 16 bp, H. sapiens
aatgaagaaattgaag

SEQ ID NO: 20799 - DNA, 16 bp, H. sapiens
aatgaagaagaaaatc

SEQ ID NO: 20800 - DNA, 16 bp, H. sapiens
aatgaagacaagtgga

SEQ ID NO: 20801 - DNA, 16 bp, H. sapiens
aatgaagacaataaca

SEQ ID NO: 20802 - DNA, 16 bp, H. sapiens
aatgaagacagaaata

SEQ ID NO: 20803 - DNA, 16 bp, H. sapiens
aatgaagacatacctg

SEQ ID NO: 20804 - DNA, 16 bp, H. sapiens
aatgaagacattaaaa

SEQ ID NO: 20805 - DNA, 16 bp, H. sapiens
aatgaagatactaaga

SEQ ID NO: 20806 - DNA, 16 bp, H. sapiens
aatgaagatattaaga

SEQ ID NO: 20807 - DNA, 16 bp, H. sapiens
aatgaagatcatcaag

SEQ ID NO: 20808 - DNA, 16 bp, H. sapiens
aatgaagatgatgatg

SEQ ID NO: 20809 - DNA, 16 bp, H. sapiens
aatgaagatggaaatt

SEQ ID NO: 20810 - DNA, 16 bp, H. sapiens
aatgaagattaaatga

SEQ ID NO: 20811 - DNA, 16 bp, H. sapiens
aatgaagcagaaagga

SEQ ID NO: 20812 - DNA, 16 bp, H. sapiens
aatgaagcagaagaaa

SEQ ID NO: 20813 - DNA, 16 bp, H. sapiens
aatgaagcagaataaa

SEQ ID NO: 20814 - DNA, 16 bp, H. sapiens
aatgaagccaacttga

SEQ ID NO: 20815 - DNA, 16 bp, H. sapiens
aatgaagctgaaaaat

SEQ ID NO: 20816 - DNA, 17 bp, H. sapiens
aatgaagctggaagcca

SEQ ID NO: 20817 - DNA, 16 bp, H. sapiens
aatgaaggaaaaaatc

SEQ ID NO: 20818 - DNA, 16 bp, H. sapiens
aatgaaggaaaacatt

SEQ ID NO: 20819 - DNA, 16 bp, H. sapiens
aatgaaggaaattctg

SEQ ID NO: 20820 - DNA, 16 bp, H. sapiens
aatgaaggacaaaaat

SEQ ID NO: 20821 - DNA, 16 bp, H. sapiens
aatgaaggacaaaacc

SEQ ID NO: 20822 - DNA, 16 bp, H. sapiens
aatgaaggagaaatca

SEQ ID NO: 20823 - DNA, 16 bp, H. sapiens
aatgaaggcaaaataa

SEQ ID NO: 20824 - DNA, 16 bp, H. sapiens
aatgaagggatttatt

SEQ ID NO: 20825 - DNA, 16 bp, H. sapiens
aatgaaggggaaatca

SEQ ID NO: 20826 - DNA, 16 bp, H. sapiens
aatgaaggtgaaataa

SEQ ID NO: 20827 - DNA, 16 bp, H. sapiens
aatgaagtattattat

SEQ ID NO: 20828 - DNA, 16 bp, H. sapiens
aatgaagtattatttt

SEQ ID NO: 20829 - DNA, 16 bp, H. sapiens
aatgaagtgatgtgta

SEQ ID NO: 20830 - DNA, 16 bp, H. sapiens
aatgaagttgaaaaat

SEQ ID NO: 20831 - DNA, 16 bp, H. sapiens
aatgaagttggacctt

SEQ ID NO: 20832 - DNA, 16 bp, H. sapiens
aatgaagttttaaatt

SEQ ID NO: 20833 - DNA, 16 bp, H. sapiens
aatgaataaaaacatt

SEQ ID NO: 20834 - DNA, 16 bp, H. sapiens
aatgaataaactgaat

SEQ ID NO: 20835 - DNA, 16 bp, H. sapiens
aatgaataaagcaaat

SEQ ID NO: 20836 - DNA, 16 bp, H. sapiens
aatgaataaataactt

SEQ ID NO: 20837 - DNA, 16 bp, H. sapiens
aatgaataaatacata

SEQ ID NO: 20838 - DNA, 16 bp, H. sapiens
aatgaataaatcaaca

SEQ ID NO: 20839 - DNA, 16 bp, H. sapiens
aatgaataaatgcaca

SEQ ID NO: 20840 - DNA, 16 bp, H. sapiens
aatgaataaatgtttt

SEQ ID NO: 20841 - DNA, 16 bp, H. sapiens
aatgaataatataaca

SEQ ID NO: 20842 - DNA, 16 bp, H. sapiens
aatgaataattcagaa

SEQ ID NO: 20843 - DNA, 16 bp, H. sapiens
aatgaatactttaaaa

SEQ ID NO: 20844 - DNA, 16 bp, H. sapiens
aatgaatagtaaatgt

SEQ ID NO: 20845 - DNA, 16 bp, H. sapiens
aatgaatatatttatg

SEQ ID NO: 20846 - DNA, 16 bp, H. sapiens
aatgaatatgaaaaca

SEQ ID NO: 20847 - DNA, 16 bp, H. sapiens
aatgaatattttgaaa

SEQ ID NO: 20848 - DNA, 16 bp, H. sapiens
aatgaatcaagcagaa

SEQ ID NO: 20849 - DNA, 16 bp, H. sapiens
aatgaatcaatgaata

SEQ ID NO: 20850 - DNA, 16 bp, H. sapiens
aatgaatctttttttc

SEQ ID NO: 20851 - DNA, 16 bp, H. sapiens
aatgaatgaaacattt

SEQ ID NO: 20852 - DNA, 16 bp, H. sapiens
aatgaatgaaagaaca

SEQ ID NO: 20853 - DNA, 16 bp, H. sapiens
aatgaatgaacaaatt

SEQ ID NO: 20854 - DNA, 16 bp, H. sapiens
aatgaatgaagagatg

SEQ ID NO: 20855 - DNA, 16 bp, H. sapiens
aatgaatgaataaaca

SEQ ID NO: 20856 - DNA, 16 bp, H. sapiens
aatgaatgaatacaga

SEQ ID NO: 20857 - DNA, 16 bp, H. sapiens
aatgaatgaatacatt

SEQ ID NO: 20858 - DNA, 16 bp, H. sapiens
aatgaatgaatcaaca

SEQ ID NO: 20859 - DNA, 16 bp, H. sapiens
aatgaatgaatgaata

SEQ ID NO: 20860 - DNA, 16 bp, H. sapiens
aatgaatgaatgaatc

SEQ ID NO: 20861 - DNA, 16 bp, H. sapiens
aatgaatgaatgaatt

SEQ ID NO: 20862 - DNA, 16 bp, H. sapiens
aatgaatgaatgtttc

SEQ ID NO: 20863 - DNA, 16 bp, H. sapiens
aatgaatgaattaatg

SEQ ID NO: 20864 - DNA, 16 bp, H. sapiens
aatgaatgacttattt

SEQ ID NO: 20865 - DNA, 16 bp, H. sapiens
aatgaatgagagttct

SEQ ID NO: 20866 - DNA, 16 bp, H. sapiens
aatgaatgagtgaagg

SEQ ID NO: 20867 - DNA, 16 bp, H. sapiens
aatgaatgattttaaa

SEQ ID NO: 20868 - DNA, 16 bp, H. sapiens
aatgaatggaaagaca

SEQ ID NO: 20869 - DNA, 16 bp, H. sapiens
aatgaatggatgcatg

SEQ ID NO: 20870 - DNA, 16 bp, H. sapiens
aatgaatggatggatg

SEQ ID NO: 20871 - DNA, 16 bp, H. sapiens
aatgaatgtatatttt

SEQ ID NO: 20872 - DNA, 16 bp, H. sapiens
aatgaatgtatttatt

SEQ ID NO: 20873 - DNA, 16 bp, H. sapiens
aatgaatgtttgttga

SEQ ID NO: 20874 - DNA, 16 bp, H. sapiens
aatgaattaaaaactt

SEQ ID NO: 20875 - DNA, 16 bp, H. sapiens
aatgaattagaaaatg

SEQ ID NO: 20876 - DNA, 16 bp, H. sapiens
aatgaattagtgaatg

SEQ ID NO: 20877 - DNA, 16 bp, H. sapiens
aatgaattcaaagaaa

SEQ ID NO: 20878 - DNA, 16 bp, H. sapiens
aatgaattctgtgttt

SEQ ID NO: 20879 - DNA, 16 bp, H. sapiens
aatgaattcttttttt

SEQ ID NO: 20880 - DNA, 16 bp, H. sapiens
aatgaatttggaagtg

SEQ ID NO: 20881 - DNA, 16 bp, H. sapiens
aatgaattttttaaag

SEQ ID NO: 20882 - DNA, 16 bp, H. sapiens
aatgaattttttcatt

SEQ ID NO: 20883 - DNA, 16 bp, H. sapiens
aatgacaaaaaccata

SEQ ID NO: 20884 - DNA, 16 bp, H. sapiens
aatgacaaaatcatct

SEQ ID NO: 20885 - DNA, 16 bp, H. sapiens
aatgacaaagggaata

SEQ ID NO: 20886 - DNA, 16 bp, H. sapiens
aatgacaaataatgtt

SEQ ID NO: 20887 - DNA, 16 bp, H. sapiens
aatgacaaatgtataa

SEQ ID NO: 20888 - DNA, 16 bp, H. sapiens
aatgacaaattttttt

SEQ ID NO: 20889 - DNA, 16 bp, H. sapiens
aatgacaattttattt

SEQ ID NO: 20890 - DNA, 16 bp, H. sapiens
aatgacacagcagcag

SEQ ID NO: 20891 - DNA, 16 bp, H. sapiens
aatgacagataaagaa

SEQ ID NO: 20892 - DNA, 16 bp, H. sapiens
aatgacaggaaaggaa

SEQ ID NO: 20893 - DNA, 16 bp, H. sapiens
aatgacagtgatgatg

SEQ ID NO: 20894 - DNA, 16 bp, H. sapiens
aatgacatatttaaaa

SEQ ID NO: 20895 - DNA, 16 bp, H. sapiens
aatgacatggatgaat

SEQ ID NO: 20896 - DNA, 16 bp, H. sapiens
aatgacatgggaaaat

SEQ ID NO: 20897 - DNA, 16 bp, H. sapiens
aatgacattcttcaca

SEQ ID NO: 20898 - DNA, 16 bp, H. sapiens
aatgacatttcaaaaa

SEQ ID NO: 20899 - DNA, 17 bp, H. sapiens
aatgaccaccattctaa

SEQ ID NO: 20900 - DNA, 16 bp, H. sapiens
aatgaccatactgtcc

SEQ ID NO: 20901 - DNA, 16 bp, H. sapiens
aatgaccatgatgatg

SEQ ID NO: 20902 - DNA, 16 bp, H. sapiens
aatgacccaaaagtta

SEQ ID NO: 20903 - DNA, 16 bp, H. sapiens
aatgacccagaagtta

SEQ ID NO: 20904 - DNA, 16 bp, H. sapiens
aatgacctccagttct

SEQ ID NO: 20905 - DNA, 16 bp, H. sapiens
aatgacctgaaggagc

SEQ ID NO: 20906 - DNA, 16 bp, H. sapiens
aatgacctgatggagt

SEQ ID NO: 20907 - DNA, 16 bp, H. sapiens
aatgactaaaacacca

SEQ ID NO: 20908 - DNA, 16 bp, H. sapiens
aatgactataaaataa

SEQ ID NO: 20909 - DNA, 16 bp, H. sapiens
aatgactccttttcct

SEQ ID NO: 20910 - DNA, 16 bp, H. sapiens
aatgactgccttgctg

SEQ ID NO: 20911 - DNA, 16 bp, H. sapiens
aatgacttactttcct

SEQ ID NO: 20912 - DNA, 16 bp, H. sapiens
aatgacttatattctt

SEQ ID NO: 20913 - DNA, 16 bp, H. sapiens
aatgacttcatcttaa

SEQ ID NO: 20914 - DNA, 16 bp, H. sapiens
aatgacttcttttgag

SEQ ID NO: 20915 - DNA, 16 bp, H. sapiens
aatgacttgcccaaag

SEQ ID NO: 20916 - DNA, 16 bp, H. sapiens
aatgacttgttcaagg

SEQ ID NO: 20917 - DNA, 16 bp, H. sapiens
aatgactttatttctc

SEQ ID NO: 20918 - DNA, 16 bp, H. sapiens
aatgactttattttct

SEQ ID NO: 20919 - DNA, 16 bp, H. sapiens
aatgactttattttta

SEQ ID NO: 20920 - DNA, 16 bp, H. sapiens
aatgactttcccaagg

SEQ ID NO: 20921 - DNA, 16 bp, H. sapiens
aatgagaaaacatatt

SEQ ID NO: 20922 - DNA, 16 bp, H. sapiens
aatgagaaaactgaag

SEQ ID NO: 20923 - DNA, 16 bp, H. sapiens
aatgagaaaagaacag

SEQ ID NO: 20924 - DNA, 16 bp, H. sapiens
aatgagaaaattgagg

SEQ ID NO: 20925 - DNA, 16 bp, H. sapiens
aatgagaaaatttttt

SEQ ID NO: 20926 - DNA, 16 bp, H. sapiens
aatgagaaagaaagca

SEQ ID NO: 20927 - DNA, 16 bp, H. sapiens
aatgagaaatacattt

SEQ ID NO: 20928 - DNA, 16 bp, H. sapiens
aatgagaaatctgaaa

SEQ ID NO: 20929 - DNA, 16 bp, H. sapiens
aatgagaaatgcaaat

SEQ ID NO: 20930 - DNA, 16 bp, H. sapiens
aatgagaaattaattt

SEQ ID NO: 20931 - DNA, 16 bp, H. sapiens
aatgagaacaacaaca

SEQ ID NO: 20932 - DNA, 16 bp, H. sapiens
aatgagaacacaggga

SEQ ID NO: 20933 - DNA, 16 bp, H. sapiens
aatgagaacagatgga

SEQ ID NO: 20934 - DNA, 16 bp, H. sapiens
aatgagaacatgcagt

SEQ ID NO: 20935 - DNA, 16 bp, H. sapiens
aatgagaacatgtggt

SEQ ID NO: 20936 - DNA, 16 bp, H. sapiens
aatgagaactataaaa

SEQ ID NO: 20937 - DNA, 16 bp, H. sapiens
aatgagaagaaaacat

SEQ ID NO: 20938 - DNA, 16 bp, H. sapiens
aatgagaaggcagcca

SEQ ID NO: 20939 - DNA, 16 bp, H. sapiens
aatgagaataatgata

SEQ ID NO: 20940 - DNA, 16 bp, H. sapiens
aatgagaatgataata

SEQ ID NO: 20941 - DNA, 16 bp, H. sapiens
aatgagacaccatctc

SEQ ID NO: 20942 - DNA, 16 bp, H. sapiens
aatgagacactgtctc

SEQ ID NO: 20943 - DNA, 16 bp, H. sapiens
aatgagaccctgtgtc

SEQ ID NO: 20944 - DNA, 16 bp, H. sapiens
aatgagagaaaatatt

SEQ ID NO: 20945 - DNA, 16 bp, H. sapiens
aatgagagaaaatgtt

SEQ ID NO: 20946 - DNA, 16 bp, H. sapiens
aatgagagaaatgcaa

SEQ ID NO: 20947 - DNA, 16 bp, H. sapiens
aatgagagaagacaca

SEQ ID NO: 20948 - DNA, 16 bp, H. sapiens
aatgagagaatgaatg

SEQ ID NO: 20949 - DNA, 16 bp, H. sapiens
aatgagagaggacaca

SEQ ID NO: 20950 - DNA, 16 bp, H. sapiens
aatgagagcaaagaca

SEQ ID NO: 20951 - DNA, 16 bp, H. sapiens
aatgagataatgcatg

SEQ ID NO: 20952 - DNA, 16 bp, H. sapiens
aatgagatagcacctc

SEQ ID NO: 20953 - DNA, 16 bp, H. sapiens
aatgagatattatttt

SEQ ID NO: 20954 - DNA, 16 bp, H. sapiens
aatgagatcaaagctg

SEQ ID NO: 20955 - DNA, 16 bp, H. sapiens
aatgagatcccatttg

SEQ ID NO: 20956 - DNA, 16 bp, H. sapiens
aatgagatgcaagaga

SEQ ID NO: 20957 - DNA, 16 bp, H. sapiens
aatgagatgccatctt

SEQ ID NO: 20958 - DNA, 16 bp, H. sapiens
aatgagatttttaaaa

SEQ ID NO: 20959 - DNA, 16 bp, H. sapiens
aatgagcaaaaataat

SEQ ID NO: 20960 - DNA, 16 bp, H. sapiens
aatgagcaacaagaaa

SEQ ID NO: 20961 - DNA, 16 bp, H. sapiens
aatgagcacatgctgt

SEQ ID NO: 20962 - DNA, 16 bp, H. sapiens
aatgagcagtgaggat

SEQ ID NO: 20963 - DNA, 16 bp, H. sapiens
aatgagcagtgatatt

SEQ ID NO: 20964 - DNA, 16 bp, H. sapiens
aatgagcatataatga

SEQ ID NO: 20965 - DNA, 16 bp, H. sapiens
aatgagccaattaaac

SEQ ID NO: 20966 - DNA, 16 bp, H. sapiens
aatgagccaggcacgg

SEQ ID NO: 20967 - DNA, 16 bp, H. sapiens
aatgagctgggcgtga

SEQ ID NO: 20968 - DNA, 16 bp, H. sapiens
aatgagctttttaaaa

SEQ ID NO: 20969 - DNA, 16 bp, H. sapiens
aatgaggaaaaaatgt

SEQ ID NO: 20970 - DNA, 16 bp, H. sapiens
aatgaggaaaatatga

SEQ ID NO: 20971 - DNA, 16 bp, H. sapiens
aatgaggaaactaaag

SEQ ID NO: 20972 - DNA, 16 bp, H. sapiens
aatgaggaaattgaag

SEQ ID NO: 20973 - DNA, 17 bp, H. sapiens
aatgaggaagaagcaaa

SEQ ID NO: 20974 - DNA, 18 bp, H. sapiens
aatgaggaagaagcaaaa

SEQ ID NO: 20975 - DNA, 16 bp, H. sapiens
aatgaggaagaagtga

SEQ ID NO: 20976 - DNA, 16 bp, H. sapiens
aatgaggaagttgagg

SEQ ID NO: 20977 - DNA, 16 bp, H. sapiens
aatgaggaattttgga

SEQ ID NO: 20978 - DNA, 16 bp, H. sapiens
aatgaggacaataata

SEQ ID NO: 20979 - DNA, 16 bp, H. sapiens
aatgaggacactgagg

SEQ ID NO: 20980 - DNA, 16 bp, H. sapiens
aatgaggagctctgtg

SEQ ID NO: 20981 - DNA, 16 bp, H. sapiens
aatgaggaggaagcaa

SEQ ID NO: 20982 - DNA, 16 bp, H. sapiens
aatgaggcaggagaat

SEQ ID NO: 20983 - DNA, 16 bp, H. sapiens
aatgaggcccagagag

SEQ ID NO: 20984 - DNA, 16 bp, H. sapiens
aatgaggccctgtctc

SEQ ID NO: 20985 - DNA, 16 bp, H. sapiens
aatgaggctggagaaa

SEQ ID NO: 20986 - DNA, 16 bp, H. sapiens
aatgagtagtaatatt

SEQ ID NO: 20987 - DNA, 16 bp, H. sapiens
aatgagtatttccttt

SEQ ID NO: 20988 - DNA, 25 bp, H. sapiens
aatgagtgaactcccattcacaatt

SEQ ID NO: 20989 - DNA, 16 bp, H. sapiens
aatgagtgaagacttt

SEQ ID NO: 20990 - DNA, 16 bp, H. sapiens
aatgagtgaatgaata

SEQ ID NO: 20991 - DNA, 16 bp, H. sapiens
aatgagtgagttttca

SEQ ID NO: 20992 - DNA, 16 bp, H. sapiens
aatgagtggataaaga

SEQ ID NO: 20993 - DNA, 16 bp, H. sapiens
aatgagtggatggatg

SEQ ID NO: 20994 - DNA, 16 bp, H. sapiens
aatgagttaacacatg

SEQ ID NO: 20995 - DNA, 16 bp, H. sapiens
aatgagttaccatctc

SEQ ID NO: 20996 - DNA, 35 bp, H. sapiens
aatgagttcatgtcctttgtagggacatggatgaa

SEQ ID NO: 20997 - DNA, 16 bp, H. sapiens
aatgagtttcttcaca

SEQ ID NO: 20998 - DNA, 16 bp, H. sapiens
aatgagtttgacaagt

SEQ ID NO: 20999 - DNA, 16 bp, H. sapiens
aatgagtttggaagaa

SEQ ID NO: 21000 - DNA, 16 bp, H. sapiens
aatgataaaaagatca

SEQ ID NO: 21001 - DNA, 16 bp, H. sapiens
aatgataaaagtgtca

SEQ ID NO: 21002 - DNA, 16 bp, H. sapiens
aatgataaaatagact

SEQ ID NO: 21003 - DNA, 16 bp, H. sapiens
aatgataaaattcaag

SEQ ID NO: 21004 - DNA, 16 bp, H. sapiens
aatgataacaaagaca

SEQ ID NO: 21005 - DNA, 16 bp, H. sapiens
aatgataactattatt

SEQ ID NO: 21006 - DNA, 16 bp, H. sapiens
aatgataatccaccac

SEQ ID NO: 21007 - DNA, 16 bp, H. sapiens
aatgataatgacaatg

SEQ ID NO: 21008 - DNA, 16 bp, H. sapiens
aatgatacctacctca

SEQ ID NO: 21009 - DNA, 16 bp, H. sapiens
aatgatagaattagaa

SEQ ID NO: 21010 - DNA, 16 bp, H. sapiens
aatgatattcttcata

SEQ ID NO: 21011 - DNA, 16 bp, H. sapiens
aatgatattggtattt

SEQ ID NO: 21012 - DNA, 16 bp, H. sapiens
aatgatatttgcttta

SEQ ID NO: 21013 - DNA, 16 bp, H. sapiens
aatgatatttggaaaa

SEQ ID NO: 21014 - DNA, 16 bp, H. sapiens
aatgatcaatttaaaa

SEQ ID NO: 21015 - DNA, 16 bp, H. sapiens
aatgatcatatgtttt

SEQ ID NO: 21016 - DNA, 16 bp, H. sapiens
aatgatcatcagagaa

SEQ ID NO: 21017 - DNA, 16 bp, H. sapiens
aatgatcatgtgtttt

SEQ ID NO: 21018 - DNA, 16 bp, H. sapiens
aatgatcattcaggag

SEQ ID NO: 21019 - DNA, 16 bp, H. sapiens
aatgatcatttatttt

SEQ ID NO: 21020 - DNA, 16 bp, H. sapiens
aatgatcctaaatata

SEQ ID NO: 21021 - DNA, 16 bp, H. sapiens
aatgatcctgtgccaa

SEQ ID NO: 21022 - DNA, 16 bp, H. sapiens
aatgatcctttaaatt

SEQ ID NO: 21023 - DNA, 16 bp, H. sapiens
aatgatctcccaccag

SEQ ID NO: 21024 - DNA, 16 bp, H. sapiens
aatgatcttttaaaaa

SEQ ID NO: 21025 - DNA, 16 bp, H. sapiens
aatgatcttttcaatg

SEQ ID NO: 21026 - DNA, 16 bp, H. sapiens
aatgatgaaattaaga

SEQ ID NO: 21027 - DNA, 16 bp, H. sapiens
aatgatgaaattttaa

SEQ ID NO: 21028 - DNA, 16 bp, H. sapiens
aatgatgaaggggata

SEQ ID NO: 21029 - DNA, 17 bp, H. sapiens
aatgatgaattaatggg

SEQ ID NO: 21030 - DNA, 16 bp, H. sapiens
aatgatgacaagaaaa

SEQ ID NO: 21031 - DNA, 16 bp, H. sapiens
aatgatgacttcatgt

SEQ ID NO: 21032 - DNA, 16 bp, H. sapiens
aatgatgagaaagcaa

SEQ ID NO: 21033 - DNA, 16 bp, H. sapiens
aatgatgagaacatgt

SEQ ID NO: 21034 - DNA, 16 bp, H. sapiens
aatgatgagaatgcat

SEQ ID NO: 21035 - DNA, 16 bp, H. sapiens
aatgatgagttcatgg

SEQ ID NO: 21036 - DNA, 16 bp, H. sapiens
aatgatgatgaagatg

SEQ ID NO: 21037 - DNA, 16 bp, H. sapiens
aatgatgatgatgaag

SEQ ID NO: 21038 - DNA, 16 bp, H. sapiens
aatgatgatgatgaca

SEQ ID NO: 21039 - DNA, 17 bp, H. sapiens
aatgatgatgatgatgt

SEQ ID NO: 21040 - DNA, 16 bp, H. sapiens
aatgatgcaatgaaca

SEQ ID NO: 21041 - DNA, 16 bp, H. sapiens
aatgatggaccacata

SEQ ID NO: 21042 - DNA, 16 bp, H. sapiens
aatgatgggatcaaat

SEQ ID NO: 21043 - DNA, 16 bp, H. sapiens
aatgatggtattttga

SEQ ID NO: 21044 - DNA, 16 bp, H. sapiens
aatgatggtgatgata

SEQ ID NO: 21045 - DNA, 18 bp, H. sapiens
aatgatggtttccaattt

SEQ ID NO: 21046 - DNA, 16 bp, H. sapiens
aatgatgtgttaatgt

SEQ ID NO: 21047 - DNA, 16 bp, H. sapiens
aatgatgtttcagtca

SEQ ID NO: 21048 - DNA, 16 bp, H. sapiens
aatgattaatgatatt

SEQ ID NO: 21049 - DNA, 16 bp, H. sapiens
aatgattaatgatgtt

SEQ ID NO: 21050 - DNA, 16 bp, H. sapiens
aatgattagtgatgat

SEQ ID NO: 21051 - DNA, 17 bp, H. sapiens
aatgattgaactagttt

SEQ ID NO: 21052 - DNA, 16 bp, H. sapiens
aatgatttaatcaatt

SEQ ID NO: 21053 - DNA, 16 bp, H. sapiens
aatgatttcaccattc

SEQ ID NO: 21054 - DNA, 16 bp, H. sapiens
aatgatttcttttctt

SEQ ID NO: 21055 - DNA, 16 bp, H. sapiens
aatgattttgaaaaag

SEQ ID NO: 21056 - DNA, 16 bp, H. sapiens
aatgatttttgcattt

SEQ ID NO: 21057 - DNA, 16 bp, H. sapiens
aatgattttttagata

SEQ ID NO: 21058 - DNA, 16 bp, H. sapiens
aatgatttttttctca

SEQ ID NO: 21059 - DNA, 16 bp, H. sapiens
aatgcaaaaatggact

SEQ ID NO: 21060 - DNA, 16 bp, H. sapiens
aatgcaaaaattatct

SEQ ID NO: 21061 - DNA, 16 bp, H. sapiens
aatgcaaaactgtaaa

SEQ ID NO: 21062 - DNA, 16 bp, H. sapiens
aatgcaaaagcagaaa

SEQ ID NO: 21063 - DNA, 16 bp, H. sapiens
aatgcaaaagcagata

SEQ ID NO: 21064 - DNA, 16 bp, H. sapiens
aatgcaaaataaaact

SEQ ID NO: 21065 - DNA, 16 bp, H. sapiens
aatgcaaaataaatgt

SEQ ID NO: 21066 - DNA, 16 bp, H. sapiens
aatgcaaaatgaaaca

SEQ ID NO: 21067 - DNA, 16 bp, H. sapiens
aatgcaaaatgaatga

SEQ ID NO: 21068 - DNA, 16 bp, H. sapiens
aatgcaaaatgacaca

SEQ ID NO: 21069 - DNA, 16 bp, H. sapiens
aatgcaaaattataca

SEQ ID NO: 21070 - DNA, 16 bp, H. sapiens
aatgcaaactctgcct

SEQ ID NO: 21071 - DNA, 16 bp, H. sapiens
aatgcaaagatgaata

SEQ ID NO: 21072 - DNA, 16 bp, H. sapiens
aatgcaaagcaaaact

SEQ ID NO: 21073 - DNA, 16 bp, H. sapiens
aatgcaaaggaaaagt

SEQ ID NO: 21074 - DNA, 16 bp, H. sapiens
aatgcaaatataaaat

SEQ ID NO: 21075 - DNA, 16 bp, H. sapiens
aatgcaaatattcaaa

SEQ ID NO: 21076 - DNA, 16 bp, H. sapiens
aatgcaaatatttgtt

SEQ ID NO: 21077 - DNA, 16 bp, H. sapiens
aatgcaaatcaaagcc

SEQ ID NO: 21078 - DNA, 16 bp, H. sapiens
aatgcaaatcagaacc

SEQ ID NO: 21079 - DNA, 16 bp, H. sapiens
aatgcaaatctgatca

SEQ ID NO: 21080 - DNA, 16 bp, H. sapiens
aatgcaaatgaaaaga

SEQ ID NO: 21081 - DNA, 16 bp, H. sapiens
aatgcaaatgaaaata

SEQ ID NO: 21082 - DNA, 16 bp, H. sapiens
aatgcaaattaaaaca

SEQ ID NO: 21083 - DNA, 16 bp, H. sapiens
aatgcaaattcatttt

SEQ ID NO: 21084 - DNA, 16 bp, H. sapiens
aatgcaaattctcaga

SEQ ID NO: 21085 - DNA, 16 bp, H. sapiens
aatgcaaattttataa

SEQ ID NO: 21086 - DNA, 16 bp, H. sapiens
aatgcaacttattttt

SEQ ID NO: 21087 - DNA, 16 bp, H. sapiens
aatgcaagaatgaact

SEQ ID NO: 21088 - DNA, 16 bp, H. sapiens
aatgcaagaatggttc

SEQ ID NO: 21089 - DNA, 16 bp, H. sapiens
aatgcaagttaaaaca

SEQ ID NO: 21090 - DNA, 16 bp, H. sapiens
aatgcaataaaaaatg

SEQ ID NO: 21091 - DNA, 16 bp, H. sapiens
aatgcaatatctgtga

SEQ ID NO: 21092 - DNA, 16 bp, H. sapiens
aatgcaatcacaagta

SEQ ID NO: 21093 - DNA, 16 bp, H. sapiens
aatgcaatgaagaaaa

SEQ ID NO: 21094 - DNA, 16 bp, H. sapiens
aatgcaattactgata

SEQ ID NO: 21095 - DNA, 16 bp, H. sapiens
aatgcaattcaaaact

SEQ ID NO: 21096 - DNA, 16 bp, H. sapiens
aatgcaattgattttc

SEQ ID NO: 21097 - DNA, 16 bp, H. sapiens
aatgcaatttcattta

SEQ ID NO: 21098 - DNA, 16 bp, H. sapiens
aatgcaattttttaaa

SEQ ID NO: 21099 - DNA, 16 bp, H. sapiens
aatgcaatttttttca

SEQ ID NO: 21100 - DNA, 18 bp, H. sapiens
aatgcacaagcctcagta

SEQ ID NO: 21101 - DNA, 16 bp, H. sapiens
aatgcacacaaaacaa

SEQ ID NO: 21102 - DNA, 16 bp, H. sapiens
aatgcacacaacagaa

SEQ ID NO: 21103 - DNA, 16 bp, H. sapiens
aatgcacacatgcaca

SEQ ID NO: 21104 - DNA, 16 bp, H. sapiens
aatgcagaaaaagcat

SEQ ID NO: 21105 - DNA, 16 bp, H. sapiens
aatgcagaaaatgaaa

SEQ ID NO: 21106 - DNA, 16 bp, H. sapiens
aatgcagaaaattggt

SEQ ID NO: 21107 - DNA, 16 bp, H. sapiens
aatgcagaaatagaaa

SEQ ID NO: 21108 - DNA, 16 bp, H. sapiens
aatgcagaaatgaaaa

SEQ ID NO: 21109 - DNA, 16 bp, H. sapiens
aatgcagaagcagaaa

SEQ ID NO: 21110 - DNA, 16 bp, H. sapiens
aatgcagaaggcaggt

SEQ ID NO: 21111 - DNA, 16 bp, H. sapiens
aatgcagagaactcct

SEQ ID NO: 21112 - DNA, 16 bp, H. sapiens
aatgcagagaaggaat

SEQ ID NO: 21113 - DNA, 16 bp, H. sapiens
aatgcagattcctggg

SEQ ID NO: 21114 - DNA, 16 bp, H. sapiens
aatgcagattctggct

SEQ ID NO: 21115 - DNA, 16 bp, H. sapiens
aatgcagattgctggg

SEQ ID NO: 21116 - DNA, 16 bp, H. sapiens
aatgcagccctgccaa

SEQ ID NO: 21117 - DNA, 16 bp, H. sapiens
aatgcagctatgaaca

SEQ ID NO: 21118 - DNA, 16 bp, H. sapiens
aatgcagctggtgact

SEQ ID NO: 21119 - DNA, 16 bp, H. sapiens
aatgcaggaacagaaa

SEQ ID NO: 21120 - DNA, 16 bp, H. sapiens
aatgcaggaactgaaa

SEQ ID NO: 21121 - DNA, 16 bp, H. sapiens
aatgcaggagcaccca

SEQ ID NO: 21122 - DNA, 16 bp, H. sapiens
aatgcaggcagcttct

SEQ ID NO: 21123 - DNA, 16 bp, H. sapiens
aatgcagtgaaaccct

SEQ ID NO: 21124 - DNA, 16 bp, H. sapiens
aatgcagtgagccaag

SEQ ID NO: 21125 - DNA, 16 bp, H. sapiens
aatgcagtggcacaaa

SEQ ID NO: 21126 - DNA, 16 bp, H. sapiens
aatgcagttattaaaa

SEQ ID NO: 21127 - DNA, 16 bp, H. sapiens
aatgcataaaatatat

SEQ ID NO: 21128 - DNA, 16 bp, H. sapiens
aatgcataaaattata

SEQ ID NO: 21129 - DNA, 16 bp, H. sapiens
aatgcatacacacata

SEQ ID NO: 21130 - DNA, 16 bp, H. sapiens
aatgcatattgctttt

SEQ ID NO: 21131 - DNA, 16 bp, H. sapiens
aatgcatatttcttct

SEQ ID NO: 21132 - DNA, 16 bp, H. sapiens
aatgcatatttttaaa

SEQ ID NO: 21133 - DNA, 16 bp, H. sapiens
aatgcatgcatgcaca

SEQ ID NO: 21134 - DNA, 16 bp, H. sapiens
aatgcatgcccaaaac

SEQ ID NO: 21135 - DNA, 16 bp, H. sapiens
aatgcattcatttctt

SEQ ID NO: 21136 - DNA, 16 bp, H. sapiens
aatgcattctttttat

SEQ ID NO: 21137 - DNA, 16 bp, H. sapiens
aatgcattctttttta

SEQ ID NO: 21138 - DNA, 16 bp, H. sapiens
aatgcatttcaaaatt

SEQ ID NO: 21139 - DNA, 16 bp, H. sapiens
aatgcattttatatta

SEQ ID NO: 21140 - DNA, 16 bp, H. sapiens
aatgcattttccactt

SEQ ID NO: 21141 - DNA, 16 bp, H. sapiens
aatgcatttttttaaa

SEQ ID NO: 21142 - DNA, 16 bp, H. sapiens
aatgccaacatcaaaa

SEQ ID NO: 21143 - DNA, 16 bp, H. sapiens
aatgccaactaataaa

SEQ ID NO: 21144 - DNA, 16 bp, H. sapiens
aatgccaactaggtga

SEQ ID NO: 21145 - DNA, 16 bp, H. sapiens
aatgccaatttaaaaa

SEQ ID NO: 21146 - DNA, 16 bp, H. sapiens
aatgccacaatgaaca

SEQ ID NO: 21147 - DNA, 16 bp, H. sapiens
aatgccacactgtttt

SEQ ID NO: 21148 - DNA, 16 bp, H. sapiens
aatgccactaaattgt

SEQ ID NO: 21149 - DNA, 16 bp, H. sapiens
aatgccactggaattt

SEQ ID NO: 21150 - DNA, 16 bp, H. sapiens
aatgccagaaaaataa

SEQ ID NO: 21151 - DNA, 16 bp, H. sapiens
aatgccagcaccttgg

SEQ ID NO: 21152 - DNA, 16 bp, H. sapiens
aatgccagcacttggg

SEQ ID NO: 21153 - DNA, 16 bp, H. sapiens
aatgccagcattttgg

SEQ ID NO: 21154 - DNA, 16 bp, H. sapiens
aatgccaggaaaaaaa

SEQ ID NO: 21155 - DNA, 16 bp, H. sapiens
aatgccatcacactgg

SEQ ID NO: 21156 - DNA, 16 bp, H. sapiens
aatgccatcctcatca

SEQ ID NO: 21157 - DNA, 16 bp, H. sapiens
aatgccatgaggggcc

SEQ ID NO: 21158 - DNA, 16 bp, H. sapiens
aatgccatgtgtctgg

SEQ ID NO: 21159 - DNA, 16 bp, H. sapiens
aatgccattctggaca

SEQ ID NO: 21160 - DNA, 16 bp, H. sapiens
aatgccatttttaaaa

SEQ ID NO: 21161 - DNA, 16 bp, H. sapiens
aatgcccacagcccag

SEQ ID NO: 21162 - DNA, 16 bp, H. sapiens
aatgcccacagcctgg

SEQ ID NO: 21163 - DNA, 16 bp, H. sapiens
aatgcccacatcagaa

SEQ ID NO: 21164 - DNA, 16 bp, H. sapiens
aatgcccagaagagaa

SEQ ID NO: 21165 - DNA, 16 bp, H. sapiens
aatgcccatcagctga

SEQ ID NO: 21166 - DNA, 17 bp, H. sapiens
aatgccctctctcacca

SEQ ID NO: 21167 - DNA, 16 bp, H. sapiens
aatgcccttataaaaa

SEQ ID NO: 21168 - DNA, 16 bp, H. sapiens
aatgcccttctttgtc

SEQ ID NO: 21169 - DNA, 16 bp, H. sapiens
aatgcctactgtgtgc

SEQ ID NO: 21170 - DNA, 16 bp, H. sapiens
aatgcctagcacagag

SEQ ID NO: 21171 - DNA, 16 bp, H. sapiens
aatgcctatacctcca

SEQ ID NO: 21172 - DNA, 17 bp, H. sapiens
aatgcctctttaataaa

SEQ ID NO: 21173 - DNA, 16 bp, H. sapiens
aatgcctgaaaaagaa

SEQ ID NO: 21174 - DNA, 16 bp, H. sapiens
aatgcctgcaccccca

SEQ ID NO: 21175 - DNA, 16 bp, H. sapiens
aatgcctgcagcccag

SEQ ID NO: 21176 - DNA, 16 bp, H. sapiens
aatgcctggcacaaag

SEQ ID NO: 21177 - DNA, 16 bp, H. sapiens
aatgcctggcttcaga

SEQ ID NO: 21178 - DNA, 16 bp, H. sapiens
aatgcctgggaccaga

SEQ ID NO: 21179 - DNA, 16 bp, H. sapiens
aatgccttccccatca

SEQ ID NO: 21180 - DNA, 16 bp, H. sapiens
aatgccttctcatccc

SEQ ID NO: 21181 - DNA, 16 bp, H. sapiens
aatgcctttaacagaa

SEQ ID NO: 21182 - DNA, 16 bp, H. sapiens
aatgcctttcatttct

SEQ ID NO: 21183 - DNA, 16 bp, H. sapiens
aatgcctttgtccttt

SEQ ID NO: 21184 - DNA, 16 bp, H. sapiens
aatgcctttttctgga

SEQ ID NO: 21185 - DNA, 16 bp, H. sapiens
aatgccttttttaaaa

SEQ ID NO: 21186 - DNA, 16 bp, H. sapiens
aatgctaatgactggt

SEQ ID NO: 21187 - DNA, 16 bp, H. sapiens
aatgctaattaaaaca

SEQ ID NO: 21188 - DNA, 16 bp, H. sapiens
aatgctaattttatta

SEQ ID NO: 21189 - DNA, 16 bp, H. sapiens
aatgctagaagaaaac

SEQ ID NO: 21190 - DNA, 19 bp, H. sapiens
aatgctagacactttcaca

SEQ ID NO: 21191 - DNA, 17 bp, H. sapiens
aatgctagactaactag

SEQ ID NO: 21192 - DNA, 16 bp, H. sapiens
aatgctataaagaact

SEQ ID NO: 21193 - DNA, 16 bp, H. sapiens
aatgctatatttaaaa

SEQ ID NO: 21194 - DNA, 16 bp, H. sapiens
aatgctatatttttaa

SEQ ID NO: 21195 - DNA, 16 bp, H. sapiens
aatgctatccctccca

SEQ ID NO: 21196 - DNA, 16 bp, H. sapiens
aatgctatccctcccc

SEQ ID NO: 21197 - DNA, 16 bp, H. sapiens
aatgctatctcttccc

SEQ ID NO: 21198 - DNA, 16 bp, H. sapiens
aatgctatgcagccat

SEQ ID NO: 21199 - DNA, 16 bp, H. sapiens
aatgctatgcagtcat

SEQ ID NO: 21200 - DNA, 16 bp, H. sapiens
aatgctattcacaata

SEQ ID NO: 21201 - DNA, 16 bp, H. sapiens
aatgctattgattttt

SEQ ID NO: 21202 - DNA, 16 bp, H. sapiens
aatgctatttttattt

SEQ ID NO: 21203 - DNA, 16 bp, H. sapiens
aatgctcaacatcatg

SEQ ID NO: 21204 - DNA, 16 bp, H. sapiens
aatgctcaatgtcact

SEQ ID NO: 21205 - DNA, 16 bp, H. sapiens
aatgctctttccccag

SEQ ID NO: 21206 - DNA, 16 bp, H. sapiens
aatgctgaaaataaaa

SEQ ID NO: 21207 - DNA, 16 bp, H. sapiens
aatgctgaaagtggga

SEQ ID NO: 21208 - DNA, 16 bp, H. sapiens
aatgctgaaatgagat

SEQ ID NO: 21209 - DNA, 16 bp, H. sapiens
aatgctgaatccaaag

SEQ ID NO: 21210 - DNA, 16 bp, H. sapiens
aatgctgagaggtttt

SEQ ID NO: 21211 - DNA, 16 bp, H. sapiens
aatgctgatagtaata

SEQ ID NO: 21212 - DNA, 16 bp, H. sapiens
aatgctgatagtgata

SEQ ID NO: 21213 - DNA, 16 bp, H. sapiens
aatgctgattggtcag

SEQ ID NO: 21214 - DNA, 16 bp, H. sapiens
aatgctgattttaaaa

SEQ ID NO: 21215 - DNA, 16 bp, H. sapiens
aatgctgccagcctct

SEQ ID NO: 21216 - DNA, 16 bp, H. sapiens
aatgctgccttgttat

SEQ ID NO: 21217 - DNA, 16 bp, H. sapiens
aatgctgctaaaaaca

SEQ ID NO: 21218 - DNA, 16 bp, H. sapiens
aatgctgctgggaaaa

SEQ ID NO: 21219 - DNA, 16 bp, H. sapiens
aatgctgctgtaaaca

SEQ ID NO: 21220 - DNA, 16 bp, H. sapiens
aatgctgctgtgaaca

SEQ ID NO: 21221 - DNA, 16 bp, H. sapiens
aatgctggaattacag

SEQ ID NO: 21222 - DNA, 16 bp, H. sapiens
aatgctggcagctgtg

SEQ ID NO: 21223 - DNA, 16 bp, H. sapiens
aatgctggccaggatg

SEQ ID NO: 21224 - DNA, 16 bp, H. sapiens
aatgctgggtgtggtg

SEQ ID NO: 21225 - DNA, 16 bp, H. sapiens
aatgctgggtttacag

SEQ ID NO: 21226 - DNA, 16 bp, H. sapiens
aatgctgtaataaata

SEQ ID NO: 21227 - DNA, 16 bp, H. sapiens
aatgctgtatttttac

SEQ ID NO: 21228 - DNA, 16 bp, H. sapiens
aatgctgtccttcccc

SEQ ID NO: 21229 - DNA, 16 bp, H. sapiens
aatgctgttattgtgg

SEQ ID NO: 21230 - DNA, 16 bp, H. sapiens
aatgcttaaaaaataa

SEQ ID NO: 21231 - DNA, 16 bp, H. sapiens
aatgcttaagggagtt

SEQ ID NO: 21232 - DNA, 16 bp, H. sapiens
aatgcttaataaatat

SEQ ID NO: 21233 - DNA, 16 bp, H. sapiens
aatgcttattttaaaa

SEQ ID NO: 21234 - DNA, 16 bp, H. sapiens
aatgcttcaagaaaac

SEQ ID NO: 21235 - DNA, 16 bp, H. sapiens
aatgcttcaatgagca

SEQ ID NO: 21236 - DNA, 16 bp, H. sapiens
aatgcttcagtgagca

SEQ ID NO: 21237 - DNA, 16 bp, H. sapiens
aatgcttcctgttttt

SEQ ID NO: 21238 - DNA, 16 bp, H. sapiens
aatgcttctctgtagt

SEQ ID NO: 21239 - DNA, 16 bp, H. sapiens
aatgcttctgtgtatt

SEQ ID NO: 21240 - DNA, 16 bp, H. sapiens
aatgcttctttaaaaa

SEQ ID NO: 21241 - DNA, 16 bp, H. sapiens
aatgcttgttattttc

SEQ ID NO: 21242 - DNA, 16 bp, H. sapiens
aatgctttaaaaatga

SEQ ID NO: 21243 - DNA, 16 bp, H. sapiens
aatgctttaaaatgtt

SEQ ID NO: 21244 - DNA, 16 bp, H. sapiens
aatgctttaaagaaaa

SEQ ID NO: 21245 - DNA, 16 bp, H. sapiens
aatgctttacttccaa

SEQ ID NO: 21246 - DNA, 16 bp, H. sapiens
aatgctttattttata

SEQ ID NO: 21247 - DNA, 16 bp, H. sapiens
aatgctttcctttttt

SEQ ID NO: 21248 - DNA, 16 bp, H. sapiens
aatgctttctttcttt

SEQ ID NO: 21249 - DNA, 16 bp, H. sapiens
aatgctttgaaagaaa

SEQ ID NO: 21250 - DNA, 16 bp, H. sapiens
aatgcttttaaaaaat

SEQ ID NO: 21251 - DNA, 16 bp, H. sapiens
aatgcttttaaaatga

SEQ ID NO: 21252 - DNA, 16 bp, H. sapiens
aatgcttttaaatttt

SEQ ID NO: 21253 - DNA, 16 bp, H. sapiens
aatgcttttaattttt

SEQ ID NO: 21254 - DNA, 16 bp, H. sapiens
aatgcttttctctttt

SEQ ID NO: 21255 - DNA, 16 bp, H. sapiens
aatgcttttgtttttg

SEQ ID NO: 21256 - DNA, 16 bp, H. sapiens
aatgctttttcagcat

SEQ ID NO: 21257 - DNA, 16 bp, H. sapiens
aatgcttttttcttta

SEQ ID NO: 21258 - DNA, 16 bp, H. sapiens
aatggaaaaaaattca

SEQ ID NO: 21259 - DNA, 16 bp, H. sapiens
aatggaaaaaattttt

SEQ ID NO: 21260 - DNA, 16 bp, H. sapiens
aatggaaaaatacttt

SEQ ID NO: 21261 - DNA, 16 bp, H. sapiens
aatggaaaaatattct

SEQ ID NO: 21262 - DNA, 16 bp, H. sapiens
aatggaaaacaaattt

SEQ ID NO: 21263 - DNA, 16 bp, H. sapiens
aatggaaaacatgaaa

SEQ ID NO: 21264 - DNA, 16 bp, H. sapiens
aatggaaaaccattcc

SEQ ID NO: 21265 - DNA, 16 bp, H. sapiens
aatggaaaactactca

SEQ ID NO: 21266 - DNA, 16 bp, H. sapiens
aatggaaaagaacaga

SEQ ID NO: 21267 - DNA, 16 bp, H. sapiens
aatggaaaagtttgaa

SEQ ID NO: 21268 - DNA, 16 bp, H. sapiens
aatggaaaatcaaaca

SEQ ID NO: 21269 - DNA, 16 bp, H. sapiens
aatggaaaatccatag

SEQ ID NO: 21270 - DNA, 16 bp, H. sapiens
aatggaaaatctgaaa

SEQ ID NO: 21271 - DNA, 16 bp, H. sapiens
aatggaaacacatctc

SEQ ID NO: 21272 - DNA, 16 bp, H. sapiens
aatggaaacagaaatg

SEQ ID NO: 21273 - DNA, 16 bp, H. sapiens
aatggaaaccaaaaat

SEQ ID NO: 21274 - DNA, 16 bp, H. sapiens
aatggaaaccaaaaca

SEQ ID NO: 21275 - DNA, 16 bp, H. sapiens
aatggaaaccctgaac

SEQ ID NO: 21276 - DNA, 16 bp, H. sapiens
aatggaaagaaaatca

SEQ ID NO: 21277 - DNA, 16 bp, H. sapiens
aatggaaagaaattat

SEQ ID NO: 21278 - DNA, 16 bp, H. sapiens
aatggaaagataattt

SEQ ID NO: 21279 - DNA, 16 bp, H. sapiens
aatggaaagcaaagaa

SEQ ID NO: 21280 - DNA, 16 bp, H. sapiens
aatggaaaggaaacaa

SEQ ID NO: 21281 - DNA, 16 bp, H. sapiens
aatggaaaggaatgga

SEQ ID NO: 21282 - DNA, 16 bp, H. sapiens
aatggaaataaaattg

SEQ ID NO: 21283 - DNA, 16 bp, H. sapiens
aatggaaatatttatt

SEQ ID NO: 21284 - DNA, 16 bp, H. sapiens
aatggaaatattttgt

SEQ ID NO: 21285 - DNA, 16 bp, H. sapiens
aatggaaatcaatgaa

SEQ ID NO: 21286 - DNA, 16 bp, H. sapiens
aatggaaatgaaaaca

SEQ ID NO: 21287 - DNA, 16 bp, H. sapiens
aatggaaatggaaatg

SEQ ID NO: 21288 - DNA, 16 bp, H. sapiens
aatggaaatgttttct

SEQ ID NO: 21289 - DNA, 16 bp, H. sapiens
aatggaaattaaaact

SEQ ID NO: 21290 - DNA, 16 bp, H. sapiens
aatggaacaaaataga

SEQ ID NO: 21291 - DNA, 16 bp, H. sapiens
aatggaacaaaatgaa

SEQ ID NO: 21292 - DNA, 16 bp, H. sapiens
aatggaacacaacaga

SEQ ID NO: 21293 - DNA, 16 bp, H. sapiens
aatggaacacagaaaa

SEQ ID NO: 21294 - DNA, 16 bp, H. sapiens
aatggaacagaaaaga

SEQ ID NO: 21295 - DNA, 17 bp, H. sapiens
aatggaacagaacagaa

SEQ ID NO: 21296 - DNA, 29 bp, H. sapiens
aatggaacagaacagagccctcagaaaca

SEQ ID NO: 21297 - DNA, 16 bp, H. sapiens
aatggaacagaagaca

SEQ ID NO: 21298 - DNA, 16 bp, H. sapiens
aatggaacagaataga

SEQ ID NO: 21299 - DNA, 16 bp, H. sapiens
aatggaacagaatgga

SEQ ID NO: 21300 - DNA, 16 bp, H. sapiens
aatggaacagagcaga

SEQ ID NO: 21301 - DNA, 16 bp, H. sapiens
aatggaacggaatgga

SEQ ID NO: 21302 - DNA, 16 bp, H. sapiens
aatggaactgaaaaat

SEQ ID NO: 21303 - DNA, 16 bp, H. sapiens
aatggaactgaacaga

SEQ ID NO: 21304 - DNA, 16 bp, H. sapiens
aatggaactgaatgga

SEQ ID NO: 21305 - DNA, 16 bp, H. sapiens
aatggaagaaaacatt

SEQ ID NO: 21306 - DNA, 16 bp, H. sapiens
aatggaagaaaatgtt

SEQ ID NO: 21307 - DNA, 16 bp, H. sapiens
aatggaagaaatattt

SEQ ID NO: 21308 - DNA, 16 bp, H. sapiens
aatggaagagaatatt

SEQ ID NO: 21309 - DNA, 16 bp, H. sapiens
aatggaagaggaaatg

SEQ ID NO: 21310 - DNA, 16 bp, H. sapiens
aatggaagcagagaga

SEQ ID NO: 21311 - DNA, 16 bp, H. sapiens
aatggaagccaaaaaa

SEQ ID NO: 21312 - DNA, 16 bp, H. sapiens
aatggaaggaaaaaca

SEQ ID NO: 21313 - DNA, 16 bp, H. sapiens
aatggaataaaattga

SEQ ID NO: 21314 - DNA, 16 bp, H. sapiens
aatggaatagaacaga

SEQ ID NO: 21315 - DNA, 16 bp, H. sapiens
aatggaatattattca

SEQ ID NO: 21316 - DNA, 16 bp, H. sapiens
aatggaatattgttta

SEQ ID NO: 21317 - DNA, 16 bp, H. sapiens
aatggaatcatcatca

SEQ ID NO: 21318 - DNA, 16 bp, H. sapiens
aatggaatcatcgaat

SEQ ID NO: 21319 - DNA, 16 bp, H. sapiens
aatggaatcttttttt

SEQ ID NO: 21320 - DNA, 16 bp, H. sapiens
aatggaatgaaatgga

SEQ ID NO: 21321 - DNA, 16 bp, H. sapiens
aatggaatgaactcga

SEQ ID NO: 21322 - DNA, 16 bp, H. sapiens
aatggaatgacatttt

SEQ ID NO: 21323 - DNA, 16 bp, H. sapiens
aatggaatgcaaaaaa

SEQ ID NO: 21324 - DNA, 16 bp, H. sapiens
aatggaatgcaatgca

SEQ ID NO: 21325 - DNA, 16 bp, H. sapiens
aatggaatgcagaatg

SEQ ID NO: 21326 - DNA, 16 bp, H. sapiens
aatggaatggaaatga

SEQ ID NO: 21327 - DNA, 16 bp, H. sapiens
aatggaatggaatgga

SEQ ID NO: 21328 - DNA, 16 bp, H. sapiens
aatggaatgttatttg

SEQ ID NO: 21329 - DNA, 16 bp, H. sapiens
aatggaattacatcaa

SEQ ID NO: 21330 - DNA, 16 bp, H. sapiens
aatggaattgaatgga

SEQ ID NO: 21331 - DNA, 16 bp, H. sapiens
aatggaattgctgaat

SEQ ID NO: 21332 - DNA, 16 bp, H. sapiens
aatggaatttaattaa

SEQ ID NO: 21333 - DNA, 16 bp, H. sapiens
aatggacaaaacagtg

SEQ ID NO: 21334 - DNA, 16 bp, H. sapiens
aatggacaaagaaaat

SEQ ID NO: 21335 - DNA, 16 bp, H. sapiens
aatggacactggggac

SEQ ID NO: 21336 - DNA, 16 bp, H. sapiens
aatggacatttgggct

SEQ ID NO: 21337 - DNA, 16 bp, H. sapiens
aatggaccagaacaga

SEQ ID NO: 21338 - DNA, 16 bp, H. sapiens
aatggaccctctgcct

SEQ ID NO: 21339 - DNA, 16 bp, H. sapiens
aatggactaagacaaa

SEQ ID NO: 21340 - DNA, 16 bp, H. sapiens
aatggactcaaagttc

SEQ ID NO: 21341 - DNA, 16 bp, H. sapiens
aatggactttttaaaa

SEQ ID NO: 21342 - DNA, 16 bp, H. sapiens
aatggagaaaaatatt

SEQ ID NO: 21343 - DNA, 16 bp, H. sapiens
aatggagaaaaatcta

SEQ ID NO: 21344 - DNA, 16 bp, H. sapiens
aatggagaaaacattt

SEQ ID NO: 21345 - DNA, 16 bp, H. sapiens
aatggagaaaatatct

SEQ ID NO: 21346 - DNA, 16 bp, H. sapiens
aatggagaaaatattt

SEQ ID NO: 21347 - DNA, 16 bp, H. sapiens
aatggagaaatatttt

SEQ ID NO: 21348 - DNA, 16 bp, H. sapiens
aatggagaactcagaa

SEQ ID NO: 21349 - DNA, 16 bp, H. sapiens
aatggagaagaaaaca

SEQ ID NO: 21350 - DNA, 16 bp, H. sapiens
aatggagaagacagaa

SEQ ID NO: 21351 - DNA, 16 bp, H. sapiens
aatggagaagctgcag

SEQ ID NO: 21352 - DNA, 16 bp, H. sapiens
aatggagacaataaaa

SEQ ID NO: 21353 - DNA, 16 bp, H. sapiens
aatggagacagatgga

SEQ ID NO: 21354 - DNA, 16 bp, H. sapiens
aatggagacttggaag

SEQ ID NO: 21355 - DNA, 16 bp, H. sapiens
aatggagagaaactga

SEQ ID NO: 21356 - DNA, 16 bp, H. sapiens
aatggagataatcata

SEQ ID NO: 21357 - DNA, 16 bp, H. sapiens
aatggagatgaaaaat

SEQ ID NO: 21358 - DNA, 16 bp, H. sapiens
aatggagcagaacaga

SEQ ID NO: 21359 - DNA, 16 bp, H. sapiens
aatggagcttacagga

SEQ ID NO: 21360 - DNA, 16 bp, H. sapiens
aatggagcttgcagga

SEQ ID NO: 21361 - DNA, 16 bp, H. sapiens
aatggaggctgagaag

SEQ ID NO: 21362 - DNA, 16 bp, H. sapiens
aatggaggctgggcac

SEQ ID NO: 21363 - DNA, 16 bp, H. sapiens
aatggagggacctgct

SEQ ID NO: 21364 - DNA, 16 bp, H. sapiens
aatggagtactattta

SEQ ID NO: 21365 - DNA, 16 bp, H. sapiens
aatggagtcagaagag

SEQ ID NO: 21366 - DNA, 16 bp, H. sapiens
aatggagtcttactct

SEQ ID NO: 21367 - DNA, 16 bp, H. sapiens
aatggagttgtttttt

SEQ ID NO: 21368 - DNA, 16 bp, H. sapiens
aatggataaaacattt

SEQ ID NO: 21369 - DNA, 16 bp, H. sapiens
aatggataaacagata

SEQ ID NO: 21370 - DNA, 16 bp, H. sapiens
aatggataaactgtgg

SEQ ID NO: 21371 - DNA, 16 bp, H. sapiens
aatggataaataattt

SEQ ID NO: 21372 - DNA, 16 bp, H. sapiens
aatggataaatagata

SEQ ID NO: 21373 - DNA, 16 bp, H. sapiens
aatggataagttcctg

SEQ ID NO: 21374 - DNA, 16 bp, H. sapiens
aatggatacaaagttt

SEQ ID NO: 21375 - DNA, 16 bp, H. sapiens
aatggatacacaaaat

SEQ ID NO: 21376 - DNA, 16 bp, H. sapiens
aatggatacagaaaaa

SEQ ID NO: 21377 - DNA, 16 bp, H. sapiens
aatggatacagaaaat

SEQ ID NO: 21378 - DNA, 16 bp, H. sapiens
aatggatatacaaaat

SEQ ID NO: 21379 - DNA, 16 bp, H. sapiens
aatggatatagaaaat

SEQ ID NO: 21380 - DNA, 16 bp, H. sapiens
aatggatattttggag

SEQ ID NO: 21381 - DNA, 16 bp, H. sapiens
aatggatcacagacct

SEQ ID NO: 21382 - DNA, 16 bp, H. sapiens
aatggatgaattgtat

SEQ ID NO: 21383 - DNA, 16 bp, H. sapiens
aatggatgaggaagaa

SEQ ID NO: 21384 - DNA, 16 bp, H. sapiens
aatggatggacaaatg

SEQ ID NO: 21385 - DNA, 16 bp, H. sapiens
aatggatggatgagtg

SEQ ID NO: 21386 - DNA, 56 bp, H. sapiens
aatggattaagggcggtgcaagatgtgctttgttaaacagatgcttgaaggcagca

SEQ ID NO: 21387 - DNA, 16 bp, H. sapiens
aatggattaatccatt

SEQ ID NO: 21388 - DNA, 16 bp, H. sapiens
aatggattaatggatt

SEQ ID NO: 21389 - DNA, 16 bp, H. sapiens
aatggattatttaaaa

SEQ ID NO: 21390 - DNA, 16 bp, H. sapiens
aatggatttttaaata

SEQ ID NO: 21391 - DNA, 16 bp, H. sapiens
aatggatttttcttag

SEQ ID NO: 21392 - DNA, 16 bp, H. sapiens
aatggcaaaaaagcaa

SEQ ID NO: 21393 - DNA, 16 bp, H. sapiens
aatggcaaaaatattt

SEQ ID NO: 21394 - DNA, 16 bp, H. sapiens
aatggcaaaaccccgt

SEQ ID NO: 21395 - DNA, 16 bp, H. sapiens
aatggcaaaacctgca

SEQ ID NO: 21396 - DNA, 16 bp, H. sapiens
aatggcaaagctggga

SEQ ID NO: 21397 - DNA, 16 bp, H. sapiens
aatggcaacagaagac

SEQ ID NO: 21398 - DNA, 16 bp, H. sapiens
aatggcaagaaaaaag

SEQ ID NO: 21399 - DNA, 16 bp, H. sapiens
aatggcaatcataaaa

SEQ ID NO: 21400 - DNA, 16 bp, H. sapiens
aatggcaattttattt

SEQ ID NO: 21401 - DNA, 16 bp, H. sapiens
aatggcacagccactc

SEQ ID NO: 21402 - DNA, 16 bp, H. sapiens
aatggcaccatcatgg

SEQ ID NO: 21403 - DNA, 16 bp, H. sapiens
aatggcacgatcacag

SEQ ID NO: 21404 - DNA, 16 bp, H. sapiens
aatggcagaatggata

SEQ ID NO: 21405 - DNA, 16 bp, H. sapiens
aatggcagagccagga

SEQ ID NO: 21406 - DNA, 16 bp, H. sapiens
aatggcagagctgaaa

SEQ ID NO: 21407 - DNA, 16 bp, H. sapiens
aatggcagagctggaa

SEQ ID NO: 21408 - DNA, 16 bp, H. sapiens
aatggcagaggcagaa

SEQ ID NO: 21409 - DNA, 16 bp, H. sapiens
aatggcagataggagg

SEQ ID NO: 21410 - DNA, 16 bp, H. sapiens
aatggcaggatttcct

SEQ ID NO: 21411 - DNA, 16 bp, H. sapiens
aatggcatcaacctgg

SEQ ID NO: 21412 - DNA, 18 bp, H. sapiens
aatggcatgaacccggta

SEQ ID NO: 21413 - DNA, 16 bp, H. sapiens
aatggcattttcagca

SEQ ID NO: 21414 - DNA, 16 bp, H. sapiens
aatggccaaaaactgg

SEQ ID NO: 21415 - DNA, 16 bp, H. sapiens
aatggccaaaactgca

SEQ ID NO: 21416 - DNA, 16 bp, H. sapiens
aatggccaaagctgga

SEQ ID NO: 21417 - DNA, 16 bp, H. sapiens
aatggccaatagatat

SEQ ID NO: 21418 - DNA, 17 bp, H. sapiens
aatggcccgatcttggc

SEQ ID NO: 21419 - DNA, 16 bp, H. sapiens
aatggcctctctcctc

SEQ ID NO: 21420 - DNA, 16 bp, H. sapiens
aatggcctgcagctgc

SEQ ID NO: 21421 - DNA, 16 bp, H. sapiens
aatggccttgtctctt

SEQ ID NO: 21422 - DNA, 16 bp, H. sapiens
aatggccttttttgtc

SEQ ID NO: 21423 - DNA, 16 bp, H. sapiens
aatggcggctccatct

SEQ ID NO: 21424 - DNA, 17 bp, H. sapiens
aatggcgtgaaccccag

SEQ ID NO: 21425 - DNA, 16 bp, H. sapiens
aatggcgtgatcctgg

SEQ ID NO: 21426 - DNA, 16 bp, H. sapiens
aatggctaaaattaaa

SEQ ID NO: 21427 - DNA, 18 bp, H. sapiens
aatggctaactagaataa

SEQ ID NO: 21428 - DNA, 16 bp, H. sapiens
aatggctaattagaat

SEQ ID NO: 21429 - DNA, 16 bp, H. sapiens
aatggctattcacagg

SEQ ID NO: 21430 - DNA, 16 bp, H. sapiens
aatggctgaaaatttc

SEQ ID NO: 21431 - DNA, 16 bp, H. sapiens
aatggctgaaatgaca

SEQ ID NO: 21432 - DNA, 16 bp, H. sapiens
aatggctgctattaaa

SEQ ID NO: 21433 - DNA, 16 bp, H. sapiens
aatggctgtatcattt

SEQ ID NO: 21434 - DNA, 16 bp, H. sapiens
aatggcttcattttaa

SEQ ID NO: 21435 - DNA, 16 bp, H. sapiens
aatggcttgaaactgg

SEQ ID NO: 21436 - DNA, 16 bp, H. sapiens
aatggcttggtgccat

SEQ ID NO: 21437 - DNA, 16 bp, H. sapiens
aatggctttcctctct

SEQ ID NO: 21438 - DNA, 16 bp, H. sapiens
aatggctttgactaaa

SEQ ID NO: 21439 - DNA, 16 bp, H. sapiens
aatgggaaagaaaaca

SEQ ID NO: 21440 - DNA, 16 bp, H. sapiens
aatgggaataataata

SEQ ID NO: 21441 - DNA, 16 bp, H. sapiens
aatgggaataccagaa

SEQ ID NO: 21442 - DNA, 16 bp, H. sapiens
aatgggaattcactca

SEQ ID NO: 21443 - DNA, 16 bp, H. sapiens
aatgggactgcattct

SEQ ID NO: 21444 - DNA, 16 bp, H. sapiens
aatgggagaaaaagca

SEQ ID NO: 21445 - DNA, 16 bp, H. sapiens
aatgggagaaaaattt

SEQ ID NO: 21446 - DNA, 16 bp, H. sapiens
aatgggagaaaatttc

SEQ ID NO: 21447 - DNA, 16 bp, H. sapiens
aatgggagaaaatttt

SEQ ID NO: 21448 - DNA, 16 bp, H. sapiens
aatgggagaaagtttt

SEQ ID NO: 21449 - DNA, 16 bp, H. sapiens
aatgggagaatatatt

SEQ ID NO: 21450 - DNA, 16 bp, H. sapiens
aatgggagatattaca

SEQ ID NO: 21451 - DNA, 16 bp, H. sapiens
aatgggaggtgaggaa

SEQ ID NO: 21452 - DNA, 16 bp, H. sapiens
aatgggagttttcctg

SEQ ID NO: 21453 - DNA, 16 bp, H. sapiens
aatgggatcatgtcct

SEQ ID NO: 21454 - DNA, 16 bp, H. sapiens
aatgggattgtttttt

SEQ ID NO: 21455 - DNA, 16 bp, H. sapiens
aatgggcaaaagagct

SEQ ID NO: 21456 - DNA, 16 bp, H. sapiens
aatgggcaaaatatct

SEQ ID NO: 21457 - DNA, 16 bp, H. sapiens
aatgggcacagggttt

SEQ ID NO: 21458 - DNA, 16 bp, H. sapiens
aatggggaaaagttaa

SEQ ID NO: 21459 - DNA, 16 bp, H. sapiens
aatggggaaaatattt

SEQ ID NO: 21460 - DNA, 16 bp, H. sapiens
aatggggaaagaattc

SEQ ID NO: 21461 - DNA, 16 bp, H. sapiens
aatggggaaaggacac

SEQ ID NO: 21462 - DNA, 25 bp, H. sapiens
aatggggaaaggattccctatttaa

SEQ ID NO: 21463 - DNA, 33 bp, H. sapiens
aatggggaaaggattccctatttaataaatggt

SEQ ID NO: 21464 - DNA, 16 bp, H. sapiens
aatggggaaaggattt

SEQ ID NO: 21465 - DNA, 16 bp, H. sapiens
aatggggaacatggta

SEQ ID NO: 21466 - DNA, 16 bp, H. sapiens
aatggggaatgttaaa

SEQ ID NO: 21467 - DNA, 16 bp, H. sapiens
aatggggaggctgagg

SEQ ID NO: 21468 - DNA, 16 bp, H. sapiens
aatggggctgggaaaa

SEQ ID NO: 21469 - DNA, 16 bp, H. sapiens
aatggggttttgccat

SEQ ID NO: 21470 - DNA, 16 bp, H. sapiens
aatgggtagaatcaat

SEQ ID NO: 21471 - DNA, 16 bp, H. sapiens
aatgggtataaaattt

SEQ ID NO: 21472 - DNA, 16 bp, H. sapiens
aatgggtatagaattt

SEQ ID NO: 21473 - DNA, 16 bp, H. sapiens
aatgggtatggagttt

SEQ ID NO: 21474 - DNA, 16 bp, H. sapiens
aatgggtgtggctgtg

SEQ ID NO: 21475 - DNA, 16 bp, H. sapiens
aatgggttcttcctgc

SEQ ID NO: 21476 - DNA, 16 bp, H. sapiens
aatgggttgtaaagca

SEQ ID NO: 21477 - DNA, 16 bp, H. sapiens
aatgggtttggtttgg

SEQ ID NO: 21478 - DNA, 19 bp, H. sapiens
aatggtaaagcttcttatt

SEQ ID NO: 21479 - DNA, 16 bp, H. sapiens
aatggtaaaggcatca

SEQ ID NO: 21480 - DNA, 16 bp, H. sapiens
aatggtaatattttgg

SEQ ID NO: 21481 - DNA, 17 bp, H. sapiens
aatggtaatcattaaaa

SEQ ID NO: 21482 - DNA, 16 bp, H. sapiens
aatggtaattatgaaa

SEQ ID NO: 21483 - DNA, 16 bp, H. sapiens
aatggtaccagctcct

SEQ ID NO: 21484 - DNA, 16 bp, H. sapiens
aatggtactggaaaaa

SEQ ID NO: 21485 - DNA, 16 bp, H. sapiens
aatggtagtttaatgg

SEQ ID NO: 21486 - DNA, 16 bp, H. sapiens
aatggtatttacttta

SEQ ID NO: 21487 - DNA, 16 bp, H. sapiens
aatggtatttctgctt

SEQ ID NO: 21488 - DNA, 16 bp, H. sapiens
aatggtctcaatctct

SEQ ID NO: 21489 - DNA, 16 bp, H. sapiens
aatggtcttccatgaa

SEQ ID NO: 21490 - DNA, 16 bp, H. sapiens
aatggtctttaccatt

SEQ ID NO: 21491 - DNA, 16 bp, H. sapiens
aatggtgaaacccagt

SEQ ID NO: 21492 - DNA, 16 bp, H. sapiens
aatggtgctaagaaaa

SEQ ID NO: 21493 - DNA, 16 bp, H. sapiens
aatggtgctggaaaaa

SEQ ID NO: 21494 - DNA, 16 bp, H. sapiens
aatggtgctggggtaa

SEQ ID NO: 21495 - DNA, 16 bp, H. sapiens
aatggtggaaggtgaa

SEQ ID NO: 21496 - DNA, 16 bp, H. sapiens
aatggtggaatttcag

SEQ ID NO: 21497 - DNA, 16 bp, H. sapiens
aatggtggattggata

SEQ ID NO: 21498 - DNA, 16 bp, H. sapiens
aatggtggtggtgatg

SEQ ID NO: 21499 - DNA, 16 bp, H. sapiens
aatggtgtctttcaaa

SEQ ID NO: 21500 - DNA, 16 bp, H. sapiens
aatggtgtgaaactgg

SEQ ID NO: 21501 - DNA, 16 bp, H. sapiens
aatggtgtgaaccagg

SEQ ID NO: 21502 - DNA, 16 bp, H. sapiens
aatggtgtttcctagg

SEQ ID NO: 21503 - DNA, 16 bp, H. sapiens
aatggttcaactctgt

SEQ ID NO: 21504 - DNA, 16 bp, H. sapiens
aatggttgaaaaaata

SEQ ID NO: 21505 - DNA, 16 bp, H. sapiens
aatggttgaattagtt

SEQ ID NO: 21506 - DNA, 16 bp, H. sapiens
aatggtttagcactat

SEQ ID NO: 21507 - DNA, 16 bp, H. sapiens
aatggttttatatata

SEQ ID NO: 21508 - DNA, 16 bp, H. sapiens
aatggttttcagtata

SEQ ID NO: 21509 - DNA, 16 bp, H. sapiens
aatggttttggaaaaa

SEQ ID NO: 21510 - DNA, 16 bp, H. sapiens
aatgtaaaaaacaatt

SEQ ID NO: 21511 - DNA, 16 bp, H. sapiens
aatgtaaaaacaattt

SEQ ID NO: 21512 - DNA, 16 bp, H. sapiens
aatgtaaaatatctca

SEQ ID NO: 21513 - DNA, 16 bp, H. sapiens
aatgtaaaatgcaaaa

SEQ ID NO: 21514 - DNA, 16 bp, H. sapiens
aatgtaaaatggtaca

SEQ ID NO: 21515 - DNA, 16 bp, H. sapiens
aatgtaaaatgttata

SEQ ID NO: 21516 - DNA, 16 bp, H. sapiens
aatgtaaaatttcaaa

SEQ ID NO: 21517 - DNA, 16 bp, H. sapiens
aatgtaaacattttaa

SEQ ID NO: 21518 - DNA, 16 bp, H. sapiens
aatgtaaactatctca

SEQ ID NO: 21519 - DNA, 16 bp, H. sapiens
aatgtaaagaaaatgt

SEQ ID NO: 21520 - DNA, 16 bp, H. sapiens
aatgtaaagcacttag

SEQ ID NO: 21521 - DNA, 16 bp, H. sapiens
aatgtaaagtagtttt

SEQ ID NO: 21522 - DNA, 16 bp, H. sapiens
aatgtaaatactatat

SEQ ID NO: 21523 - DNA, 16 bp, H. sapiens
aatgtaaatataaaca

SEQ ID NO: 21524 - DNA, 16 bp, H. sapiens
aatgtaaatatataca

SEQ ID NO: 21525 - DNA, 16 bp, H. sapiens
aatgtaaatatttctt

SEQ ID NO: 21526 - DNA, 16 bp, H. sapiens
aatgtaaatcatattt

SEQ ID NO: 21527 - DNA, 16 bp, H. sapiens
aatgtaaatcctaaaa

SEQ ID NO: 21528 - DNA, 16 bp, H. sapiens
aatgtaaatggactac

SEQ ID NO: 21529 - DNA, 16 bp, H. sapiens
aatgtaaatgtgtttt

SEQ ID NO: 21530 - DNA, 16 bp, H. sapiens
aatgtaaatgttctga

SEQ ID NO: 21531 - DNA, 16 bp, H. sapiens
aatgtaaattaaaacc

SEQ ID NO: 21532 - DNA, 16 bp, H. sapiens
aatgtaaattagtaca

SEQ ID NO: 21533 - DNA, 16 bp, H. sapiens
aatgtaaattagtgta

SEQ ID NO: 21534 - DNA, 16 bp, H. sapiens
aatgtaaattagttca

SEQ ID NO: 21535 - DNA, 16 bp, H. sapiens
aatgtaaatttaaatg

SEQ ID NO: 21536 - DNA, 16 bp, H. sapiens
aatgtaaatttgtaca

SEQ ID NO: 21537 - DNA, 16 bp, H. sapiens
aatgtaaatttgttta

SEQ ID NO: 21538 - DNA, 16 bp, H. sapiens
aatgtaacattttaaa

SEQ ID NO: 21539 - DNA, 16 bp, H. sapiens
aatgtaacttttatat

SEQ ID NO: 21540 - DNA, 16 bp, H. sapiens
aatgtaagacctgaaa

SEQ ID NO: 21541 - DNA, 16 bp, H. sapiens
aatgtaagacttaaaa

SEQ ID NO: 21542 - DNA, 16 bp, H. sapiens
aatgtaagctccatga

SEQ ID NO: 21543 - DNA, 16 bp, H. sapiens
aatgtaagcttcatga

SEQ ID NO: 21544 - DNA, 16 bp, H. sapiens
aatgtaagtgctctga

SEQ ID NO: 21545 - DNA, 16 bp, H. sapiens
aatgtaatattattca

SEQ ID NO: 21546 - DNA, 16 bp, H. sapiens
aatgtaatcattaaaa

SEQ ID NO: 21547 - DNA, 16 bp, H. sapiens
aatgtaatcatttatc

SEQ ID NO: 21548 - DNA, 16 bp, H. sapiens
aatgtaatccatcaaa

SEQ ID NO: 21549 - DNA, 16 bp, H. sapiens
aatgtaatctaccaca

SEQ ID NO: 21550 - DNA, 16 bp, H. sapiens
aatgtaattactgata

SEQ ID NO: 21551 - DNA, 16 bp, H. sapiens
aatgtaattctctgca

SEQ ID NO: 21552 - DNA, 16 bp, H. sapiens
aatgtaatttatagat

SEQ ID NO: 21553 - DNA, 16 bp, H. sapiens
aatgtaatttttttct

SEQ ID NO: 21554 - DNA, 16 bp, H. sapiens
aatgtacaaaaatgta

SEQ ID NO: 21555 - DNA, 16 bp, H. sapiens
aatgtacaaattattt

SEQ ID NO: 21556 - DNA, 16 bp, H. sapiens
aatgtacaatgaactc

SEQ ID NO: 21557 - DNA, 16 bp, H. sapiens
aatgtacacatcaaaa

SEQ ID NO: 21558 - DNA, 16 bp, H. sapiens
aatgtacagcttgggc

SEQ ID NO: 21559 - DNA, 16 bp, H. sapiens
aatgtacataaaaata

SEQ ID NO: 21560 - DNA, 16 bp, H. sapiens
aatgtacatatgtgtg

SEQ ID NO: 21561 - DNA, 16 bp, H. sapiens
aatgtacattatttca

SEQ ID NO: 21562 - DNA, 16 bp, H. sapiens
aatgtaccacagtttg

SEQ ID NO: 21563 - DNA, 16 bp, H. sapiens
aatgtaccataattta

SEQ ID NO: 21564 - DNA, 16 bp, H. sapiens
aatgtactaaaaacca

SEQ ID NO: 21565 - DNA, 16 bp, H. sapiens
aatgtagaaggaataa

SEQ ID NO: 21566 - DNA, 16 bp, H. sapiens
aatgtagagtcagtgg

SEQ ID NO: 21567 - DNA, 16 bp, H. sapiens
aatgtagatgacagat

SEQ ID NO: 21568 - DNA, 16 bp, H. sapiens
aatgtagatttttctc

SEQ ID NO: 21569 - DNA, 16 bp, H. sapiens
aatgtaggccgggtgc

SEQ ID NO: 21570 - DNA, 16 bp, H. sapiens
aatgtagtgaaacctc

SEQ ID NO: 21571 - DNA, 16 bp, H. sapiens
aatgtataaaatgtat

SEQ ID NO: 21572 - DNA, 16 bp, H. sapiens
aatgtataaattgctt

SEQ ID NO: 21573 - DNA, 16 bp, H. sapiens
aatgtataacatatat

SEQ ID NO: 21574 - DNA, 58 bp, H. sapiens
aatgtataactagaataaccaatacagagaagtgcttaaaggagctgatggagctgaa

SEQ ID NO: 21575 - DNA, 16 bp, H. sapiens
aatgtataataatcaa

SEQ ID NO: 21576 - DNA, 16 bp, H. sapiens
aatgtatatatgtaca

SEQ ID NO: 21577 - DNA, 16 bp, H. sapiens
aatgtatatatttatg

SEQ ID NO: 21578 - DNA, 16 bp, H. sapiens
aatgtatatgtgccac

SEQ ID NO: 21579 - DNA, 16 bp, H. sapiens
aatgtatattttgaat

SEQ ID NO: 21580 - DNA, 16 bp, H. sapiens
aatgtatattttgttg

SEQ ID NO: 21581 - DNA, 16 bp, H. sapiens
aatgtatatttttcta

SEQ ID NO: 21582 - DNA, 16 bp, H. sapiens
aatgtatcattttctt

SEQ ID NO: 21583 - DNA, 16 bp, H. sapiens
aatgtatctgatagaa

SEQ ID NO: 21584 - DNA, 16 bp, H. sapiens
aatgtatgaaaccaag

SEQ ID NO: 21585 - DNA, 16 bp, H. sapiens
aatgtatgaggattct

SEQ ID NO: 21586 - DNA, 16 bp, H. sapiens
aatgtatgtgaaagtg

SEQ ID NO: 21587 - DNA, 16 bp, H. sapiens
aatgtattattttcaa

SEQ ID NO: 21588 - DNA, 16 bp, H. sapiens
aatgtattcattcatt

SEQ ID NO: 21589 - DNA, 16 bp, H. sapiens
aatgtattcatttaat

SEQ ID NO: 21590 - DNA, 16 bp, H. sapiens
aatgtattcttttata

SEQ ID NO: 21591 - DNA, 16 bp, H. sapiens
aatgtatttatgtatg

SEQ ID NO: 21592 - DNA, 16 bp, H. sapiens
aatgtatttatttctg

SEQ ID NO: 21593 - DNA, 16 bp, H. sapiens
aatgtatttcaaaaaa

SEQ ID NO: 21594 - DNA, 16 bp, H. sapiens
aatgtatttctaattt

SEQ ID NO: 21595 - DNA, 16 bp, H. sapiens
aatgtatttcttaaat

SEQ ID NO: 21596 - DNA, 16 bp, H. sapiens
aatgtatttcttaatt

SEQ ID NO: 21597 - DNA, 16 bp, H. sapiens
aatgtatttctttatt

SEQ ID NO: 21598 - DNA, 16 bp, H. sapiens
aatgtatttctttctc

SEQ ID NO: 21599 - DNA, 16 bp, H. sapiens
aatgtatttgatgtct

SEQ ID NO: 21600 - DNA, 16 bp, H. sapiens
aatgtatttgcaaata

SEQ ID NO: 21601 - DNA, 16 bp, H. sapiens
aatgtatttggagata

SEQ ID NO: 21602 - DNA, 16 bp, H. sapiens
aatgtatttggctcat

SEQ ID NO: 21603 - DNA, 16 bp, H. sapiens
aatgtatttgtacatt

SEQ ID NO: 21604 - DNA, 16 bp, H. sapiens
aatgtattttaaagca

SEQ ID NO: 21605 - DNA, 16 bp, H. sapiens
aatgtattttaaatac

SEQ ID NO: 21606 - DNA, 16 bp, H. sapiens
aatgtattttaagaaa

SEQ ID NO: 21607 - DNA, 16 bp, H. sapiens
aatgtattttcaaata

SEQ ID NO: 21608 - DNA, 16 bp, H. sapiens
aatgtattttcataat

SEQ ID NO: 21609 - DNA, 16 bp, H. sapiens
aatgtattttcttcct

SEQ ID NO: 21610 - DNA, 16 bp, H. sapiens
aatgtattttctttta

SEQ ID NO: 21611 - DNA, 16 bp, H. sapiens
aatgtatttttcaaat

SEQ ID NO: 21612 - DNA, 16 bp, H. sapiens
aatgtatttttcagtt

SEQ ID NO: 21613 - DNA, 16 bp, H. sapiens
aatgtatttttcatat

SEQ ID NO: 21614 - DNA, 16 bp, H. sapiens
aatgtatttttctcct

SEQ ID NO: 21615 - DNA, 16 bp, H. sapiens
aatgtatttttttcca

SEQ ID NO: 21616 - DNA, 16 bp, H. sapiens
aatgtatttttttcta

SEQ ID NO: 21617 - DNA, 16 bp, H. sapiens
aatgtatttttttctg

SEQ ID NO: 21618 - DNA, 16 bp, H. sapiens
aatgtcaaaaacaaat

SEQ ID NO: 21619 - DNA, 16 bp, H. sapiens
aatgtcaaaatttaaa

SEQ ID NO: 21620 - DNA, 16 bp, H. sapiens
aatgtcaaagagaaaa

SEQ ID NO: 21621 - DNA, 16 bp, H. sapiens
aatgtcaatatatttt

SEQ ID NO: 21622 - DNA, 16 bp, H. sapiens
aatgtcacacctcaag

SEQ ID NO: 21623 - DNA, 16 bp, H. sapiens
aatgtcacctcctctg

SEQ ID NO: 21624 - DNA, 16 bp, H. sapiens
aatgtcactgaactgt

SEQ ID NO: 21625 - DNA, 16 bp, H. sapiens
aatgtcactgaattgt

SEQ ID NO: 21626 - DNA, 16 bp, H. sapiens
aatgtcagaaagaaaa

SEQ ID NO: 21627 - DNA, 16 bp, H. sapiens
aatgtcagtagtgcca

SEQ ID NO: 21628 - DNA, 17 bp, H. sapiens
aatgtcatcagttaagg

SEQ ID NO: 21629 - DNA, 16 bp, H. sapiens
aatgtcatcttttttt

SEQ ID NO: 21630 - DNA, 16 bp, H. sapiens
aatgtcatgtagttgg

SEQ ID NO: 21631 - DNA, 16 bp, H. sapiens
aatgtcattaaaattt

SEQ ID NO: 21632 - DNA, 16 bp, H. sapiens
aatgtcattattttaa

SEQ ID NO: 21633 - DNA, 16 bp, H. sapiens
aatgtcattgattttt

SEQ ID NO: 21634 - DNA, 16 bp, H. sapiens
aatgtcattggtattt

SEQ ID NO: 21635 - DNA, 16 bp, H. sapiens
aatgtcatttcatttt

SEQ ID NO: 21636 - DNA, 16 bp, H. sapiens
aatgtccaccaacaga

SEQ ID NO: 21637 - DNA, 16 bp, H. sapiens
aatgtccagaaaaggc

SEQ ID NO: 21638 - DNA, 16 bp, H. sapiens
aatgtccatcaacagg

SEQ ID NO: 21639 - DNA, 16 bp, H. sapiens
aatgtccatcaacagt

SEQ ID NO: 21640 - DNA, 16 bp, H. sapiens
aatgtcctcaccacaa

SEQ ID NO: 21641 - DNA, 16 bp, H. sapiens
aatgtcctcatctata

SEQ ID NO: 21642 - DNA, 16 bp, H. sapiens
aatgtccttttgtaga

SEQ ID NO: 21643 - DNA, 16 bp, H. sapiens
aatgtctactttttca

SEQ ID NO: 21644 - DNA, 16 bp, H. sapiens
aatgtctagatctcta

SEQ ID NO: 21645 - DNA, 16 bp, H. sapiens
aatgtctctttttaaa

SEQ ID NO: 21646 - DNA, 16 bp, H. sapiens
aatgtctgacacatag

SEQ ID NO: 21647 - DNA, 16 bp, H. sapiens
aatgtctgtagacatt

SEQ ID NO: 21648 - DNA, 16 bp, H. sapiens
aatgtctgttctttat

SEQ ID NO: 21649 - DNA, 16 bp, H. sapiens
aatgtcttaaaatttt

SEQ ID NO: 21650 - DNA, 16 bp, H. sapiens
aatgtcttcaaagttc

SEQ ID NO: 21651 - DNA, 16 bp, H. sapiens
aatgtcttcatctgta

SEQ ID NO: 21652 - DNA, 16 bp, H. sapiens
aatgtcttccagttcc

SEQ ID NO: 21653 - DNA, 16 bp, H. sapiens
aatgtcttctcttgag

SEQ ID NO: 21654 - DNA, 16 bp, H. sapiens
aatgtctttaaaatat

SEQ ID NO: 21655 - DNA, 16 bp, H. sapiens
aatgtctttattttta

SEQ ID NO: 21656 - DNA, 16 bp, H. sapiens
aatgtctttctttttc

SEQ ID NO: 21657 - DNA, 16 bp, H. sapiens
aatgtctttgtctggc

SEQ ID NO: 21658 - DNA, 16 bp, H. sapiens
aatgtctttgtgtttt

SEQ ID NO: 21659 - DNA, 16 bp, H. sapiens
aatgtctttgtttaaa

SEQ ID NO: 21660 - DNA, 16 bp, H. sapiens
aatgtcttttaaaaaa

SEQ ID NO: 21661 - DNA, 16 bp, H. sapiens
aatgtcttttcatttt

SEQ ID NO: 21662 - DNA, 16 bp, H. sapiens
aatgtcttttccatct

SEQ ID NO: 21663 - DNA, 16 bp, H. sapiens
aatgtcttttgttatt

SEQ ID NO: 21664 - DNA, 16 bp, H. sapiens
aatgtctttttatatt

SEQ ID NO: 21665 - DNA, 16 bp, H. sapiens
aatgtgaaaaaaatgc

SEQ ID NO: 21666 - DNA, 16 bp, H. sapiens
aatgtgaaaaaaatgt

SEQ ID NO: 21667 - DNA, 16 bp, H. sapiens
aatgtgaaaaacagaa

SEQ ID NO: 21668 - DNA, 16 bp, H. sapiens
aatgtgaaaaactgga

SEQ ID NO: 21669 - DNA, 16 bp, H. sapiens
aatgtgaaaaatgtga

SEQ ID NO: 21670 - DNA, 16 bp, H. sapiens
aatgtgaaaacagaga

SEQ ID NO: 21671 - DNA, 16 bp, H. sapiens
aatgtgaaaatccaaa

SEQ ID NO: 21672 - DNA, 16 bp, H. sapiens
aatgtgaaaattttaa

SEQ ID NO: 21673 - DNA, 16 bp, H. sapiens
aatgtgaaagacaaaa

SEQ ID NO: 21674 - DNA, 16 bp, H. sapiens
aatgtgaaataatcac

SEQ ID NO: 21675 - DNA, 16 bp, H. sapiens
aatgtgaagatgatga

SEQ ID NO: 21676 - DNA, 16 bp, H. sapiens
aatgtgaataaagtat

SEQ ID NO: 21677 - DNA, 16 bp, H. sapiens
aatgtgaatgaattaa

SEQ ID NO: 21678 - DNA, 16 bp, H. sapiens
aatgtgaatgctatgt

SEQ ID NO: 21679 - DNA, 16 bp, H. sapiens
aatgtgacagaaaaga

SEQ ID NO: 21680 - DNA, 16 bp, H. sapiens
aatgtgaccttatttg

SEQ ID NO: 21681 - DNA, 16 bp, H. sapiens
aatgtgacttaattaa

SEQ ID NO: 21682 - DNA, 16 bp, H. sapiens
aatgtgagaaagaaat

SEQ ID NO: 21683 - DNA, 16 bp, H. sapiens
aatgtgataaaatgtt

SEQ ID NO: 21684 - DNA, 16 bp, H. sapiens
aatgtgatacaccata

SEQ ID NO: 21685 - DNA, 16 bp, H. sapiens
aatgtgatatatatac

SEQ ID NO: 21686 - DNA, 16 bp, H. sapiens
aatgtgatcctcagtg

SEQ ID NO: 21687 - DNA, 16 bp, H. sapiens
aatgtgatgatttgat

SEQ ID NO: 21688 - DNA, 16 bp, H. sapiens
aatgtgatgcttctgg

SEQ ID NO: 21689 - DNA, 16 bp, H. sapiens
aatgtgattcaccata

SEQ ID NO: 21690 - DNA, 21 bp, H. sapiens
aatgtgatttctgattcttca

SEQ ID NO: 21691 - DNA, 16 bp, H. sapiens
aatgtgattttaaaag

SEQ ID NO: 21692 - DNA, 16 bp, H. sapiens
aatgtgattttttttc

SEQ ID NO: 21693 - DNA, 19 bp, H. sapiens
aatgtgcaaaaatcacaat

SEQ ID NO: 21694 - DNA, 16 bp, H. sapiens
aatgtgcaattaaatt

SEQ ID NO: 21695 - DNA, 16 bp, H. sapiens
aatgtgcacatctttg

SEQ ID NO: 21696 - DNA, 16 bp, H. sapiens
aatgtgcatatagtta

SEQ ID NO: 21697 - DNA, 16 bp, H. sapiens
aatgtgctgtattcag

SEQ ID NO: 21698 - DNA, 16 bp, H. sapiens
aatgtgcttttatttt

SEQ ID NO: 21699 - DNA, 16 bp, H. sapiens
aatgtgctttttaaaa

SEQ ID NO: 21700 - DNA, 16 bp, H. sapiens
aatgtggaaaaactga

SEQ ID NO: 21701 - DNA, 16 bp, H. sapiens
aatgtggaaaatgtct

SEQ ID NO: 21702 - DNA, 16 bp, H. sapiens
aatgtggaagagactt

SEQ ID NO: 21703 - DNA, 16 bp, H. sapiens
aatgtggaagcaattt

SEQ ID NO: 21704 - DNA, 16 bp, H. sapiens
aatgtggcaaaaccct

SEQ ID NO: 21705 - DNA, 16 bp, H. sapiens
aatgtggcagaagtga

SEQ ID NO: 21706 - DNA, 16 bp, H. sapiens
aatgtggcatcctgga

SEQ ID NO: 21707 - DNA, 16 bp, H. sapiens
aatgtggcatgttttt

SEQ ID NO: 21708 - DNA, 16 bp, H. sapiens
aatgtggctgtgttcc

SEQ ID NO: 21709 - DNA, 16 bp, H. sapiens
aatgtgggaaagcctt

SEQ ID NO: 21710 - DNA, 16 bp, H. sapiens
aatgtgggaaagcttt

SEQ ID NO: 21711 - DNA, 16 bp, H. sapiens
aatgtgggaaatattt

SEQ ID NO: 21712 - DNA, 16 bp, H. sapiens
aatgtgggcatccttg

SEQ ID NO: 21713 - DNA, 16 bp, H. sapiens
aatgtggggattacag

SEQ ID NO: 21714 - DNA, 16 bp, H. sapiens
aatgtggggtcggagc

SEQ ID NO: 21715 - DNA, 16 bp, H. sapiens
aatgtggtaaaatata

SEQ ID NO: 21716 - DNA, 16 bp, H. sapiens
aatgtggtaaaatatt

SEQ ID NO: 21717 - DNA, 16 bp, H. sapiens
aatgtggtatatgtat

SEQ ID NO: 21718 - DNA, 16 bp, H. sapiens
aatgtgtaaataaatg

SEQ ID NO: 21719 - DNA, 16 bp, H. sapiens
aatgtgtaatgatcaa

SEQ ID NO: 21720 - DNA, 16 bp, H. sapiens
aatgtgtataattatt

SEQ ID NO: 21721 - DNA, 16 bp, H. sapiens
aatgtgtatatatata

SEQ ID NO: 21722 - DNA, 16 bp, H. sapiens
aatgtgtattctgtgg

SEQ ID NO: 21723 - DNA, 16 bp, H. sapiens
aatgtgtattttgctg

SEQ ID NO: 21724 - DNA, 16 bp, H. sapiens
aatgtgtatttttaaa

SEQ ID NO: 21725 - DNA, 16 bp, H. sapiens
aatgtgtccccaaaat

SEQ ID NO: 21726 - DNA, 16 bp, H. sapiens
aatgtgtctttaaaaa

SEQ ID NO: 21727 - DNA, 16 bp, H. sapiens
aatgtgtcttttctta

SEQ ID NO: 21728 - DNA, 16 bp, H. sapiens
aatgtgtgaaaatcac

SEQ ID NO: 21729 - DNA, 16 bp, H. sapiens
aatgtgtggcacctcc

SEQ ID NO: 21730 - DNA, 16 bp, H. sapiens
aatgtgtgtatgtgtg

SEQ ID NO: 21731 - DNA, 16 bp, H. sapiens
aatgtgtgtattttta

SEQ ID NO: 21732 - DNA, 16 bp, H. sapiens
aatgtgtgtgcctgtg

SEQ ID NO: 21733 - DNA, 16 bp, H. sapiens
aatgtgtgtgtataca

SEQ ID NO: 21734 - DNA, 16 bp, H. sapiens
aatgtgtgtgtatatg

SEQ ID NO: 21735 - DNA, 16 bp, H. sapiens
aatgtgtgttttcttt

SEQ ID NO: 21736 - DNA, 16 bp, H. sapiens
aatgtgttatttaaaa

SEQ ID NO: 21737 - DNA, 16 bp, H. sapiens
aatgtgtttaaaatat

SEQ ID NO: 21738 - DNA, 16 bp, H. sapiens
aatgtgtttaaaatgt

SEQ ID NO: 21739 - DNA, 16 bp, H. sapiens
aatgtgtttaaaattt

SEQ ID NO: 21740 - DNA, 16 bp, H. sapiens
aatgtgtttaaatatt

SEQ ID NO: 21741 - DNA, 16 bp, H. sapiens
aatgtgtttctatttt

SEQ ID NO: 21742 - DNA, 16 bp, H. sapiens
aatgtgtttctgtttt

SEQ ID NO: 21743 - DNA, 16 bp, H. sapiens
aatgtgtttgaaaata

SEQ ID NO: 21744 - DNA, 16 bp, H. sapiens
aatgtgtttgtgtatg

SEQ ID NO: 21745 - DNA, 16 bp, H. sapiens
aatgtgttttaaaata

SEQ ID NO: 21746 - DNA, 16 bp, H. sapiens
aatgtgttttaaaatt

SEQ ID NO: 21747 - DNA, 16 bp, H. sapiens
aatgtgtttttattct

SEQ ID NO: 21748 - DNA, 16 bp, H. sapiens
aatgttaaaagaagtt

SEQ ID NO: 21749 - DNA, 16 bp, H. sapiens
aatgttaaaatagaga

SEQ ID NO: 21750 - DNA, 16 bp, H. sapiens
aatgttaaatattatg

SEQ ID NO: 21751 - DNA, 16 bp, H. sapiens
aatgttaaatgaaatt

SEQ ID NO: 21752 - DNA, 16 bp, H. sapiens
aatgttaaatgcaaaa

SEQ ID NO: 21753 - DNA, 16 bp, H. sapiens
aatgttaaatgttaaa

SEQ ID NO: 21754 - DNA, 16 bp, H. sapiens
aatgttaaatttcttg

SEQ ID NO: 21755 - DNA, 16 bp, H. sapiens
aatgttaacatttgtt

SEQ ID NO: 21756 - DNA, 16 bp, H. sapiens
aatgttaagaaaatca

SEQ ID NO: 21757 - DNA, 16 bp, H. sapiens
aatgttaagagaatga

SEQ ID NO: 21758 - DNA, 16 bp, H. sapiens
aatgttaagtggaaaa

SEQ ID NO: 21759 - DNA, 17 bp, H. sapiens
aatgttaatagccaaga

SEQ ID NO: 21760 - DNA, 16 bp, H. sapiens
aatgttaatattttga

SEQ ID NO: 21761 - DNA, 16 bp, H. sapiens
aatgttaatgagaaaa

SEQ ID NO: 21762 - DNA, 16 bp, H. sapiens
aatgttaattagtaca

SEQ ID NO: 21763 - DNA, 16 bp, H. sapiens
aatgttacaattaaaa

SEQ ID NO: 21764 - DNA, 16 bp, H. sapiens
aatgttacagttctta

SEQ ID NO: 21765 - DNA, 16 bp, H. sapiens
aatgttagtattgaga

SEQ ID NO: 21766 - DNA, 16 bp, H. sapiens
aatgttatgaagaaaa

SEQ ID NO: 21767 - DNA, 16 bp, H. sapiens
aatgttatgatcactt

SEQ ID NO: 21768 - DNA, 16 bp, H. sapiens
aatgttatggagaaaa

SEQ ID NO: 21769 - DNA, 16 bp, H. sapiens
aatgttattacaaaag

SEQ ID NO: 21770 - DNA, 16 bp, H. sapiens
aatgttatttctgtaa

SEQ ID NO: 21771 - DNA, 16 bp, H. sapiens
aatgttatttcttaaa

SEQ ID NO: 21772 - DNA, 16 bp, H. sapiens
aatgttattttcatca

SEQ ID NO: 21773 - DNA, 16 bp, H. sapiens
aatgttattttcttct

SEQ ID NO: 21774 - DNA, 16 bp, H. sapiens
aatgttcaaataaaat

SEQ ID NO: 21775 - DNA, 16 bp, H. sapiens
aatgttcatctctttt

SEQ ID NO: 21776 - DNA, 16 bp, H. sapiens
aatgttcatttcttct

SEQ ID NO: 21777 - DNA, 16 bp, H. sapiens
aatgttcattttattt

SEQ ID NO: 21778 - DNA, 16 bp, H. sapiens
aatgttccagctcaag

SEQ ID NO: 21779 - DNA, 16 bp, H. sapiens
aatgttcccagcacaa

SEQ ID NO: 21780 - DNA, 16 bp, H. sapiens
aatgttctcattttta

SEQ ID NO: 21781 - DNA, 16 bp, H. sapiens
aatgttctggaaatgg

SEQ ID NO: 21782 - DNA, 16 bp, H. sapiens
aatgttctgtgtgctg

SEQ ID NO: 21783 - DNA, 16 bp, H. sapiens
aatgttcttaaaattt

SEQ ID NO: 21784 - DNA, 16 bp, H. sapiens
aatgttcttaatgtca

SEQ ID NO: 21785 - DNA, 16 bp, H. sapiens
aatgttcttctttgtc

SEQ ID NO: 21786 - DNA, 16 bp, H. sapiens
aatgttctttcctttc

SEQ ID NO: 21787 - DNA, 16 bp, H. sapiens
aatgttctttctcttt

SEQ ID NO: 21788 - DNA, 16 bp, H. sapiens
aatgttgaaaatattt

SEQ ID NO: 21789 - DNA, 16 bp, H. sapiens
aatgttgagaaagaaa

SEQ ID NO: 21790 - DNA, 16 bp, H. sapiens
aatgttgatagtgggg

SEQ ID NO: 21791 - DNA, 16 bp, H. sapiens
aatgttgcagtgaaca

SEQ ID NO: 21792 - DNA, 16 bp, H. sapiens
aatgttgggtgtgtat

SEQ ID NO: 21793 - DNA, 16 bp, H. sapiens
aatgttggtgaggata

SEQ ID NO: 21794 - DNA, 16 bp, H. sapiens
aatgttggtttccagc

SEQ ID NO: 21795 - DNA, 16 bp, H. sapiens
aatgttgtaaatattt

SEQ ID NO: 21796 - DNA, 16 bp, H. sapiens
aatgttgtcttctaga

SEQ ID NO: 21797 - DNA, 16 bp, H. sapiens
aatgttgttaaaatga

SEQ ID NO: 21798 - DNA, 16 bp, H. sapiens
aatgtttaaagaagaa

SEQ ID NO: 21799 - DNA, 16 bp, H. sapiens
aatgtttaatattggc

SEQ ID NO: 21800 - DNA, 16 bp, H. sapiens
aatgtttaatatttga

SEQ ID NO: 21801 - DNA, 16 bp, H. sapiens
aatgtttaatgtaaat

SEQ ID NO: 21802 - DNA, 16 bp, H. sapiens
aatgtttacattattt

SEQ ID NO: 21803 - DNA, 16 bp, H. sapiens
aatgtttacatttatt

SEQ ID NO: 21804 - DNA, 16 bp, H. sapiens
aatgtttacttttaat

SEQ ID NO: 21805 - DNA, 16 bp, H. sapiens
aatgtttacttttcta

SEQ ID NO: 21806 - DNA, 16 bp, H. sapiens
aatgtttataaaatga

SEQ ID NO: 21807 - DNA, 16 bp, H. sapiens
aatgtttatagcagct

SEQ ID NO: 21808 - DNA, 16 bp, H. sapiens
aatgtttatatttttc

SEQ ID NO: 21809 - DNA, 16 bp, H. sapiens
aatgtttatgttcccc

SEQ ID NO: 21810 - DNA, 16 bp, H. sapiens
aatgtttattctgctg

SEQ ID NO: 21811 - DNA, 16 bp, H. sapiens
aatgtttattgaacaa

SEQ ID NO: 21812 - DNA, 16 bp, H. sapiens
aatgtttatttaaaag

SEQ ID NO: 21813 - DNA, 16 bp, H. sapiens
aatgtttatttacttt

SEQ ID NO: 21814 - DNA, 16 bp, H. sapiens
aatgtttcagtcaatg

SEQ ID NO: 21815 - DNA, 16 bp, H. sapiens
aatgtttcagtgaaca

SEQ ID NO: 21816 - DNA, 16 bp, H. sapiens
aatgtttcatcatttt

SEQ ID NO: 21817 - DNA, 16 bp, H. sapiens
aatgtttcatttatta

SEQ ID NO: 21818 - DNA, 16 bp, H. sapiens
aatgtttctagaaaaa

SEQ ID NO: 21819 - DNA, 16 bp, H. sapiens
aatgtttctatttatt

SEQ ID NO: 21820 - DNA, 16 bp, H. sapiens
aatgtttctcttcatt

SEQ ID NO: 21821 - DNA, 16 bp, H. sapiens
aatgtttctctttaaa

SEQ ID NO: 21822 - DNA, 16 bp, H. sapiens
aatgtttcttatattt

SEQ ID NO: 21823 - DNA, 16 bp, H. sapiens
aatgtttctttaaaaa

SEQ ID NO: 21824 - DNA, 16 bp, H. sapiens
aatgtttctttttaaa

SEQ ID NO: 21825 - DNA, 16 bp, H. sapiens
aatgtttgcaaatcat

SEQ ID NO: 21826 - DNA, 16 bp, H. sapiens
aatgtttgctgaagga

SEQ ID NO: 21827 - DNA, 16 bp, H. sapiens
aatgtttgctgaatta

SEQ ID NO: 21828 - DNA, 16 bp, H. sapiens
aatgtttggaaataaa

SEQ ID NO: 21829 - DNA, 16 bp, H. sapiens
aatgtttggcagaatt

SEQ ID NO: 21830 - DNA, 16 bp, H. sapiens
aatgtttggtagaact

SEQ ID NO: 21831 - DNA, 16 bp, H. sapiens
aatgtttgtgaaatga

SEQ ID NO: 21832 - DNA, 16 bp, H. sapiens
aatgtttgttaaatga

SEQ ID NO: 21833 - DNA, 16 bp, H. sapiens
aatgtttgttgaataa

SEQ ID NO: 21834 - DNA, 16 bp, H. sapiens
aatgttttaaaaattg

SEQ ID NO: 21835 - DNA, 16 bp, H. sapiens
aatgttttaaaatgta

SEQ ID NO: 21836 - DNA, 16 bp, H. sapiens
aatgttttaaaccttt

SEQ ID NO: 21837 - DNA, 16 bp, H. sapiens
aatgttttacataatt

SEQ ID NO: 21838 - DNA, 16 bp, H. sapiens
aatgttttataaatgt

SEQ ID NO: 21839 - DNA, 16 bp, H. sapiens
aatgttttatagaatt

SEQ ID NO: 21840 - DNA, 16 bp, H. sapiens
aatgttttatcatgaa

SEQ ID NO: 21841 - DNA, 16 bp, H. sapiens
aatgttttatttcagt

SEQ ID NO: 21842 - DNA, 16 bp, H. sapiens
aatgttttcaaaataa

SEQ ID NO: 21843 - DNA, 16 bp, H. sapiens
aatgttttcaaaatat

SEQ ID NO: 21844 - DNA, 16 bp, H. sapiens
aatgttttcaaagttc

SEQ ID NO: 21845 - DNA, 16 bp, H. sapiens
aatgttttcaaatttc

SEQ ID NO: 21846 - DNA, 16 bp, H. sapiens
aatgttttcacttttt

SEQ ID NO: 21847 - DNA, 16 bp, H. sapiens
aatgttttcagaaagt

SEQ ID NO: 21848 - DNA, 16 bp, H. sapiens
aatgttttcagtcttt

SEQ ID NO: 21849 - DNA, 16 bp, H. sapiens
aatgttttcataaatt

SEQ ID NO: 21850 - DNA, 16 bp, H. sapiens
aatgttttcataattt

SEQ ID NO: 21851 - DNA, 16 bp, H. sapiens
aatgttttcattaaaa

SEQ ID NO: 21852 - DNA, 16 bp, H. sapiens
aatgttttcatttaaa

SEQ ID NO: 21853 - DNA, 16 bp, H. sapiens
aatgttttccatttta

SEQ ID NO: 21854 - DNA, 16 bp, H. sapiens
aatgttttctctgcat

SEQ ID NO: 21855 - DNA, 16 bp, H. sapiens
aatgttttctgctttt

SEQ ID NO: 21856 - DNA, 16 bp, H. sapiens
aatgttttctgtttta

SEQ ID NO: 21857 - DNA, 16 bp, H. sapiens
aatgttttcttagaaa

SEQ ID NO: 21858 - DNA, 16 bp, H. sapiens
aatgttttcttcattt

SEQ ID NO: 21859 - DNA, 16 bp, H. sapiens
aatgttttcttgtagt

SEQ ID NO: 21860 - DNA, 16 bp, H. sapiens
aatgttttctttaaat

SEQ ID NO: 21861 - DNA, 16 bp, H. sapiens
aatgttttcttttagt

SEQ ID NO: 21862 - DNA, 16 bp, H. sapiens
aatgttttctttttca

SEQ ID NO: 21863 - DNA, 16 bp, H. sapiens
aatgttttgaaacaaa

SEQ ID NO: 21864 - DNA, 16 bp, H. sapiens
aatgttttgatttctt

SEQ ID NO: 21865 - DNA, 16 bp, H. sapiens
aatgttttgcagtttt

SEQ ID NO: 21866 - DNA, 16 bp, H. sapiens
aatgttttgccttttt

SEQ ID NO: 21867 - DNA, 16 bp, H. sapiens
aatgttttgtaaatat

SEQ ID NO: 21868 - DNA, 16 bp, H. sapiens
aatgttttgtatttct

SEQ ID NO: 21869 - DNA, 16 bp, H. sapiens
aatgtttttaaaaaga

SEQ ID NO: 21870 - DNA, 16 bp, H. sapiens
aatgtttttaaaaagt

SEQ ID NO: 21871 - DNA, 16 bp, H. sapiens
aatgtttttaaaggca

SEQ ID NO: 21872 - DNA, 16 bp, H. sapiens
aatgtttttaatcttt

SEQ ID NO: 21873 - DNA, 16 bp, H. sapiens
aatgtttttcaaatat

SEQ ID NO: 21874 - DNA, 16 bp, H. sapiens
aatgtttttccatctg

SEQ ID NO: 21875 - DNA, 17 bp, H. sapiens
aatgtttttccatttgt

SEQ ID NO: 21876 - DNA, 16 bp, H. sapiens
aatgtttttcctttaa

SEQ ID NO: 21877 - DNA, 16 bp, H. sapiens
aatgtttttcttaaaa

SEQ ID NO: 21878 - DNA, 16 bp, H. sapiens
aatgtttttcttttcc

SEQ ID NO: 21879 - DNA, 16 bp, H. sapiens
aatgtttttgtttgct

SEQ ID NO: 21880 - DNA, 16 bp, H. sapiens
aatgttttttaaaaag

SEQ ID NO: 21881 - DNA, 16 bp, H. sapiens
aattaaaaaatcagag

SEQ ID NO: 21882 - DNA, 16 bp, H. sapiens
aattaaaaaatggtca

SEQ ID NO: 21883 - DNA, 16 bp, H. sapiens
aattaaaaaccttctg

SEQ ID NO: 21884 - DNA, 16 bp, H. sapiens
aattaaaaacttttgc

SEQ ID NO: 21885 - DNA, 16 bp, H. sapiens
aattaaaaagctgaaa

SEQ ID NO: 21886 - DNA, 16 bp, H. sapiens
aattaaaaagtagcca

SEQ ID NO: 21887 - DNA, 16 bp, H. sapiens
aattaaaaagtgtttt

SEQ ID NO: 21888 - DNA, 16 bp, H. sapiens
aattaaaaagttttca

SEQ ID NO: 21889 - DNA, 16 bp, H. sapiens
aattaaaaatagaact

SEQ ID NO: 21890 - DNA, 16 bp, H. sapiens
aattaaaaatgctatt

SEQ ID NO: 21891 - DNA, 16 bp, H. sapiens
aattaaaaattgcaaa

SEQ ID NO: 21892 - DNA, 16 bp, H. sapiens
aattaaaacaatgatg

SEQ ID NO: 21893 - DNA, 16 bp, H. sapiens
aattaaaacagtgtgg

SEQ ID NO: 21894 - DNA, 16 bp, H. sapiens
aattaaaacatgaatt

SEQ ID NO: 21895 - DNA, 16 bp, H. sapiens
aattaaaactacaatg

SEQ ID NO: 21896 - DNA, 16 bp, H. sapiens
aattaaaactagaaat

SEQ ID NO: 21897 - DNA, 16 bp, H. sapiens
aattaaaactttcctt

SEQ ID NO: 21898 - DNA, 16 bp, H. sapiens
aattaaaagaaacatt

SEQ ID NO: 21899 - DNA, 16 bp, H. sapiens
aattaaaagaaaggtt

SEQ ID NO: 21900 - DNA, 16 bp, H. sapiens
aattaaaagaacattt

SEQ ID NO: 21901 - DNA, 16 bp, H. sapiens
aattaaaagagaagca

SEQ ID NO: 21902 - DNA, 16 bp, H. sapiens
aattaaaaggcacaga

SEQ ID NO: 21903 - DNA, 16 bp, H. sapiens
aattaaaagtggatag

SEQ ID NO: 21904 - DNA, 16 bp, H. sapiens
aattaaaatacttagg

SEQ ID NO: 21905 - DNA, 16 bp, H. sapiens
aattaaaatatttgtg

SEQ ID NO: 21906 - DNA, 16 bp, H. sapiens
aattaaaatgactttt

SEQ ID NO: 21907 - DNA, 16 bp, H. sapiens
aattaaaatgcaataa

SEQ ID NO: 21908 - DNA, 16 bp, H. sapiens
aattaaaatggcttat

SEQ ID NO: 21909 - DNA, 16 bp, H. sapiens
aattaaaatggttttt

SEQ ID NO: 21910 - DNA, 16 bp, H. sapiens
aattaaaatttcagtg

SEQ ID NO: 21911 - DNA, 16 bp, H. sapiens
aattaaacaaaaagct

SEQ ID NO: 21912 - DNA, 16 bp, H. sapiens
aattaaacaagaagac

SEQ ID NO: 21913 - DNA, 16 bp, H. sapiens
aattaaacctctttta

SEQ ID NO: 21914 - DNA, 16 bp, H. sapiens
aattaaaccttttttc

SEQ ID NO: 21915 - DNA, 16 bp, H. sapiens
aattaaacttcctttc

SEQ ID NO: 21916 - DNA, 16 bp, H. sapiens
aattaaacttttcatt

SEQ ID NO: 21917 - DNA, 16 bp, H. sapiens
aattaaagagcttctg

SEQ ID NO: 21918 - DNA, 16 bp, H. sapiens
aattaaagcattttaa

SEQ ID NO: 21919 - DNA, 16 bp, H. sapiens
aattaaagccatatat

SEQ ID NO: 21920 - DNA, 16 bp, H. sapiens
aattaaagggaaatta

SEQ ID NO: 21921 - DNA, 16 bp, H. sapiens
aattaaagggagaaat

SEQ ID NO: 21922 - DNA, 16 bp, H. sapiens
aattaaagtttttctt

SEQ ID NO: 21923 - DNA, 16 bp, H. sapiens
aattaaataacctgtt

SEQ ID NO: 21924 - DNA, 16 bp, H. sapiens
aattaaatatagaact

SEQ ID NO: 21925 - DNA, 16 bp, H. sapiens
aattaaatatgcattt

SEQ ID NO: 21926 - DNA, 16 bp, H. sapiens
aattaaatcaagatgg

SEQ ID NO: 21927 - DNA, 16 bp, H. sapiens
aattaaatcagaatat

SEQ ID NO: 21928 - DNA, 16 bp, H. sapiens
aattaaatcagtatgt

SEQ ID NO: 21929 - DNA, 16 bp, H. sapiens
aattaaatccaaagca

SEQ ID NO: 21930 - DNA, 16 bp, H. sapiens
aattaaatccacaatg

SEQ ID NO: 21931 - DNA, 16 bp, H. sapiens
aattaaatcccttttc

SEQ ID NO: 21932 - DNA, 16 bp, H. sapiens
aattaaatgaaacatt

SEQ ID NO: 21933 - DNA, 16 bp, H. sapiens
aattaaatgagaattt

SEQ ID NO: 21934 - DNA, 16 bp, H. sapiens
aattaaatgaggtcat

SEQ ID NO: 21935 - DNA, 16 bp, H. sapiens
aattaaatgtttcatt

SEQ ID NO: 21936 - DNA, 16 bp, H. sapiens
aattaaattcagcaaa

SEQ ID NO: 21937 - DNA, 16 bp, H. sapiens
aattaacaaagaaatt

SEQ ID NO: 21938 - DNA, 16 bp, H. sapiens
aattaacacagggaca

SEQ ID NO: 21939 - DNA, 16 bp, H. sapiens
aattaacattttgttt

SEQ ID NO: 21940 - DNA, 16 bp, H. sapiens
aattaaccaaaaaagt

SEQ ID NO: 21941 - DNA, 16 bp, H. sapiens
aattaacctctctgtg

SEQ ID NO: 21942 - DNA, 16 bp, H. sapiens
aattaaccttagctta

SEQ ID NO: 21943 - DNA, 16 bp, H. sapiens
aattaactcaaaatga

SEQ ID NO: 21944 - DNA, 17 bp, H. sapiens
aattaactgggcatggt

SEQ ID NO: 21945 - DNA, 16 bp, H. sapiens
aattaagaaaaacttt

SEQ ID NO: 21946 - DNA, 16 bp, H. sapiens
aattaagaaaacatta

SEQ ID NO: 21947 - DNA, 16 bp, H. sapiens
aattaagaaaactttt

SEQ ID NO: 21948 - DNA, 16 bp, H. sapiens
aattaagaaaatgtgg

SEQ ID NO: 21949 - DNA, 16 bp, H. sapiens
aattaagaaactggca

SEQ ID NO: 21950 - DNA, 16 bp, H. sapiens
aattaagaaattagct

SEQ ID NO: 21951 - DNA, 16 bp, H. sapiens
aattaagacacagaga

SEQ ID NO: 21952 - DNA, 16 bp, H. sapiens
aattaagactcagaga

SEQ ID NO: 21953 - DNA, 16 bp, H. sapiens
aattaagcaaaatgct

SEQ ID NO: 21954 - DNA, 16 bp, H. sapiens
aattaagcaagagaaa

SEQ ID NO: 21955 - DNA, 16 bp, H. sapiens
aattaagctaattaac

SEQ ID NO: 21956 - DNA, 16 bp, H. sapiens
aattaaggcaacaaaa

SEQ ID NO: 21957 - DNA, 16 bp, H. sapiens
aattaagtcagaatct

SEQ ID NO: 21958 - DNA, 16 bp, H. sapiens
aattaagtgctaaatt

SEQ ID NO: 21959 - DNA, 16 bp, H. sapiens
aattaataaaatgaca

SEQ ID NO: 21960 - DNA, 16 bp, H. sapiens
aattaataaccctaca

SEQ ID NO: 21961 - DNA, 16 bp, H. sapiens
aattaatactttcata

SEQ ID NO: 21962 - DNA, 16 bp, H. sapiens
aattaatagaaacaga

SEQ ID NO: 21963 - DNA, 16 bp, H. sapiens
aattaatatgtgtaaa

SEQ ID NO: 21964 - DNA, 16 bp, H. sapiens
aattaatcagggaaga

SEQ ID NO: 21965 - DNA, 16 bp, H. sapiens
aattaatgaacaaata

SEQ ID NO: 21966 - DNA, 16 bp, H. sapiens
aattaatgaataaaca

SEQ ID NO: 21967 - DNA, 16 bp, H. sapiens
aattaatgagataatt

SEQ ID NO: 21968 - DNA, 16 bp, H. sapiens
aattaatgcaataaaa

SEQ ID NO: 21969 - DNA, 16 bp, H. sapiens
aattaattcaggatgg

SEQ ID NO: 21970 - DNA, 16 bp, H. sapiens
aattaattgactgtta

SEQ ID NO: 21971 - DNA, 16 bp, H. sapiens
aattaatttcatctgt

SEQ ID NO: 21972 - DNA, 16 bp, H. sapiens
aattaattttcaacaa

SEQ ID NO: 21973 - DNA, 16 bp, H. sapiens
aattaattttcgtata

SEQ ID NO: 21974 - DNA, 16 bp, H. sapiens
aattaattttgcattt

SEQ ID NO: 21975 - DNA, 16 bp, H. sapiens
aattaattttgttttc

SEQ ID NO: 21976 - DNA, 16 bp, H. sapiens
aattacaaatgttgat

SEQ ID NO: 21977 - DNA, 16 bp, H. sapiens
aattacagaaacaaat

SEQ ID NO: 21978 - DNA, 16 bp, H. sapiens
aattacagatatattt

SEQ ID NO: 21979 - DNA, 16 bp, H. sapiens
aattacagatttaaaa

SEQ ID NO: 21980 - DNA, 16 bp, H. sapiens
aattacagattttaaa

SEQ ID NO: 21981 - DNA, 18 bp, H. sapiens
aattacaggcctgagcca

SEQ ID NO: 21982 - DNA, 16 bp, H. sapiens
aattacaggtgtgtgc

SEQ ID NO: 21983 - DNA, 16 bp, H. sapiens
aattacatctttaaag

SEQ ID NO: 21984 - DNA, 16 bp, H. sapiens
aattacatgcatgagc

SEQ ID NO: 21985 - DNA, 16 bp, H. sapiens
aattacatgtatattt

SEQ ID NO: 21986 - DNA, 16 bp, H. sapiens
aattacatgttaattt

SEQ ID NO: 21987 - DNA, 16 bp, H. sapiens
aattacatgttacaat

SEQ ID NO: 21988 - DNA, 16 bp, H. sapiens
aattacattgaatata

SEQ ID NO: 21989 - DNA, 16 bp, H. sapiens
aattacatttcaattt

SEQ ID NO: 21990 - DNA, 16 bp, H. sapiens
aattacatttgcaaaa

SEQ ID NO: 21991 - DNA, 16 bp, H. sapiens
aattacattttatatg

SEQ ID NO: 21992 - DNA, 16 bp, H. sapiens
aattacattttatgtt

SEQ ID NO: 21993 - DNA, 16 bp, H. sapiens
aattaccaaaatgtga

SEQ ID NO: 21994 - DNA, 16 bp, H. sapiens
aattaccaatattagg

SEQ ID NO: 21995 - DNA, 16 bp, H. sapiens
aattaccacaaaccta

SEQ ID NO: 21996 - DNA, 16 bp, H. sapiens
aattaccacaaacctg

SEQ ID NO: 21997 - DNA, 16 bp, H. sapiens
aattaccagaaaaaga

SEQ ID NO: 21998 - DNA, 16 bp, H. sapiens
aattaccagtattacc

SEQ ID NO: 21999 - DNA, 16 bp, H. sapiens
aattacccagtcctgg

SEQ ID NO: 22000 - DNA, 16 bp, H. sapiens
aattaccctgatttga

SEQ ID NO: 22001 - DNA, 16 bp, H. sapiens
aattacctccacctgt

SEQ ID NO: 22002 - DNA, 16 bp, H. sapiens
aattacctctttaaaa

SEQ ID NO: 22003 - DNA, 16 bp, H. sapiens
aattacctctttaaag

SEQ ID NO: 22004 - DNA, 16 bp, H. sapiens
aattaccttgtgcagt

SEQ ID NO: 22005 - DNA, 16 bp, H. sapiens
aattacctttttaaag

SEQ ID NO: 22006 - DNA, 16 bp, H. sapiens
aattactaaaatgtat

SEQ ID NO: 22007 - DNA, 16 bp, H. sapiens
aattactacaaagaaa

SEQ ID NO: 22008 - DNA, 16 bp, H. sapiens
aattactatttgaccc

SEQ ID NO: 22009 - DNA, 16 bp, H. sapiens
aattactctttctcca

SEQ ID NO: 22010 - DNA, 16 bp, H. sapiens
aattactgaaaaatat

SEQ ID NO: 22011 - DNA, 16 bp, H. sapiens
aattactgaaataaat

SEQ ID NO: 22012 - DNA, 16 bp, H. sapiens
aattactgagaaaaaa

SEQ ID NO: 22013 - DNA, 16 bp, H. sapiens
aattactgtatgatcc

SEQ ID NO: 22014 - DNA, 16 bp, H. sapiens
aattactgtgtatttg

SEQ ID NO: 22015 - DNA, 16 bp, H. sapiens
aattactgtttttatt

SEQ ID NO: 22016 - DNA, 16 bp, H. sapiens
aattacttaatctctt

SEQ ID NO: 22017 - DNA, 16 bp, H. sapiens
aattactttgaatgta

SEQ ID NO: 22018 - DNA, 16 bp, H. sapiens
aattacttttgaacca

SEQ ID NO: 22019 - DNA, 16 bp, H. sapiens
aattagaaactatttt

SEQ ID NO: 22020 - DNA, 16 bp, H. sapiens
aattagaagaaaacat

SEQ ID NO: 22021 - DNA, 16 bp, H. sapiens
aattagaagaactaga

SEQ ID NO: 22022 - DNA, 16 bp, H. sapiens
aattagagaaacagaa

SEQ ID NO: 22023 - DNA, 16 bp, H. sapiens
aattagcaaggtgtgg

SEQ ID NO: 22024 - DNA, 16 bp, H. sapiens
aattagcatatccatc

SEQ ID NO: 22025 - DNA, 17 bp, H. sapiens
aattagccagatgtggt

SEQ ID NO: 22026 - DNA, 16 bp, H. sapiens
aattagccaggaatgg

SEQ ID NO: 22027 - DNA, 21 bp, H. sapiens
aattagccaggcatggtggcg

SEQ ID NO: 22028 - DNA, 18 bp, H. sapiens
aattagccaggcatgttg

SEQ ID NO: 22029 - DNA, 18 bp, H. sapiens
aattagccaggcgtggta

SEQ ID NO: 22030 - DNA, 16 bp, H. sapiens
aattagccaggcgtgt

SEQ ID NO: 22031 - DNA, 17 bp, H. sapiens
aattagccagtcatggt

SEQ ID NO: 22032 - DNA, 16 bp, H. sapiens
aattagccgaacatgg

SEQ ID NO: 22033 - DNA, 16 bp, H. sapiens
aattagccgggagtag

SEQ ID NO: 22034 - DNA, 19 bp, H. sapiens
aattagccgggcatggtgc

SEQ ID NO: 22035 - DNA, 26 bp, H. sapiens
aattagccgggcgtagtggcgggcgc

SEQ ID NO: 22036 - DNA, 16 bp, H. sapiens
aattagccgggcgtcg

SEQ ID NO: 22037 - DNA, 16 bp, H. sapiens
aattagccgggcgtgt

SEQ ID NO: 22038 - DNA, 18 bp, H. sapiens
aattagccgggtgtagtg

SEQ ID NO: 22039 - DNA, 16 bp, H. sapiens
aattagccgggtgttg

SEQ ID NO: 22040 - DNA, 17 bp, H. sapiens
aattagctaggcctggt

SEQ ID NO: 22041 - DNA, 16 bp, H. sapiens
aattagctgggcatgc

SEQ ID NO: 22042 - DNA, 17 bp, H. sapiens
aattagctgggcatggc

SEQ ID NO: 22043 - DNA, 16 bp, H. sapiens
aattagctgggcgtac

SEQ ID NO: 22044 - DNA, 18 bp, H. sapiens
aattagctgggcttggtg

SEQ ID NO: 22045 - DNA, 16 bp, H. sapiens
aattagctgggtctgg

SEQ ID NO: 22046 - DNA, 17 bp, H. sapiens
aattagctgggtgtgat

SEQ ID NO: 22047 - DNA, 16 bp, H. sapiens
aattagctgtgcatgg

SEQ ID NO: 22048 - DNA, 16 bp, H. sapiens
aattaggaagagagga

SEQ ID NO: 22049 - DNA, 16 bp, H. sapiens
aattaggaattgatgg

SEQ ID NO: 22050 - DNA, 16 bp, H. sapiens
aattaggcaagagaaa

SEQ ID NO: 22051 - DNA, 16 bp, H. sapiens
aattagggatgctcaa

SEQ ID NO: 22052 - DNA, 16 bp, H. sapiens
aattagggtttcaaca

SEQ ID NO: 22053 - DNA, 16 bp, H. sapiens
aattagtaacataaaa

SEQ ID NO: 22054 - DNA, 16 bp, H. sapiens
aattagtagacaagga

SEQ ID NO: 22055 - DNA, 16 bp, H. sapiens
aattagtagcttacca

SEQ ID NO: 22056 - DNA, 16 bp, H. sapiens
aattagtaggagaaaa

SEQ ID NO: 22057 - DNA, 16 bp, H. sapiens
aattagtcaggcatga

SEQ ID NO: 22058 - DNA, 18 bp, H. sapiens
aattagtgaaagtactaa

SEQ ID NO: 22059 - DNA, 16 bp, H. sapiens
aattagtgaaataaag

SEQ ID NO: 22060 - DNA, 16 bp, H. sapiens
aattagtgatgatgag

SEQ ID NO: 22061 - DNA, 16 bp, H. sapiens
aattagtgatgttcag

SEQ ID NO: 22062 - DNA, 16 bp, H. sapiens
aattataaaaagcatt

SEQ ID NO: 22063 - DNA, 16 bp, H. sapiens
aattataaaagcaaca

SEQ ID NO: 22064 - DNA, 16 bp, H. sapiens
aattataagagaaatg

SEQ ID NO: 22065 - DNA, 16 bp, H. sapiens
aattataagatgtttt

SEQ ID NO: 22066 - DNA, 16 bp, H. sapiens
aattataagcaaaatt

SEQ ID NO: 22067 - DNA, 16 bp, H. sapiens
aattataattgttaca

SEQ ID NO: 22068 - DNA, 16 bp, H. sapiens
aattatacactttaaa

SEQ ID NO: 22069 - DNA, 16 bp, H. sapiens
aattatacatatatgt

SEQ ID NO: 22070 - DNA, 16 bp, H. sapiens
aattataccattttat

SEQ ID NO: 22071 - DNA, 16 bp, H. sapiens
aattatacctcaataa

SEQ ID NO: 22072 - DNA, 16 bp, H. sapiens
aattataccttaataa

SEQ ID NO: 22073 - DNA, 16 bp, H. sapiens
aattatactttcagtt

SEQ ID NO: 22074 - DNA, 16 bp, H. sapiens
aattatagaaatggaa

SEQ ID NO: 22075 - DNA, 16 bp, H. sapiens
aattatagaagtatta

SEQ ID NO: 22076 - DNA, 16 bp, H. sapiens
aattatagccattctg

SEQ ID NO: 22077 - DNA, 16 bp, H. sapiens
aattataggtgtgaac

SEQ ID NO: 22078 - DNA, 16 bp, H. sapiens
aattatagttttcttt

SEQ ID NO: 22079 - DNA, 16 bp, H. sapiens
aattatatcaagtact

SEQ ID NO: 22080 - DNA, 16 bp, H. sapiens
aattatatctcaataa

SEQ ID NO: 22081 - DNA, 16 bp, H. sapiens
aattatatctcaattt

SEQ ID NO: 22082 - DNA, 16 bp, H. sapiens
aattatatctcagtaa

SEQ ID NO: 22083 - DNA, 16 bp, H. sapiens
aattatatgcaaatta

SEQ ID NO: 22084 - DNA, 16 bp, H. sapiens
aattatatgcattttt

SEQ ID NO: 22085 - DNA, 16 bp, H. sapiens
aattatatggtatgtg

SEQ ID NO: 22086 - DNA, 16 bp, H. sapiens
aattatattaaaagca

SEQ ID NO: 22087 - DNA, 16 bp, H. sapiens
aattatattcagaaaa

SEQ ID NO: 22088 - DNA, 16 bp, H. sapiens
aattatattcagaatt

SEQ ID NO: 22089 - DNA, 16 bp, H. sapiens
aattatatttcagaat

SEQ ID NO: 22090 - DNA, 16 bp, H. sapiens
aattatatttgaaaag

SEQ ID NO: 22091 - DNA, 16 bp, H. sapiens
aattatattttcagaa

SEQ ID NO: 22092 - DNA, 16 bp, H. sapiens
aattatcaaaactgac

SEQ ID NO: 22093 - DNA, 16 bp, H. sapiens
aattatcaaaatgtga

SEQ ID NO: 22094 - DNA, 16 bp, H. sapiens
aattatcactttggct

SEQ ID NO: 22095 - DNA, 16 bp, H. sapiens
aattatcagaagaaaa

SEQ ID NO: 22096 - DNA, 18 bp, H. sapiens
aattatcagccaagaatt

SEQ ID NO: 22097 - DNA, 16 bp, H. sapiens
aattatcagtcaagaa

SEQ ID NO: 22098 - DNA, 16 bp, H. sapiens
aattatcagttttatt

SEQ ID NO: 22099 - DNA, 16 bp, H. sapiens
aattatccaaactgaa

SEQ ID NO: 22100 - DNA, 16 bp, H. sapiens
aattatccttcaaaaa

SEQ ID NO: 22101 - DNA, 16 bp, H. sapiens
aattatctatctatct

SEQ ID NO: 22102 - DNA, 16 bp, H. sapiens
aattatctcaataaag

SEQ ID NO: 22103 - DNA, 16 bp, H. sapiens
aattatctcagctttt

SEQ ID NO: 22104 - DNA, 16 bp, H. sapiens
aattatctctctctct

SEQ ID NO: 22105 - DNA, 16 bp, H. sapiens
aattatctgacaaaga

SEQ ID NO: 22106 - DNA, 16 bp, H. sapiens
aattatctggctgtgg

SEQ ID NO: 22107 - DNA, 16 bp, H. sapiens
aattatctttaaagaa

SEQ ID NO: 22108 - DNA, 16 bp, H. sapiens
aattatctttcaaaaa

SEQ ID NO: 22109 - DNA, 16 bp, H. sapiens
aattatcttttgaaat

SEQ ID NO: 22110 - DNA, 16 bp, H. sapiens
aattatctttttaatg

SEQ ID NO: 22111 - DNA, 16 bp, H. sapiens
aattatgaaaacagaa

SEQ ID NO: 22112 - DNA, 16 bp, H. sapiens
aattatgaaacatttt

SEQ ID NO: 22113 - DNA, 16 bp, H. sapiens
aattatgaaatgtaat

SEQ ID NO: 22114 - DNA, 16 bp, H. sapiens
aattatgaagaaacaa

SEQ ID NO: 22115 - DNA, 16 bp, H. sapiens
aattatgaatacagct

SEQ ID NO: 22116 - DNA, 16 bp, H. sapiens
aattatgcagtatgta

SEQ ID NO: 22117 - DNA, 16 bp, H. sapiens
aattatgctttaaaaa

SEQ ID NO: 22118 - DNA, 16 bp, H. sapiens
aattatgggagataca

SEQ ID NO: 22119 - DNA, 16 bp, H. sapiens
aattatgtattcatct

SEQ ID NO: 22120 - DNA, 16 bp, H. sapiens
aattatgtatttactt

SEQ ID NO: 22121 - DNA, 16 bp, H. sapiens
aattatgtatttcttt

SEQ ID NO: 22122 - DNA, 16 bp, H. sapiens
aattatgtgaagaaaa

SEQ ID NO: 22123 - DNA, 16 bp, H. sapiens
aattatgtggtccatt

SEQ ID NO: 22124 - DNA, 16 bp, H. sapiens
aattatgttatctgca

SEQ ID NO: 22125 - DNA, 16 bp, H. sapiens
aattatgttctttgca

SEQ ID NO: 22126 - DNA, 16 bp, H. sapiens
aattattaaaacaaag

SEQ ID NO: 22127 - DNA, 17 bp, H. sapiens
aattattcaatgatgtc

SEQ ID NO: 22128 - DNA, 16 bp, H. sapiens
aattattcagaaaaat

SEQ ID NO: 22129 - DNA, 16 bp, H. sapiens
aattattcatagtatt

SEQ ID NO: 22130 - DNA, 16 bp, H. sapiens
aattattcatgattca

SEQ ID NO: 22131 - DNA, 16 bp, H. sapiens
aattattctcttctag

SEQ ID NO: 22132 - DNA, 16 bp, H. sapiens
aattattgagatattt

SEQ ID NO: 22133 - DNA, 16 bp, H. sapiens
aattattgagtctgag

SEQ ID NO: 22134 - DNA, 16 bp, H. sapiens
aattattgagtgctta

SEQ ID NO: 22135 - DNA, 16 bp, H. sapiens
aattattgataatcat

SEQ ID NO: 22136 - DNA, 16 bp, H. sapiens
aattattgccttaatt

SEQ ID NO: 22137 - DNA, 16 bp, H. sapiens
aattattgcttaggaa

SEQ ID NO: 22138 - DNA, 16 bp, H. sapiens
aattattggctgggca

SEQ ID NO: 22139 - DNA, 16 bp, H. sapiens
aattattgtgcttctt

SEQ ID NO: 22140 - DNA, 16 bp, H. sapiens
aattattgtgtgtgtg

SEQ ID NO: 22141 - DNA, 16 bp, H. sapiens
aattattgtgttcttt

SEQ ID NO: 22142 - DNA, 16 bp, H. sapiens
aattatttaaaagtga

SEQ ID NO: 22143 - DNA, 16 bp, H. sapiens
aattatttaacatgtt

SEQ ID NO: 22144 - DNA, 16 bp, H. sapiens
aattatttagcttttt

SEQ ID NO: 22145 - DNA, 16 bp, H. sapiens
aattatttatttcatg

SEQ ID NO: 22146 - DNA, 16 bp, H. sapiens
aattatttatttgctt

SEQ ID NO: 22147 - DNA, 16 bp, H. sapiens
aattatttcaaaggaa

SEQ ID NO: 22148 - DNA, 16 bp, H. sapiens
aattatttcacaattt

SEQ ID NO: 22149 - DNA, 16 bp, H. sapiens
aattatttcactaatt

SEQ ID NO: 22150 - DNA, 16 bp, H. sapiens
aattatttcagctttg

SEQ ID NO: 22151 - DNA, 16 bp, H. sapiens
aattatttcaggaaat

SEQ ID NO: 22152 - DNA, 16 bp, H. sapiens
aattatttccaaagaa

SEQ ID NO: 22153 - DNA, 16 bp, H. sapiens
aattatttcccaaggc

SEQ ID NO: 22154 - DNA, 16 bp, H. sapiens
aattatttccttagga

SEQ ID NO: 22155 - DNA, 16 bp, H. sapiens
aattatttctgaaata

SEQ ID NO: 22156 - DNA, 16 bp, H. sapiens
aattatttctgtaaat

SEQ ID NO: 22157 - DNA, 16 bp, H. sapiens
aattatttcttaaagt

SEQ ID NO: 22158 - DNA, 16 bp, H. sapiens
aattatttcttcaaat

SEQ ID NO: 22159 - DNA, 16 bp, H. sapiens
aattatttcttcctta

SEQ ID NO: 22160 - DNA, 16 bp, H. sapiens
aattatttgaaatgtt

SEQ ID NO: 22161 - DNA, 16 bp, H. sapiens
aattatttgaacatat

SEQ ID NO: 22162 - DNA, 16 bp, H. sapiens
aattatttgaagattt

SEQ ID NO: 22163 - DNA, 16 bp, H. sapiens
aattatttgagaataa

SEQ ID NO: 22164 - DNA, 16 bp, H. sapiens
aattatttgagtaatt

SEQ ID NO: 22165 - DNA, 16 bp, H. sapiens
aattatttgtcaatta

SEQ ID NO: 22166 - DNA, 16 bp, H. sapiens
aattatttgttacata

SEQ ID NO: 22167 - DNA, 16 bp, H. sapiens
aattatttgtttcatt

SEQ ID NO: 22168 - DNA, 16 bp, H. sapiens
aattatttgttttcct

SEQ ID NO: 22169 - DNA, 16 bp, H. sapiens
aattattttaaaagct

SEQ ID NO: 22170 - DNA, 16 bp, H. sapiens
aattattttacagatg

SEQ ID NO: 22171 - DNA, 16 bp, H. sapiens
aattattttcaaatgt

SEQ ID NO: 22172 - DNA, 16 bp, H. sapiens
aattattttcacaaaa

SEQ ID NO: 22173 - DNA, 16 bp, H. sapiens
aattattttcatgcag

SEQ ID NO: 22174 - DNA, 16 bp, H. sapiens
aattattttccaaaat

SEQ ID NO: 22175 - DNA, 16 bp, H. sapiens
aattattttccaaaga

SEQ ID NO: 22176 - DNA, 16 bp, H. sapiens
aattattttccattgt

SEQ ID NO: 22177 - DNA, 16 bp, H. sapiens
aattattttcttcctg

SEQ ID NO: 22178 - DNA, 16 bp, H. sapiens
aattattttgaaatct

SEQ ID NO: 22179 - DNA, 16 bp, H. sapiens
aattattttgctttat

SEQ ID NO: 22180 - DNA, 16 bp, H. sapiens
aattattttggaaaat

SEQ ID NO: 22181 - DNA, 16 bp, H. sapiens
aattattttggtaaaa

SEQ ID NO: 22182 - DNA, 16 bp, H. sapiens
aattattttgtctatt

SEQ ID NO: 22183 - DNA, 16 bp, H. sapiens
aattatttttaacagt

SEQ ID NO: 22184 - DNA, 16 bp, H. sapiens
aattatttttaagaag

SEQ ID NO: 22185 - DNA, 16 bp, H. sapiens
aattatttttcagaaa

SEQ ID NO: 22186 - DNA, 16 bp, H. sapiens
aattatttttcccatt

SEQ ID NO: 22187 - DNA, 16 bp, H. sapiens
aattatttttctgagt

SEQ ID NO: 22188 - DNA, 16 bp, H. sapiens
aattatttttgcctta

SEQ ID NO: 22189 - DNA, 16 bp, H. sapiens
aattcaaaaataggaa

SEQ ID NO: 22190 - DNA, 16 bp, H. sapiens
aattcaaaaatgaaat

SEQ ID NO: 22191 - DNA, 16 bp, H. sapiens
aattcaaaaatggaaa

SEQ ID NO: 22192 - DNA, 16 bp, H. sapiens
aattcaaaagaatgca

SEQ ID NO: 22193 - DNA, 16 bp, H. sapiens
aattcaaaagccagaa

SEQ ID NO: 22194 - DNA, 16 bp, H. sapiens
aattcaaaatcatttt

SEQ ID NO: 22195 - DNA, 16 bp, H. sapiens
aattcaaaatggaaaa

SEQ ID NO: 22196 - DNA, 16 bp, H. sapiens
aattcaaaattgtttt

SEQ ID NO: 22197 - DNA, 16 bp, H. sapiens
aattcaaaatttgaaa

SEQ ID NO: 22198 - DNA, 16 bp, H. sapiens
aattcaaacaattcaa

SEQ ID NO: 22199 - DNA, 16 bp, H. sapiens
aattcaaagaaattca

SEQ ID NO: 22200 - DNA, 16 bp, H. sapiens
aattcaaagagaaaat

SEQ ID NO: 22201 - DNA, 16 bp, H. sapiens
aattcaaaggaataaa

SEQ ID NO: 22202 - DNA, 16 bp, H. sapiens
aattcaaatagaaaat

SEQ ID NO: 22203 - DNA, 16 bp, H. sapiens
aattcaaatgaaaacc

SEQ ID NO: 22204 - DNA, 16 bp, H. sapiens
aattcaaatgttttct

SEQ ID NO: 22205 - DNA, 16 bp, H. sapiens
aattcaacaaacattt

SEQ ID NO: 22206 - DNA, 16 bp, H. sapiens
aattcaacaaaccttc

SEQ ID NO: 22207 - DNA, 16 bp, H. sapiens
aattcaacaaagaaat

SEQ ID NO: 22208 - DNA, 16 bp, H. sapiens
aattcaacaagaagag

SEQ ID NO: 22209 - DNA, 16 bp, H. sapiens
aattcaacaatacatt

SEQ ID NO: 22210 - DNA, 16 bp, H. sapiens
aattcaacaccagcct

SEQ ID NO: 22211 - DNA, 16 bp, H. sapiens
aattcaacaccctttt

SEQ ID NO: 22212 - DNA, 16 bp, H. sapiens
aattcaacagagaaat

SEQ ID NO: 22213 - DNA, 16 bp, H. sapiens
aattcaacaggaagag

SEQ ID NO: 22214 - DNA, 16 bp, H. sapiens
aattcaacattatttt

SEQ ID NO: 22215 - DNA, 16 bp, H. sapiens
aattcaacatttattt

SEQ ID NO: 22216 - DNA, 16 bp, H. sapiens
aattcaacatttttaa

SEQ ID NO: 22217 - DNA, 16 bp, H. sapiens
aattcaacccataaca

SEQ ID NO: 22218 - DNA, 16 bp, H. sapiens
aattcaacccatgaca

SEQ ID NO: 22219 - DNA, 16 bp, H. sapiens
aattcaactttttaaa

SEQ ID NO: 22220 - DNA, 16 bp, H. sapiens
aattcaagaaaacttt

SEQ ID NO: 22221 - DNA, 16 bp, H. sapiens
aattcaagaaaattta

SEQ ID NO: 22222 - DNA, 16 bp, H. sapiens
aattcaagaaacagaa

SEQ ID NO: 22223 - DNA, 16 bp, H. sapiens
aattcaagaagagatt

SEQ ID NO: 22224 - DNA, 16 bp, H. sapiens
aattcaagaatgaaaa

SEQ ID NO: 22225 - DNA, 16 bp, H. sapiens
aattcaagaccatcct

SEQ ID NO: 22226 - DNA, 16 bp, H. sapiens
aattcaagatgagatt

SEQ ID NO: 22227 - DNA, 16 bp, H. sapiens
aattcaagctggatta

SEQ ID NO: 22228 - DNA, 16 bp, H. sapiens
aattcaaggtgatatt

SEQ ID NO: 22229 - DNA, 16 bp, H. sapiens
aattcaaggttgcagt

SEQ ID NO: 22230 - DNA, 17 bp, H. sapiens
aattcaagttgagattt

SEQ ID NO: 22231 - DNA, 16 bp, H. sapiens
aattcaagttttattt

SEQ ID NO: 22232 - DNA, 16 bp, H. sapiens
aattcaagttttgttt

SEQ ID NO: 22233 - DNA, 16 bp, H. sapiens
aattcaataaaaaatg

SEQ ID NO: 22234 - DNA, 16 bp, H. sapiens
aattcaatagaaaaat

SEQ ID NO: 22235 - DNA, 16 bp, H. sapiens
aattcaatccacaaca

SEQ ID NO: 22236 - DNA, 16 bp, H. sapiens
aattcaatgtttgata

SEQ ID NO: 22237 - DNA, 16 bp, H. sapiens
aattcaattcatttca

SEQ ID NO: 22238 - DNA, 16 bp, H. sapiens
aattcaattttcaaaa

SEQ ID NO: 22239 - DNA, 16 bp, H. sapiens
aattcacaaatgcaaa

SEQ ID NO: 22240 - DNA, 16 bp, H. sapiens
aattcacacaccataa

SEQ ID NO: 22241 - DNA, 16 bp, H. sapiens
aattcacacagagcca

SEQ ID NO: 22242 - DNA, 18 bp, H. sapiens
aattcacacataacacta

SEQ ID NO: 22243 - DNA, 16 bp, H. sapiens
aattcacacataataa

SEQ ID NO: 22244 - DNA, 16 bp, H. sapiens
aattcacacatttaaa

SEQ ID NO: 22245 - DNA, 16 bp, H. sapiens
aattcacagaaacaga

SEQ ID NO: 22246 - DNA, 16 bp, H. sapiens
aattcacagaaagaaa

SEQ ID NO: 22247 - DNA, 16 bp, H. sapiens
aattcacagaagcaga

SEQ ID NO: 22248 - DNA, 16 bp, H. sapiens
aattcacatttataaa

SEQ ID NO: 22249 - DNA, 16 bp, H. sapiens
aattcacattttttaa

SEQ ID NO: 22250 - DNA, 17 bp, H. sapiens
aattcaccaaagttgaa

SEQ ID NO: 22251 - DNA, 16 bp, H. sapiens
aattcaccaattttaa

SEQ ID NO: 22252 - DNA, 16 bp, H. sapiens
aattcaccatgatcaa

SEQ ID NO: 22253 - DNA, 16 bp, H. sapiens
aattcacttttaaaaa

SEQ ID NO: 22254 - DNA, 16 bp, H. sapiens
aattcagaaaaaaagt

SEQ ID NO: 22255 - DNA, 16 bp, H. sapiens
aattcagaaaaaaatg

SEQ ID NO: 22256 - DNA, 16 bp, H. sapiens
aattcagaaaaactga

SEQ ID NO: 22257 - DNA, 16 bp, H. sapiens
aattcagaaaataaag

SEQ ID NO: 22258 - DNA, 16 bp, H. sapiens
aattcagaaagtattt

SEQ ID NO: 22259 - DNA, 16 bp, H. sapiens
aattcagaaataaaat

SEQ ID NO: 22260 - DNA, 16 bp, H. sapiens
aattcagaatatggat

SEQ ID NO: 22261 - DNA, 16 bp, H. sapiens
aattcagaatctggat

SEQ ID NO: 22262 - DNA, 16 bp, H. sapiens
aattcagagaaaaaga

SEQ ID NO: 22263 - DNA, 16 bp, H. sapiens
aattcagagatttctt

SEQ ID NO: 22264 - DNA, 16 bp, H. sapiens
aattcagaggaagaag

SEQ ID NO: 22265 - DNA, 16 bp, H. sapiens
aattcagataaaattt

SEQ ID NO: 22266 - DNA, 16 bp, H. sapiens
aattcagatgttgaaa

SEQ ID NO: 22267 - DNA, 16 bp, H. sapiens
aattcagatttaaaaa

SEQ ID NO: 22268 - DNA, 16 bp, H. sapiens
aattcagattttaaaa

SEQ ID NO: 22269 - DNA, 16 bp, H. sapiens
aattcagcaaacattt

SEQ ID NO: 22270 - DNA, 16 bp, H. sapiens
aattcagcaagtattt

SEQ ID NO: 22271 - DNA, 16 bp, H. sapiens
aattcagcagcatatt

SEQ ID NO: 22272 - DNA, 16 bp, H. sapiens
aattcagctgtgaacc

SEQ ID NO: 22273 - DNA, 16 bp, H. sapiens
aattcaggaaatattt

SEQ ID NO: 22274 - DNA, 16 bp, H. sapiens
aattcaggagctggtt

SEQ ID NO: 22275 - DNA, 16 bp, H. sapiens
aattcaggcacaactg

SEQ ID NO: 22276 - DNA, 16 bp, H. sapiens
aattcaggtctcctga

SEQ ID NO: 22277 - DNA, 16 bp, H. sapiens
aattcagtagcatttt

SEQ ID NO: 22278 - DNA, 16 bp, H. sapiens
aattcagtatttcttt

SEQ ID NO: 22279 - DNA, 16 bp, H. sapiens
aattcagtattttctt

SEQ ID NO: 22280 - DNA, 16 bp, H. sapiens
aattcagtatttttaa

SEQ ID NO: 22281 - DNA, 16 bp, H. sapiens
aattcagtccatagca

SEQ ID NO: 22282 - DNA, 16 bp, H. sapiens
aattcagtgaaataat

SEQ ID NO: 22283 - DNA, 16 bp, H. sapiens
aattcagtgacttaaa

SEQ ID NO: 22284 - DNA, 16 bp, H. sapiens
aattcagtggttttta

SEQ ID NO: 22285 - DNA, 16 bp, H. sapiens
aattcagtgtttgcag

SEQ ID NO: 22286 - DNA, 16 bp, H. sapiens
aattcagttatacaac

SEQ ID NO: 22287 - DNA, 16 bp, H. sapiens
aattcagttccttgtg

SEQ ID NO: 22288 - DNA, 16 bp, H. sapiens
aattcataaagcaagt

SEQ ID NO: 22289 - DNA, 16 bp, H. sapiens
aattcatatgaaatct

SEQ ID NO: 22290 - DNA, 16 bp, H. sapiens
aattcatatgctgaag

SEQ ID NO: 22291 - DNA, 16 bp, H. sapiens
aattcatatggaatct

SEQ ID NO: 22292 - DNA, 16 bp, H. sapiens
aattcatatggaattg

SEQ ID NO: 22293 - DNA, 16 bp, H. sapiens
aattcatatgttaaaa

SEQ ID NO: 22294 - DNA, 16 bp, H. sapiens
aattcatcaagctgta

SEQ ID NO: 22295 - DNA, 16 bp, H. sapiens
aattcatcatgaccaa

SEQ ID NO: 22296 - DNA, 16 bp, H. sapiens
aattcatcatgatcaa

SEQ ID NO: 22297 - DNA, 16 bp, H. sapiens
aattcatccatatttt

SEQ ID NO: 22298 - DNA, 16 bp, H. sapiens
aattcatccatttttt

SEQ ID NO: 22299 - DNA, 16 bp, H. sapiens
aattcatctgtgaatc

SEQ ID NO: 22300 - DNA, 16 bp, H. sapiens
aattcatcttgagtta

SEQ ID NO: 22301 - DNA, 16 bp, H. sapiens
aattcatgaatatttt

SEQ ID NO: 22302 - DNA, 16 bp, H. sapiens
aattcatgattaaaaa

SEQ ID NO: 22303 - DNA, 16 bp, H. sapiens
aattcatgttttaaat

SEQ ID NO: 22304 - DNA, 16 bp, H. sapiens
aattcattcaagaaat

SEQ ID NO: 22305 - DNA, 16 bp, H. sapiens
aattcattctctctct

SEQ ID NO: 22306 - DNA, 16 bp, H. sapiens
aattcatttccttgcc

SEQ ID NO: 22307 - DNA, 16 bp, H. sapiens
aattcattttatgagg

SEQ ID NO: 22308 - DNA, 16 bp, H. sapiens
aattcattttgagttt

SEQ ID NO: 22309 - DNA, 16 bp, H. sapiens
aattcatttttcagtt

SEQ ID NO: 22310 - DNA, 16 bp, H. sapiens
aattcattttttaaag

SEQ ID NO: 22311 - DNA, 16 bp, H. sapiens
aattccaaaaggagaa

SEQ ID NO: 22312 - DNA, 16 bp, H. sapiens
aattccaaagccactt

SEQ ID NO: 22313 - DNA, 16 bp, H. sapiens
aattccaaattatttt

SEQ ID NO: 22314 - DNA, 16 bp, H. sapiens
aattccaacactttgt

SEQ ID NO: 22315 - DNA, 16 bp, H. sapiens
aattccaaggggaaaa

SEQ ID NO: 22316 - DNA, 16 bp, H. sapiens
aattccaattatatga

SEQ ID NO: 22317 - DNA, 16 bp, H. sapiens
aattccaattatattt

SEQ ID NO: 22318 - DNA, 21 bp, H. sapiens
aattccaattccttgtaaaca

SEQ ID NO: 22319 - DNA, 16 bp, H. sapiens
aattccacttctaggt

SEQ ID NO: 22320 - DNA, 16 bp, H. sapiens
aattccacttttaaaa

SEQ ID NO: 22321 - DNA, 16 bp, H. sapiens
aattccagaaaaagaa

SEQ ID NO: 22322 - DNA, 16 bp, H. sapiens
aattccagaaataaat

SEQ ID NO: 22323 - DNA, 16 bp, H. sapiens
aattccagagctttgg

SEQ ID NO: 22324 - DNA, 16 bp, H. sapiens
aattccagcaccttgg

SEQ ID NO: 22325 - DNA, 16 bp, H. sapiens
aattccagcattctct

SEQ ID NO: 22326 - DNA, 16 bp, H. sapiens
aattccagcctgggca

SEQ ID NO: 22327 - DNA, 16 bp, H. sapiens
aattccagctctttgg

SEQ ID NO: 22328 - DNA, 16 bp, H. sapiens
aattccagtgttttct

SEQ ID NO: 22329 - DNA, 16 bp, H. sapiens
aattccattcatgaga

SEQ ID NO: 22330 - DNA, 16 bp, H. sapiens
aattccatttataata

SEQ ID NO: 22331 - DNA, 16 bp, H. sapiens
aattccatttctttct

SEQ ID NO: 22332 - DNA, 16 bp, H. sapiens
aattccattttaaaat

SEQ ID NO: 22333 - DNA, 16 bp, H. sapiens
aattccattttctcca

SEQ ID NO: 22334 - DNA, 16 bp, H. sapiens
aattccatttttccat

SEQ ID NO: 22335 - DNA, 16 bp, H. sapiens
aattcccacatgtcat

SEQ ID NO: 22336 - DNA, 17 bp, H. sapiens
aattcccacctacgagt

SEQ ID NO: 22337 - DNA, 16 bp, H. sapiens
aattcccacgtgtcat

SEQ ID NO: 22338 - DNA, 16 bp, H. sapiens
aattcccaggtgttgt

SEQ ID NO: 22339 - DNA, 16 bp, H. sapiens
aattcccctgcttcag

SEQ ID NO: 22340 - DNA, 20 bp, H. sapiens
aattccctatttaataaatg

SEQ ID NO: 22341 - DNA, 16 bp, H. sapiens
aattccctcagtattt

SEQ ID NO: 22342 - DNA, 16 bp, H. sapiens
aattccctcatctgta

SEQ ID NO: 22343 - DNA, 16 bp, H. sapiens
aattcccttgcttgtc

SEQ ID NO: 22344 - DNA, 16 bp, H. sapiens
aattcctaaatatttt

SEQ ID NO: 22345 - DNA, 16 bp, H. sapiens
aattcctatgttgaaa

SEQ ID NO: 22346 - DNA, 16 bp, H. sapiens
aattcctcaaggatgt

SEQ ID NO: 22347 - DNA, 16 bp, H. sapiens
aattcctcctcctggg

SEQ ID NO: 22348 - DNA, 16 bp, H. sapiens
aattcctctgcctcag

SEQ ID NO: 22349 - DNA, 16 bp, H. sapiens
aattcctctttaaatg

SEQ ID NO: 22350 - DNA, 16 bp, H. sapiens
aattcctgaaggatct

SEQ ID NO: 22351 - DNA, 19 bp, H. sapiens
aattcctgacctcaggtga

SEQ ID NO: 22352 - DNA, 20 bp, H. sapiens
aattcctgacctcaggtgat

SEQ ID NO: 22353 - DNA, 16 bp, H. sapiens
aattcctgacctcggg

SEQ ID NO: 22354 - DNA, 16 bp, H. sapiens
aattcctgagcccaag

SEQ ID NO: 22355 - DNA, 16 bp, H. sapiens
aattcctgagctcaag

SEQ ID NO: 22356 - DNA, 19 bp, H. sapiens
aattcctgcagtaaacaac

SEQ ID NO: 22357 - DNA, 16 bp, H. sapiens
aattcctggaagaaaa

SEQ ID NO: 22358 - DNA, 16 bp, H. sapiens
aattcctggacacaaa

SEQ ID NO: 22359 - DNA, 16 bp, H. sapiens
aattcctggactcaag

SEQ ID NO: 22360 - DNA, 16 bp, H. sapiens
aattcctggcctcaag

SEQ ID NO: 22361 - DNA, 16 bp, H. sapiens
aattcctgggctcaag

SEQ ID NO: 22362 - DNA, 16 bp, H. sapiens
aattcctgggctccag

SEQ ID NO: 22363 - DNA, 16 bp, H. sapiens
aattcctgggctcgag

SEQ ID NO: 22364 - DNA, 16 bp, H. sapiens
aattcctggtctcaag

SEQ ID NO: 22365 - DNA, 16 bp, H. sapiens
aattcctgtcaaaatc

SEQ ID NO: 22366 - DNA, 16 bp, H. sapiens
aattccttataataaa

SEQ ID NO: 22367 - DNA, 16 bp, H. sapiens
aattccttatgataaa

SEQ ID NO: 22368 - DNA, 16 bp, H. sapiens
aattccttcttcctca

SEQ ID NO: 22369 - DNA, 16 bp, H. sapiens
aattccttgaaagata

SEQ ID NO: 22370 - DNA, 16 bp, H. sapiens
aattccttgaacctgg

SEQ ID NO: 22371 - DNA, 16 bp, H. sapiens
aattccttttttaaaa

SEQ ID NO: 22372 - DNA, 16 bp, H. sapiens
aattctaaaaaatgca

SEQ ID NO: 22373 - DNA, 16 bp, H. sapiens
aattctaaaaagcaga

SEQ ID NO: 22374 - DNA, 16 bp, H. sapiens
aattctaaaaatggaa

SEQ ID NO: 22375 - DNA, 16 bp, H. sapiens
aattctaaaactgaaa

SEQ ID NO: 22376 - DNA, 16 bp, H. sapiens
aattctaaaagaattt

SEQ ID NO: 22377 - DNA, 16 bp, H. sapiens
aattctaaaatgtata

SEQ ID NO: 22378 - DNA, 16 bp, H. sapiens
aattctaaagaaaaat

SEQ ID NO: 22379 - DNA, 16 bp, H. sapiens
aattctaccacctcag

SEQ ID NO: 22380 - DNA, 19 bp, H. sapiens
aattctaccagagatacaa

SEQ ID NO: 22381 - DNA, 19 bp, H. sapiens
aattctaccagaggtacaa

SEQ ID NO: 22382 - DNA, 16 bp, H. sapiens
aattctaccagatgta

SEQ ID NO: 22383 - DNA, 16 bp, H. sapiens
aattctactaaatatt

SEQ ID NO: 22384 - DNA, 16 bp, H. sapiens
aattctactactgggt

SEQ ID NO: 22385 - DNA, 16 bp, H. sapiens
aattctagaaaaggca

SEQ ID NO: 22386 - DNA, 16 bp, H. sapiens
aattctagaaataaat

SEQ ID NO: 22387 - DNA, 16 bp, H. sapiens
aattctagaaatattt

SEQ ID NO: 22388 - DNA, 16 bp, H. sapiens
aattctagtctctgat

SEQ ID NO: 22389 - DNA, 16 bp, H. sapiens
aattctagttttaaaa

SEQ ID NO: 22390 - DNA, 16 bp, H. sapiens
aattctatcatttctt

SEQ ID NO: 22391 - DNA, 16 bp, H. sapiens
aattctatgaaaaatg

SEQ ID NO: 22392 - DNA, 16 bp, H. sapiens
aattctatgaagaaaa

SEQ ID NO: 22393 - DNA, 16 bp, H. sapiens
aattctatttcattga

SEQ ID NO: 22394 - DNA, 16 bp, H. sapiens
aattctcaaaagaaaa

SEQ ID NO: 22395 - DNA, 16 bp, H. sapiens
aattctcaacaaaatg

SEQ ID NO: 22396 - DNA, 32 bp, H. sapiens
aattctcaaggacaagccatagtggaaagaat

SEQ ID NO: 22397 - DNA, 16 bp, H. sapiens
aattctcacaatattt

SEQ ID NO: 22398 - DNA, 16 bp, H. sapiens
aattctcagaaaacta

SEQ ID NO: 22399 - DNA, 16 bp, H. sapiens
aattctcaggccccat

SEQ ID NO: 22400 - DNA, 16 bp, H. sapiens
aattctcatcaaaata

SEQ ID NO: 22401 - DNA, 16 bp, H. sapiens
aattctccatggttct

SEQ ID NO: 22402 - DNA, 16 bp, H. sapiens
aattctccatttattt

SEQ ID NO: 22403 - DNA, 19 bp, H. sapiens
aattctcccgcctcagcct

SEQ ID NO: 22404 - DNA, 16 bp, H. sapiens
aattctcctccctcag

SEQ ID NO: 22405 - DNA, 16 bp, H. sapiens
aattctcctggatctt

SEQ ID NO: 22406 - DNA, 16 bp, H. sapiens
aattctcctgtgtttc

SEQ ID NO: 22407 - DNA, 16 bp, H. sapiens
aattctcctgtttcag

SEQ ID NO: 22408 - DNA, 16 bp, H. sapiens
aattctctcaacattt

SEQ ID NO: 22409 - DNA, 16 bp, H. sapiens
aattctctcaattttt

SEQ ID NO: 22410 - DNA, 16 bp, H. sapiens
aattctctcctcttca

SEQ ID NO: 22411 - DNA, 16 bp, H. sapiens
aattctctctggagga

SEQ ID NO: 22412 - DNA, 16 bp, H. sapiens
aattctgaaaaattct

SEQ ID NO: 22413 - DNA, 16 bp, H. sapiens
aattctgaaaataatt

SEQ ID NO: 22414 - DNA, 16 bp, H. sapiens
aattctgaaacaaaaa

SEQ ID NO: 22415 - DNA, 16 bp, H. sapiens
aattctgaaagaaaaa

SEQ ID NO: 22416 - DNA, 16 bp, H. sapiens
aattctgaaagaaaat

SEQ ID NO: 22417 - DNA, 16 bp, H. sapiens
aattctgaataatttt

SEQ ID NO: 22418 - DNA, 16 bp, H. sapiens
aattctgaatataatt

SEQ ID NO: 22419 - DNA, 16 bp, H. sapiens
aattctgaatttcttc

SEQ ID NO: 22420 - DNA, 16 bp, H. sapiens
aattctgacactacct

SEQ ID NO: 22421 - DNA, 16 bp, H. sapiens
aattctgagaaataaa

SEQ ID NO: 22422 - DNA, 16 bp, H. sapiens
aattctgagaagaaaa

SEQ ID NO: 22423 - DNA, 16 bp, H. sapiens
aattctgaggaaaaaa

SEQ ID NO: 22424 - DNA, 16 bp, H. sapiens
aattctgataaaatat

SEQ ID NO: 22425 - DNA, 16 bp, H. sapiens
aattctgatttctttt

SEQ ID NO: 22426 - DNA, 16 bp, H. sapiens
aattctgcattgaaaa

SEQ ID NO: 22427 - DNA, 16 bp, H. sapiens
aattctgccaaacatt

SEQ ID NO: 22428 - DNA, 16 bp, H. sapiens
aattctgctttaagtt

SEQ ID NO: 22429 - DNA, 16 bp, H. sapiens
aattctggacacatta

SEQ ID NO: 22430 - DNA, 16 bp, H. sapiens
aattctggacacattt

SEQ ID NO: 22431 - DNA, 16 bp, H. sapiens
aattctggagtggaaa

SEQ ID NO: 22432 - DNA, 16 bp, H. sapiens
aattctggctctgcta

SEQ ID NO: 22433 - DNA, 16 bp, H. sapiens
aattctggcttgaaaa

SEQ ID NO: 22434 - DNA, 16 bp, H. sapiens
aattctggggaaaaaa

SEQ ID NO: 22435 - DNA, 16 bp, H. sapiens
aattctgtaaattatt

SEQ ID NO: 22436 - DNA, 16 bp, H. sapiens
aattctgtatttcttt

SEQ ID NO: 22437 - DNA, 16 bp, H. sapiens
aattctgtcatttcaa

SEQ ID NO: 22438 - DNA, 16 bp, H. sapiens
aattctgtgaaaaaaa

SEQ ID NO: 22439 - DNA, 16 bp, H. sapiens
aattctgtgaaaaata

SEQ ID NO: 22440 - DNA, 16 bp, H. sapiens
aattctgtgaaaatga

SEQ ID NO: 22441 - DNA, 16 bp, H. sapiens
aattctgtgaagaaaa

SEQ ID NO: 22442 - DNA, 16 bp, H. sapiens
aattctgtgaaggaag

SEQ ID NO: 22443 - DNA, 16 bp, H. sapiens
aattctgtgacttgaa

SEQ ID NO: 22444 - DNA, 16 bp, H. sapiens
aattctgtgagaaatg

SEQ ID NO: 22445 - DNA, 16 bp, H. sapiens
aattctgtgtttaatt

SEQ ID NO: 22446 - DNA, 16 bp, H. sapiens
aattctgttcattttt

SEQ ID NO: 22447 - DNA, 16 bp, H. sapiens
aattctgtttaatttt

SEQ ID NO: 22448 - DNA, 16 bp, H. sapiens
aattctgtttttgtgg

SEQ ID NO: 22449 - DNA, 16 bp, H. sapiens
aattcttaaaattctt

SEQ ID NO: 22450 - DNA, 16 bp, H. sapiens
aattcttaaaggaaat

SEQ ID NO: 22451 - DNA, 16 bp, H. sapiens
aattcttaacaaaatt

SEQ ID NO: 22452 - DNA, 17 bp, H. sapiens
aattcttacacaaggac

SEQ ID NO: 22453 - DNA, 16 bp, H. sapiens
aattcttacttctctt

SEQ ID NO: 22454 - DNA, 23 bp, H. sapiens
aattcttagtcctttaataccca

SEQ ID NO: 22455 - DNA, 16 bp, H. sapiens
aattcttataactcaa

SEQ ID NO: 22456 - DNA, 16 bp, H. sapiens
aattcttcaaaagaaa

SEQ ID NO: 22457 - DNA, 16 bp, H. sapiens
aattcttcaatcaaaa

SEQ ID NO: 22458 - DNA, 16 bp, H. sapiens
aattcttcagttccaa

SEQ ID NO: 22459 - DNA, 16 bp, H. sapiens
aattcttccacctcag

SEQ ID NO: 22460 - DNA, 16 bp, H. sapiens
aattcttctccctcag

SEQ ID NO: 22461 - DNA, 16 bp, H. sapiens
aattcttctctgcctt

SEQ ID NO: 22462 - DNA, 16 bp, H. sapiens
aattcttgacttttgt

SEQ ID NO: 22463 - DNA, 16 bp, H. sapiens
aattcttggactcaag

SEQ ID NO: 22464 - DNA, 16 bp, H. sapiens
aattcttgggcctcca

SEQ ID NO: 22465 - DNA, 16 bp, H. sapiens
aattcttgtgttttta

SEQ ID NO: 22466 - DNA, 16 bp, H. sapiens
aattctttaaaatatc

SEQ ID NO: 22467 - DNA, 16 bp, H. sapiens
aattctttaaagaaat

SEQ ID NO: 22468 - DNA, 16 bp, H. sapiens
aattctttaagaaatt

SEQ ID NO: 22469 - DNA, 16 bp, H. sapiens
aattctttataaaatg

SEQ ID NO: 22470 - DNA, 16 bp, H. sapiens
aattctttatttctgt

SEQ ID NO: 22471 - DNA, 16 bp, H. sapiens
aattctttcagaattt

SEQ ID NO: 22472 - DNA, 16 bp, H. sapiens
aattctttccccagta

SEQ ID NO: 22473 - DNA, 16 bp, H. sapiens
aattctttctctgccc

SEQ ID NO: 22474 - DNA, 16 bp, H. sapiens
aattctttcttttgct

SEQ ID NO: 22475 - DNA, 16 bp, H. sapiens
aattctttgaaagaaa

SEQ ID NO: 22476 - DNA, 16 bp, H. sapiens
aattctttgaagaatg

SEQ ID NO: 22477 - DNA, 16 bp, H. sapiens
aattctttgagatttt

SEQ ID NO: 22478 - DNA, 16 bp, H. sapiens
aattctttgcattttt

SEQ ID NO: 22479 - DNA, 16 bp, H. sapiens
aattctttgccaagac

SEQ ID NO: 22480 - DNA, 16 bp, H. sapiens
aattctttgccaaggc

SEQ ID NO: 22481 - DNA, 16 bp, H. sapiens
aattctttgccacttt

SEQ ID NO: 22482 - DNA, 16 bp, H. sapiens
aattctttggagaaaa

SEQ ID NO: 22483 - DNA, 16 bp, H. sapiens
aattctttgtcaggca

SEQ ID NO: 22484 - DNA, 16 bp, H. sapiens
aattcttttcaaaata

SEQ ID NO: 22485 - DNA, 24 bp, H. sapiens
aattcttttcctagcaaggaatat

SEQ ID NO: 22486 - DNA, 16 bp, H. sapiens
aattcttttgaaaata

SEQ ID NO: 22487 - DNA, 16 bp, H. sapiens
aattcttttggataca

SEQ ID NO: 22488 - DNA, 16 bp, H. sapiens
aattctttttgaaata

SEQ ID NO: 22489 - DNA, 16 bp, H. sapiens
aattgaaaaattagcc

SEQ ID NO: 22490 - DNA, 16 bp, H. sapiens
aattgaaagcaaaata

SEQ ID NO: 22491 - DNA, 16 bp, H. sapiens
aattgaaagcagaaaa

SEQ ID NO: 22492 - DNA, 16 bp, H. sapiens
aattgaaagtctttcc

SEQ ID NO: 22493 - DNA, 16 bp, H. sapiens
aattgaaatgaaaaca

SEQ ID NO: 22494 - DNA, 16 bp, H. sapiens
aattgaaattatatca

SEQ ID NO: 22495 - DNA, 16 bp, H. sapiens
aattgaactgaattga

SEQ ID NO: 22496 - DNA, 16 bp, H. sapiens
aattgaagaaaacaca

SEQ ID NO: 22497 - DNA, 16 bp, H. sapiens
aattgaagaatatttt

SEQ ID NO: 22498 - DNA, 16 bp, H. sapiens
aattgaagacataaat

SEQ ID NO: 22499 - DNA, 16 bp, H. sapiens
aattgaagaggaggaa

SEQ ID NO: 22500 - DNA, 16 bp, H. sapiens
aattgaaggcagaaat

SEQ ID NO: 22501 - DNA, 16 bp, H. sapiens
aattgaatacccttga

SEQ ID NO: 22502 - DNA, 16 bp, H. sapiens
aattgaatgaaatgga

SEQ ID NO: 22503 - DNA, 16 bp, H. sapiens
aattgaatttgtagtt

SEQ ID NO: 22504 - DNA, 16 bp, H. sapiens
aattgacaaaataatt

SEQ ID NO: 22505 - DNA, 16 bp, H. sapiens
aattgacaaataataa

SEQ ID NO: 22506 - DNA, 16 bp, H. sapiens
aattgacaaattggat

SEQ ID NO: 22507 - DNA, 16 bp, H. sapiens
aattgacaagaaaatt

SEQ ID NO: 22508 - DNA, 16 bp, H. sapiens
aattgacagaagtaga

SEQ ID NO: 22509 - DNA, 16 bp, H. sapiens
aattgaccttgtgaca

SEQ ID NO: 22510 - DNA, 16 bp, H. sapiens
aattgacttttgtgta

SEQ ID NO: 22511 - DNA, 16 bp, H. sapiens
aattgagatagagtct

SEQ ID NO: 22512 - DNA, 16 bp, H. sapiens
aattgagatgtgctgt

SEQ ID NO: 22513 - DNA, 16 bp, H. sapiens
aattgagatgttttca

SEQ ID NO: 22514 - DNA, 16 bp, H. sapiens
aattgaggaaaacttc

SEQ ID NO: 22515 - DNA, 16 bp, H. sapiens
aattgaggtttgggga

SEQ ID NO: 22516 - DNA, 16 bp, H. sapiens
aattgataaacattta

SEQ ID NO: 22517 - DNA, 19 bp, H. sapiens
aattgataaatgggatcta

SEQ ID NO: 22518 - DNA, 16 bp, H. sapiens
aattgatattttttct

SEQ ID NO: 22519 - DNA, 16 bp, H. sapiens
aattgatcaaacagaa

SEQ ID NO: 22520 - DNA, 16 bp, H. sapiens
aattgatccacctgcc

SEQ ID NO: 22521 - DNA, 16 bp, H. sapiens
aattgatttttgacaa

SEQ ID NO: 22522 - DNA, 16 bp, H. sapiens
aattgcaaaaataata

SEQ ID NO: 22523 - DNA, 16 bp, H. sapiens
aattgcaaaaatatgg

SEQ ID NO: 22524 - DNA, 16 bp, H. sapiens
aattgcaaaactatgg

SEQ ID NO: 22525 - DNA, 16 bp, H. sapiens
aattgcaaatcaaaac

SEQ ID NO: 22526 - DNA, 16 bp, H. sapiens
aattgcaataaaaaca

SEQ ID NO: 22527 - DNA, 16 bp, H. sapiens
aattgcaattattatt

SEQ ID NO: 22528 - DNA, 16 bp, H. sapiens
aattgcaatttggggc

SEQ ID NO: 22529 - DNA, 16 bp, H. sapiens
aattgcactgaattta

SEQ ID NO: 22530 - DNA, 16 bp, H. sapiens
aattgcatatatttat

SEQ ID NO: 22531 - DNA, 16 bp, H. sapiens
aattgcatctgcaaag

SEQ ID NO: 22532 - DNA, 16 bp, H. sapiens
aattgcatttatttat

SEQ ID NO: 22533 - DNA, 16 bp, H. sapiens
aattgcattttaaatt

SEQ ID NO: 22534 - DNA, 16 bp, H. sapiens
aattgcatttttaatt

SEQ ID NO: 22535 - DNA, 16 bp, H. sapiens
aattgcatttttttct

SEQ ID NO: 22536 - DNA, 16 bp, H. sapiens
aattgccaaattgttt

SEQ ID NO: 22537 - DNA, 16 bp, H. sapiens
aattgccacaaaagca

SEQ ID NO: 22538 - DNA, 16 bp, H. sapiens
aattgcccaatctcag

SEQ ID NO: 22539 - DNA, 16 bp, H. sapiens
aattgcctgaacttgg

SEQ ID NO: 22540 - DNA, 16 bp, H. sapiens
aattgctaagagtaaa

SEQ ID NO: 22541 - DNA, 16 bp, H. sapiens
aattgctatatcttct

SEQ ID NO: 22542 - DNA, 16 bp, H. sapiens
aattgctattttaaat

SEQ ID NO: 22543 - DNA, 16 bp, H. sapiens
aattgctattttgaat

SEQ ID NO: 22544 - DNA, 16 bp, H. sapiens
aattgctatttttata

SEQ ID NO: 22545 - DNA, 20 bp, H. sapiens
aattgctcactcggggagct

SEQ ID NO: 22546 - DNA, 16 bp, H. sapiens
aattgctcctgtagat

SEQ ID NO: 22547 - DNA, 16 bp, H. sapiens
aattgctcttctctgt

SEQ ID NO: 22548 - DNA, 16 bp, H. sapiens
aattgctgctgctgct

SEQ ID NO: 22549 - DNA, 17 bp, H. sapiens
aattgcttcaaagacaa

SEQ ID NO: 22550 - DNA, 16 bp, H. sapiens
aattgcttgaacctgc

SEQ ID NO: 22551 - DNA, 16 bp, H. sapiens
aattgcttgaagccag

SEQ ID NO: 22552 - DNA, 16 bp, H. sapiens
aattgcttgagcacag

SEQ ID NO: 22553 - DNA, 16 bp, H. sapiens
aattgcttgaggctag

SEQ ID NO: 22554 - DNA, 16 bp, H. sapiens
aattgctttataattt

SEQ ID NO: 22555 - DNA, 17 bp, H. sapiens
aattgctttatggctga

SEQ ID NO: 22556 - DNA, 16 bp, H. sapiens
aattgctttgagcagt

SEQ ID NO: 22557 - DNA, 16 bp, H. sapiens
aattgcttttgtttaa

SEQ ID NO: 22558 - DNA, 16 bp, H. sapiens
aattgctttttaaaat

SEQ ID NO: 22559 - DNA, 16 bp, H. sapiens
aattgcttttttaaaa

SEQ ID NO: 22560 - DNA, 16 bp, H. sapiens
aattggaaaaactggt

SEQ ID NO: 22561 - DNA, 16 bp, H. sapiens
aattggaaaaagctac

SEQ ID NO: 22562 - DNA, 16 bp, H. sapiens
aattggaaaattcaaa

SEQ ID NO: 22563 - DNA, 16 bp, H. sapiens
aattggaaacagaaaa

SEQ ID NO: 22564 - DNA, 16 bp, H. sapiens
aattggaagcttcctg

SEQ ID NO: 22565 - DNA, 16 bp, H. sapiens
aattggaatgtttata

SEQ ID NO: 22566 - DNA, 16 bp, H. sapiens
aattggaatgtttcta

SEQ ID NO: 22567 - DNA, 16 bp, H. sapiens
aattggactttataaa

SEQ ID NO: 22568 - DNA, 16 bp, H. sapiens
aattggagaaaaatat

SEQ ID NO: 22569 - DNA, 16 bp, H. sapiens
aattggagaaacagaa

SEQ ID NO: 22570 - DNA, 16 bp, H. sapiens
aattggagaagtcaca

SEQ ID NO: 22571 - DNA, 16 bp, H. sapiens
aattggaggcctctaa

SEQ ID NO: 22572 - DNA, 16 bp, H. sapiens
aattggatattcatat

SEQ ID NO: 22573 - DNA, 16 bp, H. sapiens
aattggctattgccat

SEQ ID NO: 22574 - DNA, 16 bp, H. sapiens
aattggctcactgcaa

SEQ ID NO: 22575 - DNA, 16 bp, H. sapiens
aattggcttaaagaaa

SEQ ID NO: 22576 - DNA, 16 bp, H. sapiens
aattggtaccaggaga

SEQ ID NO: 22577 - DNA, 16 bp, H. sapiens
aattggtgctcaataa

SEQ ID NO: 22578 - DNA, 16 bp, H. sapiens
aattggtgttcctgag

SEQ ID NO: 22579 - DNA, 16 bp, H. sapiens
aattggttaaaagagt

SEQ ID NO: 22580 - DNA, 16 bp, H. sapiens
aattggttttctttgt

SEQ ID NO: 22581 - DNA, 16 bp, H. sapiens
aattgtaaagaacatc

SEQ ID NO: 22582 - DNA, 16 bp, H. sapiens
aattgtaaaggaaatt

SEQ ID NO: 22583 - DNA, 16 bp, H. sapiens
aattgtacaatatgtg

SEQ ID NO: 22584 - DNA, 16 bp, H. sapiens
aattgtacacttcaaa

SEQ ID NO: 22585 - DNA, 16 bp, H. sapiens
aattgtacactttaaa

SEQ ID NO: 22586 - DNA, 16 bp, H. sapiens
aattgtacagtttaaa

SEQ ID NO: 22587 - DNA, 16 bp, H. sapiens
aattgtacatatttat

SEQ ID NO: 22588 - DNA, 16 bp, H. sapiens
aattgtacatattttg

SEQ ID NO: 22589 - DNA, 16 bp, H. sapiens
aattgtacattgtaaa

SEQ ID NO: 22590 - DNA, 16 bp, H. sapiens
aattgtacctttaaaa

SEQ ID NO: 22591 - DNA, 16 bp, H. sapiens
aattgtagctcactgt

SEQ ID NO: 22592 - DNA, 16 bp, H. sapiens
aattgtaggccaggca

SEQ ID NO: 22593 - DNA, 16 bp, H. sapiens
aattgtagttcccaca

SEQ ID NO: 22594 - DNA, 16 bp, H. sapiens
aattgtataattgtat

SEQ ID NO: 22595 - DNA, 16 bp, H. sapiens
aattgtatatctgata

SEQ ID NO: 22596 - DNA, 16 bp, H. sapiens
aattgtatgtatttaa

SEQ ID NO: 22597 - DNA, 16 bp, H. sapiens
aattgtatgtttaaaa

SEQ ID NO: 22598 - DNA, 16 bp, H. sapiens
aattgtatttccatat

SEQ ID NO: 22599 - DNA, 16 bp, H. sapiens
aattgtcaatcagaaa

SEQ ID NO: 22600 - DNA, 16 bp, H. sapiens
aattgtcatttataca

SEQ ID NO: 22601 - DNA, 16 bp, H. sapiens
aattgtctatttttat

SEQ ID NO: 22602 - DNA, 16 bp, H. sapiens
aattgtctcccattct

SEQ ID NO: 22603 - DNA, 16 bp, H. sapiens
aattgtcttgattttt

SEQ ID NO: 22604 - DNA, 17 bp, H. sapiens
aattgtcttgggccaca

SEQ ID NO: 22605 - DNA, 16 bp, H. sapiens
aattgtctttgtttct

SEQ ID NO: 22606 - DNA, 17 bp, H. sapiens
aattgtctttgtttgca

SEQ ID NO: 22607 - DNA, 16 bp, H. sapiens
aattgtgaatgggagc

SEQ ID NO: 22608 - DNA, 16 bp, H. sapiens
aattgtgatttttttc

SEQ ID NO: 22609 - DNA, 17 bp, H. sapiens
aattgtgctgctataaa

SEQ ID NO: 22610 - DNA, 16 bp, H. sapiens
aattgtgctgggaaaa

SEQ ID NO: 22611 - DNA, 16 bp, H. sapiens
aattgtgctgtaataa

SEQ ID NO: 22612 - DNA, 16 bp, H. sapiens
aattgtgcttctataa

SEQ ID NO: 22613 - DNA, 16 bp, H. sapiens
aattgtgcttttaatt

SEQ ID NO: 22614 - DNA, 16 bp, H. sapiens
aattgtggatttattt

SEQ ID NO: 22615 - DNA, 16 bp, H. sapiens
aattgtggccattctt

SEQ ID NO: 22616 - DNA, 16 bp, H. sapiens
aattgtgggagctaca

SEQ ID NO: 22617 - DNA, 16 bp, H. sapiens
aattgtggtatatata

SEQ ID NO: 22618 - DNA, 16 bp, H. sapiens
aattgtgtttatcttt

SEQ ID NO: 22619 - DNA, 16 bp, H. sapiens
aattgttaaaactttt

SEQ ID NO: 22620 - DNA, 16 bp, H. sapiens
aattgttaaacattta

SEQ ID NO: 22621 - DNA, 16 bp, H. sapiens
aattgttaaattttca

SEQ ID NO: 22622 - DNA, 16 bp, H. sapiens
aattgttaacattttg

SEQ ID NO: 22623 - DNA, 16 bp, H. sapiens
aattgttcactttaaa

SEQ ID NO: 22624 - DNA, 16 bp, H. sapiens
aattgttcattttaaa

SEQ ID NO: 22625 - DNA, 16 bp, H. sapiens
aattgttgcttttgtt

SEQ ID NO: 22626 - DNA, 16 bp, H. sapiens
aattgttggcaaggat

SEQ ID NO: 22627 - DNA, 16 bp, H. sapiens
aattgttgtattttca

SEQ ID NO: 22628 - DNA, 16 bp, H. sapiens
aattgtttaaaaaaca

SEQ ID NO: 22629 - DNA, 16 bp, H. sapiens
aattgtttaaaacaaa

SEQ ID NO: 22630 - DNA, 16 bp, H. sapiens
aattgtttcagctttg

SEQ ID NO: 22631 - DNA, 16 bp, H. sapiens
aattgtttgaaaatta

SEQ ID NO: 22632 - DNA, 16 bp, H. sapiens
aattgttttaagaaaa

SEQ ID NO: 22633 - DNA, 16 bp, H. sapiens
aattgttttccaaaag

SEQ ID NO: 22634 - DNA, 16 bp, H. sapiens
aattgttttcctttta

SEQ ID NO: 22635 - DNA, 16 bp, H. sapiens
aattgttttttctaat

SEQ ID NO: 22636 - DNA, 16 bp, H. sapiens
aatttaaaaaatgcat

SEQ ID NO: 22637 - DNA, 16 bp, H. sapiens
aatttaaaaaatgggc

SEQ ID NO: 22638 - DNA, 16 bp, H. sapiens
aatttaaaaacacagt

SEQ ID NO: 22639 - DNA, 16 bp, H. sapiens
aatttaaaaacatgat

SEQ ID NO: 22640 - DNA, 16 bp, H. sapiens
aatttaaaaactcact

SEQ ID NO: 22641 - DNA, 16 bp, H. sapiens
aatttaaaaagccaaa

SEQ ID NO: 22642 - DNA, 16 bp, H. sapiens
aatttaaaaagcctat

SEQ ID NO: 22643 - DNA, 16 bp, H. sapiens
aatttaaaaaggaagt

SEQ ID NO: 22644 - DNA, 16 bp, H. sapiens
aatttaaaaatacaag

SEQ ID NO: 22645 - DNA, 16 bp, H. sapiens
aatttaaaaatccttt

SEQ ID NO: 22646 - DNA, 16 bp, H. sapiens
aatttaaaaatgggga

SEQ ID NO: 22647 - DNA, 16 bp, H. sapiens
aatttaaaaattacct

SEQ ID NO: 22648 - DNA, 16 bp, H. sapiens
aatttaaaaattggtt

SEQ ID NO: 22649 - DNA, 16 bp, H. sapiens
aatttaaaacaatcct

SEQ ID NO: 22650 - DNA, 16 bp, H. sapiens
aatttaaaacattttg

SEQ ID NO: 22651 - DNA, 16 bp, H. sapiens
aatttaaaacttctat

SEQ ID NO: 22652 - DNA, 16 bp, H. sapiens
aatttaaaacttttgt

SEQ ID NO: 22653 - DNA, 16 bp, H. sapiens
aatttaaaagaaagca

SEQ ID NO: 22654 - DNA, 16 bp, H. sapiens
aatttaaaagacataa

SEQ ID NO: 22655 - DNA, 16 bp, H. sapiens
aatttaaaagttgaat

SEQ ID NO: 22656 - DNA, 16 bp, H. sapiens
aatttaaaatactgtt

SEQ ID NO: 22657 - DNA, 16 bp, H. sapiens
aatttaaaatgataca

SEQ ID NO: 22658 - DNA, 16 bp, H. sapiens
aatttaaaatgcagtt

SEQ ID NO: 22659 - DNA, 16 bp, H. sapiens
aatttaaaatgtgaat

SEQ ID NO: 22660 - DNA, 16 bp, H. sapiens
aatttaaacaaaatgt

SEQ ID NO: 22661 - DNA, 16 bp, H. sapiens
aatttaaacaactcaa

SEQ ID NO: 22662 - DNA, 16 bp, H. sapiens
aatttaaacatgtttt

SEQ ID NO: 22663 - DNA, 16 bp, H. sapiens
aatttaaactgaaaaa

SEQ ID NO: 22664 - DNA, 16 bp, H. sapiens
aatttaaagtactttt

SEQ ID NO: 22665 - DNA, 16 bp, H. sapiens
aatttaaatagccaca

SEQ ID NO: 22666 - DNA, 16 bp, H. sapiens
aatttaaatgtttact

SEQ ID NO: 22667 - DNA, 16 bp, H. sapiens
aatttaacatccattc

SEQ ID NO: 22668 - DNA, 16 bp, H. sapiens
aatttaacatttcctt

SEQ ID NO: 22669 - DNA, 16 bp, H. sapiens
aatttaacattttact

SEQ ID NO: 22670 - DNA, 16 bp, H. sapiens
aatttaagaaaaacat

SEQ ID NO: 22671 - DNA, 16 bp, H. sapiens
aatttaagaaaatgtt

SEQ ID NO: 22672 - DNA, 16 bp, H. sapiens
aatttaagaaacagaa

SEQ ID NO: 22673 - DNA, 16 bp, H. sapiens
aatttaagaagacaga

SEQ ID NO: 22674 - DNA, 16 bp, H. sapiens
aatttaagacttaaaa

SEQ ID NO: 22675 - DNA, 16 bp, H. sapiens
aatttaagacttcaaa

SEQ ID NO: 22676 - DNA, 16 bp, H. sapiens
aatttaataagcattt

SEQ ID NO: 22677 - DNA, 16 bp, H. sapiens
aatttaatcacctctt

SEQ ID NO: 22678 - DNA, 16 bp, H. sapiens
aatttaatgccttttt

SEQ ID NO: 22679 - DNA, 16 bp, H. sapiens
aatttaatgtattagt

SEQ ID NO: 22680 - DNA, 16 bp, H. sapiens
aatttaattcagctga

SEQ ID NO: 22681 - DNA, 16 bp, H. sapiens
aatttaattgcatttt

SEQ ID NO: 22682 - DNA, 16 bp, H. sapiens
aatttaatttcctttc

SEQ ID NO: 22683 - DNA, 16 bp, H. sapiens
aatttaatttggctga

SEQ ID NO: 22684 - DNA, 16 bp, H. sapiens
aatttaattttctcag

SEQ ID NO: 22685 - DNA, 16 bp, H. sapiens
aatttaatttttgtct

SEQ ID NO: 22686 - DNA, 16 bp, H. sapiens
aatttacaaaagaaag

SEQ ID NO: 22687 - DNA, 16 bp, H. sapiens
aatttacaagaaaata

SEQ ID NO: 22688 - DNA, 16 bp, H. sapiens
aatttacaagaacaaa

SEQ ID NO: 22689 - DNA, 16 bp, H. sapiens
aatttacaagtaaaaa

SEQ ID NO: 22690 - DNA, 16 bp, H. sapiens
aatttacaatagcatc

SEQ ID NO: 22691 - DNA, 16 bp, H. sapiens
aatttacaatagccac

SEQ ID NO: 22692 - DNA, 16 bp, H. sapiens
aatttacaatttacaa

SEQ ID NO: 22693 - DNA, 16 bp, H. sapiens
aatttacacatatttt

SEQ ID NO: 22694 - DNA, 16 bp, H. sapiens
aatttacagaaaagtt

SEQ ID NO: 22695 - DNA, 16 bp, H. sapiens
aatttacagaaaataa

SEQ ID NO: 22696 - DNA, 16 bp, H. sapiens
aatttacagagaaaaa

SEQ ID NO: 22697 - DNA, 16 bp, H. sapiens
aatttacagattcagt

SEQ ID NO: 22698 - DNA, 21 bp, H. sapiens
aatttacatcccacaggagga

SEQ ID NO: 22699 - DNA, 16 bp, H. sapiens
aatttacatcttaaaa

SEQ ID NO: 22700 - DNA, 16 bp, H. sapiens
aatttacatttccact

SEQ ID NO: 22701 - DNA, 16 bp, H. sapiens
aatttacatttttgaa

SEQ ID NO: 22702 - DNA, 16 bp, H. sapiens
aatttaccaaaattta

SEQ ID NO: 22703 - DNA, 16 bp, H. sapiens
aatttaccaaagagat

SEQ ID NO: 22704 - DNA, 16 bp, H. sapiens
aatttactgtattagt

SEQ ID NO: 22705 - DNA, 16 bp, H. sapiens
aatttactgtattcat

SEQ ID NO: 22706 - DNA, 16 bp, H. sapiens
aatttacttaaccatt

SEQ ID NO: 22707 - DNA, 16 bp, H. sapiens
aatttactttgtccag

SEQ ID NO: 22708 - DNA, 16 bp, H. sapiens
aatttagaaaatacaa

SEQ ID NO: 22709 - DNA, 16 bp, H. sapiens
aatttagaaacagaaa

SEQ ID NO: 22710 - DNA, 16 bp, H. sapiens
aatttagacaaatgta

SEQ ID NO: 22711 - DNA, 16 bp, H. sapiens
aatttagcaaaagaaa

SEQ ID NO: 22712 - DNA, 16 bp, H. sapiens
aatttagcccataaca

SEQ ID NO: 22713 - DNA, 16 bp, H. sapiens
aatttagggggaaaaa

SEQ ID NO: 22714 - DNA, 16 bp, H. sapiens
aatttaggtttttaaa

SEQ ID NO: 22715 - DNA, 16 bp, H. sapiens
aatttagtatatgata

SEQ ID NO: 22716 - DNA, 16 bp, H. sapiens
aatttataaagacaaa

SEQ ID NO: 22717 - DNA, 16 bp, H. sapiens
aatttataaagaggtt

SEQ ID NO: 22718 - DNA, 16 bp, H. sapiens
aatttataaagcaaag

SEQ ID NO: 22719 - DNA, 16 bp, H. sapiens
aatttataaaggagaa

SEQ ID NO: 22720 - DNA, 16 bp, H. sapiens
aatttatacaaagaaa

SEQ ID NO: 22721 - DNA, 16 bp, H. sapiens
aatttatagacaaaaa

SEQ ID NO: 22722 - DNA, 16 bp, H. sapiens
aatttatagaggaaaa

SEQ ID NO: 22723 - DNA, 17 bp, H. sapiens
aatttatagattcaatg

SEQ ID NO: 22724 - DNA, 21 bp, H. sapiens
aatttatagattcaatgctat

SEQ ID NO: 22725 - DNA, 17 bp, H. sapiens
aatttatagattcagtg

SEQ ID NO: 22726 - DNA, 16 bp, H. sapiens
aatttatagccaagga

SEQ ID NO: 22727 - DNA, 16 bp, H. sapiens
aatttatagctgtaaa

SEQ ID NO: 22728 - DNA, 16 bp, H. sapiens
aatttatatagaaatg

SEQ ID NO: 22729 - DNA, 16 bp, H. sapiens
aatttatatatgtgtg

SEQ ID NO: 22730 - DNA, 16 bp, H. sapiens
aatttatatggaacca

SEQ ID NO: 22731 - DNA, 16 bp, H. sapiens
aatttatatgttaaag

SEQ ID NO: 22732 - DNA, 16 bp, H. sapiens
aatttatattcccttg

SEQ ID NO: 22733 - DNA, 16 bp, H. sapiens
aatttatattcctttg

SEQ ID NO: 22734 - DNA, 16 bp, H. sapiens
aatttatattcttttg

SEQ ID NO: 22735 - DNA, 16 bp, H. sapiens
aatttatcaaacattt

SEQ ID NO: 22736 - DNA, 16 bp, H. sapiens
aatttatcaagaaaag

SEQ ID NO: 22737 - DNA, 16 bp, H. sapiens
aatttatcaagcagaa

SEQ ID NO: 22738 - DNA, 16 bp, H. sapiens
aatttatcaatgtatt

SEQ ID NO: 22739 - DNA, 16 bp, H. sapiens
aatttatcagtgtttt

SEQ ID NO: 22740 - DNA, 16 bp, H. sapiens
aatttatcagtttttt

SEQ ID NO: 22741 - DNA, 16 bp, H. sapiens
aatttatcatccaaac

SEQ ID NO: 22742 - DNA, 16 bp, H. sapiens
aatttatcatctaaat

SEQ ID NO: 22743 - DNA, 16 bp, H. sapiens
aatttatcctaagaaa

SEQ ID NO: 22744 - DNA, 16 bp, H. sapiens
aatttatcctttgtgt

SEQ ID NO: 22745 - DNA, 16 bp, H. sapiens
aatttatctgaaaatt

SEQ ID NO: 22746 - DNA, 16 bp, H. sapiens
aatttatctgtagatt

SEQ ID NO: 22747 - DNA, 16 bp, H. sapiens
aatttatgaaagaaag

SEQ ID NO: 22748 - DNA, 16 bp, H. sapiens
aatttatgaagaaatt

SEQ ID NO: 22749 - DNA, 16 bp, H. sapiens
aatttatgaagcaaaa

SEQ ID NO: 22750 - DNA, 16 bp, H. sapiens
aatttatggaagaaaa

SEQ ID NO: 22751 - DNA, 16 bp, H. sapiens
aatttatggagaaaag

SEQ ID NO: 22752 - DNA, 16 bp, H. sapiens
aatttatgtgaaaatg

SEQ ID NO: 22753 - DNA, 16 bp, H. sapiens
aatttatgttgaaact

SEQ ID NO: 22754 - DNA, 16 bp, H. sapiens
aatttatgtttaactt

SEQ ID NO: 22755 - DNA, 16 bp, H. sapiens
aatttatgttttgaaa

SEQ ID NO: 22756 - DNA, 16 bp, H. sapiens
aatttattaaatgctt

SEQ ID NO: 22757 - DNA, 16 bp, H. sapiens
aatttattaagcaaaa

SEQ ID NO: 22758 - DNA, 16 bp, H. sapiens
aatttattagttttct

SEQ ID NO: 22759 - DNA, 16 bp, H. sapiens
aatttattcaacaaac

SEQ ID NO: 22760 - DNA, 16 bp, H. sapiens
aatttattcatctgtt

SEQ ID NO: 22761 - DNA, 16 bp, H. sapiens
aatttattcctcttat

SEQ ID NO: 22762 - DNA, 16 bp, H. sapiens
aatttattccttaaaa

SEQ ID NO: 22763 - DNA, 16 bp, H. sapiens
aatttattctgaaatt

SEQ ID NO: 22764 - DNA, 16 bp, H. sapiens
aatttattcttcaaaa

SEQ ID NO: 22765 - DNA, 16 bp, H. sapiens
aatttattgagcatct

SEQ ID NO: 22766 - DNA, 16 bp, H. sapiens
aatttattgcatattt

SEQ ID NO: 22767 - DNA, 16 bp, H. sapiens
aatttattgcttttta

SEQ ID NO: 22768 - DNA, 16 bp, H. sapiens
aatttatttagcaaat

SEQ ID NO: 22769 - DNA, 16 bp, H. sapiens
aatttatttcagaaaa

SEQ ID NO: 22770 - DNA, 16 bp, H. sapiens
aatttatttcagaaat

SEQ ID NO: 22771 - DNA, 16 bp, H. sapiens
aatttatttctcacag

SEQ ID NO: 22772 - DNA, 16 bp, H. sapiens
aatttatttgcttttg

SEQ ID NO: 22773 - DNA, 16 bp, H. sapiens
aatttattttcaagtt

SEQ ID NO: 22774 - DNA, 16 bp, H. sapiens
aatttattttcatgtt

SEQ ID NO: 22775 - DNA, 16 bp, H. sapiens
aatttattttcattgt

SEQ ID NO: 22776 - DNA, 16 bp, H. sapiens
aatttattttctgtat

SEQ ID NO: 22777 - DNA, 16 bp, H. sapiens
aatttattttgctttg

SEQ ID NO: 22778 - DNA, 16 bp, H. sapiens
aatttattttggcata

SEQ ID NO: 22779 - DNA, 16 bp, H. sapiens
aatttatttttggaaa

SEQ ID NO: 22780 - DNA, 16 bp, H. sapiens
aatttattttttgcct

SEQ ID NO: 22781 - DNA, 16 bp, H. sapiens
aatttcaaagaaaaat

SEQ ID NO: 22782 - DNA, 16 bp, H. sapiens
aatttcaaagaatttt

SEQ ID NO: 22783 - DNA, 16 bp, H. sapiens
aatttcaaagcttact

SEQ ID NO: 22784 - DNA, 16 bp, H. sapiens
aatttcaaagttaaaa

SEQ ID NO: 22785 - DNA, 16 bp, H. sapiens
aatttcaaatacatat

SEQ ID NO: 22786 - DNA, 16 bp, H. sapiens
aatttcaacatgtgaa

SEQ ID NO: 22787 - DNA, 16 bp, H. sapiens
aatttcaacccagaat

SEQ ID NO: 22788 - DNA, 16 bp, H. sapiens
aatttcaagaaaaaca

SEQ ID NO: 22789 - DNA, 16 bp, H. sapiens
aatttcaagtatttta

SEQ ID NO: 22790 - DNA, 16 bp, H. sapiens
aatttcaatacattta

SEQ ID NO: 22791 - DNA, 16 bp, H. sapiens
aatttcaattaaaatg

SEQ ID NO: 22792 - DNA, 16 bp, H. sapiens
aatttcaatttgaaaa

SEQ ID NO: 22793 - DNA, 16 bp, H. sapiens
aatttcacatttaaaa

SEQ ID NO: 22794 - DNA, 16 bp, H. sapiens
aatttcacattttaaa

SEQ ID NO: 22795 - DNA, 16 bp, H. sapiens
aatttcaccctgacaa

SEQ ID NO: 22796 - DNA, 16 bp, H. sapiens
aatttcaccctggtcc

SEQ ID NO: 22797 - DNA, 16 bp, H. sapiens
aatttcactcttgttg

SEQ ID NO: 22798 - DNA, 16 bp, H. sapiens
aatttcacttgatcat

SEQ ID NO: 22799 - DNA, 16 bp, H. sapiens
aatttcactttaaaat

SEQ ID NO: 22800 - DNA, 16 bp, H. sapiens
aatttcagaaaagaaa

SEQ ID NO: 22801 - DNA, 16 bp, H. sapiens
aatttcagaaacaaaa

SEQ ID NO: 22802 - DNA, 16 bp, H. sapiens
aatttcagaaattaaa

SEQ ID NO: 22803 - DNA, 16 bp, H. sapiens
aatttcagaacatttc

SEQ ID NO: 22804 - DNA, 16 bp, H. sapiens
aatttcagaacatttt

SEQ ID NO: 22805 - DNA, 16 bp, H. sapiens
aatttcagaacttatt

SEQ ID NO: 22806 - DNA, 16 bp, H. sapiens
aatttcagaaggaaaa

SEQ ID NO: 22807 - DNA, 16 bp, H. sapiens
aatttcagaataattt

SEQ ID NO: 22808 - DNA, 16 bp, H. sapiens
aatttcagaatataaa

SEQ ID NO: 22809 - DNA, 16 bp, H. sapiens
aatttcagaatttatt

SEQ ID NO: 22810 - DNA, 16 bp, H. sapiens
aatttcagacaaagca

SEQ ID NO: 22811 - DNA, 16 bp, H. sapiens
aatttcagacttacaa

SEQ ID NO: 22812 - DNA, 16 bp, H. sapiens
aatttcagaggatgta

SEQ ID NO: 22813 - DNA, 16 bp, H. sapiens
aatttcagattttcag

SEQ ID NO: 22814 - DNA, 16 bp, H. sapiens
aatttcagcaattttt

SEQ ID NO: 22815 - DNA, 16 bp, H. sapiens
aatttcagcactctgg

SEQ ID NO: 22816 - DNA, 16 bp, H. sapiens
aatttcaggaaggaaa

SEQ ID NO: 22817 - DNA, 16 bp, H. sapiens
aatttcaggatacaaa

SEQ ID NO: 22818 - DNA, 16 bp, H. sapiens
aatttcaggtaaacaa

SEQ ID NO: 22819 - DNA, 16 bp, H. sapiens
aatttcaggtcttaca

SEQ ID NO: 22820 - DNA, 16 bp, H. sapiens
aatttcagtgttttct

SEQ ID NO: 22821 - DNA, 16 bp, H. sapiens
aatttcagttattatt

SEQ ID NO: 22822 - DNA, 16 bp, H. sapiens
aatttcagttcctttc

SEQ ID NO: 22823 - DNA, 16 bp, H. sapiens
aatttcagttctttga

SEQ ID NO: 22824 - DNA, 16 bp, H. sapiens
aatttcagtttcagaa

SEQ ID NO: 22825 - DNA, 16 bp, H. sapiens
aatttcagtttttaaa

SEQ ID NO: 22826 - DNA, 16 bp, H. sapiens
aatttcataaaaatga

SEQ ID NO: 22827 - DNA, 16 bp, H. sapiens
aatttcataaaacatt

SEQ ID NO: 22828 - DNA, 16 bp, H. sapiens
aatttcataatgaaat

SEQ ID NO: 22829 - DNA, 16 bp, H. sapiens
aatttcatacagaacc

SEQ ID NO: 22830 - DNA, 16 bp, H. sapiens
aatttcatatggttca

SEQ ID NO: 22831 - DNA, 16 bp, H. sapiens
aatttcatatttcaaa

SEQ ID NO: 22832 - DNA, 16 bp, H. sapiens
aatttcatcataaaat

SEQ ID NO: 22833 - DNA, 16 bp, H. sapiens
aatttcatcattgtgc

SEQ ID NO: 22834 - DNA, 16 bp, H. sapiens
aatttcatcattttaa

SEQ ID NO: 22835 - DNA, 16 bp, H. sapiens
aatttcatccatatcc

SEQ ID NO: 22836 - DNA, 16 bp, H. sapiens
aatttcatctttaaaa

SEQ ID NO: 22837 - DNA, 16 bp, H. sapiens
aatttcatcttttaaa

SEQ ID NO: 22838 - DNA, 16 bp, H. sapiens
aatttcatgaagaaaa

SEQ ID NO: 22839 - DNA, 16 bp, H. sapiens
aatttcatgtcatttt

SEQ ID NO: 22840 - DNA, 16 bp, H. sapiens
aatttcattcatttct

SEQ ID NO: 22841 - DNA, 16 bp, H. sapiens
aatttcattgattttt

SEQ ID NO: 22842 - DNA, 16 bp, H. sapiens
aatttcattgttttct

SEQ ID NO: 22843 - DNA, 16 bp, H. sapiens
aatttcatttatctct

SEQ ID NO: 22844 - DNA, 16 bp, H. sapiens
aatttcatttgtaaaa

SEQ ID NO: 22845 - DNA, 16 bp, H. sapiens
aatttcattttctaaa

SEQ ID NO: 22846 - DNA, 16 bp, H. sapiens
aatttcattttttatg

SEQ ID NO: 22847 - DNA, 16 bp, H. sapiens
aatttcattttttcca

SEQ ID NO: 22848 - DNA, 16 bp, H. sapiens
aatttccaaatatttg

SEQ ID NO: 22849 - DNA, 16 bp, H. sapiens
aatttccaaatgaaaa

SEQ ID NO: 22850 - DNA, 16 bp, H. sapiens
aatttccaagacaaaa

SEQ ID NO: 22851 - DNA, 16 bp, H. sapiens
aatttccagtttttct

SEQ ID NO: 22852 - DNA, 16 bp, H. sapiens
aatttccatatgtttg

SEQ ID NO: 22853 - DNA, 16 bp, H. sapiens
aatttccatgtattta

SEQ ID NO: 22854 - DNA, 16 bp, H. sapiens
aatttccattcttttg

SEQ ID NO: 22855 - DNA, 16 bp, H. sapiens
aatttccattttataa

SEQ ID NO: 22856 - DNA, 16 bp, H. sapiens
aatttcccaaatattt

SEQ ID NO: 22857 - DNA, 16 bp, H. sapiens
aatttcccaagttttt

SEQ ID NO: 22858 - DNA, 16 bp, H. sapiens
aatttccccagcacca

SEQ ID NO: 22859 - DNA, 16 bp, H. sapiens
aatttccctctactca

SEQ ID NO: 22860 - DNA, 16 bp, H. sapiens
aatttccctctagaca

SEQ ID NO: 22861 - DNA, 16 bp, H. sapiens
aatttccctcttaaca

SEQ ID NO: 22862 - DNA, 16 bp, H. sapiens
aatttccctttaaaaa

SEQ ID NO: 22863 - DNA, 16 bp, H. sapiens
aatttccctttaattt

SEQ ID NO: 22864 - DNA, 16 bp, H. sapiens
aatttcccttttttaa

SEQ ID NO: 22865 - DNA, 16 bp, H. sapiens
aatttcctaattttga

SEQ ID NO: 22866 - DNA, 16 bp, H. sapiens
aatttcctcaactgta

SEQ ID NO: 22867 - DNA, 16 bp, H. sapiens
aatttcctcatctcca

SEQ ID NO: 22868 - DNA, 16 bp, H. sapiens
aatttcctcatctttt

SEQ ID NO: 22869 - DNA, 16 bp, H. sapiens
aatttcctgaaacaaa

SEQ ID NO: 22870 - DNA, 16 bp, H. sapiens
aatttcctggttttga

SEQ ID NO: 22871 - DNA, 16 bp, H. sapiens
aatttccttaaaaata

SEQ ID NO: 22872 - DNA, 16 bp, H. sapiens
aatttccttaaaattt

SEQ ID NO: 22873 - DNA, 16 bp, H. sapiens
aatttccttcatcagt

SEQ ID NO: 22874 - DNA, 16 bp, H. sapiens
aatttccttccatttt

SEQ ID NO: 22875 - DNA, 16 bp, H. sapiens
aatttcctttagttct

SEQ ID NO: 22876 - DNA, 16 bp, H. sapiens
aatttccttttctgtt

SEQ ID NO: 22877 - DNA, 16 bp, H. sapiens
aatttccttttggaaa

SEQ ID NO: 22878 - DNA, 16 bp, H. sapiens
aatttctaaaaagaaa

SEQ ID NO: 22879 - DNA, 16 bp, H. sapiens
aatttctaaatatttg

SEQ ID NO: 22880 - DNA, 16 bp, H. sapiens
aatttctaagaaaata

SEQ ID NO: 22881 - DNA, 16 bp, H. sapiens
aatttctaagataaaa

SEQ ID NO: 22882 - DNA, 16 bp, H. sapiens
aatttctaatatgata

SEQ ID NO: 22883 - DNA, 16 bp, H. sapiens
aatttctacaaagaaa

SEQ ID NO: 22884 - DNA, 16 bp, H. sapiens
aatttctagaaaacaa

SEQ ID NO: 22885 - DNA, 16 bp, H. sapiens
aatttctagaaacaaa

SEQ ID NO: 22886 - DNA, 16 bp, H. sapiens
aatttctatgtgtttg

SEQ ID NO: 22887 - DNA, 16 bp, H. sapiens
aatttctcaaaagaag

SEQ ID NO: 22888 - DNA, 16 bp, H. sapiens
aatttctcaaagatct

SEQ ID NO: 22889 - DNA, 16 bp, H. sapiens
aatttctcaacaaaat

SEQ ID NO: 22890 - DNA, 16 bp, H. sapiens
aatttctcagtctttt

SEQ ID NO: 22891 - DNA, 16 bp, H. sapiens
aatttctcattaatat

SEQ ID NO: 22892 - DNA, 16 bp, H. sapiens
aatttctcatttaaaa

SEQ ID NO: 22893 - DNA, 16 bp, H. sapiens
aatttctccacagaaa

SEQ ID NO: 22894 - DNA, 16 bp, H. sapiens
aatttctccatattct

SEQ ID NO: 22895 - DNA, 16 bp, H. sapiens
aatttctcccatttgc

SEQ ID NO: 22896 - DNA, 16 bp, H. sapiens
aatttctccttgtttt

SEQ ID NO: 22897 - DNA, 16 bp, H. sapiens
aatttctccttttaaa

SEQ ID NO: 22898 - DNA, 16 bp, H. sapiens
aatttctctctctctc

SEQ ID NO: 22899 - DNA, 16 bp, H. sapiens
aatttctctcttctgt

SEQ ID NO: 22900 - DNA, 16 bp, H. sapiens
aatttctctcttcttg

SEQ ID NO: 22901 - DNA, 16 bp, H. sapiens
aatttctctgagtttc

SEQ ID NO: 22902 - DNA, 16 bp, H. sapiens
aatttctcttctttaa

SEQ ID NO: 22903 - DNA, 16 bp, H. sapiens
aatttctctttgtctt

SEQ ID NO: 22904 - DNA, 16 bp, H. sapiens
aatttctgaaaataaa

SEQ ID NO: 22905 - DNA, 16 bp, H. sapiens
aatttctgaaatattt

SEQ ID NO: 22906 - DNA, 16 bp, H. sapiens
aatttctgaaattaaa

SEQ ID NO: 22907 - DNA, 16 bp, H. sapiens
aatttctgacctcaag

SEQ ID NO: 22908 - DNA, 16 bp, H. sapiens
aatttctgcagcaagc

SEQ ID NO: 22909 - DNA, 16 bp, H. sapiens
aatttctgcagctagc

SEQ ID NO: 22910 - DNA, 16 bp, H. sapiens
aatttctggaaaactg

SEQ ID NO: 22911 - DNA, 16 bp, H. sapiens
aatttctggaaacaaa

SEQ ID NO: 22912 - DNA, 16 bp, H. sapiens
aatttctgtggtttat

SEQ ID NO: 22913 - DNA, 16 bp, H. sapiens
aatttctgttcatttt

SEQ ID NO: 22914 - DNA, 16 bp, H. sapiens
aatttctgtttctgag

SEQ ID NO: 22915 - DNA, 16 bp, H. sapiens
aatttctgttttatat

SEQ ID NO: 22916 - DNA, 16 bp, H. sapiens
aatttctgttttcaaa

SEQ ID NO: 22917 - DNA, 16 bp, H. sapiens
aatttcttaaaaaggt

SEQ ID NO: 22918 - DNA, 16 bp, H. sapiens
aatttcttaaaaatgt

SEQ ID NO: 22919 - DNA, 16 bp, H. sapiens
aatttcttaagacaac

SEQ ID NO: 22920 - DNA, 16 bp, H. sapiens
aatttcttaagttttt

SEQ ID NO: 22921 - DNA, 16 bp, H. sapiens
aatttcttcaaaaaat

SEQ ID NO: 22922 - DNA, 16 bp, H. sapiens
aatttcttcagttttt

SEQ ID NO: 22923 - DNA, 16 bp, H. sapiens
aatttcttcatctgaa

SEQ ID NO: 22924 - DNA, 16 bp, H. sapiens
aatttcttcattgacc

SEQ ID NO: 22925 - DNA, 16 bp, H. sapiens
aatttcttgagcctgg

SEQ ID NO: 22926 - DNA, 16 bp, H. sapiens
aatttcttgaggaacc

SEQ ID NO: 22927 - DNA, 16 bp, H. sapiens
aatttcttgcattttt

SEQ ID NO: 22928 - DNA, 16 bp, H. sapiens
aatttcttgcttttaa

SEQ ID NO: 22929 - DNA, 16 bp, H. sapiens
aatttctttaatgtct

SEQ ID NO: 22930 - DNA, 16 bp, H. sapiens
aatttctttacaaaat

SEQ ID NO: 22931 - DNA, 16 bp, H. sapiens
aatttctttcatcaat

SEQ ID NO: 22932 - DNA, 16 bp, H. sapiens
aatttctttcattagt

SEQ ID NO: 22933 - DNA, 16 bp, H. sapiens
aatttctttctagctc

SEQ ID NO: 22934 - DNA, 16 bp, H. sapiens
aatttctttgaaaatt

SEQ ID NO: 22935 - DNA, 16 bp, H. sapiens
aatttcttttacaaaa

SEQ ID NO: 22936 - DNA, 16 bp, H. sapiens
aatttcttttcataaa

SEQ ID NO: 22937 - DNA, 16 bp, H. sapiens
aatttcttttgaaaaa

SEQ ID NO: 22938 - DNA, 16 bp, H. sapiens
aatttgaaaaaaatct

SEQ ID NO: 22939 - DNA, 16 bp, H. sapiens
aatttgaaaaacatat

SEQ ID NO: 22940 - DNA, 16 bp, H. sapiens
aatttgaaaacaataa

SEQ ID NO: 22941 - DNA, 16 bp, H. sapiens
aatttgaaaaccttgt

SEQ ID NO: 22942 - DNA, 16 bp, H. sapiens
aatttgaaaagcaaaa

SEQ ID NO: 22943 - DNA, 16 bp, H. sapiens
aatttgaaaaggaaat

SEQ ID NO: 22944 - DNA, 16 bp, H. sapiens
aatttgaaaatataca

SEQ ID NO: 22945 - DNA, 16 bp, H. sapiens
aatttgaaaattatgt

SEQ ID NO: 22946 - DNA, 16 bp, H. sapiens
aatttgaaacattttt

SEQ ID NO: 22947 - DNA, 16 bp, H. sapiens
aatttgaaagcagcaa

SEQ ID NO: 22948 - DNA, 16 bp, H. sapiens
aatttgaaagtgaaaa

SEQ ID NO: 22949 - DNA, 16 bp, H. sapiens
aatttgaaatccaaaa

SEQ ID NO: 22950 - DNA, 16 bp, H. sapiens
aatttgaaatctgaaa

SEQ ID NO: 22951 - DNA, 16 bp, H. sapiens
aatttgaaatgtgaaa

SEQ ID NO: 22952 - DNA, 16 bp, H. sapiens
aatttgaaattgaaat

SEQ ID NO: 22953 - DNA, 16 bp, H. sapiens
aatttgaaattttcta

SEQ ID NO: 22954 - DNA, 16 bp, H. sapiens
aatttgaacaacaaaa

SEQ ID NO: 22955 - DNA, 16 bp, H. sapiens
aatttgaacatcaaaa

SEQ ID NO: 22956 - DNA, 16 bp, H. sapiens
aatttgaagacagaaa

SEQ ID NO: 22957 - DNA, 16 bp, H. sapiens
aatttgaatttcacat

SEQ ID NO: 22958 - DNA, 16 bp, H. sapiens
aatttgaatttcccca

SEQ ID NO: 22959 - DNA, 16 bp, H. sapiens
aatttgaattttatct

SEQ ID NO: 22960 - DNA, 16 bp, H. sapiens
aatttgacaaatattt

SEQ ID NO: 22961 - DNA, 16 bp, H. sapiens
aatttgacaaatggga

SEQ ID NO: 22962 - DNA, 17 bp, H. sapiens
aatttgacatgagattt

SEQ ID NO: 22963 - DNA, 16 bp, H. sapiens
aatttgacattatttt

SEQ ID NO: 22964 - DNA, 16 bp, H. sapiens
aatttgactttggaaa

SEQ ID NO: 22965 - DNA, 16 bp, H. sapiens
aatttgacttttattt

SEQ ID NO: 22966 - DNA, 16 bp, H. sapiens
aatttgagaaacactg

SEQ ID NO: 22967 - DNA, 16 bp, H. sapiens
aatttgagaaacattg

SEQ ID NO: 22968 - DNA, 16 bp, H. sapiens
aatttgagaaatattt

SEQ ID NO: 22969 - DNA, 16 bp, H. sapiens
aatttgagaagaaatg

SEQ ID NO: 22970 - DNA, 16 bp, H. sapiens
aatttgagactagcct

SEQ ID NO: 22971 - DNA, 16 bp, H. sapiens
aatttgataaatgaat

SEQ ID NO: 22972 - DNA, 16 bp, H. sapiens
aatttgataacctaga

SEQ ID NO: 22973 - DNA, 16 bp, H. sapiens
aatttgatgaaaacta

SEQ ID NO: 22974 - DNA, 16 bp, H. sapiens
aatttgatgctgtcat

SEQ ID NO: 22975 - DNA, 16 bp, H. sapiens
aatttgcaaaacaaaa

SEQ ID NO: 22976 - DNA, 16 bp, H. sapiens
aatttgcaaaatgttt

SEQ ID NO: 22977 - DNA, 16 bp, H. sapiens
aatttgcaaatgtttt

SEQ ID NO: 22978 - DNA, 16 bp, H. sapiens
aatttgcaacctctgg

SEQ ID NO: 22979 - DNA, 16 bp, H. sapiens
aatttgcaagtggaga

SEQ ID NO: 22980 - DNA, 16 bp, H. sapiens
aatttgcaatttaaaa

SEQ ID NO: 22981 - DNA, 16 bp, H. sapiens
aatttgcaggataatt

SEQ ID NO: 22982 - DNA, 16 bp, H. sapiens
aatttgcatgtaattg

SEQ ID NO: 22983 - DNA, 16 bp, H. sapiens
aatttgcatttaaaat

SEQ ID NO: 22984 - DNA, 16 bp, H. sapiens
aatttgcatttaaatt

SEQ ID NO: 22985 - DNA, 16 bp, H. sapiens
aatttgcatttatata

SEQ ID NO: 22986 - DNA, 16 bp, H. sapiens
aatttgcattttattt

SEQ ID NO: 22987 - DNA, 16 bp, H. sapiens
aatttgcattttctga

SEQ ID NO: 22988 - DNA, 16 bp, H. sapiens
aatttgcatttttatt

SEQ ID NO: 22989 - DNA, 16 bp, H. sapiens
aatttgccaatatttt

SEQ ID NO: 22990 - DNA, 16 bp, H. sapiens
aatttgccacaaatat

SEQ ID NO: 22991 - DNA, 16 bp, H. sapiens
aatttgcccaaggcca

SEQ ID NO: 22992 - DNA, 16 bp, H. sapiens
aatttgcccaaggtaa

SEQ ID NO: 22993 - DNA, 16 bp, H. sapiens
aatttgccccaaatca

SEQ ID NO: 22994 - DNA, 16 bp, H. sapiens
aatttgctcaaagaaa

SEQ ID NO: 22995 - DNA, 16 bp, H. sapiens
aatttgctgaggatga

SEQ ID NO: 22996 - DNA, 16 bp, H. sapiens
aatttgctttaaaata

SEQ ID NO: 22997 - DNA, 16 bp, H. sapiens
aatttgctttctgttt

SEQ ID NO: 22998 - DNA, 16 bp, H. sapiens
aatttgcttttactgt

SEQ ID NO: 22999 - DNA, 16 bp, H. sapiens
aatttgctttttaaat

SEQ ID NO: 23000 - DNA, 16 bp, H. sapiens
aatttggaaaactaag

SEQ ID NO: 23001 - DNA, 16 bp, H. sapiens
aatttggaaaactttt

SEQ ID NO: 23002 - DNA, 16 bp, H. sapiens
aatttggaaaagaaat

SEQ ID NO: 23003 - DNA, 16 bp, H. sapiens
aatttggaaaatttgg

SEQ ID NO: 23004 - DNA, 16 bp, H. sapiens
aatttggaaacatttt

SEQ ID NO: 23005 - DNA, 16 bp, H. sapiens
aatttggaaaggagag

SEQ ID NO: 23006 - DNA, 16 bp, H. sapiens
aatttggaaattattt

SEQ ID NO: 23007 - DNA, 16 bp, H. sapiens
aatttggaactttcct

SEQ ID NO: 23008 - DNA, 16 bp, H. sapiens
aatttggaagagtcag

SEQ ID NO: 23009 - DNA, 16 bp, H. sapiens
aatttggaaggaaaaa

SEQ ID NO: 23010 - DNA, 16 bp, H. sapiens
aatttggagaagaaaa

SEQ ID NO: 23011 - DNA, 16 bp, H. sapiens
aatttggagagaactg

SEQ ID NO: 23012 - DNA, 16 bp, H. sapiens
aatttggatacccttt

SEQ ID NO: 23013 - DNA, 16 bp, H. sapiens
aatttggatgaatctc

SEQ ID NO: 23014 - DNA, 16 bp, H. sapiens
aatttggattataaaa

SEQ ID NO: 23015 - DNA, 16 bp, H. sapiens
aatttgggaaagaaaa

SEQ ID NO: 23016 - DNA, 16 bp, H. sapiens
aatttgggagctccag

SEQ ID NO: 23017 - DNA, 18 bp, H. sapiens
aatttgggaggccaaggc

SEQ ID NO: 23018 - DNA, 16 bp, H. sapiens
aatttgggaggctgag

SEQ ID NO: 23019 - DNA, 16 bp, H. sapiens
aatttggggagaattg

SEQ ID NO: 23020 - DNA, 16 bp, H. sapiens
aatttgggggattttt

SEQ ID NO: 23021 - DNA, 16 bp, H. sapiens
aatttggtatcttatt

SEQ ID NO: 23022 - DNA, 16 bp, H. sapiens
aatttggtggcattaa

SEQ ID NO: 23023 - DNA, 16 bp, H. sapiens
aatttggttgagatct

SEQ ID NO: 23024 - DNA, 16 bp, H. sapiens
aatttgtaaaaaacaa

SEQ ID NO: 23025 - DNA, 16 bp, H. sapiens
aatttgtaaactttgt

SEQ ID NO: 23026 - DNA, 16 bp, H. sapiens
aatttgtaggaaaaaa

SEQ ID NO: 23027 - DNA, 16 bp, H. sapiens
aatttgtatggaacta

SEQ ID NO: 23028 - DNA, 16 bp, H. sapiens
aatttgtattcatttt

SEQ ID NO: 23029 - DNA, 16 bp, H. sapiens
aatttgtattcctttg

SEQ ID NO: 23030 - DNA, 16 bp, H. sapiens
aatttgtcaatttcat

SEQ ID NO: 23031 - DNA, 16 bp, H. sapiens
aatttgtcacagcagc

SEQ ID NO: 23032 - DNA, 16 bp, H. sapiens
aatttgtcagtttttt

SEQ ID NO: 23033 - DNA, 16 bp, H. sapiens
aatttgtcattctttt

SEQ ID NO: 23034 - DNA, 16 bp, H. sapiens
aatttgtcatttaatt

SEQ ID NO: 23035 - DNA, 16 bp, H. sapiens
aatttgtccaaaccca

SEQ ID NO: 23036 - DNA, 16 bp, H. sapiens
aatttgtctaaaattt

SEQ ID NO: 23037 - DNA, 16 bp, H. sapiens
aatttgtctcaaagtg

SEQ ID NO: 23038 - DNA, 16 bp, H. sapiens
aatttgtctgatattt

SEQ ID NO: 23039 - DNA, 16 bp, H. sapiens
aatttgtcttttaata

SEQ ID NO: 23040 - DNA, 16 bp, H. sapiens
aatttgtgagaaaaaa

SEQ ID NO: 23041 - DNA, 21 bp, H. sapiens
aatttgtgcagttaatgcaat

SEQ ID NO: 23042 - DNA, 16 bp, H. sapiens
aatttgtgctctttca

SEQ ID NO: 23043 - DNA, 16 bp, H. sapiens
aatttgtggtgatttg

SEQ ID NO: 23044 - DNA, 16 bp, H. sapiens
aatttgttacagcagc

SEQ ID NO: 23045 - DNA, 16 bp, H. sapiens
aatttgttacatcagc

SEQ ID NO: 23046 - DNA, 16 bp, H. sapiens
aatttgttattcaaaa

SEQ ID NO: 23047 - DNA, 16 bp, H. sapiens
aatttgttattttaca

SEQ ID NO: 23048 - DNA, 16 bp, H. sapiens
aatttgttcaactttt

SEQ ID NO: 23049 - DNA, 16 bp, H. sapiens
aatttgttcattaaaa

SEQ ID NO: 23050 - DNA, 16 bp, H. sapiens
aatttgttgaaaattt

SEQ ID NO: 23051 - DNA, 16 bp, H. sapiens
aatttgttgacatata

SEQ ID NO: 23052 - DNA, 16 bp, H. sapiens
aatttgtttaagaaaa

SEQ ID NO: 23053 - DNA, 16 bp, H. sapiens
aatttgtttacattcc

SEQ ID NO: 23054 - DNA, 16 bp, H. sapiens
aatttgtttaggatta

SEQ ID NO: 23055 - DNA, 16 bp, H. sapiens
aatttgtttccagaaa

SEQ ID NO: 23056 - DNA, 16 bp, H. sapiens
aatttgtttccttaaa

SEQ ID NO: 23057 - DNA, 16 bp, H. sapiens
aatttgtttctctctt

SEQ ID NO: 23058 - DNA, 16 bp, H. sapiens
aatttgtttgtgttca

SEQ ID NO: 23059 - DNA, 16 bp, H. sapiens
aatttgtttgttcttg

SEQ ID NO: 23060 - DNA, 16 bp, H. sapiens
aatttgttttatgcat

SEQ ID NO: 23061 - DNA, 16 bp, H. sapiens
aatttgttttcttaca

SEQ ID NO: 23062 - DNA, 16 bp, H. sapiens
aatttgttttgaaatg

SEQ ID NO: 23063 - DNA, 16 bp, H. sapiens
aatttgtttttctgat

SEQ ID NO: 23064 - DNA, 16 bp, H. sapiens
aatttgtttttcttaa

SEQ ID NO: 23065 - DNA, 16 bp, H. sapiens
aatttgtttttgcaat

SEQ ID NO: 23066 - DNA, 16 bp, H. sapiens
aattttaaaaactgat

SEQ ID NO: 23067 - DNA, 16 bp, H. sapiens
aattttaaaaagctac

SEQ ID NO: 23068 - DNA, 16 bp, H. sapiens
aattttaaaaagctat

SEQ ID NO: 23069 - DNA, 16 bp, H. sapiens
aattttaaaaatagct

SEQ ID NO: 23070 - DNA, 16 bp, H. sapiens
aattttaaaaatcagt

SEQ ID NO: 23071 - DNA, 16 bp, H. sapiens
aattttaaaaatgcca

SEQ ID NO: 23072 - DNA, 16 bp, H. sapiens
aattttaaaaatgtag

SEQ ID NO: 23073 - DNA, 16 bp, H. sapiens
aattttaaaactgtat

SEQ ID NO: 23074 - DNA, 16 bp, H. sapiens
aattttaaaacttttg

SEQ ID NO: 23075 - DNA, 16 bp, H. sapiens
aattttaaaagaagtt

SEQ ID NO: 23076 - DNA, 16 bp, H. sapiens
aattttaaaagcagca

SEQ ID NO: 23077 - DNA, 16 bp, H. sapiens
aattttaaaaggcaaa

SEQ ID NO: 23078 - DNA, 16 bp, H. sapiens
aattttaaaagtagct

SEQ ID NO: 23079 - DNA, 16 bp, H. sapiens
aattttaaaagtcaaa

SEQ ID NO: 23080 - DNA, 16 bp, H. sapiens
aattttaaaatatcca

SEQ ID NO: 23081 - DNA, 16 bp, H. sapiens
aattttaaaatgcaat

SEQ ID NO: 23082 - DNA, 16 bp, H. sapiens
aattttaaaatgtctt

SEQ ID NO: 23083 - DNA, 16 bp, H. sapiens
aattttaaaatgttga

SEQ ID NO: 23084 - DNA, 16 bp, H. sapiens
aattttaaacaaaagt

SEQ ID NO: 23085 - DNA, 16 bp, H. sapiens
aattttaaagaaacaa

SEQ ID NO: 23086 - DNA, 16 bp, H. sapiens
aattttaaagaggaaa

SEQ ID NO: 23087 - DNA, 16 bp, H. sapiens
aattttaaaggaagaa

SEQ ID NO: 23088 - DNA, 16 bp, H. sapiens
aattttaaaggaattt

SEQ ID NO: 23089 - DNA, 16 bp, H. sapiens
aattttaaataagatg

SEQ ID NO: 23090 - DNA, 16 bp, H. sapiens
aattttaaatgtgatt

SEQ ID NO: 23091 - DNA, 16 bp, H. sapiens
aattttaacaaaagaa

SEQ ID NO: 23092 - DNA, 16 bp, H. sapiens
aattttaacaaatgca

SEQ ID NO: 23093 - DNA, 16 bp, H. sapiens
aattttaacaaatgta

SEQ ID NO: 23094 - DNA, 16 bp, H. sapiens
aattttaacaagtttt

SEQ ID NO: 23095 - DNA, 16 bp, H. sapiens
aattttaacacaatgg

SEQ ID NO: 23096 - DNA, 16 bp, H. sapiens
aattttaacatgagtt

SEQ ID NO: 23097 - DNA, 16 bp, H. sapiens
aattttaactgaaaat

SEQ ID NO: 23098 - DNA, 16 bp, H. sapiens
aattttaagaaataca

SEQ ID NO: 23099 - DNA, 16 bp, H. sapiens
aattttaagagttctt

SEQ ID NO: 23100 - DNA, 16 bp, H. sapiens
aattttaagcaaaaag

SEQ ID NO: 23101 - DNA, 16 bp, H. sapiens
aattttaagggaaaaa

SEQ ID NO: 23102 - DNA, 16 bp, H. sapiens
aattttaagtgaaaat

SEQ ID NO: 23103 - DNA, 16 bp, H. sapiens
aattttaagtttcctg

SEQ ID NO: 23104 - DNA, 16 bp, H. sapiens
aattttaatcagtttg

SEQ ID NO: 23105 - DNA, 16 bp, H. sapiens
aattttaatctgtatt

SEQ ID NO: 23106 - DNA, 16 bp, H. sapiens
aattttaatggaaata

SEQ ID NO: 23107 - DNA, 16 bp, H. sapiens
aattttaatggctgca

SEQ ID NO: 23108 - DNA, 16 bp, H. sapiens
aattttaatgtgaaaa

SEQ ID NO: 23109 - DNA, 16 bp, H. sapiens
aattttaattctgaaa

SEQ ID NO: 23110 - DNA, 16 bp, H. sapiens
aattttaattttgcta

SEQ ID NO: 23111 - DNA, 16 bp, H. sapiens
aattttacaaaggaaa

SEQ ID NO: 23112 - DNA, 16 bp, H. sapiens
aattttacaagaaaaa

SEQ ID NO: 23113 - DNA, 16 bp, H. sapiens
aattttacacacacac

SEQ ID NO: 23114 - DNA, 16 bp, H. sapiens
aattttacatgtttat

SEQ ID NO: 23115 - DNA, 16 bp, H. sapiens
aattttacctgttttt

SEQ ID NO: 23116 - DNA, 16 bp, H. sapiens
aattttactgaagtca

SEQ ID NO: 23117 - DNA, 16 bp, H. sapiens
aattttactttgtatt

SEQ ID NO: 23118 - DNA, 16 bp, H. sapiens
aattttacttttcaaa

SEQ ID NO: 23119 - DNA, 16 bp, H. sapiens
aattttagaaaacaaa

SEQ ID NO: 23120 - DNA, 16 bp, H. sapiens
aattttagaaaatcaa

SEQ ID NO: 23121 - DNA, 16 bp, H. sapiens
aattttagaacatttt

SEQ ID NO: 23122 - DNA, 16 bp, H. sapiens
aattttagaacttgtt

SEQ ID NO: 23123 - DNA, 16 bp, H. sapiens
aattttagaacttttt

SEQ ID NO: 23124 - DNA, 16 bp, H. sapiens
aattttagaatcaaaa

SEQ ID NO: 23125 - DNA, 16 bp, H. sapiens
aattttagagacaggg

SEQ ID NO: 23126 - DNA, 16 bp, H. sapiens
aattttagagcatttt

SEQ ID NO: 23127 - DNA, 16 bp, H. sapiens
aattttagatcaatat

SEQ ID NO: 23128 - DNA, 16 bp, H. sapiens
aattttagccattctg

SEQ ID NO: 23129 - DNA, 16 bp, H. sapiens
aattttagctttaaaa

SEQ ID NO: 23130 - DNA, 16 bp, H. sapiens
aattttagtacatttt

SEQ ID NO: 23131 - DNA, 16 bp, H. sapiens
aattttagtagagatg

SEQ ID NO: 23132 - DNA, 16 bp, H. sapiens
aattttagtcagattt

SEQ ID NO: 23133 - DNA, 16 bp, H. sapiens
aattttagtcttttaa

SEQ ID NO: 23134 - DNA, 16 bp, H. sapiens
aattttagttttctga

SEQ ID NO: 23135 - DNA, 16 bp, H. sapiens
aattttataagaaact

SEQ ID NO: 23136 - DNA, 16 bp, H. sapiens
aattttatagcttttt

SEQ ID NO: 23137 - DNA, 16 bp, H. sapiens
aattttatagtttcag

SEQ ID NO: 23138 - DNA, 16 bp, H. sapiens
aattttatagtttctt

SEQ ID NO: 23139 - DNA, 16 bp, H. sapiens
aattttatataaatgg

SEQ ID NO: 23140 - DNA, 16 bp, H. sapiens
aattttatatggaaaa

SEQ ID NO: 23141 - DNA, 16 bp, H. sapiens
aattttatattttcag

SEQ ID NO: 23142 - DNA, 16 bp, H. sapiens
aattttatcaaaaacc

SEQ ID NO: 23143 - DNA, 16 bp, H. sapiens
aattttatcacatgtg

SEQ ID NO: 23144 - DNA, 16 bp, H. sapiens
aattttatcattgttt

SEQ ID NO: 23145 - DNA, 16 bp, H. sapiens
aattttatgaaatgta

SEQ ID NO: 23146 - DNA, 16 bp, H. sapiens
aattttatgaaattca

SEQ ID NO: 23147 - DNA, 16 bp, H. sapiens
aattttatgaatatgt

SEQ ID NO: 23148 - DNA, 16 bp, H. sapiens
aattttatgcaaatat

SEQ ID NO: 23149 - DNA, 16 bp, H. sapiens
aattttatgtcatgta

SEQ ID NO: 23150 - DNA, 16 bp, H. sapiens
aattttatgtgaaaaa

SEQ ID NO: 23151 - DNA, 16 bp, H. sapiens
aattttatgttctgta

SEQ ID NO: 23152 - DNA, 16 bp, H. sapiens
aattttattctgcttt

SEQ ID NO: 23153 - DNA, 16 bp, H. sapiens
aattttatttagttct

SEQ ID NO: 23154 - DNA, 16 bp, H. sapiens
aattttatttcaaact

SEQ ID NO: 23155 - DNA, 16 bp, H. sapiens
aattttatttcaagaa

SEQ ID NO: 23156 - DNA, 16 bp, H. sapiens
aattttatttcctttg

SEQ ID NO: 23157 - DNA, 16 bp, H. sapiens
aattttatttctcaca

SEQ ID NO: 23158 - DNA, 16 bp, H. sapiens
aattttatttctgctc

SEQ ID NO: 23159 - DNA, 16 bp, H. sapiens
aattttattttacaga

SEQ ID NO: 23160 - DNA, 16 bp, H. sapiens
aattttattttacttg

SEQ ID NO: 23161 - DNA, 16 bp, H. sapiens
aattttattttcccca

SEQ ID NO: 23162 - DNA, 16 bp, H. sapiens
aattttattttgcatt

SEQ ID NO: 23163 - DNA, 16 bp, H. sapiens
aattttattttgctga

SEQ ID NO: 23164 - DNA, 16 bp, H. sapiens
aattttcaaaaattgt

SEQ ID NO: 23165 - DNA, 16 bp, H. sapiens
aattttcaaaagaaaa

SEQ ID NO: 23166 - DNA, 16 bp, H. sapiens
aattttcaaaagaata

SEQ ID NO: 23167 - DNA, 16 bp, H. sapiens
aattttcaaatgtata

SEQ ID NO: 23168 - DNA, 16 bp, H. sapiens
aattttcaaattcaaa

SEQ ID NO: 23169 - DNA, 16 bp, H. sapiens
aattttcaaatttttg

SEQ ID NO: 23170 - DNA, 42 bp, H. sapiens
aattttcaacccagaatttcatatccagccaaactaagcttc

SEQ ID NO: 23171 - DNA, 16 bp, H. sapiens
aattttcaactatggg

SEQ ID NO: 23172 - DNA, 16 bp, H. sapiens
aattttcaactcagaa

SEQ ID NO: 23173 - DNA, 16 bp, H. sapiens
aattttcaactctgtg

SEQ ID NO: 23174 - DNA, 16 bp, H. sapiens
aattttcaagaatttt

SEQ ID NO: 23175 - DNA, 16 bp, H. sapiens
aattttcaagtatata

SEQ ID NO: 23176 - DNA, 16 bp, H. sapiens
aattttcaagttaaaa

SEQ ID NO: 23177 - DNA, 16 bp, H. sapiens
aattttcaagtttttt

SEQ ID NO: 23178 - DNA, 16 bp, H. sapiens
aattttcaatgaaata

SEQ ID NO: 23179 - DNA, 16 bp, H. sapiens
aattttcagaaaaaga

SEQ ID NO: 23180 - DNA, 16 bp, H. sapiens
aattttcagaaaattt

SEQ ID NO: 23181 - DNA, 16 bp, H. sapiens
aattttcagaaatgaa

SEQ ID NO: 23182 - DNA, 16 bp, H. sapiens
aattttcagagaaaaa

SEQ ID NO: 23183 - DNA, 16 bp, H. sapiens
aattttcagggaaaaa

SEQ ID NO: 23184 - DNA, 16 bp, H. sapiens
aattttcagttattat

SEQ ID NO: 23185 - DNA, 16 bp, H. sapiens
aattttcagttttaaa

SEQ ID NO: 23186 - DNA, 16 bp, H. sapiens
aattttcagtttttct

SEQ ID NO: 23187 - DNA, 16 bp, H. sapiens
aattttcatattttag

SEQ ID NO: 23188 - DNA, 16 bp, H. sapiens
aattttcatcagaaat

SEQ ID NO: 23189 - DNA, 16 bp, H. sapiens
aattttcatgaacaat

SEQ ID NO: 23190 - DNA, 16 bp, H. sapiens
aattttcatgataaat

SEQ ID NO: 23191 - DNA, 16 bp, H. sapiens
aattttccaaattttc

SEQ ID NO: 23192 - DNA, 16 bp, H. sapiens
aattttccaagaaaat

SEQ ID NO: 23193 - DNA, 16 bp, H. sapiens
aattttccacttaata

SEQ ID NO: 23194 - DNA, 16 bp, H. sapiens
aattttccagatattt

SEQ ID NO: 23195 - DNA, 16 bp, H. sapiens
aattttccagcctcag

SEQ ID NO: 23196 - DNA, 16 bp, H. sapiens
aattttccattaaaaa

SEQ ID NO: 23197 - DNA, 16 bp, H. sapiens
aattttcccaacacaa

SEQ ID NO: 23198 - DNA, 16 bp, H. sapiens
aattttcctgtaataa

SEQ ID NO: 23199 - DNA, 16 bp, H. sapiens
aattttcctgtttatt

SEQ ID NO: 23200 - DNA, 16 bp, H. sapiens
aattttcctttacctg

SEQ ID NO: 23201 - DNA, 16 bp, H. sapiens
aattttcctttcatat

SEQ ID NO: 23202 - DNA, 16 bp, H. sapiens
aattttctaaaactga

SEQ ID NO: 23203 - DNA, 16 bp, H. sapiens
aattttctaaagaaat

SEQ ID NO: 23204 - DNA, 16 bp, H. sapiens
aattttctaaatgcaa

SEQ ID NO: 23205 - DNA, 16 bp, H. sapiens
aattttctaatttcaa

SEQ ID NO: 23206 - DNA, 16 bp, H. sapiens
aattttctagtttttc

SEQ ID NO: 23207 - DNA, 16 bp, H. sapiens
aattttctatagtaaa

SEQ ID NO: 23208 - DNA, 16 bp, H. sapiens
aattttctcaaataaa

SEQ ID NO: 23209 - DNA, 16 bp, H. sapiens
aattttctcaagtttt

SEQ ID NO: 23210 - DNA, 16 bp, H. sapiens
aattttctcagaaaat

SEQ ID NO: 23211 - DNA, 16 bp, H. sapiens
aattttctcagcattt

SEQ ID NO: 23212 - DNA, 16 bp, H. sapiens
aattttctgaaaaata

SEQ ID NO: 23213 - DNA, 16 bp, H. sapiens
aattttctgaaattaa

SEQ ID NO: 23214 - DNA, 16 bp, H. sapiens
aattttctgaactttt

SEQ ID NO: 23215 - DNA, 16 bp, H. sapiens
aattttctgaggagaa

SEQ ID NO: 23216 - DNA, 16 bp, H. sapiens
aattttctgcattttt

SEQ ID NO: 23217 - DNA, 16 bp, H. sapiens
aattttctgtatattt

SEQ ID NO: 23218 - DNA, 16 bp, H. sapiens
aattttctgtctcgtt

SEQ ID NO: 23219 - DNA, 16 bp, H. sapiens
aattttctgttgttta

SEQ ID NO: 23220 - DNA, 16 bp, H. sapiens
aattttctgtttcata

SEQ ID NO: 23221 - DNA, 16 bp, H. sapiens
aattttctgttttaat

SEQ ID NO: 23222 - DNA, 16 bp, H. sapiens
aattttcttaaaacat

SEQ ID NO: 23223 - DNA, 16 bp, H. sapiens
aattttcttggtcttt

SEQ ID NO: 23224 - DNA, 16 bp, H. sapiens
aattttctttctgaaa

SEQ ID NO: 23225 - DNA, 16 bp, H. sapiens
aattttctttgctctg

SEQ ID NO: 23226 - DNA, 16 bp, H. sapiens
aattttcttttaaaag

SEQ ID NO: 23227 - DNA, 16 bp, H. sapiens
aattttcttttcagat

SEQ ID NO: 23228 - DNA, 16 bp, H. sapiens
aattttgaaaaacaaa

SEQ ID NO: 23229 - DNA, 16 bp, H. sapiens
aattttgaaaaagcaa

SEQ ID NO: 23230 - DNA, 16 bp, H. sapiens
aattttgaaaaatttc

SEQ ID NO: 23231 - DNA, 16 bp, H. sapiens
aattttgaaaacaaat

SEQ ID NO: 23232 - DNA, 16 bp, H. sapiens
aattttgaaaatacag

SEQ ID NO: 23233 - DNA, 16 bp, H. sapiens
aattttgaaacatttt

SEQ ID NO: 23234 - DNA, 16 bp, H. sapiens
aattttgaaactatga

SEQ ID NO: 23235 - DNA, 16 bp, H. sapiens
aattttgaaactgaaa

SEQ ID NO: 23236 - DNA, 16 bp, H. sapiens
aattttgaaagaaatt

SEQ ID NO: 23237 - DNA, 16 bp, H. sapiens
aattttgaaagaactt

SEQ ID NO: 23238 - DNA, 16 bp, H. sapiens
aattttgaaagaagtt

SEQ ID NO: 23239 - DNA, 16 bp, H. sapiens
aattttgaaagagaaa

SEQ ID NO: 23240 - DNA, 16 bp, H. sapiens
aattttgaaagcagta

SEQ ID NO: 23241 - DNA, 16 bp, H. sapiens
aattttgaaattgaaa

SEQ ID NO: 23242 - DNA, 16 bp, H. sapiens
aattttgaactgtttt

SEQ ID NO: 23243 - DNA, 16 bp, H. sapiens
aattttgaagaaaaga

SEQ ID NO: 23244 - DNA, 16 bp, H. sapiens
aattttgaagaacaaa

SEQ ID NO: 23245 - DNA, 16 bp, H. sapiens
aattttgaaggaaaaa

SEQ ID NO: 23246 - DNA, 16 bp, H. sapiens
aattttgaattagctt

SEQ ID NO: 23247 - DNA, 16 bp, H. sapiens
aattttgagaaatttt

SEQ ID NO: 23248 - DNA, 16 bp, H. sapiens
aattttgagggggaca

SEQ ID NO: 23249 - DNA, 16 bp, H. sapiens
aattttgagttttctt

SEQ ID NO: 23250 - DNA, 16 bp, H. sapiens
aattttgataaattgt

SEQ ID NO: 23251 - DNA, 16 bp, H. sapiens
aattttgattgagatt

SEQ ID NO: 23252 - DNA, 16 bp, H. sapiens
aattttgatttcaaat

SEQ ID NO: 23253 - DNA, 16 bp, H. sapiens
aattttgattttcaag

SEQ ID NO: 23254 - DNA, 16 bp, H. sapiens
aattttgcaaaaataa

SEQ ID NO: 23255 - DNA, 16 bp, H. sapiens
aattttgcaagagttt

SEQ ID NO: 23256 - DNA, 16 bp, H. sapiens
aattttgcaatatttt

SEQ ID NO: 23257 - DNA, 16 bp, H. sapiens
aattttgcaatctacc

SEQ ID NO: 23258 - DNA, 16 bp, H. sapiens
aattttgcataaaatt

SEQ ID NO: 23259 - DNA, 16 bp, H. sapiens
aattttgcattttaca

SEQ ID NO: 23260 - DNA, 16 bp, H. sapiens
aattttgccaaagagc

SEQ ID NO: 23261 - DNA, 16 bp, H. sapiens
aattttgctgtgaact

SEQ ID NO: 23262 - DNA, 16 bp, H. sapiens
aattttgcttcatttt

SEQ ID NO: 23263 - DNA, 16 bp, H. sapiens
aattttgcttttaatt

SEQ ID NO: 23264 - DNA, 16 bp, H. sapiens
aattttggaaagaaaa

SEQ ID NO: 23265 - DNA, 16 bp, H. sapiens
aattttggaaatcaaa

SEQ ID NO: 23266 - DNA, 16 bp, H. sapiens
aattttggaagaaaga

SEQ ID NO: 23267 - DNA, 16 bp, H. sapiens
aattttggaagatttt

SEQ ID NO: 23268 - DNA, 16 bp, H. sapiens
aattttggaataattt

SEQ ID NO: 23269 - DNA, 18 bp, H. sapiens
aattttggaatatttgca

SEQ ID NO: 23270 - DNA, 16 bp, H. sapiens
aattttggagaaaaat

SEQ ID NO: 23271 - DNA, 16 bp, H. sapiens
aattttggattatatc

SEQ ID NO: 23272 - DNA, 16 bp, H. sapiens
aattttgggggaaaat

SEQ ID NO: 23273 - DNA, 16 bp, H. sapiens
aattttggggggaaca

SEQ ID NO: 23274 - DNA, 16 bp, H. sapiens
aattttgtacattttt

SEQ ID NO: 23275 - DNA, 16 bp, H. sapiens
aattttgtagccacct

SEQ ID NO: 23276 - DNA, 16 bp, H. sapiens
aattttgtatgccttt

SEQ ID NO: 23277 - DNA, 16 bp, H. sapiens
aattttgtcatttcaa

SEQ ID NO: 23278 - DNA, 16 bp, H. sapiens
aattttgtcttctgtt

SEQ ID NO: 23279 - DNA, 16 bp, H. sapiens
aattttgtctttctgt

SEQ ID NO: 23280 - DNA, 16 bp, H. sapiens
aattttgtgaaataaa

SEQ ID NO: 23281 - DNA, 16 bp, H. sapiens
aattttgtgaaataat

SEQ ID NO: 23282 - DNA, 16 bp, H. sapiens
aattttgtgcatgaaa

SEQ ID NO: 23283 - DNA, 16 bp, H. sapiens
aattttgtgtactttt

SEQ ID NO: 23284 - DNA, 16 bp, H. sapiens
aattttgttaaagaaa

SEQ ID NO: 23285 - DNA, 16 bp, H. sapiens
aattttgttactttta

SEQ ID NO: 23286 - DNA, 16 bp, H. sapiens
aattttgttatttcaa

SEQ ID NO: 23287 - DNA, 16 bp, H. sapiens
aattttgtttaccttt

SEQ ID NO: 23288 - DNA, 16 bp, H. sapiens
aattttgtttcaaatt

SEQ ID NO: 23289 - DNA, 16 bp, H. sapiens
aattttgtttccaaaa

SEQ ID NO: 23290 - DNA, 16 bp, H. sapiens
aattttgtttgaaaat

SEQ ID NO: 23291 - DNA, 16 bp, H. sapiens
aattttgttttccatt

SEQ ID NO: 23292 - DNA, 16 bp, H. sapiens
aattttgtttttcaca

SEQ ID NO: 23293 - DNA, 16 bp, H. sapiens
aatttttaaaaaccca

SEQ ID NO: 23294 - DNA, 16 bp, H. sapiens
aatttttaaaaagtca

SEQ ID NO: 23295 - DNA, 16 bp, H. sapiens
aatttttaaaaatcca

SEQ ID NO: 23296 - DNA, 16 bp, H. sapiens
aatttttaaaaatgca

SEQ ID NO: 23297 - DNA, 16 bp, H. sapiens
aatttttaaaaattgg

SEQ ID NO: 23298 - DNA, 16 bp, H. sapiens
aatttttaaaatactg

SEQ ID NO: 23299 - DNA, 16 bp, H. sapiens
aatttttaaacatgta

SEQ ID NO: 23300 - DNA, 16 bp, H. sapiens
aatttttaaagaggaa

SEQ ID NO: 23301 - DNA, 16 bp, H. sapiens
aatttttaaaggaaat

SEQ ID NO: 23302 - DNA, 16 bp, H. sapiens
aatttttaaatactga

SEQ ID NO: 23303 - DNA, 16 bp, H. sapiens
aatttttaaatgccat

SEQ ID NO: 23304 - DNA, 16 bp, H. sapiens
aatttttaaatgcttt

SEQ ID NO: 23305 - DNA, 16 bp, H. sapiens
aatttttaaatgttca

SEQ ID NO: 23306 - DNA, 16 bp, H. sapiens
aatttttaacacattt

SEQ ID NO: 23307 - DNA, 16 bp, H. sapiens
aatttttaactttttg

SEQ ID NO: 23308 - DNA, 16 bp, H. sapiens
aatttttaagaaatga

SEQ ID NO: 23309 - DNA, 16 bp, H. sapiens
aatttttaagaataca

SEQ ID NO: 23310 - DNA, 16 bp, H. sapiens
aatttttaagtttctt

SEQ ID NO: 23311 - DNA, 16 bp, H. sapiens
aatttttaattgagtg

SEQ ID NO: 23312 - DNA, 16 bp, H. sapiens
aatttttacagaaatt

SEQ ID NO: 23313 - DNA, 16 bp, H. sapiens
aatttttagattcaat

SEQ ID NO: 23314 - DNA, 16 bp, H. sapiens
aatttttagtagagac

SEQ ID NO: 23315 - DNA, 17 bp, H. sapiens
aatttttagtagagacg

SEQ ID NO: 23316 - DNA, 16 bp, H. sapiens
aatttttatacattga

SEQ ID NO: 23317 - DNA, 16 bp, H. sapiens
aatttttatatctttg

SEQ ID NO: 23318 - DNA, 16 bp, H. sapiens
aatttttatgatgaaa

SEQ ID NO: 23319 - DNA, 16 bp, H. sapiens
aatttttatggaatta

SEQ ID NO: 23320 - DNA, 16 bp, H. sapiens
aatttttatggctttt

SEQ ID NO: 23321 - DNA, 16 bp, H. sapiens
aatttttattcccatt

SEQ ID NO: 23322 - DNA, 16 bp, H. sapiens
aatttttattggataa

SEQ ID NO: 23323 - DNA, 16 bp, H. sapiens
aatttttattgttcta

SEQ ID NO: 23324 - DNA, 16 bp, H. sapiens
aatttttatttcctgt

SEQ ID NO: 23325 - DNA, 16 bp, H. sapiens
aatttttcacaattat

SEQ ID NO: 23326 - DNA, 16 bp, H. sapiens
aatttttcagttccat

SEQ ID NO: 23327 - DNA, 16 bp, H. sapiens
aatttttcatagtatt

SEQ ID NO: 23328 - DNA, 16 bp, H. sapiens
aatttttcatttagaa

SEQ ID NO: 23329 - DNA, 16 bp, H. sapiens
aatttttccacattct

SEQ ID NO: 23330 - DNA, 16 bp, H. sapiens
aatttttccaccaaaa

SEQ ID NO: 23331 - DNA, 16 bp, H. sapiens
aatttttccatttaaa

SEQ ID NO: 23332 - DNA, 16 bp, H. sapiens
aatttttccatttgtt

SEQ ID NO: 23333 - DNA, 16 bp, H. sapiens
aatttttccttgaaaa

SEQ ID NO: 23334 - DNA, 16 bp, H. sapiens
aatttttcctttgaaa

SEQ ID NO: 23335 - DNA, 16 bp, H. sapiens
aatttttccttttgaa

SEQ ID NO: 23336 - DNA, 16 bp, H. sapiens
aatttttctaaatgtt

SEQ ID NO: 23337 - DNA, 16 bp, H. sapiens
aatttttctacaaaaa

SEQ ID NO: 23338 - DNA, 16 bp, H. sapiens
aatttttctacatcct

SEQ ID NO: 23339 - DNA, 16 bp, H. sapiens
aatttttctgagtttt

SEQ ID NO: 23340 - DNA, 16 bp, H. sapiens
aatttttctgtaaaca

SEQ ID NO: 23341 - DNA, 16 bp, H. sapiens
aatttttctgtaaatt

SEQ ID NO: 23342 - DNA, 16 bp, H. sapiens
aatttttctgtaataa

SEQ ID NO: 23343 - DNA, 16 bp, H. sapiens
aatttttcttagtata

SEQ ID NO: 23344 - DNA, 16 bp, H. sapiens
aatttttgaaaaagat

SEQ ID NO: 23345 - DNA, 16 bp, H. sapiens
aatttttgaaatagtt

SEQ ID NO: 23346 - DNA, 16 bp, H. sapiens
aatttttgaactttta

SEQ ID NO: 23347 - DNA, 16 bp, H. sapiens
aatttttgaagaaaat

SEQ ID NO: 23348 - DNA, 16 bp, H. sapiens
aatttttgattcagta

SEQ ID NO: 23349 - DNA, 16 bp, H. sapiens
aatttttgcaaactat

SEQ ID NO: 23350 - DNA, 16 bp, H. sapiens
aatttttgcaacttac

SEQ ID NO: 23351 - DNA, 16 bp, H. sapiens
aatttttgcaatctag

SEQ ID NO: 23352 - DNA, 16 bp, H. sapiens
aatttttgcatgttta

SEQ ID NO: 23353 - DNA, 16 bp, H. sapiens
aatttttgcattatta

SEQ ID NO: 23354 - DNA, 16 bp, H. sapiens
aatttttgcatttatt

SEQ ID NO: 23355 - DNA, 16 bp, H. sapiens
aatttttgcatttgta

SEQ ID NO: 23356 - DNA, 16 bp, H. sapiens
aatttttgcctttgtt

SEQ ID NO: 23357 - DNA, 16 bp, H. sapiens
aatttttgcttcatgt

SEQ ID NO: 23358 - DNA, 16 bp, H. sapiens
aatttttgcttcctat

SEQ ID NO: 23359 - DNA, 16 bp, H. sapiens
aatttttgcttttgct

SEQ ID NO: 23360 - DNA, 16 bp, H. sapiens
aatttttgctttttaa

SEQ ID NO: 23361 - DNA, 16 bp, H. sapiens
aatttttggtagagac

SEQ ID NO: 23362 - DNA, 16 bp, H. sapiens
aatttttgtacatagt

SEQ ID NO: 23363 - DNA, 16 bp, H. sapiens
aatttttgtagaaatg

SEQ ID NO: 23364 - DNA, 16 bp, H. sapiens
aatttttgtatacagt

SEQ ID NO: 23365 - DNA, 16 bp, H. sapiens
aatttttgtcatttat

SEQ ID NO: 23366 - DNA, 16 bp, H. sapiens
aatttttgtgaaaagt

SEQ ID NO: 23367 - DNA, 16 bp, H. sapiens
aatttttgtggatata

SEQ ID NO: 23368 - DNA, 16 bp, H. sapiens
aatttttgtttcagaa

SEQ ID NO: 23369 - DNA, 16 bp, H. sapiens
aatttttgtttctaaa

SEQ ID NO: 23370 - DNA, 16 bp, H. sapiens
aattttttaaaaagct

SEQ ID NO: 23371 - DNA, 16 bp, H. sapiens
aattttttaaaaagga

SEQ ID NO: 23372 - DNA, 16 bp, H. sapiens
aattttttaaaatgca

SEQ ID NO: 23373 - DNA, 16 bp, H. sapiens
aattttttaaagcata

SEQ ID NO: 23374 - DNA, 16 bp, H. sapiens
aattttttaaatgtca

SEQ ID NO: 23375 - DNA, 16 bp, H. sapiens
aattttttaaatgtct

SEQ ID NO: 23376 - DNA, 16 bp, H. sapiens
aattttttacagcagc

SEQ ID NO: 23377 - DNA, 16 bp, H. sapiens
aattttttagagatag

SEQ ID NO: 23378 - DNA, 16 bp, H. sapiens
aattttttcaaatgtt

SEQ ID NO: 23379 - DNA, 16 bp, H. sapiens
aattttttcacattct

SEQ ID NO: 23380 - DNA, 16 bp, H. sapiens
aattttttcagcattt

SEQ ID NO: 23381 - DNA, 16 bp, H. sapiens
aattttttcatctgta

SEQ ID NO: 23382 - DNA, 16 bp, H. sapiens
aattttttccattaaa

SEQ ID NO: 23383 - DNA, 16 bp, H. sapiens
aattttttcttctgag

SEQ ID NO: 23384 - DNA, 16 bp, H. sapiens
aattttttgaagaaaa

SEQ ID NO: 23385 - DNA, 16 bp, H. sapiens
aattttttgagaaaca

SEQ ID NO: 23386 - DNA, 16 bp, H. sapiens
aattttttgagaaatt

SEQ ID NO: 23387 - DNA, 16 bp, H. sapiens
aattttttgaggaacc

SEQ ID NO: 23388 - DNA, 16 bp, H. sapiens
aattttttgcatattt

SEQ ID NO: 23389 - DNA, 16 bp, H. sapiens
aattttttggtcattt

SEQ ID NO: 23390 - DNA, 16 bp, H. sapiens
aattttttgtagagac

SEQ ID NO: 23391 - DNA, 17 bp, H. sapiens
aattttttgtagagata

SEQ ID NO: 23392 - DNA, 16 bp, H. sapiens
aattttttgtgtgtga

SEQ ID NO: 23393 - DNA, 16 bp, H. sapiens
aatttttttaaacact

SEQ ID NO: 23394 - DNA, 16 bp, H. sapiens
aatttttttaatgcca

SEQ ID NO: 23395 - DNA, 16 bp, H. sapiens
aatttttttaattgac

SEQ ID NO: 23396 - DNA, 17 bp, H. sapiens
aatttttttcaaagttt

SEQ ID NO: 23397 - DNA, 16 bp, H. sapiens
aatttttttcaagcaa

SEQ ID NO: 23398 - DNA, 16 bp, H. sapiens
aatttttttcatcagt

SEQ ID NO: 23399 - DNA, 16 bp, H. sapiens
aatttttttccaaact

SEQ ID NO: 23400 - DNA, 16 bp, H. sapiens
aatttttttccagaat

SEQ ID NO: 23401 - DNA, 16 bp, H. sapiens
aatttttttcctccca

SEQ ID NO: 23402 - DNA, 16 bp, H. sapiens
aatttttttctgaaaa

SEQ ID NO: 23403 - DNA, 16 bp, H. sapiens
aatttttttgagatgg

SEQ ID NO: 23404 - DNA, 16 bp, H. sapiens
aatttttttgccattt

SEQ ID NO: 23405 - DNA, 16 bp, H. sapiens
aattttttttaaagga

SEQ ID NO: 23406 - DNA, 16 bp, H. sapiens
aattttttttaaccca

SEQ ID NO: 23407 - DNA, 16 bp, H. sapiens
aattttttttaagttc

SEQ ID NO: 23408 - DNA, 16 bp, H. sapiens
aattttttttcatgaa

SEQ ID NO: 23409 - DNA, 16 bp, H. sapiens
aattttttttcccaaa

SEQ ID NO: 23410 - DNA, 16 bp, H. sapiens
aattttttttgtggag

SEQ ID NO: 23411 - DNA, 17 bp, H. sapiens
aatttttttttgagaca

SEQ ID NO: 23412 - DNA, 18 bp, H. sapiens
acaaaaaaaatttagcca

SEQ ID NO: 23413 - DNA, 16 bp, H. sapiens
acaaaaaaacatttct

SEQ ID NO: 23414 - DNA, 16 bp, H. sapiens
acaaaaaaactcttca

SEQ ID NO: 23415 - DNA, 16 bp, H. sapiens
acaaaaaaaggaattt

SEQ ID NO: 23416 - DNA, 16 bp, H. sapiens
acaaaaaaagtcagga

SEQ ID NO: 23417 - DNA, 16 bp, H. sapiens
acaaaaaacacatgat

SEQ ID NO: 23418 - DNA, 16 bp, H. sapiens
acaaaaaactcttcaa

SEQ ID NO: 23419 - DNA, 16 bp, H. sapiens
acaaaaaaggagacat

SEQ ID NO: 23420 - DNA, 16 bp, H. sapiens
acaaaaaagtagccag

SEQ ID NO: 23421 - DNA, 16 bp, H. sapiens
acaaaaaagtttaaat

SEQ ID NO: 23422 - DNA, 16 bp, H. sapiens
acaaaaaatgtgaaat

SEQ ID NO: 23423 - DNA, 16 bp, H. sapiens
acaaaaaattaacctg

SEQ ID NO: 23424 - DNA, 16 bp, H. sapiens
acaaaaaattagccca

SEQ ID NO: 23425 - DNA, 16 bp, H. sapiens
acaaaaacaaattttg

SEQ ID NO: 23426 - DNA, 16 bp, H. sapiens
acaaaaacaagaattg

SEQ ID NO: 23427 - DNA, 16 bp, H. sapiens
acaaaaacaatttttt

SEQ ID NO: 23428 - DNA, 16 bp, H. sapiens
acaaaaacacatgatt

SEQ ID NO: 23429 - DNA, 16 bp, H. sapiens
acaaaaacagatacat

SEQ ID NO: 23430 - DNA, 16 bp, H. sapiens
acaaaaacaggaaatg

SEQ ID NO: 23431 - DNA, 16 bp, H. sapiens
acaaaaacagtatttc

SEQ ID NO: 23432 - DNA, 16 bp, H. sapiens
acaaaaacatgaagtg

SEQ ID NO: 23433 - DNA, 16 bp, H. sapiens
acaaaaacattttctt

SEQ ID NO: 23434 - DNA, 17 bp, H. sapiens
acaaaaaccacatgatt

SEQ ID NO: 23435 - DNA, 16 bp, H. sapiens
acaaaaaccacctgat

SEQ ID NO: 23436 - DNA, 16 bp, H. sapiens
acaaaaaccatatcat

SEQ ID NO: 23437 - DNA, 16 bp, H. sapiens
acaaaaaccatatgat

SEQ ID NO: 23438 - DNA, 16 bp, H. sapiens
acaaaaaccccattca

SEQ ID NO: 23439 - DNA, 16 bp, H. sapiens
acaaaaactacatgat

SEQ ID NO: 23440 - DNA, 16 bp, H. sapiens
acaaaaactatctggg

SEQ ID NO: 23441 - DNA, 16 bp, H. sapiens
acaaaaacttgtacat

SEQ ID NO: 23442 - DNA, 16 bp, H. sapiens
acaaaaagaaacattt

SEQ ID NO: 23443 - DNA, 16 bp, H. sapiens
acaaaaagacatggaa

SEQ ID NO: 23444 - DNA, 16 bp, H. sapiens
acaaaaagcagctggg

SEQ ID NO: 23445 - DNA, 16 bp, H. sapiens
acaaaaagctcaaaga

SEQ ID NO: 23446 - DNA, 16 bp, H. sapiens
acaaaaagctgtttct

SEQ ID NO: 23447 - DNA, 16 bp, H. sapiens
acaaaaagtagattaa

SEQ ID NO: 23448 - DNA, 16 bp, H. sapiens
acaaaaagttattttc

SEQ ID NO: 23449 - DNA, 16 bp, H. sapiens
acaaaaataatgtgac

SEQ ID NO: 23450 - DNA, 16 bp, H. sapiens
acaaaaatatttctga

SEQ ID NO: 23451 - DNA, 16 bp, H. sapiens
acaaaaatcccttcaa

SEQ ID NO: 23452 - DNA, 16 bp, H. sapiens
acaaaaatcctcagca

SEQ ID NO: 23453 - DNA, 16 bp, H. sapiens
acaaaaatgaaaattt

SEQ ID NO: 23454 - DNA, 16 bp, H. sapiens
acaaaaatgagaaatg

SEQ ID NO: 23455 - DNA, 16 bp, H. sapiens
acaaaaatgagccagt

SEQ ID NO: 23456 - DNA, 16 bp, H. sapiens
acaaaaatggaaagat

SEQ ID NO: 23457 - DNA, 16 bp, H. sapiens
acaaaaatggaaatat

SEQ ID NO: 23458 - DNA, 16 bp, H. sapiens
acaaaaatgtatataa

SEQ ID NO: 23459 - DNA, 16 bp, H. sapiens
acaaaaatgtattgaa

SEQ ID NO: 23460 - DNA, 16 bp, H. sapiens
acaaaaatgtatttct

SEQ ID NO: 23461 - DNA, 16 bp, H. sapiens
acaaaaatgtcaacat

SEQ ID NO: 23462 - DNA, 16 bp, H. sapiens
acaaaaatgtgaatgt

SEQ ID NO: 23463 - DNA, 16 bp, H. sapiens
acaaaaatgtgagaaa

SEQ ID NO: 23464 - DNA, 16 bp, H. sapiens
acaaaaatgttattaa

SEQ ID NO: 23465 - DNA, 16 bp, H. sapiens
acaaaaattaaccaga

SEQ ID NO: 23466 - DNA, 16 bp, H. sapiens
acaaaaattaactgaa

SEQ ID NO: 23467 - DNA, 16 bp, H. sapiens
acaaaaattagctgta

SEQ ID NO: 23468 - DNA, 17 bp, H. sapiens
acaaaaattagtcaggc

SEQ ID NO: 23469 - DNA, 16 bp, H. sapiens
acaaaaattatccaga

SEQ ID NO: 23470 - DNA, 16 bp, H. sapiens
acaaaaattctgaaaa

SEQ ID NO: 23471 - DNA, 16 bp, H. sapiens
acaaaaattgactcaa

SEQ ID NO: 23472 - DNA, 16 bp, H. sapiens
acaaaaattgattttt

SEQ ID NO: 23473 - DNA, 16 bp, H. sapiens
acaaaaatttcaaaag

SEQ ID NO: 23474 - DNA, 16 bp, H. sapiens
acaaaaatttcagaaa

SEQ ID NO: 23475 - DNA, 16 bp, H. sapiens
acaaaacaaaactctt

SEQ ID NO: 23476 - DNA, 16 bp, H. sapiens
acaaaacaaaactttg

SEQ ID NO: 23477 - DNA, 16 bp, H. sapiens
acaaaacaaaatgtta

SEQ ID NO: 23478 - DNA, 16 bp, H. sapiens
acaaaacaaatacttt

SEQ ID NO: 23479 - DNA, 16 bp, H. sapiens
acaaaacaacattgaa

SEQ ID NO: 23480 - DNA, 16 bp, H. sapiens
acaaaacaattcaatt

SEQ ID NO: 23481 - DNA, 16 bp, H. sapiens
acaaaacaattttgaa

SEQ ID NO: 23482 - DNA, 16 bp, H. sapiens
acaaaacactactgaa

SEQ ID NO: 23483 - DNA, 16 bp, H. sapiens
acaaaacactgtggaa

SEQ ID NO: 23484 - DNA, 16 bp, H. sapiens
acaaaacactgttaaa

SEQ ID NO: 23485 - DNA, 16 bp, H. sapiens
acaaaacagaaaatct

SEQ ID NO: 23486 - DNA, 16 bp, H. sapiens
acaaaacagaaatttt

SEQ ID NO: 23487 - DNA, 16 bp, H. sapiens
acaaaacagactaata

SEQ ID NO: 23488 - DNA, 16 bp, H. sapiens
acaaaacagactcttt

SEQ ID NO: 23489 - DNA, 16 bp, H. sapiens
acaaaacagatttaaa

SEQ ID NO: 23490 - DNA, 16 bp, H. sapiens
acaaaacattgatgaa

SEQ ID NO: 23491 - DNA, 16 bp, H. sapiens
acaaaaccaatgtgca

SEQ ID NO: 23492 - DNA, 16 bp, H. sapiens
acaaaacccacatgat

SEQ ID NO: 23493 - DNA, 16 bp, H. sapiens
acaaaacccccatctc

SEQ ID NO: 23494 - DNA, 16 bp, H. sapiens
acaaaacctttgagaa

SEQ ID NO: 23495 - DNA, 16 bp, H. sapiens
acaaaactggaaaaat

SEQ ID NO: 23496 - DNA, 16 bp, H. sapiens
acaaaactggaagaat

SEQ ID NO: 23497 - DNA, 16 bp, H. sapiens
acaaaactggagaaat

SEQ ID NO: 23498 - DNA, 16 bp, H. sapiens
acaaaagaaacatgta

SEQ ID NO: 23499 - DNA, 16 bp, H. sapiens
acaaaagaaactgtca

SEQ ID NO: 23500 - DNA, 16 bp, H. sapiens
acaaaagaaatgcaat

SEQ ID NO: 23501 - DNA, 16 bp, H. sapiens
acaaaagaagacattt

SEQ ID NO: 23502 - DNA, 16 bp, H. sapiens
acaaaagacagcagta

SEQ ID NO: 23503 - DNA, 16 bp, H. sapiens
acaaaagaccacaaat

SEQ ID NO: 23504 - DNA, 16 bp, H. sapiens
acaaaagaccatatat

SEQ ID NO: 23505 - DNA, 16 bp, H. sapiens
acaaaagactgacctc

SEQ ID NO: 23506 - DNA, 16 bp, H. sapiens
acaaaagagtacctat

SEQ ID NO: 23507 - DNA, 16 bp, H. sapiens
acaaaagataaatgct

SEQ ID NO: 23508 - DNA, 16 bp, H. sapiens
acaaaagatcaatgaa

SEQ ID NO: 23509 - DNA, 16 bp, H. sapiens
acaaaagcaaaaattg

SEQ ID NO: 23510 - DNA, 16 bp, H. sapiens
acaaaagcaattgcaa

SEQ ID NO: 23511 - DNA, 16 bp, H. sapiens
acaaaagctcctgaag

SEQ ID NO: 23512 - DNA, 16 bp, H. sapiens
acaaaaggaaaaactg

SEQ ID NO: 23513 - DNA, 16 bp, H. sapiens
acaaaaggaaaaattt

SEQ ID NO: 23514 - DNA, 16 bp, H. sapiens
acaaaaggaaacattt

SEQ ID NO: 23515 - DNA, 16 bp, H. sapiens
acaaaaggataaatat

SEQ ID NO: 23516 - DNA, 16 bp, H. sapiens
acaaaaggcagattaa

SEQ ID NO: 23517 - DNA, 16 bp, H. sapiens
acaaaaggtaaatgaa

SEQ ID NO: 23518 - DNA, 16 bp, H. sapiens
acaaaagtaccaagaa

SEQ ID NO: 23519 - DNA, 16 bp, H. sapiens
acaaaagtatatttta

SEQ ID NO: 23520 - DNA, 16 bp, H. sapiens
acaaaagtgccaagaa

SEQ ID NO: 23521 - DNA, 16 bp, H. sapiens
acaaaagtttggaaaa

SEQ ID NO: 23522 - DNA, 16 bp, H. sapiens
acaaaagttttttatt

SEQ ID NO: 23523 - DNA, 16 bp, H. sapiens
acaaaataaatgtata

SEQ ID NO: 23524 - DNA, 16 bp, H. sapiens
acaaaataatatgtac

SEQ ID NO: 23525 - DNA, 16 bp, H. sapiens
acaaaataatgaagga

SEQ ID NO: 23526 - DNA, 16 bp, H. sapiens
acaaaataatgtcctt

SEQ ID NO: 23527 - DNA, 16 bp, H. sapiens
acaaaatacatttgaa

SEQ ID NO: 23528 - DNA, 16 bp, H. sapiens
acaaaataccacagac

SEQ ID NO: 23529 - DNA, 16 bp, H. sapiens
acaaaatactaatgaa

SEQ ID NO: 23530 - DNA, 16 bp, H. sapiens
acaaaatactacagac

SEQ ID NO: 23531 - DNA, 16 bp, H. sapiens
acaaaatagattttaa

SEQ ID NO: 23532 - DNA, 16 bp, H. sapiens
acaaaataggattaca

SEQ ID NO: 23533 - DNA, 16 bp, H. sapiens
acaaaatataacaagt

SEQ ID NO: 23534 - DNA, 16 bp, H. sapiens
acaaaatatagtaatt

SEQ ID NO: 23535 - DNA, 16 bp, H. sapiens
acaaaatatgtgcaaa

SEQ ID NO: 23536 - DNA, 16 bp, H. sapiens
acaaaatatgtgttaa

SEQ ID NO: 23537 - DNA, 16 bp, H. sapiens
acaaaatattaagtaa

SEQ ID NO: 23538 - DNA, 16 bp, H. sapiens
acaaaatattagtaaa

SEQ ID NO: 23539 - DNA, 16 bp, H. sapiens
acaaaatattcctaat

SEQ ID NO: 23540 - DNA, 16 bp, H. sapiens
acaaaatattcttctt

SEQ ID NO: 23541 - DNA, 16 bp, H. sapiens
acaaaatatttagaat

SEQ ID NO: 23542 - DNA, 16 bp, H. sapiens
acaaaatatttctaat

SEQ ID NO: 23543 - DNA, 16 bp, H. sapiens
acaaaatatttgattt

SEQ ID NO: 23544 - DNA, 16 bp, H. sapiens
acaaaatattttactt

SEQ ID NO: 23545 - DNA, 16 bp, H. sapiens
acaaaatattttcatt

SEQ ID NO: 23546 - DNA, 16 bp, H. sapiens
acaaaatatttttaca

SEQ ID NO: 23547 - DNA, 16 bp, H. sapiens
acaaaatcaagcaatg

SEQ ID NO: 23548 - DNA, 16 bp, H. sapiens
acaaaatcagaaatta

SEQ ID NO: 23549 - DNA, 16 bp, H. sapiens
acaaaatccaacacct

SEQ ID NO: 23550 - DNA, 16 bp, H. sapiens
acaaaatccagcatcg

SEQ ID NO: 23551 - DNA, 16 bp, H. sapiens
acaaaatctctcagta

SEQ ID NO: 23552 - DNA, 16 bp, H. sapiens
acaaaatgaaaactat

SEQ ID NO: 23553 - DNA, 16 bp, H. sapiens
acaaaatgaaaagctg

SEQ ID NO: 23554 - DNA, 16 bp, H. sapiens
acaaaatgaaaagttt

SEQ ID NO: 23555 - DNA, 16 bp, H. sapiens
acaaaatgaaaatgct

SEQ ID NO: 23556 - DNA, 16 bp, H. sapiens
acaaaatgaatgaaat

SEQ ID NO: 23557 - DNA, 16 bp, H. sapiens
acaaaatgagataata

SEQ ID NO: 23558 - DNA, 16 bp, H. sapiens
acaaaatgatgttgaa

SEQ ID NO: 23559 - DNA, 16 bp, H. sapiens
acaaaatgatgttttg

SEQ ID NO: 23560 - DNA, 16 bp, H. sapiens
acaaaatgattctaaa

SEQ ID NO: 23561 - DNA, 16 bp, H. sapiens
acaaaatgatttaaaa

SEQ ID NO: 23562 - DNA, 16 bp, H. sapiens
acaaaatgcaaaaatt

SEQ ID NO: 23563 - DNA, 16 bp, H. sapiens
acaaaatgctgggatt

SEQ ID NO: 23564 - DNA, 16 bp, H. sapiens
acaaaatggagtttct

SEQ ID NO: 23565 - DNA, 16 bp, H. sapiens
acaaaatgggataaaa

SEQ ID NO: 23566 - DNA, 16 bp, H. sapiens
acaaaatggggagaaa

SEQ ID NO: 23567 - DNA, 16 bp, H. sapiens
acaaaatgtattattt

SEQ ID NO: 23568 - DNA, 16 bp, H. sapiens
acaaaatgttgctgaa

SEQ ID NO: 23569 - DNA, 16 bp, H. sapiens
acaaaatgttgtatat

SEQ ID NO: 23570 - DNA, 16 bp, H. sapiens
acaaaatgtttttctt

SEQ ID NO: 23571 - DNA, 16 bp, H. sapiens
acaaaattaaggaaga

SEQ ID NO: 23572 - DNA, 16 bp, H. sapiens
acaaaattattctctt

SEQ ID NO: 23573 - DNA, 16 bp, H. sapiens
acaaaattcaacaatg

SEQ ID NO: 23574 - DNA, 16 bp, H. sapiens
acaaaattcatttatg

SEQ ID NO: 23575 - DNA, 16 bp, H. sapiens
acaaaattccatctca

SEQ ID NO: 23576 - DNA, 16 bp, H. sapiens
acaaaattcttaattt

SEQ ID NO: 23577 - DNA, 16 bp, H. sapiens
acaaaattgacaaaca

SEQ ID NO: 23578 - DNA, 16 bp, H. sapiens
acaaaattgagaccca

SEQ ID NO: 23579 - DNA, 16 bp, H. sapiens
acaaaattgggatcat

SEQ ID NO: 23580 - DNA, 16 bp, H. sapiens
acaaaatttacaagaa

SEQ ID NO: 23581 - DNA, 16 bp, H. sapiens
acaaaatttcagttgg

SEQ ID NO: 23582 - DNA, 16 bp, H. sapiens
acaaaatttctgaaaa

SEQ ID NO: 23583 - DNA, 16 bp, H. sapiens
acaaaatttggagcat

SEQ ID NO: 23584 - DNA, 16 bp, H. sapiens
acaaaattttagaaat

SEQ ID NO: 23585 - DNA, 16 bp, H. sapiens
acaaacaaaaactgtg

SEQ ID NO: 23586 - DNA, 16 bp, H. sapiens
acaaacaaaaacttgt

SEQ ID NO: 23587 - DNA, 16 bp, H. sapiens
acaaacaaaaagcctg

SEQ ID NO: 23588 - DNA, 16 bp, H. sapiens
acaaacaaaaatcttt

SEQ ID NO: 23589 - DNA, 16 bp, H. sapiens
acaaacaaaaattctg

SEQ ID NO: 23590 - DNA, 16 bp, H. sapiens
acaaacaaaagctgaa

SEQ ID NO: 23591 - DNA, 33 bp, H. sapiens
acaaacaaatggaagaacattccatgctcatgg

SEQ ID NO: 23592 - DNA, 16 bp, H. sapiens
acaaacaaatggaata

SEQ ID NO: 23593 - DNA, 16 bp, H. sapiens
acaaacaaatgtaaga

SEQ ID NO: 23594 - DNA, 16 bp, H. sapiens
acaaacaacagcatga

SEQ ID NO: 23595 - DNA, 16 bp, H. sapiens
acaaacaactccatca

SEQ ID NO: 23596 - DNA, 16 bp, H. sapiens
acaaacaagcacatgt

SEQ ID NO: 23597 - DNA, 16 bp, H. sapiens
acaaacaatccaatta

SEQ ID NO: 23598 - DNA, 16 bp, H. sapiens
acaaacaatggagaaa

SEQ ID NO: 23599 - DNA, 16 bp, H. sapiens
acaaacacatggaaat

SEQ ID NO: 23600 - DNA, 16 bp, H. sapiens
acaaacacattataca

SEQ ID NO: 23601 - DNA, 16 bp, H. sapiens
acaaacactgcatatt

SEQ ID NO: 23602 - DNA, 16 bp, H. sapiens
acaaacactgtggaag

SEQ ID NO: 23603 - DNA, 16 bp, H. sapiens
acaaacagaaatgaca

SEQ ID NO: 23604 - DNA, 16 bp, H. sapiens
acaaacagacactttt

SEQ ID NO: 23605 - DNA, 16 bp, H. sapiens
acaaacagaccttcag

SEQ ID NO: 23606 - DNA, 16 bp, H. sapiens
acaaacaggccaggcg

SEQ ID NO: 23607 - DNA, 16 bp, H. sapiens
acaaacaggccaggtg

SEQ ID NO: 23608 - DNA, 16 bp, H. sapiens
acaaacagtctcttag

SEQ ID NO: 23609 - DNA, 16 bp, H. sapiens
acaaacatgttttaaa

SEQ ID NO: 23610 - DNA, 16 bp, H. sapiens
acaaacattcaatcca

SEQ ID NO: 23611 - DNA, 16 bp, H. sapiens
acaaacattcagtcca

SEQ ID NO: 23612 - DNA, 16 bp, H. sapiens
acaaaccaatggaaga

SEQ ID NO: 23613 - DNA, 16 bp, H. sapiens
acaaaccactgctcat

SEQ ID NO: 23614 - DNA, 16 bp, H. sapiens
acaaaccagaaaatct

SEQ ID NO: 23615 - DNA, 16 bp, H. sapiens
acaaaccaggaagaga

SEQ ID NO: 23616 - DNA, 16 bp, H. sapiens
acaaacccccatgaca

SEQ ID NO: 23617 - DNA, 16 bp, H. sapiens
acaaaccctcatgaca

SEQ ID NO: 23618 - DNA, 22 bp, H. sapiens
acaaaccctgagctagacacag

SEQ ID NO: 23619 - DNA, 16 bp, H. sapiens
acaaacctagatggca

SEQ ID NO: 23620 - DNA, 16 bp, H. sapiens
acaaacctcttttctt

SEQ ID NO: 23621 - DNA, 16 bp, H. sapiens
acaaacctttaatttg

SEQ ID NO: 23622 - DNA, 16 bp, H. sapiens
acaaactacctgaaaa

SEQ ID NO: 23623 - DNA, 16 bp, H. sapiens
acaaactagaaaatat

SEQ ID NO: 23624 - DNA, 16 bp, H. sapiens
acaaactagaaaatct

SEQ ID NO: 23625 - DNA, 16 bp, H. sapiens
acaaactaggcataaa

SEQ ID NO: 23626 - DNA, 16 bp, H. sapiens
acaaactctggacata

SEQ ID NO: 23627 - DNA, 16 bp, H. sapiens
acaaactgaaaaccaa

SEQ ID NO: 23628 - DNA, 16 bp, H. sapiens
acaaactgaagagaca

SEQ ID NO: 23629 - DNA, 16 bp, H. sapiens
acaaactgacattcta

SEQ ID NO: 23630 - DNA, 16 bp, H. sapiens
acaaactggaaaacct

SEQ ID NO: 23631 - DNA, 16 bp, H. sapiens
acaaactgggcagctt

SEQ ID NO: 23632 - DNA, 16 bp, H. sapiens
acaaactgggtggctc

SEQ ID NO: 23633 - DNA, 16 bp, H. sapiens
acaaacttctttgtga

SEQ ID NO: 23634 - DNA, 16 bp, H. sapiens
acaaacttggagaaaa

SEQ ID NO: 23635 - DNA, 16 bp, H. sapiens
acaaactttaaatcaa

SEQ ID NO: 23636 - DNA, 16 bp, H. sapiens
acaaagaaaaagaggt

SEQ ID NO: 23637 - DNA, 16 bp, H. sapiens
acaaagaaaaatattt

SEQ ID NO: 23638 - DNA, 16 bp, H. sapiens
acaaagaaaagagttt

SEQ ID NO: 23639 - DNA, 16 bp, H. sapiens
acaaagaaaagctcag

SEQ ID NO: 23640 - DNA, 16 bp, H. sapiens
acaaagaaaatgttta

SEQ ID NO: 23641 - DNA, 16 bp, H. sapiens
acaaagaaacaaattt

SEQ ID NO: 23642 - DNA, 16 bp, H. sapiens
acaaagaaacactgga

SEQ ID NO: 23643 - DNA, 16 bp, H. sapiens
acaaagaaactctgga

SEQ ID NO: 23644 - DNA, 16 bp, H. sapiens
acaaagaaaggatcct

SEQ ID NO: 23645 - DNA, 16 bp, H. sapiens
acaaagaaatatttca

SEQ ID NO: 23646 - DNA, 33 bp, H. sapiens
acaaagaaatggaagaacattccatgctcatgg

SEQ ID NO: 23647 - DNA, 16 bp, H. sapiens
acaaagaaatggtaaa

SEQ ID NO: 23648 - DNA, 16 bp, H. sapiens
acaaagaaatgttaaa

SEQ ID NO: 23649 - DNA, 16 bp, H. sapiens
acaaagaaattctgga

SEQ ID NO: 23650 - DNA, 16 bp, H. sapiens
acaaagaaattgaaat

SEQ ID NO: 23651 - DNA, 16 bp, H. sapiens
acaaagaaatttggtt

SEQ ID NO: 23652 - DNA, 16 bp, H. sapiens
acaaagaacccttcaa

SEQ ID NO: 23653 - DNA, 16 bp, H. sapiens
acaaagaactctcaaa

SEQ ID NO: 23654 - DNA, 16 bp, H. sapiens
acaaagaactcttaaa

SEQ ID NO: 23655 - DNA, 16 bp, H. sapiens
acaaagaagaaaactg

SEQ ID NO: 23656 - DNA, 16 bp, H. sapiens
acaaagaagaagtcaa

SEQ ID NO: 23657 - DNA, 16 bp, H. sapiens
acaaagaagaccatta

SEQ ID NO: 23658 - DNA, 16 bp, H. sapiens
acaaagaagagctggt

SEQ ID NO: 23659 - DNA, 47 bp, H. sapiens
acaaagaaggccattacataatggtaaagggatcaattcaacaagag

SEQ ID NO: 23660 - DNA, 16 bp, H. sapiens
acaaagaagtgaaaga

SEQ ID NO: 23661 - DNA, 16 bp, H. sapiens
acaaagaagttgaaaa

SEQ ID NO: 23662 - DNA, 16 bp, H. sapiens
acaaagaagttgctca

SEQ ID NO: 23663 - DNA, 16 bp, H. sapiens
acaaagaattatttgg

SEQ ID NO: 23664 - DNA, 16 bp, H. sapiens
acaaagaattcaaaat

SEQ ID NO: 23665 - DNA, 16 bp, H. sapiens
acaaagaattcttaaa

SEQ ID NO: 23666 - DNA, 16 bp, H. sapiens
acaaagaattttctga

SEQ ID NO: 23667 - DNA, 16 bp, H. sapiens
acaaagacagggcttg

SEQ ID NO: 23668 - DNA, 16 bp, H. sapiens
acaaagagaaaaatct

SEQ ID NO: 23669 - DNA, 16 bp, H. sapiens
acaaagagaatacagc

SEQ ID NO: 23670 - DNA, 16 bp, H. sapiens
acaaagagagaattct

SEQ ID NO: 23671 - DNA, 16 bp, H. sapiens
acaaagagattgaagt

SEQ ID NO: 23672 - DNA, 16 bp, H. sapiens
acaaagaggagctgct

SEQ ID NO: 23673 - DNA, 16 bp, H. sapiens
acaaagataaatattt

SEQ ID NO: 23674 - DNA, 16 bp, H. sapiens
acaaagataataacag

SEQ ID NO: 23675 - DNA, 16 bp, H. sapiens
acaaagataatttaaa

SEQ ID NO: 23676 - DNA, 16 bp, H. sapiens
acaaagatactcagga

SEQ ID NO: 23677 - DNA, 16 bp, H. sapiens
acaaagatattctgga

SEQ ID NO: 23678 - DNA, 16 bp, H. sapiens
acaaagatcaagagag

SEQ ID NO: 23679 - DNA, 16 bp, H. sapiens
acaaagatggcaacaa

SEQ ID NO: 23680 - DNA, 16 bp, H. sapiens
acaaagatgggaagaa

SEQ ID NO: 23681 - DNA, 16 bp, H. sapiens
acaaagattttctcct

SEQ ID NO: 23682 - DNA, 16 bp, H. sapiens
acaaagatttttaaag

SEQ ID NO: 23683 - DNA, 16 bp, H. sapiens
acaaagatttttcttt

SEQ ID NO: 23684 - DNA, 16 bp, H. sapiens
acaaagcaacaataat

SEQ ID NO: 23685 - DNA, 16 bp, H. sapiens
acaaagcaagactctt

SEQ ID NO: 23686 - DNA, 16 bp, H. sapiens
acaaagcagcttctga

SEQ ID NO: 23687 - DNA, 16 bp, H. sapiens
acaaagcagtttccca

SEQ ID NO: 23688 - DNA, 16 bp, H. sapiens
acaaagcattttcaaa

SEQ ID NO: 23689 - DNA, 16 bp, H. sapiens
acaaagccaacagtca

SEQ ID NO: 23690 - DNA, 16 bp, H. sapiens
acaaagccagagacat

SEQ ID NO: 23691 - DNA, 16 bp, H. sapiens
acaaagccatttctca

SEQ ID NO: 23692 - DNA, 16 bp, H. sapiens
acaaagcccccaagaa

SEQ ID NO: 23693 - DNA, 16 bp, H. sapiens
acaaagcctccaaaaa

SEQ ID NO: 23694 - DNA, 16 bp, H. sapiens
acaaagctgacaaaaa

SEQ ID NO: 23695 - DNA, 16 bp, H. sapiens
acaaagctgccaggaa

SEQ ID NO: 23696 - DNA, 16 bp, H. sapiens
acaaagctgtttctca

SEQ ID NO: 23697 - DNA, 16 bp, H. sapiens
acaaagcttctttcta

SEQ ID NO: 23698 - DNA, 16 bp, H. sapiens
acaaagcttttctttt

SEQ ID NO: 23699 - DNA, 16 bp, H. sapiens
acaaaggaaagaagtt

SEQ ID NO: 23700 - DNA, 16 bp, H. sapiens
acaaaggaaaggaaat

SEQ ID NO: 23701 - DNA, 16 bp, H. sapiens
acaaaggaagtgaaag

SEQ ID NO: 23702 - DNA, 16 bp, H. sapiens
acaaaggaatgaagag

SEQ ID NO: 23703 - DNA, 16 bp, H. sapiens
acaaaggaatgtgggg

SEQ ID NO: 23704 - DNA, 16 bp, H. sapiens
acaaaggacatgaatg

SEQ ID NO: 23705 - DNA, 16 bp, H. sapiens
acaaaggactttatta

SEQ ID NO: 23706 - DNA, 16 bp, H. sapiens
acaaaggatctctcag

SEQ ID NO: 23707 - DNA, 16 bp, H. sapiens
acaaaggattagtatc

SEQ ID NO: 23708 - DNA, 16 bp, H. sapiens
acaaaggattcagaat

SEQ ID NO: 23709 - DNA, 16 bp, H. sapiens
acaaaggattttaaaa

SEQ ID NO: 23710 - DNA, 16 bp, H. sapiens
acaaaggcaccaagaa

SEQ ID NO: 23711 - DNA, 16 bp, H. sapiens
acaaaggcagagactg

SEQ ID NO: 23712 - DNA, 16 bp, H. sapiens
acaaaggcatgaatga

SEQ ID NO: 23713 - DNA, 16 bp, H. sapiens
acaaaggccatatatg

SEQ ID NO: 23714 - DNA, 16 bp, H. sapiens
acaaaggcccagagag

SEQ ID NO: 23715 - DNA, 16 bp, H. sapiens
acaaagggaagcctat

SEQ ID NO: 23716 - DNA, 16 bp, H. sapiens
acaaagggatgattta

SEQ ID NO: 23717 - DNA, 16 bp, H. sapiens
acaaagggctaatctc

SEQ ID NO: 23718 - DNA, 16 bp, H. sapiens
acaaagtaaatatttt

SEQ ID NO: 23719 - DNA, 16 bp, H. sapiens
acaaagtaataataat

SEQ ID NO: 23720 - DNA, 16 bp, H. sapiens
acaaagtaattttaaa

SEQ ID NO: 23721 - DNA, 16 bp, H. sapiens
acaaagtatagagaaa

SEQ ID NO: 23722 - DNA, 16 bp, H. sapiens
acaaagtattaatcct

SEQ ID NO: 23723 - DNA, 16 bp, H. sapiens
acaaagtatttatttt

SEQ ID NO: 23724 - DNA, 16 bp, H. sapiens
acaaagtcaagagaca

SEQ ID NO: 23725 - DNA, 16 bp, H. sapiens
acaaagtcatcaaaaa

SEQ ID NO: 23726 - DNA, 16 bp, H. sapiens
acaaagtctctcagca

SEQ ID NO: 23727 - DNA, 16 bp, H. sapiens
acaaagtgaagagaca

SEQ ID NO: 23728 - DNA, 16 bp, H. sapiens
acaaagtgaagataca

SEQ ID NO: 23729 - DNA, 16 bp, H. sapiens
acaaagtgagacctgt

SEQ ID NO: 23730 - DNA, 18 bp, H. sapiens
acaaagtgagactccgtc

SEQ ID NO: 23731 - DNA, 16 bp, H. sapiens
acaaagtggccaggaa

SEQ ID NO: 23732 - DNA, 16 bp, H. sapiens
acaaagtgtgtgtgtg

SEQ ID NO: 23733 - DNA, 16 bp, H. sapiens
acaaagttaacaagga

SEQ ID NO: 23734 - DNA, 16 bp, H. sapiens
acaaagttagctgggt

SEQ ID NO: 23735 - DNA, 16 bp, H. sapiens
acaaagttgacaaaaa

SEQ ID NO: 23736 - DNA, 16 bp, H. sapiens
acaaagtttaatttat

SEQ ID NO: 23737 - DNA, 16 bp, H. sapiens
acaaagtttacaaaaa

SEQ ID NO: 23738 - DNA, 16 bp, H. sapiens
acaaagtttcagttac

SEQ ID NO: 23739 - DNA, 16 bp, H. sapiens
acaaataaaaattgta

SEQ ID NO: 23740 - DNA, 16 bp, H. sapiens
acaaataaatatttgt

SEQ ID NO: 23741 - DNA, 16 bp, H. sapiens
acaaataaatgtttta

SEQ ID NO: 23742 - DNA, 16 bp, H. sapiens
acaaataaattcagta

SEQ ID NO: 23743 - DNA, 16 bp, H. sapiens
acaaataaggaaacag

SEQ ID NO: 23744 - DNA, 16 bp, H. sapiens
acaaataagtgaacaa

SEQ ID NO: 23745 - DNA, 16 bp, H. sapiens
acaaataatcccatca

SEQ ID NO: 23746 - DNA, 16 bp, H. sapiens
acaaatacatacagga

SEQ ID NO: 23747 - DNA, 16 bp, H. sapiens
acaaatacatacattt

SEQ ID NO: 23748 - DNA, 16 bp, H. sapiens
acaaatacattttaca

SEQ ID NO: 23749 - DNA, 16 bp, H. sapiens
acaaatacatttttaa

SEQ ID NO: 23750 - DNA, 16 bp, H. sapiens
acaaataccactgtgt

SEQ ID NO: 23751 - DNA, 16 bp, H. sapiens
acaaatagaaatacat

SEQ ID NO: 23752 - DNA, 16 bp, H. sapiens
acaaatatacacatac

SEQ ID NO: 23753 - DNA, 16 bp, H. sapiens
acaaatatatagatat

SEQ ID NO: 23754 - DNA, 16 bp, H. sapiens
acaaatattaactgag

SEQ ID NO: 23755 - DNA, 16 bp, H. sapiens
acaaatattcagacca

SEQ ID NO: 23756 - DNA, 16 bp, H. sapiens
acaaatattgctgaaa

SEQ ID NO: 23757 - DNA, 16 bp, H. sapiens
acaaatatttaatgag

SEQ ID NO: 23758 - DNA, 16 bp, H. sapiens
acaaatatttacagaa

SEQ ID NO: 23759 - DNA, 16 bp, H. sapiens
acaaatatttactttt

SEQ ID NO: 23760 - DNA, 16 bp, H. sapiens
acaaatatttattggg

SEQ ID NO: 23761 - DNA, 16 bp, H. sapiens
acaaatatttcttaaa

SEQ ID NO: 23762 - DNA, 16 bp, H. sapiens
acaaatatttcttcaa

SEQ ID NO: 23763 - DNA, 16 bp, H. sapiens
acaaatatttctttct

SEQ ID NO: 23764 - DNA, 16 bp, H. sapiens
acaaatattttaaagc

SEQ ID NO: 23765 - DNA, 16 bp, H. sapiens
acaaatattttctatt

SEQ ID NO: 23766 - DNA, 16 bp, H. sapiens
acaaatatttttacat

SEQ ID NO: 23767 - DNA, 16 bp, H. sapiens
acaaatcaacaagcaa

SEQ ID NO: 23768 - DNA, 16 bp, H. sapiens
acaaatcagcaagcaa

SEQ ID NO: 23769 - DNA, 16 bp, H. sapiens
acaaatctcatctcaa

SEQ ID NO: 23770 - DNA, 16 bp, H. sapiens
acaaatctgcacatat

SEQ ID NO: 23771 - DNA, 16 bp, H. sapiens
acaaatctggaagcat

SEQ ID NO: 23772 - DNA, 16 bp, H. sapiens
acaaatgaaaatcaat

SEQ ID NO: 23773 - DNA, 16 bp, H. sapiens
acaaatgaaaatgaat

SEQ ID NO: 23774 - DNA, 16 bp, H. sapiens
acaaatgaacaagcaa

SEQ ID NO: 23775 - DNA, 16 bp, H. sapiens
acaaatgaagaaacta

SEQ ID NO: 23776 - DNA, 16 bp, H. sapiens
acaaatgaagaaactg

SEQ ID NO: 23777 - DNA, 16 bp, H. sapiens
acaaatgaatgaatag

SEQ ID NO: 23778 - DNA, 16 bp, H. sapiens
acaaatgacaaaatgg

SEQ ID NO: 23779 - DNA, 16 bp, H. sapiens
acaaatgacaagattt

SEQ ID NO: 23780 - DNA, 16 bp, H. sapiens
acaaatgacagtattt

SEQ ID NO: 23781 - DNA, 16 bp, H. sapiens
acaaatgacattcttc

SEQ ID NO: 23782 - DNA, 16 bp, H. sapiens
acaaatgaccaacaaa

SEQ ID NO: 23783 - DNA, 16 bp, H. sapiens
acaaatgaccacaaac

SEQ ID NO: 23784 - DNA, 16 bp, H. sapiens
acaaatgaggaaacaa

SEQ ID NO: 23785 - DNA, 16 bp, H. sapiens
acaaatgagtaaataa

SEQ ID NO: 23786 - DNA, 16 bp, H. sapiens
acaaatgagtaaatga

SEQ ID NO: 23787 - DNA, 16 bp, H. sapiens
acaaatgataaaaatt

SEQ ID NO: 23788 - DNA, 16 bp, H. sapiens
acaaatgatattggga

SEQ ID NO: 23789 - DNA, 16 bp, H. sapiens
acaaatgatgctgaaa

SEQ ID NO: 23790 - DNA, 16 bp, H. sapiens
acaaatgatgctgaga

SEQ ID NO: 23791 - DNA, 16 bp, H. sapiens
acaaatgctgctgtct

SEQ ID NO: 23792 - DNA, 16 bp, H. sapiens
acaaatgctgtgtgat

SEQ ID NO: 23793 - DNA, 16 bp, H. sapiens
acaaatggaaaaacat

SEQ ID NO: 23794 - DNA, 16 bp, H. sapiens
acaaatggaaaaacgt

SEQ ID NO: 23795 - DNA, 16 bp, H. sapiens
acaaatggaaaaatgt

SEQ ID NO: 23796 - DNA, 16 bp, H. sapiens
acaaatggaaaataat

SEQ ID NO: 23797 - DNA, 16 bp, H. sapiens
acaaatggaaaccaaa

SEQ ID NO: 23798 - DNA, 16 bp, H. sapiens
acaaatggaaagatat

SEQ ID NO: 23799 - DNA, 16 bp, H. sapiens
acaaatggaagaaaat

SEQ ID NO: 23800 - DNA, 16 bp, H. sapiens
acaaatggaagtcaaa

SEQ ID NO: 23801 - DNA, 16 bp, H. sapiens
acaaatggagagatat

SEQ ID NO: 23802 - DNA, 16 bp, H. sapiens
acaaatggataactca

SEQ ID NO: 23803 - DNA, 16 bp, H. sapiens
acaaatggatgtggct

SEQ ID NO: 23804 - DNA, 16 bp, H. sapiens
acaaatggcaaataag

SEQ ID NO: 23805 - DNA, 16 bp, H. sapiens
acaaatggcactggga

SEQ ID NO: 23806 - DNA, 16 bp, H. sapiens
acaaatggccaacagg

SEQ ID NO: 23807 - DNA, 16 bp, H. sapiens
acaaatgggaaaatta

SEQ ID NO: 23808 - DNA, 16 bp, H. sapiens
acaaatgggaaataaa

SEQ ID NO: 23809 - DNA, 16 bp, H. sapiens
acaaatgggatataat

SEQ ID NO: 23810 - DNA, 16 bp, H. sapiens
acaaatgggcaaaaga

SEQ ID NO: 23811 - DNA, 19 bp, H. sapiens
acaaatggtatctaattaa

SEQ ID NO: 23812 - DNA, 16 bp, H. sapiens
acaaatggtggtggga

SEQ ID NO: 23813 - DNA, 16 bp, H. sapiens
acaaatggtttttggt

SEQ ID NO: 23814 - DNA, 16 bp, H. sapiens
acaaatgtaaaatgta

SEQ ID NO: 23815 - DNA, 16 bp, H. sapiens
acaaatgtaattttat

SEQ ID NO: 23816 - DNA, 16 bp, H. sapiens
acaaatgtactgtact

SEQ ID NO: 23817 - DNA, 16 bp, H. sapiens
acaaatgtatatttat

SEQ ID NO: 23818 - DNA, 16 bp, H. sapiens
acaaatgtgtttttct

SEQ ID NO: 23819 - DNA, 16 bp, H. sapiens
acaaatgttggcaaag

SEQ ID NO: 23820 - DNA, 16 bp, H. sapiens
acaaatgttggtgaga

SEQ ID NO: 23821 - DNA, 16 bp, H. sapiens
acaaatgtttattgag

SEQ ID NO: 23822 - DNA, 16 bp, H. sapiens
acaaatgtttattggg

SEQ ID NO: 23823 - DNA, 19 bp, H. sapiens
acaaatgtttcttctaaca

SEQ ID NO: 23824 - DNA, 16 bp, H. sapiens
acaaatgttttcattt

SEQ ID NO: 23825 - DNA, 16 bp, H. sapiens
acaaatgtttttaaaa

SEQ ID NO: 23826 - DNA, 16 bp, H. sapiens
acaaatgtttttaaat

SEQ ID NO: 23827 - DNA, 16 bp, H. sapiens
acaaattaaatgcaat

SEQ ID NO: 23828 - DNA, 16 bp, H. sapiens
acaaattaacaagcaa

SEQ ID NO: 23829 - DNA, 16 bp, H. sapiens
acaaattaagaaactg

SEQ ID NO: 23830 - DNA, 16 bp, H. sapiens
acaaattaccataaat

SEQ ID NO: 23831 - DNA, 16 bp, H. sapiens
acaaattaccccaaat

SEQ ID NO: 23832 - DNA, 16 bp, H. sapiens
acaaattacccccaaa

SEQ ID NO: 23833 - DNA, 16 bp, H. sapiens
acaaattactgcaaat

SEQ ID NO: 23834 - DNA, 16 bp, H. sapiens
acaaattacttgaaaa

SEQ ID NO: 23835 - DNA, 16 bp, H. sapiens
acaaattagcctggca

SEQ ID NO: 23836 - DNA, 16 bp, H. sapiens
acaaattagttatata

SEQ ID NO: 23837 - DNA, 16 bp, H. sapiens
acaaattcaagaagct

SEQ ID NO: 23838 - DNA, 16 bp, H. sapiens
acaaattcacagccaa

SEQ ID NO: 23839 - DNA, 16 bp, H. sapiens
acaaattcagaaaagt

SEQ ID NO: 23840 - DNA, 16 bp, H. sapiens
acaaattcagtaaagc

SEQ ID NO: 23841 - DNA, 16 bp, H. sapiens
acaaattccttgaaaa

SEQ ID NO: 23842 - DNA, 16 bp, H. sapiens
acaaattgaagatttg

SEQ ID NO: 23843 - DNA, 16 bp, H. sapiens
acaaattgaagttttg

SEQ ID NO: 23844 - DNA, 16 bp, H. sapiens
acaaattgacaaccta

SEQ ID NO: 23845 - DNA, 16 bp, H. sapiens
acaaattgatgtggat

SEQ ID NO: 23846 - DNA, 16 bp, H. sapiens
acaaattggaaaatct

SEQ ID NO: 23847 - DNA, 16 bp, H. sapiens
acaaattgggtcattc

SEQ ID NO: 23848 - DNA, 16 bp, H. sapiens
acaaattgtgtttgct

SEQ ID NO: 23849 - DNA, 16 bp, H. sapiens
acaaatttaaaaatgt

SEQ ID NO: 23850 - DNA, 16 bp, H. sapiens
acaaatttaaatagaa

SEQ ID NO: 23851 - DNA, 16 bp, H. sapiens
acaaatttatcatttt

SEQ ID NO: 23852 - DNA, 16 bp, H. sapiens
acaaatttattatctt

SEQ ID NO: 23853 - DNA, 16 bp, H. sapiens
acaaatttcaacatga

SEQ ID NO: 23854 - DNA, 16 bp, H. sapiens
acaaatttggaaaaaa

SEQ ID NO: 23855 - DNA, 16 bp, H. sapiens
acaaatttgtgtgtgt

SEQ ID NO: 23856 - DNA, 16 bp, H. sapiens
acaaatttgtttttat

SEQ ID NO: 23857 - DNA, 16 bp, H. sapiens
acaaattttccaaatt

SEQ ID NO: 23858 - DNA, 16 bp, H. sapiens
acaaattttcttttct

SEQ ID NO: 23859 - DNA, 16 bp, H. sapiens
acaaatttttgttgtt

SEQ ID NO: 23860 - DNA, 16 bp, H. sapiens
acaacaaaaaatagtt

SEQ ID NO: 23861 - DNA, 16 bp, H. sapiens
acaacaaaataaggca

SEQ ID NO: 23862 - DNA, 16 bp, H. sapiens
acaacaaaattatttt

SEQ ID NO: 23863 - DNA, 16 bp, H. sapiens
acaacaaacaccaggg

SEQ ID NO: 23864 - DNA, 16 bp, H. sapiens
acaacaaagaattatc

SEQ ID NO: 23865 - DNA, 16 bp, H. sapiens
acaacaacaaaaagct

SEQ ID NO: 23866 - DNA, 16 bp, H. sapiens
acaacaacaaaaagtc

SEQ ID NO: 23867 - DNA, 16 bp, H. sapiens
acaacaacaaaacagt

SEQ ID NO: 23868 - DNA, 16 bp, H. sapiens
acaacaacaaaacatg

SEQ ID NO: 23869 - DNA, 16 bp, H. sapiens
acaacaacaaaagctt

SEQ ID NO: 23870 - DNA, 16 bp, H. sapiens
acaacaacaaaagtat

SEQ ID NO: 23871 - DNA, 16 bp, H. sapiens
acaacaacaaaatcag

SEQ ID NO: 23872 - DNA, 16 bp, H. sapiens
acaacaacaaaatgcc

SEQ ID NO: 23873 - DNA, 16 bp, H. sapiens
acaacaacaaaatgtt

SEQ ID NO: 23874 - DNA, 16 bp, H. sapiens
acaacaacaaatgctg

SEQ ID NO: 23875 - DNA, 16 bp, H. sapiens
acaacaacaagaaatg

SEQ ID NO: 23876 - DNA, 16 bp, H. sapiens
acaacaacagcagcag

SEQ ID NO: 23877 - DNA, 16 bp, H. sapiens
acaacaacagcatcaa

SEQ ID NO: 23878 - DNA, 16 bp, H. sapiens
acaacaacatttattt

SEQ ID NO: 23879 - DNA, 16 bp, H. sapiens
acaacaactttttaag

SEQ ID NO: 23880 - DNA, 16 bp, H. sapiens
acaacaagtgggaatt

SEQ ID NO: 23881 - DNA, 16 bp, H. sapiens
acaacaatatgaatgt

SEQ ID NO: 23882 - DNA, 16 bp, H. sapiens
acaacaatgaaatttg

SEQ ID NO: 23883 - DNA, 16 bp, H. sapiens
acaacacaaggatgcc

SEQ ID NO: 23884 - DNA, 16 bp, H. sapiens
acaacacagggagact

SEQ ID NO: 23885 - DNA, 16 bp, H. sapiens
acaacacaggtttgaa

SEQ ID NO: 23886 - DNA, 16 bp, H. sapiens
acaacacccaagtcct

SEQ ID NO: 23887 - DNA, 16 bp, H. sapiens
acaacagaaatttatt

SEQ ID NO: 23888 - DNA, 16 bp, H. sapiens
acaacagagtgagacc

SEQ ID NO: 23889 - DNA, 16 bp, H. sapiens
acaacagatactggag

SEQ ID NO: 23890 - DNA, 16 bp, H. sapiens
acaacagatataataa

SEQ ID NO: 23891 - DNA, 16 bp, H. sapiens
acaacagatgaatgaa

SEQ ID NO: 23892 - DNA, 16 bp, H. sapiens
acaacagatgctgaag

SEQ ID NO: 23893 - DNA, 16 bp, H. sapiens
acaacagatgctgcag

SEQ ID NO: 23894 - DNA, 16 bp, H. sapiens
acaacagcaataacaa

SEQ ID NO: 23895 - DNA, 16 bp, H. sapiens
acaacagcagagctga

SEQ ID NO: 23896 - DNA, 16 bp, H. sapiens
acaacagcagagttga

SEQ ID NO: 23897 - DNA, 19 bp, H. sapiens
acaacagcagcagcagcaa

SEQ ID NO: 23898 - DNA, 16 bp, H. sapiens
acaacaggcctcagtg

SEQ ID NO: 23899 - DNA, 16 bp, H. sapiens
acaacaggtgtactat

SEQ ID NO: 23900 - DNA, 16 bp, H. sapiens
acaacagtgaagtttg

SEQ ID NO: 23901 - DNA, 16 bp, H. sapiens
acaacatacagaatgg

SEQ ID NO: 23902 - DNA, 16 bp, H. sapiens
acaacatagcagaatc

SEQ ID NO: 23903 - DNA, 16 bp, H. sapiens
acaacatgatgaacct

SEQ ID NO: 23904 - DNA, 16 bp, H. sapiens
acaacatgcagaatgg

SEQ ID NO: 23905 - DNA, 16 bp, H. sapiens
acaacatgcaggttta

SEQ ID NO: 23906 - DNA, 16 bp, H. sapiens
acaacatggacaaatc

SEQ ID NO: 23907 - DNA, 16 bp, H. sapiens
acaacatggcgaaacc

SEQ ID NO: 23908 - DNA, 16 bp, H. sapiens
acaacattaatccatt

SEQ ID NO: 23909 - DNA, 16 bp, H. sapiens
acaacattttgggagg

SEQ ID NO: 23910 - DNA, 16 bp, H. sapiens
acaacattttttaaat

SEQ ID NO: 23911 - DNA, 16 bp, H. sapiens
acaacattttttttaa

SEQ ID NO: 23912 - DNA, 16 bp, H. sapiens
acaaccaaaaatgtct

SEQ ID NO: 23913 - DNA, 16 bp, H. sapiens
acaaccaaaaatgttt

SEQ ID NO: 23914 - DNA, 16 bp, H. sapiens
acaaccaacagaatga

SEQ ID NO: 23915 - DNA, 16 bp, H. sapiens
acaaccacgcccagct

SEQ ID NO: 23916 - DNA, 16 bp, H. sapiens
acaaccagatcccatg

SEQ ID NO: 23917 - DNA, 16 bp, H. sapiens
acaaccagatctcacg

SEQ ID NO: 23918 - DNA, 16 bp, H. sapiens
acaaccagcctggcca

SEQ ID NO: 23919 - DNA, 16 bp, H. sapiens
acaaccatgtgatctt

SEQ ID NO: 23920 - DNA, 16 bp, H. sapiens
acaaccattgtggaag

SEQ ID NO: 23921 - DNA, 16 bp, H. sapiens
acaaccattttggaaa

SEQ ID NO: 23922 - DNA, 16 bp, H. sapiens
acaacccaatagaaaa

SEQ ID NO: 23923 - DNA, 16 bp, H. sapiens
acaacctaatgtcaca

SEQ ID NO: 23924 - DNA, 16 bp, H. sapiens
acaacctcaccagcat

SEQ ID NO: 23925 - DNA, 16 bp, H. sapiens
acaacctcatcaacaa

SEQ ID NO: 23926 - DNA, 16 bp, H. sapiens
acaacctctgcttccc

SEQ ID NO: 23927 - DNA, 16 bp, H. sapiens
acaacctgctcctgga

SEQ ID NO: 23928 - DNA, 16 bp, H. sapiens
acaaccttccagtgtg

SEQ ID NO: 23929 - DNA, 16 bp, H. sapiens
acaactactatggaga

SEQ ID NO: 23930 - DNA, 17 bp, H. sapiens
acaactccagtgacctg

SEQ ID NO: 23931 - DNA, 18 bp, H. sapiens
acaactcctttccttcct

SEQ ID NO: 23932 - DNA, 16 bp, H. sapiens
acaactctataaatat

SEQ ID NO: 23933 - DNA, 16 bp, H. sapiens
acaactctcctagctt

SEQ ID NO: 23934 - DNA, 16 bp, H. sapiens
acaactctggaggctg

SEQ ID NO: 23935 - DNA, 16 bp, H. sapiens
acaactctgtgtgtgt

SEQ ID NO: 23936 - DNA, 16 bp, H. sapiens
acaactgaggaaactg

SEQ ID NO: 23937 - DNA, 16 bp, H. sapiens
acaactgcagaatgta

SEQ ID NO: 23938 - DNA, 16 bp, H. sapiens
acaactgcaggaataa

SEQ ID NO: 23939 - DNA, 16 bp, H. sapiens
acaactgctacaaaaa

SEQ ID NO: 23940 - DNA, 16 bp, H. sapiens
acaactggcagtgcag

SEQ ID NO: 23941 - DNA, 16 bp, H. sapiens
acaacttaggcaatac

SEQ ID NO: 23942 - DNA, 16 bp, H. sapiens
acaactttgaagagag

SEQ ID NO: 23943 - DNA, 16 bp, H. sapiens
acaacttttaaaaagt

SEQ ID NO: 23944 - DNA, 16 bp, H. sapiens
acaacttttatatgca

SEQ ID NO: 23945 - DNA, 16 bp, H. sapiens
acaagaaaactacaga

SEQ ID NO: 23946 - DNA, 16 bp, H. sapiens
acaagaaaattataga

SEQ ID NO: 23947 - DNA, 16 bp, H. sapiens
acaagaaacacatttc

SEQ ID NO: 23948 - DNA, 16 bp, H. sapiens
acaagaaagaattcag

SEQ ID NO: 23949 - DNA, 16 bp, H. sapiens
acaagaaagtcaatgt

SEQ ID NO: 23950 - DNA, 16 bp, H. sapiens
acaagaaatagtatca

SEQ ID NO: 23951 - DNA, 16 bp, H. sapiens
acaagaacagcaaagg

SEQ ID NO: 23952 - DNA, 16 bp, H. sapiens
acaagaacagtatggg

SEQ ID NO: 23953 - DNA, 16 bp, H. sapiens
acaagaagagcatggg

SEQ ID NO: 23954 - DNA, 16 bp, H. sapiens
acaagaagaggaaatt

SEQ ID NO: 23955 - DNA, 16 bp, H. sapiens
acaagaaggtcaaaga

SEQ ID NO: 23956 - DNA, 16 bp, H. sapiens
acaagaagtgctaact

SEQ ID NO: 23957 - DNA, 16 bp, H. sapiens
acaagaataagtacac

SEQ ID NO: 23958 - DNA, 16 bp, H. sapiens
acaagaatgaaactct

SEQ ID NO: 23959 - DNA, 16 bp, H. sapiens
acaagaatgaaattcc

SEQ ID NO: 23960 - DNA, 16 bp, H. sapiens
acaagaatgtttatag

SEQ ID NO: 23961 - DNA, 16 bp, H. sapiens
acaagaattgcttgaa

SEQ ID NO: 23962 - DNA, 16 bp, H. sapiens
acaagaatttaaaaat

SEQ ID NO: 23963 - DNA, 16 bp, H. sapiens
acaagacaagaatgcc

SEQ ID NO: 23964 - DNA, 16 bp, H. sapiens
acaagacaaggatgcc

SEQ ID NO: 23965 - DNA, 16 bp, H. sapiens
acaagacaaggatgtc

SEQ ID NO: 23966 - DNA, 16 bp, H. sapiens
acaagaccctgcctca

SEQ ID NO: 23967 - DNA, 16 bp, H. sapiens
acaagacctccaggtg

SEQ ID NO: 23968 - DNA, 22 bp, H. sapiens
acaagacctcccttcagcttaa

SEQ ID NO: 23969 - DNA, 16 bp, H. sapiens
acaagactaataaaga

SEQ ID NO: 23970 - DNA, 16 bp, H. sapiens
acaagagaaagatgaa

SEQ ID NO: 23971 - DNA, 16 bp, H. sapiens
acaagagaaagcagca

SEQ ID NO: 23972 - DNA, 16 bp, H. sapiens
acaagagaaggaaata

SEQ ID NO: 23973 - DNA, 16 bp, H. sapiens
acaagagcaaaactat

SEQ ID NO: 23974 - DNA, 16 bp, H. sapiens
acaagagcaagactcc

SEQ ID NO: 23975 - DNA, 16 bp, H. sapiens
acaagagcagctaaaa

SEQ ID NO: 23976 - DNA, 17 bp, H. sapiens
acaagagcagggcattt

SEQ ID NO: 23977 - DNA, 16 bp, H. sapiens
acaagagcgagactcc

SEQ ID NO: 23978 - DNA, 16 bp, H. sapiens
acaagagcgagactgt

SEQ ID NO: 23979 - DNA, 16 bp, H. sapiens
acaagaggaattttga

SEQ ID NO: 23980 - DNA, 16 bp, H. sapiens
acaagagtaaaactgt

SEQ ID NO: 23981 - DNA, 16 bp, H. sapiens
acaagagtgaaagtct

SEQ ID NO: 23982 - DNA, 16 bp, H. sapiens
acaagagtgaagctcc

SEQ ID NO: 23983 - DNA, 16 bp, H. sapiens
acaagagtgagactcc

SEQ ID NO: 23984 - DNA, 16 bp, H. sapiens
acaagagtgccaagac

SEQ ID NO: 23985 - DNA, 16 bp, H. sapiens
acaagagtttccttgt

SEQ ID NO: 23986 - DNA, 16 bp, H. sapiens
acaagataaagatgcc

SEQ ID NO: 23987 - DNA, 16 bp, H. sapiens
acaagatgcagatgaa

SEQ ID NO: 23988 - DNA, 16 bp, H. sapiens
acaagatggaaataaa

SEQ ID NO: 23989 - DNA, 16 bp, H. sapiens
acaagatttagaatct

SEQ ID NO: 23990 - DNA, 16 bp, H. sapiens
acaagatttattgcaa

SEQ ID NO: 23991 - DNA, 16 bp, H. sapiens
acaagattttcatgta

SEQ ID NO: 23992 - DNA, 16 bp, H. sapiens
acaagattttttaaaa

SEQ ID NO: 23993 - DNA, 16 bp, H. sapiens
acaagcaaatgctaag

SEQ ID NO: 23994 - DNA, 32 bp, H. sapiens
acaagcaaatgctgagagattttgtcaccacg

SEQ ID NO: 23995 - DNA, 16 bp, H. sapiens
acaagcaaatggaaaa

SEQ ID NO: 23996 - DNA, 16 bp, H. sapiens
acaagcaacttcagca

SEQ ID NO: 23997 - DNA, 16 bp, H. sapiens
acaagcaagctgggag

SEQ ID NO: 23998 - DNA, 16 bp, H. sapiens
acaagcaatggggaag

SEQ ID NO: 23999 - DNA, 16 bp, H. sapiens
acaagcagaaagccaa

SEQ ID NO: 24000 - DNA, 16 bp, H. sapiens
acaagcagagagcaaa

SEQ ID NO: 24001 - DNA, 16 bp, H. sapiens
acaagcagattctaaa

SEQ ID NO: 24002 - DNA, 16 bp, H. sapiens
acaagcagcgagattg

SEQ ID NO: 24003 - DNA, 16 bp, H. sapiens
acaagcaggaagtgaa

SEQ ID NO: 24004 - DNA, 16 bp, H. sapiens
acaagcaggagacaga

SEQ ID NO: 24005 - DNA, 16 bp, H. sapiens
acaagcatgagccatg

SEQ ID NO: 24006 - DNA, 16 bp, H. sapiens
acaagcatttattgaa

SEQ ID NO: 24007 - DNA, 16 bp, H. sapiens
acaagcatttattttt

SEQ ID NO: 24008 - DNA, 16 bp, H. sapiens
acaagcccagtgggcc

SEQ ID NO: 24009 - DNA, 18 bp, H. sapiens
acaagcccggctaatttt

SEQ ID NO: 24010 - DNA, 16 bp, H. sapiens
acaagccttatttacc

SEQ ID NO: 24011 - DNA, 16 bp, H. sapiens
acaagctcagccacag

SEQ ID NO: 24012 - DNA, 16 bp, H. sapiens
acaagctccacctcct

SEQ ID NO: 24013 - DNA, 16 bp, H. sapiens
acaagctcccagggga

SEQ ID NO: 24014 - DNA, 16 bp, H. sapiens
acaagctccctggtga

SEQ ID NO: 24015 - DNA, 17 bp, H. sapiens
acaagctctctttgcct

SEQ ID NO: 24016 - DNA, 16 bp, H. sapiens
acaagctctgcttttt

SEQ ID NO: 24017 - DNA, 16 bp, H. sapiens
acaagctgactgaaga

SEQ ID NO: 24018 - DNA, 16 bp, H. sapiens
acaagctgtgcagcct

SEQ ID NO: 24019 - DNA, 16 bp, H. sapiens
acaagctgtgtgactt

SEQ ID NO: 24020 - DNA, 17 bp, H. sapiens
acaagctgttccagtat

SEQ ID NO: 24021 - DNA, 16 bp, H. sapiens
acaaggaaaactgcaa

SEQ ID NO: 24022 - DNA, 16 bp, H. sapiens
acaaggaaacaaattc

SEQ ID NO: 24023 - DNA, 16 bp, H. sapiens
acaaggaaacatcaga

SEQ ID NO: 24024 - DNA, 16 bp, H. sapiens
acaaggaaagaaaact

SEQ ID NO: 24025 - DNA, 16 bp, H. sapiens
acaaggaaatcaaaca

SEQ ID NO: 24026 - DNA, 16 bp, H. sapiens
acaaggaaattatgga

SEQ ID NO: 24027 - DNA, 16 bp, H. sapiens
acaaggaagaaattaa

SEQ ID NO: 24028 - DNA, 16 bp, H. sapiens
acaaggaagaaattga

SEQ ID NO: 24029 - DNA, 16 bp, H. sapiens
acaaggaagctaaaaa

SEQ ID NO: 24030 - DNA, 16 bp, H. sapiens
acaaggacaccaagtt

SEQ ID NO: 24031 - DNA, 16 bp, H. sapiens
acaaggacatgaatac

SEQ ID NO: 24032 - DNA, 16 bp, H. sapiens
acaaggaggagctgtt

SEQ ID NO: 24033 - DNA, 16 bp, H. sapiens
acaaggatattcaaga

SEQ ID NO: 24034 - DNA, 16 bp, H. sapiens
acaaggatgccatctc

SEQ ID NO: 24035 - DNA, 16 bp, H. sapiens
acaaggcaaaaccctg

SEQ ID NO: 24036 - DNA, 16 bp, H. sapiens
acaaggcaaagatgcc

SEQ ID NO: 24037 - DNA, 16 bp, H. sapiens
acaaggcaccaagtcc

SEQ ID NO: 24038 - DNA, 16 bp, H. sapiens
acaaggcctctgaagt

SEQ ID NO: 24039 - DNA, 16 bp, H. sapiens
acaaggctggaggcat

SEQ ID NO: 24040 - DNA, 16 bp, H. sapiens
acaaggggcttttccc

SEQ ID NO: 24041 - DNA, 16 bp, H. sapiens
acaaggtaggtcagag

SEQ ID NO: 24042 - DNA, 16 bp, H. sapiens
acaaggtctctgtcac

SEQ ID NO: 24043 - DNA, 16 bp, H. sapiens
acaaggtcttgctatg

SEQ ID NO: 24044 - DNA, 16 bp, H. sapiens
acaaggtgaagtccca

SEQ ID NO: 24045 - DNA, 16 bp, H. sapiens
acaaggtgactcagag

SEQ ID NO: 24046 - DNA, 16 bp, H. sapiens
acaaggttgttgtgag

SEQ ID NO: 24047 - DNA, 16 bp, H. sapiens
acaaggtttccccatg

SEQ ID NO: 24048 - DNA, 16 bp, H. sapiens
acaagtaaataaatac

SEQ ID NO: 24049 - DNA, 16 bp, H. sapiens
acaagtacaaaaatta

SEQ ID NO: 24050 - DNA, 16 bp, H. sapiens
acaagtatgtggaaat

SEQ ID NO: 24051 - DNA, 16 bp, H. sapiens
acaagtatttgtttga

SEQ ID NO: 24052 - DNA, 16 bp, H. sapiens
acaagtcaaggatgcc

SEQ ID NO: 24053 - DNA, 16 bp, H. sapiens
acaagtccttagagac

SEQ ID NO: 24054 - DNA, 16 bp, H. sapiens
acaagtggaaaaacat

SEQ ID NO: 24055 - DNA, 16 bp, H. sapiens
acaagtggaaacacat

SEQ ID NO: 24056 - DNA, 16 bp, H. sapiens
acaagtggagcctgaa

SEQ ID NO: 24057 - DNA, 16 bp, H. sapiens
acaagtggcaaacagg

SEQ ID NO: 24058 - DNA, 16 bp, H. sapiens
acaagtgtgcgccacc

SEQ ID NO: 24059 - DNA, 16 bp, H. sapiens
acaagttaagggcaag

SEQ ID NO: 24060 - DNA, 16 bp, H. sapiens
acaagttatctgtgaa

SEQ ID NO: 24061 - DNA, 17 bp, H. sapiens
acaagttgagagaagaa

SEQ ID NO: 24062 - DNA, 16 bp, H. sapiens
acaagttgtttaattt

SEQ ID NO: 24063 - DNA, 16 bp, H. sapiens
acaagtttatttaaaa

SEQ ID NO: 24064 - DNA, 16 bp, H. sapiens
acaataaaaataagtg

SEQ ID NO: 24065 - DNA, 16 bp, H. sapiens
acaataaaatgttaat

SEQ ID NO: 24066 - DNA, 16 bp, H. sapiens
acaataaaattgaaat

SEQ ID NO: 24067 - DNA, 16 bp, H. sapiens
acaataaaccagtaaa

SEQ ID NO: 24068 - DNA, 16 bp, H. sapiens
acaataaactcatttt

SEQ ID NO: 24069 - DNA, 16 bp, H. sapiens
acaataaagcaaatca

SEQ ID NO: 24070 - DNA, 16 bp, H. sapiens
acaataaatatgtatt

SEQ ID NO: 24071 - DNA, 16 bp, H. sapiens
acaataaatcattttt

SEQ ID NO: 24072 - DNA, 16 bp, H. sapiens
acaataaatgtttgtt

SEQ ID NO: 24073 - DNA, 16 bp, H. sapiens
acaataactagtaata

SEQ ID NO: 24074 - DNA, 16 bp, H. sapiens
acaataactgaaatta

SEQ ID NO: 24075 - DNA, 16 bp, H. sapiens
acaataagatccaggc

SEQ ID NO: 24076 - DNA, 17 bp, H. sapiens
acaataaggtccaggct

SEQ ID NO: 24077 - DNA, 16 bp, H. sapiens
acaataataaacccat

SEQ ID NO: 24078 - DNA, 16 bp, H. sapiens
acaataataacaatga

SEQ ID NO: 24079 - DNA, 16 bp, H. sapiens
acaataatacctacct

SEQ ID NO: 24080 - DNA, 16 bp, H. sapiens
acaataatatattgta

SEQ ID NO: 24081 - DNA, 16 bp, H. sapiens
acaataatcatgggag

SEQ ID NO: 24082 - DNA, 16 bp, H. sapiens
acaataatttgttaat

SEQ ID NO: 24083 - DNA, 16 bp, H. sapiens
acaatacctaggaata

SEQ ID NO: 24084 - DNA, 16 bp, H. sapiens
acaatacgtgcactgc

SEQ ID NO: 24085 - DNA, 16 bp, H. sapiens
acaatactgttaacta

SEQ ID NO: 24086 - DNA, 16 bp, H. sapiens
acaatagaaaatatta

SEQ ID NO: 24087 - DNA, 16 bp, H. sapiens
acaatagaaatgtatt

SEQ ID NO: 24088 - DNA, 16 bp, H. sapiens
acaatagacatttatt

SEQ ID NO: 24089 - DNA, 16 bp, H. sapiens
acaatagatgcagaaa

SEQ ID NO: 24090 - DNA, 16 bp, H. sapiens
acaatagcaaaaatgt

SEQ ID NO: 24091 - DNA, 24 bp, H. sapiens
acaatagcaaagacttggaaccaa

SEQ ID NO: 24092 - DNA, 16 bp, H. sapiens
acaatagccaaaagtg

SEQ ID NO: 24093 - DNA, 16 bp, H. sapiens
acaatagccaagattt

SEQ ID NO: 24094 - DNA, 16 bp, H. sapiens
acaatatacatttttt

SEQ ID NO: 24095 - DNA, 16 bp, H. sapiens
acaatatattcatgta

SEQ ID NO: 24096 - DNA, 16 bp, H. sapiens
acaatatcacaggggt

SEQ ID NO: 24097 - DNA, 16 bp, H. sapiens
acaatatcacctttct

SEQ ID NO: 24098 - DNA, 16 bp, H. sapiens
acaatatgaaaaatat

SEQ ID NO: 24099 - DNA, 21 bp, H. sapiens
acaatatgaaatcagtgcacc

SEQ ID NO: 24100 - DNA, 16 bp, H. sapiens
acaatatgaacctgtg

SEQ ID NO: 24101 - DNA, 16 bp, H. sapiens
acaatatggtgaaacc

SEQ ID NO: 24102 - DNA, 16 bp, H. sapiens
acaatatgtaaacaaa

SEQ ID NO: 24103 - DNA, 16 bp, H. sapiens
acaatatgtaaatgaa

SEQ ID NO: 24104 - DNA, 16 bp, H. sapiens
acaatattattatcta

SEQ ID NO: 24105 - DNA, 16 bp, H. sapiens
acaatattgattcttc

SEQ ID NO: 24106 - DNA, 16 bp, H. sapiens
acaatattgatttttc

SEQ ID NO: 24107 - DNA, 16 bp, H. sapiens
acaatattgtcttcta

SEQ ID NO: 24108 - DNA, 16 bp, H. sapiens
acaatatttcatttaa

SEQ ID NO: 24109 - DNA, 16 bp, H. sapiens
acaatcaaaaattcag

SEQ ID NO: 24110 - DNA, 16 bp, H. sapiens
acaatcaacaaaatga

SEQ ID NO: 24111 - DNA, 16 bp, H. sapiens
acaatcaacaaagcaa

SEQ ID NO: 24112 - DNA, 16 bp, H. sapiens
acaatcaatttgtaca

SEQ ID NO: 24113 - DNA, 16 bp, H. sapiens
acaatcagaaattgaa

SEQ ID NO: 24114 - DNA, 17 bp, H. sapiens
acaatcatgcccttcca

SEQ ID NO: 24115 - DNA, 16 bp, H. sapiens
acaatcatggcggaag

SEQ ID NO: 24116 - DNA, 16 bp, H. sapiens
acaatcatggctcact

SEQ ID NO: 24117 - DNA, 16 bp, H. sapiens
acaatcatggtggaag

SEQ ID NO: 24118 - DNA, 16 bp, H. sapiens
acaatccaattgtact

SEQ ID NO: 24119 - DNA, 16 bp, H. sapiens
acaatccacagagtgg

SEQ ID NO: 24120 - DNA, 16 bp, H. sapiens
acaatcctcagcaaat

SEQ ID NO: 24121 - DNA, 16 bp, H. sapiens
acaatcggtaccagcc

SEQ ID NO: 24122 - DNA, 16 bp, H. sapiens
acaatcgtgtcatctg

SEQ ID NO: 24123 - DNA, 16 bp, H. sapiens
acaatctcaactcact

SEQ ID NO: 24124 - DNA, 18 bp, H. sapiens
acaatctcagctcactgt

SEQ ID NO: 24125 - DNA, 16 bp, H. sapiens
acaatctcatttacaa

SEQ ID NO: 24126 - DNA, 16 bp, H. sapiens
acaatctctgtctttt

SEQ ID NO: 24127 - DNA, 16 bp, H. sapiens
acaatctctttcatga

SEQ ID NO: 24128 - DNA, 16 bp, H. sapiens
acaatctgaaaataaa

SEQ ID NO: 24129 - DNA, 16 bp, H. sapiens
acaatctgccatctgc

SEQ ID NO: 24130 - DNA, 16 bp, H. sapiens
acaatcttaaatatat

SEQ ID NO: 24131 - DNA, 21 bp, H. sapiens
acaatcttggctcactgcaac

SEQ ID NO: 24132 - DNA, 16 bp, H. sapiens
acaatgaaaagaaatt

SEQ ID NO: 24133 - DNA, 16 bp, H. sapiens
acaatgaaaatattaa

SEQ ID NO: 24134 - DNA, 16 bp, H. sapiens
acaatgaaagctataa

SEQ ID NO: 24135 - DNA, 16 bp, H. sapiens
acaatgaaatactgct

SEQ ID NO: 24136 - DNA, 16 bp, H. sapiens
acaatgaaattaaagc

SEQ ID NO: 24137 - DNA, 16 bp, H. sapiens
acaatgaaccatttct

SEQ ID NO: 24138 - DNA, 16 bp, H. sapiens
acaatgaagatgaaaa

SEQ ID NO: 24139 - DNA, 16 bp, H. sapiens
acaatgacaatgatga

SEQ ID NO: 24140 - DNA, 16 bp, H. sapiens
acaatgagaacatttg

SEQ ID NO: 24141 - DNA, 16 bp, H. sapiens
acaatgagaagaaatg

SEQ ID NO: 24142 - DNA, 16 bp, H. sapiens
acaatgagaaggcagc

SEQ ID NO: 24143 - DNA, 16 bp, H. sapiens
acaatgagatgctact

SEQ ID NO: 24144 - DNA, 16 bp, H. sapiens
acaatgaggaaactga

SEQ ID NO: 24145 - DNA, 16 bp, H. sapiens
acaatgaggatgaaga

SEQ ID NO: 24146 - DNA, 16 bp, H. sapiens
acaatgataaaaatat

SEQ ID NO: 24147 - DNA, 16 bp, H. sapiens
acaatgataaactgga

SEQ ID NO: 24148 - DNA, 16 bp, H. sapiens
acaatgatcaaaatca

SEQ ID NO: 24149 - DNA, 16 bp, H. sapiens
acaatgatgaataaaa

SEQ ID NO: 24150 - DNA, 16 bp, H. sapiens
acaatgatgataatga

SEQ ID NO: 24151 - DNA, 16 bp, H. sapiens
acaatgatgcaaaaat

SEQ ID NO: 24152 - DNA, 16 bp, H. sapiens
acaatgatttcttgga

SEQ ID NO: 24153 - DNA, 16 bp, H. sapiens
acaatgcaacagaaaa

SEQ ID NO: 24154 - DNA, 16 bp, H. sapiens
acaatgcacagaatgg

SEQ ID NO: 24155 - DNA, 16 bp, H. sapiens
acaatgcacagcacag

SEQ ID NO: 24156 - DNA, 16 bp, H. sapiens
acaatgcatttctcaa

SEQ ID NO: 24157 - DNA, 16 bp, H. sapiens
acaatgcctgggaaag

SEQ ID NO: 24158 - DNA, 16 bp, H. sapiens
acaatgccttgcacat

SEQ ID NO: 24159 - DNA, 16 bp, H. sapiens
acaatgctgcaatgaa

SEQ ID NO: 24160 - DNA, 16 bp, H. sapiens
acaatgctttcttctg

SEQ ID NO: 24161 - DNA, 16 bp, H. sapiens
acaatggaatattatt

SEQ ID NO: 24162 - DNA, 16 bp, H. sapiens
acaatggcaacaaaaa

SEQ ID NO: 24163 - DNA, 16 bp, H. sapiens
acaatggccaagattt

SEQ ID NO: 24164 - DNA, 16 bp, H. sapiens
acaatggctcatgcct

SEQ ID NO: 24165 - DNA, 16 bp, H. sapiens
acaatggtggaactag

SEQ ID NO: 24166 - DNA, 16 bp, H. sapiens
acaatggtggaatgtc

SEQ ID NO: 24167 - DNA, 16 bp, H. sapiens
acaatggtgggacagg

SEQ ID NO: 24168 - DNA, 16 bp, H. sapiens
acaatggtggtacagg

SEQ ID NO: 24169 - DNA, 16 bp, H. sapiens
acaatggttaaactag

SEQ ID NO: 24170 - DNA, 16 bp, H. sapiens
acaatgtaaatatata

SEQ ID NO: 24171 - DNA, 16 bp, H. sapiens
acaatgtacacatgta

SEQ ID NO: 24172 - DNA, 20 bp, H. sapiens
acaatgtaccagaatctctg

SEQ ID NO: 24173 - DNA, 16 bp, H. sapiens
acaatgtatatcaaaa

SEQ ID NO: 24174 - DNA, 16 bp, H. sapiens
acaatgtattttttaa

SEQ ID NO: 24175 - DNA, 16 bp, H. sapiens
acaatgtcttccacaa

SEQ ID NO: 24176 - DNA, 16 bp, H. sapiens
acaatgtcttcttctg

SEQ ID NO: 24177 - DNA, 16 bp, H. sapiens
acaatgtgaaaatgaa

SEQ ID NO: 24178 - DNA, 16 bp, H. sapiens
acaatgtgatatttta

SEQ ID NO: 24179 - DNA, 16 bp, H. sapiens
acaatgtgatggtatt

SEQ ID NO: 24180 - DNA, 16 bp, H. sapiens
acaatgtgtacatgta

SEQ ID NO: 24181 - DNA, 16 bp, H. sapiens
acaatgttcactgttt

SEQ ID NO: 24182 - DNA, 16 bp, H. sapiens
acaatgtttcctgtat

SEQ ID NO: 24183 - DNA, 16 bp, H. sapiens
acaatgttttctttct

SEQ ID NO: 24184 - DNA, 16 bp, H. sapiens
acaatgtttttaaaaa

SEQ ID NO: 24185 - DNA, 16 bp, H. sapiens
acaatgtttttgtaga

SEQ ID NO: 24186 - DNA, 16 bp, H. sapiens
acaattaaaagcacta

SEQ ID NO: 24187 - DNA, 16 bp, H. sapiens
acaattactatgtgtc

SEQ ID NO: 24188 - DNA, 16 bp, H. sapiens
acaattagaaatgata

SEQ ID NO: 24189 - DNA, 16 bp, H. sapiens
acaattatatgaaaat

SEQ ID NO: 24190 - DNA, 16 bp, H. sapiens
acaattatgtttcttg

SEQ ID NO: 24191 - DNA, 16 bp, H. sapiens
acaattatttattgag

SEQ ID NO: 24192 - DNA, 16 bp, H. sapiens
acaattattttctttc

SEQ ID NO: 24193 - DNA, 16 bp, H. sapiens
acaattcaagctgaga

SEQ ID NO: 24194 - DNA, 16 bp, H. sapiens
acaattcacctgcctc

SEQ ID NO: 24195 - DNA, 16 bp, H. sapiens
acaattcctatcaaaa

SEQ ID NO: 24196 - DNA, 16 bp, H. sapiens
acaattctggagactg

SEQ ID NO: 24197 - DNA, 16 bp, H. sapiens
acaattcttcttcttt

SEQ ID NO: 24198 - DNA, 16 bp, H. sapiens
acaattctttttcttc

SEQ ID NO: 24199 - DNA, 16 bp, H. sapiens
acaattgctttgctga

SEQ ID NO: 24200 - DNA, 16 bp, H. sapiens
acaattgcttttgagg

SEQ ID NO: 24201 - DNA, 16 bp, H. sapiens
acaattggaaaatgaa

SEQ ID NO: 24202 - DNA, 16 bp, H. sapiens
acaattgtaacacaat

SEQ ID NO: 24203 - DNA, 16 bp, H. sapiens
acaattgtatgccaac

SEQ ID NO: 24204 - DNA, 16 bp, H. sapiens
acaattgtggcagaag

SEQ ID NO: 24205 - DNA, 18 bp, H. sapiens
acaatttatgtttagaga

SEQ ID NO: 24206 - DNA, 16 bp, H. sapiens
acaatttattgagcac

SEQ ID NO: 24207 - DNA, 16 bp, H. sapiens
acaatttatttatcca

SEQ ID NO: 24208 - DNA, 16 bp, H. sapiens
acaatttatttttgta

SEQ ID NO: 24209 - DNA, 16 bp, H. sapiens
acaatttcaacaattt

SEQ ID NO: 24210 - DNA, 16 bp, H. sapiens
acaatttcagctcact

SEQ ID NO: 24211 - DNA, 16 bp, H. sapiens
acaatttccattttat

SEQ ID NO: 24212 - DNA, 16 bp, H. sapiens
acaatttgaaatgaga

SEQ ID NO: 24213 - DNA, 16 bp, H. sapiens
acaatttgacttccta

SEQ ID NO: 24214 - DNA, 16 bp, H. sapiens
acaatttgttatgttt

SEQ ID NO: 24215 - DNA, 16 bp, H. sapiens
acaatttgtttatgca

SEQ ID NO: 24216 - DNA, 16 bp, H. sapiens
acaattttaaaagatg

SEQ ID NO: 24217 - DNA, 16 bp, H. sapiens
acaattttaaaatgtt

SEQ ID NO: 24218 - DNA, 16 bp, H. sapiens
acaattttaagaaaat

SEQ ID NO: 24219 - DNA, 16 bp, H. sapiens
acaattttgaaaagaa

SEQ ID NO: 24220 - DNA, 16 bp, H. sapiens
acaattttgaaatatt

SEQ ID NO: 24221 - DNA, 16 bp, H. sapiens
acaattttgaagaaaa

SEQ ID NO: 24222 - DNA, 16 bp, H. sapiens
acaatttttaaaagta

SEQ ID NO: 24223 - DNA, 16 bp, H. sapiens
acaatttttagaaatt

SEQ ID NO: 24224 - DNA, 16 bp, H. sapiens
acaatttttcttccaa

SEQ ID NO: 24225 - DNA, 16 bp, H. sapiens
acaatttttgaaaatt

SEQ ID NO: 24226 - DNA, 16 bp, H. sapiens
acaattttttgtattt

SEQ ID NO: 24227 - DNA, 16 bp, H. sapiens
acacaaaaaaattagc

SEQ ID NO: 24228 - DNA, 16 bp, H. sapiens
acacaaaaagcatgaa

SEQ ID NO: 24229 - DNA, 16 bp, H. sapiens
acacaaaaatcagttg

SEQ ID NO: 24230 - DNA, 16 bp, H. sapiens
acacaaaaattggctg

SEQ ID NO: 24231 - DNA, 16 bp, H. sapiens
acacaaaaccattttt

SEQ ID NO: 24232 - DNA, 16 bp, H. sapiens
acacaaaagagcacat

SEQ ID NO: 24233 - DNA, 16 bp, H. sapiens
acacaaaaggaatctc

SEQ ID NO: 24234 - DNA, 16 bp, H. sapiens
acacaaaagtagaaag

SEQ ID NO: 24235 - DNA, 16 bp, H. sapiens
acacaaacaaatgaag

SEQ ID NO: 24236 - DNA, 16 bp, H. sapiens
acacaaacaaatgcaa

SEQ ID NO: 24237 - DNA, 16 bp, H. sapiens
acacaaacaaatggaa

SEQ ID NO: 24238 - DNA, 17 bp, H. sapiens
acacaaacaaatggaaa

SEQ ID NO: 24239 - DNA, 16 bp, H. sapiens
acacaaacaattggaa

SEQ ID NO: 24240 - DNA, 16 bp, H. sapiens
acacaaacatgtatat

SEQ ID NO: 24241 - DNA, 16 bp, H. sapiens
acacaaacctagatga

SEQ ID NO: 24242 - DNA, 16 bp, H. sapiens
acacaaacctggatgg

SEQ ID NO: 24243 - DNA, 16 bp, H. sapiens
acacaaagaaaatatt

SEQ ID NO: 24244 - DNA, 16 bp, H. sapiens
acacaaagaaatggaa

SEQ ID NO: 24245 - DNA, 16 bp, H. sapiens
acacaaagatgggaat

SEQ ID NO: 24246 - DNA, 16 bp, H. sapiens
acacaaagccaaatca

SEQ ID NO: 24247 - DNA, 16 bp, H. sapiens
acacaaagccagagag

SEQ ID NO: 24248 - DNA, 16 bp, H. sapiens
acacaaagctggagag

SEQ ID NO: 24249 - DNA, 16 bp, H. sapiens
acacaaaggagaaata

SEQ ID NO: 24250 - DNA, 16 bp, H. sapiens
acacaaataaatggaa

SEQ ID NO: 24251 - DNA, 16 bp, H. sapiens
acacaaataattttat

SEQ ID NO: 24252 - DNA, 16 bp, H. sapiens
acacaaatgaatacat

SEQ ID NO: 24253 - DNA, 16 bp, H. sapiens
acacaaatgtgtgtgt

SEQ ID NO: 24254 - DNA, 16 bp, H. sapiens
acacaaattaatttta

SEQ ID NO: 24255 - DNA, 16 bp, H. sapiens
acacaagaaagaattt

SEQ ID NO: 24256 - DNA, 16 bp, H. sapiens
acacaagaagaaatag

SEQ ID NO: 24257 - DNA, 16 bp, H. sapiens
acacaagcacatgcac

SEQ ID NO: 24258 - DNA, 16 bp, H. sapiens
acacaagcgcacacac

SEQ ID NO: 24259 - DNA, 16 bp, H. sapiens
acacaaggccaggcac

SEQ ID NO: 24260 - DNA, 16 bp, H. sapiens
acacaagtggccaaca

SEQ ID NO: 24261 - DNA, 16 bp, H. sapiens
acacaagtttacatat

SEQ ID NO: 24262 - DNA, 16 bp, H. sapiens
acacaataataatgga

SEQ ID NO: 24263 - DNA, 16 bp, H. sapiens
acacaataatagtggg

SEQ ID NO: 24264 - DNA, 16 bp, H. sapiens
acacaatacaagaatt

SEQ ID NO: 24265 - DNA, 16 bp, H. sapiens
acacaatggagtacta

SEQ ID NO: 24266 - DNA, 16 bp, H. sapiens
acacaatgggaaaaaa

SEQ ID NO: 24267 - DNA, 16 bp, H. sapiens
acacaattattatttg

SEQ ID NO: 24268 - DNA, 16 bp, H. sapiens
acacaattcaatccat

SEQ ID NO: 24269 - DNA, 16 bp, H. sapiens
acacaattgcactcca

SEQ ID NO: 24270 - DNA, 16 bp, H. sapiens
acacaatttaccaaaa

SEQ ID NO: 24271 - DNA, 16 bp, H. sapiens
acacaattttagaaat

SEQ ID NO: 24272 - DNA, 16 bp, H. sapiens
acacacaaaagaatga

SEQ ID NO: 24273 - DNA, 16 bp, H. sapiens
acacacaaacacatgc

SEQ ID NO: 24274 - DNA, 16 bp, H. sapiens
acacacaatgaggaaa

SEQ ID NO: 24275 - DNA, 16 bp, H. sapiens
acacacaatgcacaca

SEQ ID NO: 24276 - DNA, 16 bp, H. sapiens
acacacacaaaaggta

SEQ ID NO: 24277 - DNA, 16 bp, H. sapiens
acacacacaaaatgga

SEQ ID NO: 24278 - DNA, 16 bp, H. sapiens
acacacacaaatgctt

SEQ ID NO: 24279 - DNA, 16 bp, H. sapiens
acacacacacaaagat

SEQ ID NO: 24280 - DNA, 16 bp, H. sapiens
acacacacacaaagct

SEQ ID NO: 24281 - DNA, 16 bp, H. sapiens
acacacacacaaatga

SEQ ID NO: 24282 - DNA, 16 bp, H. sapiens
acacacacacaaattt

SEQ ID NO: 24283 - DNA, 16 bp, H. sapiens
acacacacacaatgga

SEQ ID NO: 24284 - DNA, 16 bp, H. sapiens
acacacacacacactt

SEQ ID NO: 24285 - DNA, 16 bp, H. sapiens
acacacacacacagct

SEQ ID NO: 24286 - DNA, 16 bp, H. sapiens
acacacacacacagtt

SEQ ID NO: 24287 - DNA, 16 bp, H. sapiens
acacacacacacatct

SEQ ID NO: 24288 - DNA, 16 bp, H. sapiens
acacacacacacatgt

SEQ ID NO: 24289 - DNA, 16 bp, H. sapiens
acacacacacacattt

SEQ ID NO: 24290 - DNA, 16 bp, H. sapiens
acacacacacaccatg

SEQ ID NO: 24291 - DNA, 16 bp, H. sapiens
acacacacacacctgc

SEQ ID NO: 24292 - DNA, 16 bp, H. sapiens
acacacacacacctgt

SEQ ID NO: 24293 - DNA, 16 bp, H. sapiens
acacacacacacgcgc

SEQ ID NO: 24294 - DNA, 16 bp, H. sapiens
acacacacacacgctc

SEQ ID NO: 24295 - DNA, 16 bp, H. sapiens
acacacacacacggat

SEQ ID NO: 24296 - DNA, 16 bp, H. sapiens
acacacacacacgggg

SEQ ID NO: 24297 - DNA, 16 bp, H. sapiens
acacacacacacgtgc

SEQ ID NO: 24298 - DNA, 16 bp, H. sapiens
acacacacacacgttt

SEQ ID NO: 24299 - DNA, 16 bp, H. sapiens
acacacacacactgat

SEQ ID NO: 24300 - DNA, 16 bp, H. sapiens
acacacacacacttat

SEQ ID NO: 24301 - DNA, 16 bp, H. sapiens
acacacacacagacat

SEQ ID NO: 24302 - DNA, 16 bp, H. sapiens
acacacacacagagac

SEQ ID NO: 24303 - DNA, 16 bp, H. sapiens
acacacacacagagca

SEQ ID NO: 24304 - DNA, 16 bp, H. sapiens
acacacacacagagta

SEQ ID NO: 24305 - DNA, 16 bp, H. sapiens
acacacacacagatac

SEQ ID NO: 24306 - DNA, 16 bp, H. sapiens
acacacacacagcctg

SEQ ID NO: 24307 - DNA, 16 bp, H. sapiens
acacacacacagctaa

SEQ ID NO: 24308 - DNA, 16 bp, H. sapiens
acacacacacaggtac

SEQ ID NO: 24309 - DNA, 16 bp, H. sapiens
acacacacacagtagg

SEQ ID NO: 24310 - DNA, 16 bp, H. sapiens
acacacacacatacta

SEQ ID NO: 24311 - DNA, 16 bp, H. sapiens
acacacacacatatgc

SEQ ID NO: 24312 - DNA, 16 bp, H. sapiens
acacacacacatattt

SEQ ID NO: 24313 - DNA, 16 bp, H. sapiens
acacacacacatcaga

SEQ ID NO: 24314 - DNA, 16 bp, H. sapiens
acacacacacattgtg

SEQ ID NO: 24315 - DNA, 16 bp, H. sapiens
acacacacacattttt

SEQ ID NO: 24316 - DNA, 16 bp, H. sapiens
acacacacacccctta

SEQ ID NO: 24317 - DNA, 16 bp, H. sapiens
acacacacaccctgtg

SEQ ID NO: 24318 - DNA, 16 bp, H. sapiens
acacacacacgcacat

SEQ ID NO: 24319 - DNA, 16 bp, H. sapiens
acacacacacgcagag

SEQ ID NO: 24320 - DNA, 16 bp, H. sapiens
acacacacacgtgcgc

SEQ ID NO: 24321 - DNA, 16 bp, H. sapiens
acacacacactcacat

SEQ ID NO: 24322 - DNA, 16 bp, H. sapiens
acacacacactccagc

SEQ ID NO: 24323 - DNA, 16 bp, H. sapiens
acacacacactccatt

SEQ ID NO: 24324 - DNA, 16 bp, H. sapiens
acacacacactcctaa

SEQ ID NO: 24325 - DNA, 16 bp, H. sapiens
acacacacactcctct

SEQ ID NO: 24326 - DNA, 16 bp, H. sapiens
acacacacactggaat

SEQ ID NO: 24327 - DNA, 16 bp, H. sapiens
acacacacacttactt

SEQ ID NO: 24328 - DNA, 16 bp, H. sapiens
acacacacacttatat

SEQ ID NO: 24329 - DNA, 16 bp, H. sapiens
acacacacagagagaa

SEQ ID NO: 24330 - DNA, 16 bp, H. sapiens
acacacacagagagga

SEQ ID NO: 24331 - DNA, 16 bp, H. sapiens
acacacacagagccac

SEQ ID NO: 24332 - DNA, 16 bp, H. sapiens
acacacacagaggaga

SEQ ID NO: 24333 - DNA, 16 bp, H. sapiens
acacacacagaggagg

SEQ ID NO: 24334 - DNA, 16 bp, H. sapiens
acacacacagatgaaa

SEQ ID NO: 24335 - DNA, 16 bp, H. sapiens
acacacacataatata

SEQ ID NO: 24336 - DNA, 16 bp, H. sapiens
acacacacatacacgc

SEQ ID NO: 24337 - DNA, 16 bp, H. sapiens
acacacacatacactc

SEQ ID NO: 24338 - DNA, 16 bp, H. sapiens
acacacacatacagga

SEQ ID NO: 24339 - DNA, 16 bp, H. sapiens
acacacacatacgtat

SEQ ID NO: 24340 - DNA, 16 bp, H. sapiens
acacacacatagacca

SEQ ID NO: 24341 - DNA, 16 bp, H. sapiens
acacacacatatatac

SEQ ID NO: 24342 - DNA, 16 bp, H. sapiens
acacacacatatgtat

SEQ ID NO: 24343 - DNA, 16 bp, H. sapiens
acacacacatattcac

SEQ ID NO: 24344 - DNA, 16 bp, H. sapiens
acacacacatcacata

SEQ ID NO: 24345 - DNA, 16 bp, H. sapiens
acacacacatccatgc

SEQ ID NO: 24346 - DNA, 17 bp, H. sapiens
acacacacatgcatgca

SEQ ID NO: 24347 - DNA, 16 bp, H. sapiens
acacacacatgctcaa

SEQ ID NO: 24348 - DNA, 16 bp, H. sapiens
acacacacatgtgtac

SEQ ID NO: 24349 - DNA, 16 bp, H. sapiens
acacacacattcacat

SEQ ID NO: 24350 - DNA, 16 bp, H. sapiens
acacacaccatatata

SEQ ID NO: 24351 - DNA, 16 bp, H. sapiens
acacacacctgcacat

SEQ ID NO: 24352 - DNA, 16 bp, H. sapiens
acacacacgatggaat

SEQ ID NO: 24353 - DNA, 16 bp, H. sapiens
acacacacgcacatac

SEQ ID NO: 24354 - DNA, 16 bp, H. sapiens
acacacacgcagacat

SEQ ID NO: 24355 - DNA, 16 bp, H. sapiens
acacacacgtatatat

SEQ ID NO: 24356 - DNA, 16 bp, H. sapiens
acacacacgtgcgcac

SEQ ID NO: 24357 - DNA, 16 bp, H. sapiens
acacacactctcacac

SEQ ID NO: 24358 - DNA, 16 bp, H. sapiens
acacacactctctctt

SEQ ID NO: 24359 - DNA, 16 bp, H. sapiens
acacacactggggaaa

SEQ ID NO: 24360 - DNA, 16 bp, H. sapiens
acacacactggggcca

SEQ ID NO: 24361 - DNA, 17 bp, H. sapiens
acacacactggggcctg

SEQ ID NO: 24362 - DNA, 16 bp, H. sapiens
acacacagaaggaaga

SEQ ID NO: 24363 - DNA, 16 bp, H. sapiens
acacacagaatttctt

SEQ ID NO: 24364 - DNA, 16 bp, H. sapiens
acacacagagacagac

SEQ ID NO: 24365 - DNA, 16 bp, H. sapiens
acacacagagagaaga

SEQ ID NO: 24366 - DNA, 16 bp, H. sapiens
acacacagagagggaa

SEQ ID NO: 24367 - DNA, 16 bp, H. sapiens
acacacagaggaaaga

SEQ ID NO: 24368 - DNA, 16 bp, H. sapiens
acacacagaggagaag

SEQ ID NO: 24369 - DNA, 16 bp, H. sapiens
acacacagaggggaac

SEQ ID NO: 24370 - DNA, 16 bp, H. sapiens
acacacagatgcacat

SEQ ID NO: 24371 - DNA, 16 bp, H. sapiens
acacacagcacataca

SEQ ID NO: 24372 - DNA, 16 bp, H. sapiens
acacacagcatatata

SEQ ID NO: 24373 - DNA, 16 bp, H. sapiens
acacacagctaatttt

SEQ ID NO: 24374 - DNA, 16 bp, H. sapiens
acacacaggggagaag

SEQ ID NO: 24375 - DNA, 16 bp, H. sapiens
acacacatacacacag

SEQ ID NO: 24376 - DNA, 16 bp, H. sapiens
acacacatacacacat

SEQ ID NO: 24377 - DNA, 16 bp, H. sapiens
acacacatacacgcac

SEQ ID NO: 24378 - DNA, 16 bp, H. sapiens
acacacatacatatat

SEQ ID NO: 24379 - DNA, 16 bp, H. sapiens
acacacatacatgaaa

SEQ ID NO: 24380 - DNA, 16 bp, H. sapiens
acacacatacatttta

SEQ ID NO: 24381 - DNA, 16 bp, H. sapiens
acacacatataattta

SEQ ID NO: 24382 - DNA, 16 bp, H. sapiens
acacacatatacacta

SEQ ID NO: 24383 - DNA, 16 bp, H. sapiens
acacacatatatatat

SEQ ID NO: 24384 - DNA, 17 bp, H. sapiens
acacacatatatatatt

SEQ ID NO: 24385 - DNA, 16 bp, H. sapiens
acacacatatatgtgt

SEQ ID NO: 24386 - DNA, 16 bp, H. sapiens
acacacatatgtatat

SEQ ID NO: 24387 - DNA, 16 bp, H. sapiens
acacacatcagacaca

SEQ ID NO: 24388 - DNA, 16 bp, H. sapiens
acacacatgcaaacat

SEQ ID NO: 24389 - DNA, 16 bp, H. sapiens
acacacatgcacacag

SEQ ID NO: 24390 - DNA, 16 bp, H. sapiens
acacacatgcatacat

SEQ ID NO: 24391 - DNA, 16 bp, H. sapiens
acacacatgcatgctc

SEQ ID NO: 24392 - DNA, 16 bp, H. sapiens
acacacatgtacatgc

SEQ ID NO: 24393 - DNA, 16 bp, H. sapiens
acacacatgtatatat

SEQ ID NO: 24394 - DNA, 16 bp, H. sapiens
acacacattcacacac

SEQ ID NO: 24395 - DNA, 16 bp, H. sapiens
acacacattttctttt

SEQ ID NO: 24396 - DNA, 16 bp, H. sapiens
acacacccacacatgc

SEQ ID NO: 24397 - DNA, 18 bp, H. sapiens
acacacccagctaatttt

SEQ ID NO: 24398 - DNA, 16 bp, H. sapiens
acacaccctgggccag

SEQ ID NO: 24399 - DNA, 16 bp, H. sapiens
acacacctacagtgaa

SEQ ID NO: 24400 - DNA, 28 bp, H. sapiens
acacacctattccaaaattgaccacata

SEQ ID NO: 24401 - DNA, 17 bp, H. sapiens
acacacctgcagtccca

SEQ ID NO: 24402 - DNA, 16 bp, H. sapiens
acacacctgtaattcc

SEQ ID NO: 24403 - DNA, 16 bp, H. sapiens
acacacctgtacacac

SEQ ID NO: 24404 - DNA, 16 bp, H. sapiens
acacacctgtagtctc

SEQ ID NO: 24405 - DNA, 16 bp, H. sapiens
acacacgcacacacat

SEQ ID NO: 24406 - DNA, 16 bp, H. sapiens
acacacgcagacacac

SEQ ID NO: 24407 - DNA, 16 bp, H. sapiens
acacacgcgcacacac

SEQ ID NO: 24408 - DNA, 16 bp, H. sapiens
acacacggctaatttt

SEQ ID NO: 24409 - DNA, 16 bp, H. sapiens
acacacgtacatacat

SEQ ID NO: 24410 - DNA, 16 bp, H. sapiens
acacacgtgtgcacac

SEQ ID NO: 24411 - DNA, 16 bp, H. sapiens
acacacgtgtgcatgt

SEQ ID NO: 24412 - DNA, 16 bp, H. sapiens
acacactcacactctc

SEQ ID NO: 24413 - DNA, 16 bp, H. sapiens
acacactctggggact

SEQ ID NO: 24414 - DNA, 16 bp, H. sapiens
acacactgaaatattt

SEQ ID NO: 24415 - DNA, 16 bp, H. sapiens
acacactgaagaatgc

SEQ ID NO: 24416 - DNA, 18 bp, H. sapiens
acacactggggcctgtcg

SEQ ID NO: 24417 - DNA, 16 bp, H. sapiens
acacactgggtggctt

SEQ ID NO: 24418 - DNA, 16 bp, H. sapiens
acacacttagaaaaat

SEQ ID NO: 24419 - DNA, 16 bp, H. sapiens
acacactttaaaccaa

SEQ ID NO: 24420 - DNA, 16 bp, H. sapiens
acacactttctttttt

SEQ ID NO: 24421 - DNA, 16 bp, H. sapiens
acacacttttaaaaat

SEQ ID NO: 24422 - DNA, 16 bp, H. sapiens
acacactttttctaca

SEQ ID NO: 24423 - DNA, 16 bp, H. sapiens
acacagaaaactacaa

SEQ ID NO: 24424 - DNA, 16 bp, H. sapiens
acacagaaagtcaaca

SEQ ID NO: 24425 - DNA, 16 bp, H. sapiens
acacagaaatggaaaa

SEQ ID NO: 24426 - DNA, 16 bp, H. sapiens
acacagaacaatggaa

SEQ ID NO: 24427 - DNA, 16 bp, H. sapiens
acacagaacatattct

SEQ ID NO: 24428 - DNA, 16 bp, H. sapiens
acacagaagtggaatt

SEQ ID NO: 24429 - DNA, 16 bp, H. sapiens
acacagaatttcatat

SEQ ID NO: 24430 - DNA, 16 bp, H. sapiens
acacagacaaatggaa

SEQ ID NO: 24431 - DNA, 16 bp, H. sapiens
acacagacacacaaat

SEQ ID NO: 24432 - DNA, 16 bp, H. sapiens
acacagacacacacag

SEQ ID NO: 24433 - DNA, 16 bp, H. sapiens
acacagacacacacat

SEQ ID NO: 24434 - DNA, 16 bp, H. sapiens
acacagacacacacgc

SEQ ID NO: 24435 - DNA, 17 bp, H. sapiens
acacagacacagcaaca

SEQ ID NO: 24436 - DNA, 16 bp, H. sapiens
acacagacacaggaag

SEQ ID NO: 24437 - DNA, 16 bp, H. sapiens
acacagacagaagagg

SEQ ID NO: 24438 - DNA, 16 bp, H. sapiens
acacagacattcagtc

SEQ ID NO: 24439 - DNA, 16 bp, H. sapiens
acacagaccagtggaa

SEQ ID NO: 24440 - DNA, 16 bp, H. sapiens
acacagagaaacccca

SEQ ID NO: 24441 - DNA, 16 bp, H. sapiens
acacagagaaagaaat

SEQ ID NO: 24442 - DNA, 16 bp, H. sapiens
acacagagaaatgttt

SEQ ID NO: 24443 - DNA, 16 bp, H. sapiens
acacagagaaggaaac

SEQ ID NO: 24444 - DNA, 16 bp, H. sapiens
acacagagacacacag

SEQ ID NO: 24445 - DNA, 16 bp, H. sapiens
acacagagacacagat

SEQ ID NO: 24446 - DNA, 16 bp, H. sapiens
acacagagacagacac

SEQ ID NO: 24447 - DNA, 16 bp, H. sapiens
acacagagacagacag

SEQ ID NO: 24448 - DNA, 16 bp, H. sapiens
acacagagagacccca

SEQ ID NO: 24449 - DNA, 16 bp, H. sapiens
acacagagagaggcag

SEQ ID NO: 24450 - DNA, 16 bp, H. sapiens
acacagagatatgaag

SEQ ID NO: 24451 - DNA, 16 bp, H. sapiens
acacagagccaaacca

SEQ ID NO: 24452 - DNA, 16 bp, H. sapiens
acacagaggaaaggcc

SEQ ID NO: 24453 - DNA, 16 bp, H. sapiens
acacagaggagaagca

SEQ ID NO: 24454 - DNA, 16 bp, H. sapiens
acacagaggagaaggc

SEQ ID NO: 24455 - DNA, 16 bp, H. sapiens
acacagaggataaatg

SEQ ID NO: 24456 - DNA, 16 bp, H. sapiens
acacagagggaagaca

SEQ ID NO: 24457 - DNA, 16 bp, H. sapiens
acacagagtaggcact

SEQ ID NO: 24458 - DNA, 17 bp, H. sapiens
acacagagtcctttgct

SEQ ID NO: 24459 - DNA, 16 bp, H. sapiens
acacagataaatggaa

SEQ ID NO: 24460 - DNA, 16 bp, H. sapiens
acacagatgaatcttg

SEQ ID NO: 24461 - DNA, 16 bp, H. sapiens
acacagatgtacacac

SEQ ID NO: 24462 - DNA, 16 bp, H. sapiens
acacagatgtgcacac

SEQ ID NO: 24463 - DNA, 16 bp, H. sapiens
acacagattgctgggc

SEQ ID NO: 24464 - DNA, 16 bp, H. sapiens
acacagatttttaaaa

SEQ ID NO: 24465 - DNA, 16 bp, H. sapiens
acacagatttttgact

SEQ ID NO: 24466 - DNA, 16 bp, H. sapiens
acacagcaaaagaaat

SEQ ID NO: 24467 - DNA, 16 bp, H. sapiens
acacagcaagaaagcc

SEQ ID NO: 24468 - DNA, 16 bp, H. sapiens
acacagcaagaaagtg

SEQ ID NO: 24469 - DNA, 16 bp, H. sapiens
acacagcaagatccta

SEQ ID NO: 24470 - DNA, 16 bp, H. sapiens
acacagcagcagcagc

SEQ ID NO: 24471 - DNA, 16 bp, H. sapiens
acacagcagccagaga

SEQ ID NO: 24472 - DNA, 16 bp, H. sapiens
acacagcagccagagt

SEQ ID NO: 24473 - DNA, 16 bp, H. sapiens
acacagcaggtgctca

SEQ ID NO: 24474 - DNA, 16 bp, H. sapiens
acacagcatttttttt

SEQ ID NO: 24475 - DNA, 17 bp, H. sapiens
acacagccaaaccatat

SEQ ID NO: 24476 - DNA, 17 bp, H. sapiens
acacagccaatatcata

SEQ ID NO: 24477 - DNA, 16 bp, H. sapiens
acacagccagaccctg

SEQ ID NO: 24478 - DNA, 16 bp, H. sapiens
acacagccagcaaatg

SEQ ID NO: 24479 - DNA, 16 bp, H. sapiens
acacagccaggaagag

SEQ ID NO: 24480 - DNA, 16 bp, H. sapiens
acacagccaggcacac

SEQ ID NO: 24481 - DNA, 16 bp, H. sapiens
acacagcccctgccct

SEQ ID NO: 24482 - DNA, 16 bp, H. sapiens
acacagcctcagaagg

SEQ ID NO: 24483 - DNA, 16 bp, H. sapiens
acacagctaataagta

SEQ ID NO: 24484 - DNA, 16 bp, H. sapiens
acacagctagaaggtg

SEQ ID NO: 24485 - DNA, 16 bp, H. sapiens
acacagctagtgagtg

SEQ ID NO: 24486 - DNA, 16 bp, H. sapiens
acacagctattaagtg

SEQ ID NO: 24487 - DNA, 16 bp, H. sapiens
acacagctgaaagaaa

SEQ ID NO: 24488 - DNA, 16 bp, H. sapiens
acacaggaacagagaa

SEQ ID NO: 24489 - DNA, 16 bp, H. sapiens
acacaggaagaaggca

SEQ ID NO: 24490 - DNA, 16 bp, H. sapiens
acacaggaagacaaat

SEQ ID NO: 24491 - DNA, 16 bp, H. sapiens
acacaggaggtgctca

SEQ ID NO: 24492 - DNA, 16 bp, H. sapiens
acacaggcacacaaac

SEQ ID NO: 24493 - DNA, 21 bp, H. sapiens
acacaggcccccgcagagggg

SEQ ID NO: 24494 - DNA, 16 bp, H. sapiens
acacaggctcacacac

SEQ ID NO: 24495 - DNA, 16 bp, H. sapiens
acacagggagacccag

SEQ ID NO: 24496 - DNA, 16 bp, H. sapiens
acacagggagaccccc

SEQ ID NO: 24497 - DNA, 16 bp, H. sapiens
acacagggagaccttg

SEQ ID NO: 24498 - DNA, 16 bp, H. sapiens
acacagggccagaaat

SEQ ID NO: 24499 - DNA, 16 bp, H. sapiens
acacagggcctggcac

SEQ ID NO: 24500 - DNA, 16 bp, H. sapiens
acacagggtctcattc

SEQ ID NO: 24501 - DNA, 16 bp, H. sapiens
acacagggtttcactc

SEQ ID NO: 24502 - DNA, 16 bp, H. sapiens
acacaggttgctgggc

SEQ ID NO: 24503 - DNA, 16 bp, H. sapiens
acacagtaaatattca

SEQ ID NO: 24504 - DNA, 16 bp, H. sapiens
acacagtagctgctca

SEQ ID NO: 24505 - DNA, 16 bp, H. sapiens
acacagtaggagctca

SEQ ID NO: 24506 - DNA, 16 bp, H. sapiens
acacagtaggcactca

SEQ ID NO: 24507 - DNA, 16 bp, H. sapiens
acacagtaggtgctca

SEQ ID NO: 24508 - DNA, 16 bp, H. sapiens
acacagtaggtgttca

SEQ ID NO: 24509 - DNA, 16 bp, H. sapiens
acacagtcaaaccaca

SEQ ID NO: 24510 - DNA, 16 bp, H. sapiens
acacagtcaaatcata

SEQ ID NO: 24511 - DNA, 16 bp, H. sapiens
acacagtccctgccct

SEQ ID NO: 24512 - DNA, 16 bp, H. sapiens
acacagtgagacctcg

SEQ ID NO: 24513 - DNA, 16 bp, H. sapiens
acacagttatcaaaaa

SEQ ID NO: 24514 - DNA, 16 bp, H. sapiens
acacagttcaaaccca

SEQ ID NO: 24515 - DNA, 16 bp, H. sapiens
acacagtttaaaaaat

SEQ ID NO: 24516 - DNA, 16 bp, H. sapiens
acacagttttatttct

SEQ ID NO: 24517 - DNA, 16 bp, H. sapiens
acacagttttgccatg

SEQ ID NO: 24518 - DNA, 16 bp, H. sapiens
acacataaaacttacc

SEQ ID NO: 24519 - DNA, 16 bp, H. sapiens
acacatacaaccatct

SEQ ID NO: 24520 - DNA, 16 bp, H. sapiens
acacatacaggcacac

SEQ ID NO: 24521 - DNA, 16 bp, H. sapiens
acacatacatacatat

SEQ ID NO: 24522 - DNA, 16 bp, H. sapiens
acacatacatatatgt

SEQ ID NO: 24523 - DNA, 16 bp, H. sapiens
acacatacatgcatat

SEQ ID NO: 24524 - DNA, 16 bp, H. sapiens
acacataccacatgca

SEQ ID NO: 24525 - DNA, 16 bp, H. sapiens
acacataccatggaat

SEQ ID NO: 24526 - DNA, 16 bp, H. sapiens
acacatagacatacac

SEQ ID NO: 24527 - DNA, 16 bp, H. sapiens
acacatagatatatat

SEQ ID NO: 24528 - DNA, 16 bp, H. sapiens
acacatagattaatgg

SEQ ID NO: 24529 - DNA, 16 bp, H. sapiens
acacatagtaagcact

SEQ ID NO: 24530 - DNA, 16 bp, H. sapiens
acacatatacacatat

SEQ ID NO: 24531 - DNA, 33 bp, H. sapiens
acacatatacaccatggaatactatgcagccat

SEQ ID NO: 24532 - DNA, 16 bp, H. sapiens
acacatatacatatat

SEQ ID NO: 24533 - DNA, 16 bp, H. sapiens
acacatatatatacgt

SEQ ID NO: 24534 - DNA, 16 bp, H. sapiens
acacatatatatttgt

SEQ ID NO: 24535 - DNA, 16 bp, H. sapiens
acacatatatgtacat

SEQ ID NO: 24536 - DNA, 16 bp, H. sapiens
acacatatgcacacat

SEQ ID NO: 24537 - DNA, 16 bp, H. sapiens
acacatatgtatacac

SEQ ID NO: 24538 - DNA, 16 bp, H. sapiens
acacatatgtatgtat

SEQ ID NO: 24539 - DNA, 16 bp, H. sapiens
acacatatttaaattt

SEQ ID NO: 24540 - DNA, 16 bp, H. sapiens
acacatatttatattt

SEQ ID NO: 24541 - DNA, 16 bp, H. sapiens
acacatattttgtata

SEQ ID NO: 24542 - DNA, 16 bp, H. sapiens
acacatatttttaaaa

SEQ ID NO: 24543 - DNA, 16 bp, H. sapiens
acacatatttttacat

SEQ ID NO: 24544 - DNA, 16 bp, H. sapiens
acacatcaaaaaatgc

SEQ ID NO: 24545 - DNA, 16 bp, H. sapiens
acacatcactgcagcc

SEQ ID NO: 24546 - DNA, 16 bp, H. sapiens
acacatcattatcatc

SEQ ID NO: 24547 - DNA, 24 bp, H. sapiens
acacatcattgtcagattcaccaa

SEQ ID NO: 24548 - DNA, 16 bp, H. sapiens
acacatcctcactggg

SEQ ID NO: 24549 - DNA, 16 bp, H. sapiens
acacatcctcctgtat

SEQ ID NO: 24550 - DNA, 16 bp, H. sapiens
acacatgaaaaaatac

SEQ ID NO: 24551 - DNA, 17 bp, H. sapiens
acacatgaaaaaatgct

SEQ ID NO: 24552 - DNA, 16 bp, H. sapiens
acacatgaatgtgtat

SEQ ID NO: 24553 - DNA, 16 bp, H. sapiens
acacatgaggaaacag

SEQ ID NO: 24554 - DNA, 16 bp, H. sapiens
acacatgcacacaaag

SEQ ID NO: 24555 - DNA, 16 bp, H. sapiens
acacatgcacacgaat

SEQ ID NO: 24556 - DNA, 16 bp, H. sapiens
acacatgcacagcctc

SEQ ID NO: 24557 - DNA, 16 bp, H. sapiens
acacatgcacatgtac

SEQ ID NO: 24558 - DNA, 16 bp, H. sapiens
acacatgcagacacac

SEQ ID NO: 24559 - DNA, 16 bp, H. sapiens
acacatgcaggatgtg

SEQ ID NO: 24560 - DNA, 16 bp, H. sapiens
acacatgcatatatat

SEQ ID NO: 24561 - DNA, 16 bp, H. sapiens
acacatgcatgcatat

SEQ ID NO: 24562 - DNA, 16 bp, H. sapiens
acacatgcatgtgtct

SEQ ID NO: 24563 - DNA, 16 bp, H. sapiens
acacatgcgcgcacac

SEQ ID NO: 24564 - DNA, 16 bp, H. sapiens
acacatggaaatgaaa

SEQ ID NO: 24565 - DNA, 16 bp, H. sapiens
acacatggacacacat

SEQ ID NO: 24566 - DNA, 16 bp, H. sapiens
acacatggacacaggt

SEQ ID NO: 24567 - DNA, 16 bp, H. sapiens
acacatggacatatgg

SEQ ID NO: 24568 - DNA, 16 bp, H. sapiens
acacatggattttctt

SEQ ID NO: 24569 - DNA, 16 bp, H. sapiens
acacatgggggttatg

SEQ ID NO: 24570 - DNA, 16 bp, H. sapiens
acacatggtgttgggc

SEQ ID NO: 24571 - DNA, 16 bp, H. sapiens
acacatgtatatgtat

SEQ ID NO: 24572 - DNA, 16 bp, H. sapiens
acacatgtatcaaaac

SEQ ID NO: 24573 - DNA, 16 bp, H. sapiens
acacatgtatcaaaat

SEQ ID NO: 24574 - DNA, 16 bp, H. sapiens
acacatgtgcacacag

SEQ ID NO: 24575 - DNA, 16 bp, H. sapiens
acacatgtgcacacat

SEQ ID NO: 24576 - DNA, 16 bp, H. sapiens
acacatgtgtacatgt

SEQ ID NO: 24577 - DNA, 16 bp, H. sapiens
acacatgttcatttta

SEQ ID NO: 24578 - DNA, 16 bp, H. sapiens
acacatgttttcattt

SEQ ID NO: 24579 - DNA, 16 bp, H. sapiens
acacattagaatcacc

SEQ ID NO: 24580 - DNA, 16 bp, H. sapiens
acacattagcctaggt

SEQ ID NO: 24581 - DNA, 16 bp, H. sapiens
acacattattttcaaa

SEQ ID NO: 24582 - DNA, 16 bp, H. sapiens
acacattattttgttt

SEQ ID NO: 24583 - DNA, 16 bp, H. sapiens
acacattcaaaagata

SEQ ID NO: 24584 - DNA, 16 bp, H. sapiens
acacattcatacatat

SEQ ID NO: 24585 - DNA, 16 bp, H. sapiens
acacattcattcattc

SEQ ID NO: 24586 - DNA, 16 bp, H. sapiens
acacattcatttttat

SEQ ID NO: 24587 - DNA, 16 bp, H. sapiens
acacattctattcatc

SEQ ID NO: 24588 - DNA, 16 bp, H. sapiens
acacattgcaaagcag

SEQ ID NO: 24589 - DNA, 16 bp, H. sapiens
acacattgggattcat

SEQ ID NO: 24590 - DNA, 16 bp, H. sapiens
acacatttaaagaagt

SEQ ID NO: 24591 - DNA, 16 bp, H. sapiens
acacatttaaagcggt

SEQ ID NO: 24592 - DNA, 16 bp, H. sapiens
acacatttaaatcagt

SEQ ID NO: 24593 - DNA, 16 bp, H. sapiens
acacatttattatctt

SEQ ID NO: 24594 - DNA, 16 bp, H. sapiens
acacatttatttaatc

SEQ ID NO: 24595 - DNA, 16 bp, H. sapiens
acacatttattttcaa

SEQ ID NO: 24596 - DNA, 16 bp, H. sapiens
acacatttatttttct

SEQ ID NO: 24597 - DNA, 16 bp, H. sapiens
acacattttaaagaaa

SEQ ID NO: 24598 - DNA, 16 bp, H. sapiens
acacattttaattaaa

SEQ ID NO: 24599 - DNA, 16 bp, H. sapiens
acacattttatttctt

SEQ ID NO: 24600 - DNA, 16 bp, H. sapiens
acacattttccatgaa

SEQ ID NO: 24601 - DNA, 16 bp, H. sapiens
acacatttttaaatga

SEQ ID NO: 24602 - DNA, 16 bp, H. sapiens
acacatttttcaaaag

SEQ ID NO: 24603 - DNA, 16 bp, H. sapiens
acacatttttctttct

SEQ ID NO: 24604 - DNA, 16 bp, H. sapiens
acacattttttaaaaa

SEQ ID NO: 24605 - DNA, 16 bp, H. sapiens
acacattttttaaatg

SEQ ID NO: 24606 - DNA, 16 bp, H. sapiens
acacatttttttaaaa

SEQ ID NO: 24607 - DNA, 16 bp, H. sapiens
acaccaaaaatggaaa

SEQ ID NO: 24608 - DNA, 16 bp, H. sapiens
acaccaaaatcaatgg

SEQ ID NO: 24609 - DNA, 16 bp, H. sapiens
acaccaaacaggcttt

SEQ ID NO: 24610 - DNA, 16 bp, H. sapiens
acaccaaagttctgag

SEQ ID NO: 24611 - DNA, 16 bp, H. sapiens
acaccaaatctcagaa

SEQ ID NO: 24612 - DNA, 16 bp, H. sapiens
acaccaacaacaggca

SEQ ID NO: 24613 - DNA, 16 bp, H. sapiens
acaccaacagtgaaca

SEQ ID NO: 24614 - DNA, 16 bp, H. sapiens
acaccaacctggccaa

SEQ ID NO: 24615 - DNA, 16 bp, H. sapiens
acaccaaggcaggagg

SEQ ID NO: 24616 - DNA, 16 bp, H. sapiens
acaccaagtcctgcta

SEQ ID NO: 24617 - DNA, 16 bp, H. sapiens
acaccacattttcctt

SEQ ID NO: 24618 - DNA, 16 bp, H. sapiens
acaccacattttcttt

SEQ ID NO: 24619 - DNA, 16 bp, H. sapiens
acaccaccacatccag

SEQ ID NO: 24620 - DNA, 18 bp, H. sapiens
acaccaccatgcccggct

SEQ ID NO: 24621 - DNA, 16 bp, H. sapiens
acaccaccatgtccag

SEQ ID NO: 24622 - DNA, 16 bp, H. sapiens
acaccacctagtggag

SEQ ID NO: 24623 - DNA, 16 bp, H. sapiens
acaccacctattcccc

SEQ ID NO: 24624 - DNA, 16 bp, H. sapiens
acaccactgcacttca

SEQ ID NO: 24625 - DNA, 16 bp, H. sapiens
acaccactgccttcca

SEQ ID NO: 24626 - DNA, 16 bp, H. sapiens
acaccactggtgggaa

SEQ ID NO: 24627 - DNA, 16 bp, H. sapiens
acaccagacctgttct

SEQ ID NO: 24628 - DNA, 16 bp, H. sapiens
acaccagagagctctc

SEQ ID NO: 24629 - DNA, 16 bp, H. sapiens
acaccagcctggccaa

SEQ ID NO: 24630 - DNA, 16 bp, H. sapiens
acaccagcctgggcca

SEQ ID NO: 24631 - DNA, 16 bp, H. sapiens
acaccagcctgtgcaa

SEQ ID NO: 24632 - DNA, 16 bp, H. sapiens
acaccaggctaattta

SEQ ID NO: 24633 - DNA, 16 bp, H. sapiens
acaccaggctcatttt

SEQ ID NO: 24634 - DNA, 16 bp, H. sapiens
acaccagggaatacta

SEQ ID NO: 24635 - DNA, 16 bp, H. sapiens
acaccagggcctgtca

SEQ ID NO: 24636 - DNA, 16 bp, H. sapiens
acaccagtcatactgg

SEQ ID NO: 24637 - DNA, 16 bp, H. sapiens
acaccagtgcactcta

SEQ ID NO: 24638 - DNA, 16 bp, H. sapiens
acaccataaactgggt

SEQ ID NO: 24639 - DNA, 16 bp, H. sapiens
acaccatatatgaaaa

SEQ ID NO: 24640 - DNA, 16 bp, H. sapiens
acaccatattaataga

SEQ ID NO: 24641 - DNA, 16 bp, H. sapiens
acaccatctcagctca

SEQ ID NO: 24642 - DNA, 16 bp, H. sapiens
acaccatcttccacaa

SEQ ID NO: 24643 - DNA, 16 bp, H. sapiens
acaccatgaaacccca

SEQ ID NO: 24644 - DNA, 16 bp, H. sapiens
acaccatgaccaagtg

SEQ ID NO: 24645 - DNA, 16 bp, H. sapiens
acaccatgtagaagct

SEQ ID NO: 24646 - DNA, 16 bp, H. sapiens
acaccattcactccag

SEQ ID NO: 24647 - DNA, 16 bp, H. sapiens
acaccattccaaagga

SEQ ID NO: 24648 - DNA, 16 bp, H. sapiens
acacccacacacatgc

SEQ ID NO: 24649 - DNA, 16 bp, H. sapiens
acacccacacatatat

SEQ ID NO: 24650 - DNA, 16 bp, H. sapiens
acacccacaccttatc

SEQ ID NO: 24651 - DNA, 16 bp, H. sapiens
acacccacccaagact

SEQ ID NO: 24652 - DNA, 16 bp, H. sapiens
acacccagaaggaagg

SEQ ID NO: 24653 - DNA, 16 bp, H. sapiens
acacccagaataatgt

SEQ ID NO: 24654 - DNA, 16 bp, H. sapiens
acacccagccattttt

SEQ ID NO: 24655 - DNA, 16 bp, H. sapiens
acacccagcctcttcc

SEQ ID NO: 24656 - DNA, 16 bp, H. sapiens
acacccagctaatttt

SEQ ID NO: 24657 - DNA, 16 bp, H. sapiens
acacccagctcatttt

SEQ ID NO: 24658 - DNA, 16 bp, H. sapiens
acacccagctgatttt

SEQ ID NO: 24659 - DNA, 16 bp, H. sapiens
acacccagctggtgtt

SEQ ID NO: 24660 - DNA, 16 bp, H. sapiens
acacccaggtaatttt

SEQ ID NO: 24661 - DNA, 16 bp, H. sapiens
acacccatcaggatgg

SEQ ID NO: 24662 - DNA, 17 bp, H. sapiens
acacccatcagtcccag

SEQ ID NO: 24663 - DNA, 16 bp, H. sapiens
acacccatgacacagc

SEQ ID NO: 24664 - DNA, 16 bp, H. sapiens
acacccatgtaaccac

SEQ ID NO: 24665 - DNA, 16 bp, H. sapiens
acaccccaaagatcct

SEQ ID NO: 24666 - DNA, 16 bp, H. sapiens
acaccccaccctgctt

SEQ ID NO: 24667 - DNA, 16 bp, H. sapiens
acaccccagggcctgt

SEQ ID NO: 24668 - DNA, 16 bp, H. sapiens
acaccccgctaatttt

SEQ ID NO: 24669 - DNA, 16 bp, H. sapiens
acacccctttccagcc

SEQ ID NO: 24670 - DNA, 17 bp, H. sapiens
acacccgcctcggcctc

SEQ ID NO: 24671 - DNA, 16 bp, H. sapiens
acacccggctaatttt

SEQ ID NO: 24672 - DNA, 17 bp, H. sapiens
acacccggtccagctta

SEQ ID NO: 24673 - DNA, 16 bp, H. sapiens
acacccggttaatttt

SEQ ID NO: 24674 - DNA, 16 bp, H. sapiens
acaccctcacagaaac

SEQ ID NO: 24675 - DNA, 16 bp, H. sapiens
acaccctcaccaacat

SEQ ID NO: 24676 - DNA, 16 bp, H. sapiens
acaccctccgcagcca

SEQ ID NO: 24677 - DNA, 16 bp, H. sapiens
acaccctcctgctcct

SEQ ID NO: 24678 - DNA, 16 bp, H. sapiens
acaccctcttcaataa

SEQ ID NO: 24679 - DNA, 16 bp, H. sapiens
acaccctggctgtgga

SEQ ID NO: 24680 - DNA, 16 bp, H. sapiens
acaccggcccctccca

SEQ ID NO: 24681 - DNA, 16 bp, H. sapiens
acaccgtggaatacta

SEQ ID NO: 24682 - DNA, 16 bp, H. sapiens
acacctaagaaaatta

SEQ ID NO: 24683 - DNA, 16 bp, H. sapiens
acacctacaacaatct

SEQ ID NO: 24684 - DNA, 16 bp, H. sapiens
acacctacaaccatct

SEQ ID NO: 24685 - DNA, 16 bp, H. sapiens
acacctactatatacc

SEQ ID NO: 24686 - DNA, 16 bp, H. sapiens
acacctactatgtacc

SEQ ID NO: 24687 - DNA, 16 bp, H. sapiens
acacctaggctatatg

SEQ ID NO: 24688 - DNA, 16 bp, H. sapiens
acacctataataccag

SEQ ID NO: 24689 - DNA, 16 bp, H. sapiens
acacctcactatgtcc

SEQ ID NO: 24690 - DNA, 16 bp, H. sapiens
acacctcagcctcctg

SEQ ID NO: 24691 - DNA, 17 bp, H. sapiens
acacctcccaccaggct

SEQ ID NO: 24692 - DNA, 16 bp, H. sapiens
acacctcctccaggaa

SEQ ID NO: 24693 - DNA, 16 bp, H. sapiens
acacctctgtgcacat

SEQ ID NO: 24694 - DNA, 16 bp, H. sapiens
acacctctttccttta

SEQ ID NO: 24695 - DNA, 16 bp, H. sapiens
acacctgaggtcaaga

SEQ ID NO: 24696 - DNA, 16 bp, H. sapiens
acacctgcaatctcag

SEQ ID NO: 24697 - DNA, 16 bp, H. sapiens
acacctgcacattctg

SEQ ID NO: 24698 - DNA, 16 bp, H. sapiens
acacctgcatacacac

SEQ ID NO: 24699 - DNA, 16 bp, H. sapiens
acacctgctctgtgcc

SEQ ID NO: 24700 - DNA, 16 bp, H. sapiens
acacctggaattccag

SEQ ID NO: 24701 - DNA, 16 bp, H. sapiens
acacctggataatttt

SEQ ID NO: 24702 - DNA, 16 bp, H. sapiens
acacctggctaatttt

SEQ ID NO: 24703 - DNA, 17 bp, H. sapiens
acacctggctgattttt

SEQ ID NO: 24704 - DNA, 16 bp, H. sapiens
acacctgtaaacccaa

SEQ ID NO: 24705 - DNA, 16 bp, H. sapiens
acacctgtaatcccac

SEQ ID NO: 24706 - DNA, 16 bp, H. sapiens
acacctgtagttccag

SEQ ID NO: 24707 - DNA, 18 bp, H. sapiens
acacctgtcatcccagct

SEQ ID NO: 24708 - DNA, 16 bp, H. sapiens
acacctgtgtaaccac

SEQ ID NO: 24709 - DNA, 16 bp, H. sapiens
acaccttatacaggag

SEQ ID NO: 24710 - DNA, 16 bp, H. sapiens
acacgcacacacattc

SEQ ID NO: 24711 - DNA, 16 bp, H. sapiens
acacgcacacgcgcgc

SEQ ID NO: 24712 - DNA, 16 bp, H. sapiens
acacgcacgcacacat

SEQ ID NO: 24713 - DNA, 16 bp, H. sapiens
acacgcagctaatttt

SEQ ID NO: 24714 - DNA, 16 bp, H. sapiens
acacgcatgcacacat

SEQ ID NO: 24715 - DNA, 16 bp, H. sapiens
acacggcaagaccctg

SEQ ID NO: 24716 - DNA, 16 bp, H. sapiens
acacggtcttccacaa

SEQ ID NO: 24717 - DNA, 16 bp, H. sapiens
acacggtgagactctg

SEQ ID NO: 24718 - DNA, 18 bp, H. sapiens
acacggtggctcacgcct

SEQ ID NO: 24719 - DNA, 16 bp, H. sapiens
acacgtacacacacac

SEQ ID NO: 24720 - DNA, 16 bp, H. sapiens
acacgtacaccctccc

SEQ ID NO: 24721 - DNA, 16 bp, H. sapiens
acacgtgcacacacgc

SEQ ID NO: 24722 - DNA, 16 bp, H. sapiens
acacgtgcaggatgtg

SEQ ID NO: 24723 - DNA, 16 bp, H. sapiens
acacgtgcgtgcacac

SEQ ID NO: 24724 - DNA, 16 bp, H. sapiens
acacgtgtaatcccag

SEQ ID NO: 24725 - DNA, 16 bp, H. sapiens
acacgtgtgcacatgc

SEQ ID NO: 24726 - DNA, 16 bp, H. sapiens
acacgtgtgcatgtgt

SEQ ID NO: 24727 - DNA, 16 bp, H. sapiens
acactaaagatttcac

SEQ ID NO: 24728 - DNA, 16 bp, H. sapiens
acactacaagaatttt

SEQ ID NO: 24729 - DNA, 16 bp, H. sapiens
acactactacactcca

SEQ ID NO: 24730 - DNA, 16 bp, H. sapiens
acactactcaaagcaa

SEQ ID NO: 24731 - DNA, 16 bp, H. sapiens
acactactcaggtgac

SEQ ID NO: 24732 - DNA, 16 bp, H. sapiens
acactagaaagaagct

SEQ ID NO: 24733 - DNA, 16 bp, H. sapiens
acactatatacatata

SEQ ID NO: 24734 - DNA, 16 bp, H. sapiens
acactatctacctgga

SEQ ID NO: 24735 - DNA, 16 bp, H. sapiens
acactattttgtcttt

SEQ ID NO: 24736 - DNA, 16 bp, H. sapiens
acactatttttaaatt

SEQ ID NO: 24737 - DNA, 16 bp, H. sapiens
acactcaacgccagcc

SEQ ID NO: 24738 - DNA, 16 bp, H. sapiens
acactcaagcaatcct

SEQ ID NO: 24739 - DNA, 16 bp, H. sapiens
acactcaataaatgtt

SEQ ID NO: 24740 - DNA, 16 bp, H. sapiens
acactcacaccaacag

SEQ ID NO: 24741 - DNA, 16 bp, H. sapiens
acactcagctaatttt

SEQ ID NO: 24742 - DNA, 16 bp, H. sapiens
acactcatacatatat

SEQ ID NO: 24743 - DNA, 16 bp, H. sapiens
acactcatcacacaca

SEQ ID NO: 24744 - DNA, 16 bp, H. sapiens
acactcatttgtttat

SEQ ID NO: 24745 - DNA, 16 bp, H. sapiens
acactccagccagggt

SEQ ID NO: 24746 - DNA, 23 bp, H. sapiens
acactccagcctgggcaacagaa

SEQ ID NO: 24747 - DNA, 16 bp, H. sapiens
acactccatcctgggt

SEQ ID NO: 24748 - DNA, 16 bp, H. sapiens
acactcccaccagcac

SEQ ID NO: 24749 - DNA, 16 bp, H. sapiens
acactcctcagccctt

SEQ ID NO: 24750 - DNA, 16 bp, H. sapiens
acactcctcatcttca

SEQ ID NO: 24751 - DNA, 16 bp, H. sapiens
acactcctgattcacc

SEQ ID NO: 24752 - DNA, 16 bp, H. sapiens
acactcctgcctgggt

SEQ ID NO: 24753 - DNA, 16 bp, H. sapiens
acactcggctaatttt

SEQ ID NO: 24754 - DNA, 16 bp, H. sapiens
acactctcatcaacag

SEQ ID NO: 24755 - DNA, 16 bp, H. sapiens
acactctgggaggccg

SEQ ID NO: 24756 - DNA, 17 bp, H. sapiens
acactctgtatctagct

SEQ ID NO: 24757 - DNA, 16 bp, H. sapiens
acactctgtctcaaaa

SEQ ID NO: 24758 - DNA, 16 bp, H. sapiens
acactctgtcttaaaa

SEQ ID NO: 24759 - DNA, 16 bp, H. sapiens
acactctttaggatat

SEQ ID NO: 24760 - DNA, 16 bp, H. sapiens
acactgaaaaataatt

SEQ ID NO: 24761 - DNA, 16 bp, H. sapiens
acactgaaatacacag

SEQ ID NO: 24762 - DNA, 16 bp, H. sapiens
acactgaattagtgaa

SEQ ID NO: 24763 - DNA, 16 bp, H. sapiens
acactgaatttatttt

SEQ ID NO: 24764 - DNA, 16 bp, H. sapiens
acactgacattttaaa

SEQ ID NO: 24765 - DNA, 16 bp, H. sapiens
acactgacttccaaaa

SEQ ID NO: 24766 - DNA, 16 bp, H. sapiens
acactgagaaataaaa

SEQ ID NO: 24767 - DNA, 16 bp, H. sapiens
acactgagaccactga

SEQ ID NO: 24768 - DNA, 16 bp, H. sapiens
acactgaggcccagag

SEQ ID NO: 24769 - DNA, 16 bp, H. sapiens
acactgatgatgagga

SEQ ID NO: 24770 - DNA, 16 bp, H. sapiens
acactgatggacattt

SEQ ID NO: 24771 - DNA, 16 bp, H. sapiens
acactgatgggtcctg

SEQ ID NO: 24772 - DNA, 16 bp, H. sapiens
acactgattttctttc

SEQ ID NO: 24773 - DNA, 16 bp, H. sapiens
acactgatttttaaaa

SEQ ID NO: 24774 - DNA, 16 bp, H. sapiens
acactgattttttttt

SEQ ID NO: 24775 - DNA, 16 bp, H. sapiens
acactgcagaaattca

SEQ ID NO: 24776 - DNA, 16 bp, H. sapiens
acactgcagcctcaac

SEQ ID NO: 24777 - DNA, 16 bp, H. sapiens
acactgcctcttcaat

SEQ ID NO: 24778 - DNA, 16 bp, H. sapiens
acactgctccctgcat

SEQ ID NO: 24779 - DNA, 16 bp, H. sapiens
acactgctgaaagata

SEQ ID NO: 24780 - DNA, 16 bp, H. sapiens
acactgctgacaaaga

SEQ ID NO: 24781 - DNA, 16 bp, H. sapiens
acactgctgataagga

SEQ ID NO: 24782 - DNA, 16 bp, H. sapiens
acactgctgctgagtt

SEQ ID NO: 24783 - DNA, 16 bp, H. sapiens
acactgctgctggctt

SEQ ID NO: 24784 - DNA, 16 bp, H. sapiens
acactgctgctgggat

SEQ ID NO: 24785 - DNA, 16 bp, H. sapiens
acactgctggtgggag

SEQ ID NO: 24786 - DNA, 16 bp, H. sapiens
acactggaagaattgt

SEQ ID NO: 24787 - DNA, 16 bp, H. sapiens
acactggaatgcagtg

SEQ ID NO: 24788 - DNA, 16 bp, H. sapiens
acactggagagaaacc

SEQ ID NO: 24789 - DNA, 16 bp, H. sapiens
acactggatctgccag

SEQ ID NO: 24790 - DNA, 16 bp, H. sapiens
acactggatctgctgg

SEQ ID NO: 24791 - DNA, 16 bp, H. sapiens
acactggctaattttt

SEQ ID NO: 24792 - DNA, 16 bp, H. sapiens
acactgggaactccaa

SEQ ID NO: 24793 - DNA, 16 bp, H. sapiens
acactgggacactgtc

SEQ ID NO: 24794 - DNA, 16 bp, H. sapiens
acactggggaaaaaaa

SEQ ID NO: 24795 - DNA, 16 bp, H. sapiens
acactggggagggcaa

SEQ ID NO: 24796 - DNA, 16 bp, H. sapiens
acactggggcctgcca

SEQ ID NO: 24797 - DNA, 16 bp, H. sapiens
acactgggggaaaaaa

SEQ ID NO: 24798 - DNA, 16 bp, H. sapiens
acactgtaaggggaaa

SEQ ID NO: 24799 - DNA, 16 bp, H. sapiens
acactgtactgaaagt

SEQ ID NO: 24800 - DNA, 16 bp, H. sapiens
acactgtctctttaaa

SEQ ID NO: 24801 - DNA, 16 bp, H. sapiens
acactgtgactgtcac

SEQ ID NO: 24802 - DNA, 16 bp, H. sapiens
acactgtgagcataga

SEQ ID NO: 24803 - DNA, 16 bp, H. sapiens
acactgtgaggggaaa

SEQ ID NO: 24804 - DNA, 16 bp, H. sapiens
acactgtggaaggcca

SEQ ID NO: 24805 - DNA, 16 bp, H. sapiens
acactgtgtgattcca

SEQ ID NO: 24806 - DNA, 16 bp, H. sapiens
acactgttaactttta

SEQ ID NO: 24807 - DNA, 16 bp, H. sapiens
acactgttcttccttc

SEQ ID NO: 24808 - DNA, 16 bp, H. sapiens
acactgttcttgtaga

SEQ ID NO: 24809 - DNA, 16 bp, H. sapiens
acactgttgaaagaaa

SEQ ID NO: 24810 - DNA, 16 bp, H. sapiens
acactgttgagttttc

SEQ ID NO: 24811 - DNA, 16 bp, H. sapiens
acactgttgtacaacc

SEQ ID NO: 24812 - DNA, 16 bp, H. sapiens
acactgtttattaaat

SEQ ID NO: 24813 - DNA, 16 bp, H. sapiens
acactgtttgtgggaa

SEQ ID NO: 24814 - DNA, 16 bp, H. sapiens
acacttaaaaaatttt

SEQ ID NO: 24815 - DNA, 16 bp, H. sapiens
acacttaaaaatagtt

SEQ ID NO: 24816 - DNA, 16 bp, H. sapiens
acacttaaaaatggtt

SEQ ID NO: 24817 - DNA, 16 bp, H. sapiens
acacttaacatttttt

SEQ ID NO: 24818 - DNA, 16 bp, H. sapiens
acacttaccatatgat

SEQ ID NO: 24819 - DNA, 16 bp, H. sapiens
acacttagaaatggtt

SEQ ID NO: 24820 - DNA, 16 bp, H. sapiens
acacttaggttgcttc

SEQ ID NO: 24821 - DNA, 16 bp, H. sapiens
acacttataaagccat

SEQ ID NO: 24822 - DNA, 16 bp, H. sapiens
acacttatagaaatgc

SEQ ID NO: 24823 - DNA, 16 bp, H. sapiens
acacttattttttaaa

SEQ ID NO: 24824 - DNA, 16 bp, H. sapiens
acacttcaataaagct

SEQ ID NO: 24825 - DNA, 16 bp, H. sapiens
acacttcacaaagcag

SEQ ID NO: 24826 - DNA, 16 bp, H. sapiens
acacttcaggatatca

SEQ ID NO: 24827 - DNA, 16 bp, H. sapiens
acacttccaccagcaa

SEQ ID NO: 24828 - DNA, 16 bp, H. sapiens
acacttccaccagcag

SEQ ID NO: 24829 - DNA, 16 bp, H. sapiens
acacttcccaaagcaa

SEQ ID NO: 24830 - DNA, 16 bp, H. sapiens
acacttcctgtttaca

SEQ ID NO: 24831 - DNA, 16 bp, H. sapiens
acacttctcaaaagca

SEQ ID NO: 24832 - DNA, 16 bp, H. sapiens
acacttctccttcctg

SEQ ID NO: 24833 - DNA, 16 bp, H. sapiens
acacttctctctcctg

SEQ ID NO: 24834 - DNA, 16 bp, H. sapiens
acacttctggaggcca

SEQ ID NO: 24835 - DNA, 16 bp, H. sapiens
acacttgaccaaatgg

SEQ ID NO: 24836 - DNA, 16 bp, H. sapiens
acacttgcacatgcat

SEQ ID NO: 24837 - DNA, 16 bp, H. sapiens
acacttggaaactaaa

SEQ ID NO: 24838 - DNA, 16 bp, H. sapiens
acacttggaaattaaa

SEQ ID NO: 24839 - DNA, 16 bp, H. sapiens
acacttggaagagggt

SEQ ID NO: 24840 - DNA, 16 bp, H. sapiens
acacttggacacagtg

SEQ ID NO: 24841 - DNA, 16 bp, H. sapiens
acacttggctaatttt

SEQ ID NO: 24842 - DNA, 16 bp, H. sapiens
acacttggctgatttt

SEQ ID NO: 24843 - DNA, 16 bp, H. sapiens
acactttaaaaagcaa

SEQ ID NO: 24844 - DNA, 16 bp, H. sapiens
acactttaaattattt

SEQ ID NO: 24845 - DNA, 16 bp, H. sapiens
acactttaagttttag

SEQ ID NO: 24846 - DNA, 16 bp, H. sapiens
acactttattttaaaa

SEQ ID NO: 24847 - DNA, 16 bp, H. sapiens
acactttgagaaccag

SEQ ID NO: 24848 - DNA, 16 bp, H. sapiens
acactttgatttcaga

SEQ ID NO: 24849 - DNA, 16 bp, H. sapiens
acactttgattttagc

SEQ ID NO: 24850 - DNA, 16 bp, H. sapiens
acactttgggaggcca

SEQ ID NO: 24851 - DNA, 27 bp, H. sapiens
acactttgggaggccaaggtgggcaga

SEQ ID NO: 24852 - DNA, 16 bp, H. sapiens
acacttttaaaagaaa

SEQ ID NO: 24853 - DNA, 16 bp, H. sapiens
acacttttcaaaagat

SEQ ID NO: 24854 - DNA, 16 bp, H. sapiens
acacttttcctggaaa

SEQ ID NO: 24855 - DNA, 16 bp, H. sapiens
acacttttgttgttgt

SEQ ID NO: 24856 - DNA, 16 bp, H. sapiens
acactttttaaaaaca

SEQ ID NO: 24857 - DNA, 16 bp, H. sapiens
acactttttaaaagaa

SEQ ID NO: 24858 - DNA, 16 bp, H. sapiens
acagaaaaaaatagtt

SEQ ID NO: 24859 - DNA, 16 bp, H. sapiens
acagaaaaaaatgcag

SEQ ID NO: 24860 - DNA, 16 bp, H. sapiens
acagaaaaaaatgcat

SEQ ID NO: 24861 - DNA, 16 bp, H. sapiens
acagaaaaaaatgtat

SEQ ID NO: 24862 - DNA, 16 bp, H. sapiens
acagaaaaactgagca

SEQ ID NO: 24863 - DNA, 16 bp, H. sapiens
acagaaaaagatattt

SEQ ID NO: 24864 - DNA, 16 bp, H. sapiens
acagaaaaagcttgct

SEQ ID NO: 24865 - DNA, 16 bp, H. sapiens
acagaaaaataattat

SEQ ID NO: 24866 - DNA, 16 bp, H. sapiens
acagaaaaatatattt

SEQ ID NO: 24867 - DNA, 16 bp, H. sapiens
acagaaaaatgacatt

SEQ ID NO: 24868 - DNA, 16 bp, H. sapiens
acagaaaaattagcca

SEQ ID NO: 24869 - DNA, 16 bp, H. sapiens
acagaaaaattggaaa

SEQ ID NO: 24870 - DNA, 16 bp, H. sapiens
acagaaaacatgtaaa

SEQ ID NO: 24871 - DNA, 16 bp, H. sapiens
acagaaaacatttttc

SEQ ID NO: 24872 - DNA, 16 bp, H. sapiens
acagaaaactgtaaaa

SEQ ID NO: 24873 - DNA, 16 bp, H. sapiens
acagaaaagaaaatcc

SEQ ID NO: 24874 - DNA, 16 bp, H. sapiens
acagaaaagcaaatat

SEQ ID NO: 24875 - DNA, 16 bp, H. sapiens
acagaaaagcccagga

SEQ ID NO: 24876 - DNA, 16 bp, H. sapiens
acagaaaagctgaaaa

SEQ ID NO: 24877 - DNA, 16 bp, H. sapiens
acagaaaaggaattca

SEQ ID NO: 24878 - DNA, 16 bp, H. sapiens
acagaaaaggacaaat

SEQ ID NO: 24879 - DNA, 16 bp, H. sapiens
acagaaaaggcacagt

SEQ ID NO: 24880 - DNA, 16 bp, H. sapiens
acagaaaagttacaaa

SEQ ID NO: 24881 - DNA, 16 bp, H. sapiens
acagaaaagttgaaag

SEQ ID NO: 24882 - DNA, 16 bp, H. sapiens
acagaaaagttggaaa

SEQ ID NO: 24883 - DNA, 16 bp, H. sapiens
acagaaaataagcaag

SEQ ID NO: 24884 - DNA, 16 bp, H. sapiens
acagaaaataataatt

SEQ ID NO: 24885 - DNA, 16 bp, H. sapiens
acagaaaatatgaact

SEQ ID NO: 24886 - DNA, 16 bp, H. sapiens
acagaaaatcatcaaa

SEQ ID NO: 24887 - DNA, 16 bp, H. sapiens
acagaaaatctaaaca

SEQ ID NO: 24888 - DNA, 16 bp, H. sapiens
acagaaaatgaaaagt

SEQ ID NO: 24889 - DNA, 16 bp, H. sapiens
acagaaaatgaaagtg

SEQ ID NO: 24890 - DNA, 16 bp, H. sapiens
acagaaaatgaagaca

SEQ ID NO: 24891 - DNA, 16 bp, H. sapiens
acagaaaatgattttt

SEQ ID NO: 24892 - DNA, 16 bp, H. sapiens
acagaaaatggaaaga

SEQ ID NO: 24893 - DNA, 16 bp, H. sapiens
acagaaaatggagaaa

SEQ ID NO: 24894 - DNA, 16 bp, H. sapiens
acagaaaatggagcag

SEQ ID NO: 24895 - DNA, 16 bp, H. sapiens
acagaaaattcaaaca

SEQ ID NO: 24896 - DNA, 16 bp, H. sapiens
acagaaaattctaaaa

SEQ ID NO: 24897 - DNA, 16 bp, H. sapiens
acagaaaatttggaaa

SEQ ID NO: 24898 - DNA, 16 bp, H. sapiens
acagaaaattttactt

SEQ ID NO: 24899 - DNA, 16 bp, H. sapiens
acagaaacaaccaaat

SEQ ID NO: 24900 - DNA, 16 bp, H. sapiens
acagaaacacctgaaa

SEQ ID NO: 24901 - DNA, 16 bp, H. sapiens
acagaaacagaattca

SEQ ID NO: 24902 - DNA, 16 bp, H. sapiens
acagaaacagagacag

SEQ ID NO: 24903 - DNA, 16 bp, H. sapiens
acagaaaccacatgat

SEQ ID NO: 24904 - DNA, 16 bp, H. sapiens
acagaaactagaaaat

SEQ ID NO: 24905 - DNA, 16 bp, H. sapiens
acagaaacttctgcag

SEQ ID NO: 24906 - DNA, 16 bp, H. sapiens
acagaaacttgaaaaa

SEQ ID NO: 24907 - DNA, 16 bp, H. sapiens
acagaaacttttaaaa

SEQ ID NO: 24908 - DNA, 16 bp, H. sapiens
acagaaagaaaaatgc

SEQ ID NO: 24909 - DNA, 16 bp, H. sapiens
acagaaagaaagccag

SEQ ID NO: 24910 - DNA, 16 bp, H. sapiens
acagaaagaaatagca

SEQ ID NO: 24911 - DNA, 16 bp, H. sapiens
acagaaagaaatggaa

SEQ ID NO: 24912 - DNA, 16 bp, H. sapiens
acagaaagacaaactg

SEQ ID NO: 24913 - DNA, 16 bp, H. sapiens
acagaaagacaaattt

SEQ ID NO: 24914 - DNA, 16 bp, H. sapiens
acagaaagagaaatac

SEQ ID NO: 24915 - DNA, 16 bp, H. sapiens
acagaaagagaaatat

SEQ ID NO: 24916 - DNA, 16 bp, H. sapiens
acagaaagagactccg

SEQ ID NO: 24917 - DNA, 16 bp, H. sapiens
acagaaagagagaatg

SEQ ID NO: 24918 - DNA, 16 bp, H. sapiens
acagaaagcaaatcag

SEQ ID NO: 24919 - DNA, 16 bp, H. sapiens
acagaaaggaacagca

SEQ ID NO: 24920 - DNA, 16 bp, H. sapiens
acagaaaggcaaatat

SEQ ID NO: 24921 - DNA, 16 bp, H. sapiens
acagaaaggggaatat

SEQ ID NO: 24922 - DNA, 16 bp, H. sapiens
acagaaagtgagaaaa

SEQ ID NO: 24923 - DNA, 16 bp, H. sapiens
acagaaagttcaaaaa

SEQ ID NO: 24924 - DNA, 16 bp, H. sapiens
acagaaagtttttttt

SEQ ID NO: 24925 - DNA, 16 bp, H. sapiens
acagaaataaatattt

SEQ ID NO: 24926 - DNA, 16 bp, H. sapiens
acagaaataatttatt

SEQ ID NO: 24927 - DNA, 16 bp, H. sapiens
acagaaataattttta

SEQ ID NO: 24928 - DNA, 16 bp, H. sapiens
acagaaatagaaaatg

SEQ ID NO: 24929 - DNA, 16 bp, H. sapiens
acagaaatataaatga

SEQ ID NO: 24930 - DNA, 16 bp, H. sapiens
acagaaatatagagtg

SEQ ID NO: 24931 - DNA, 16 bp, H. sapiens
acagaaatattttttc

SEQ ID NO: 24932 - DNA, 16 bp, H. sapiens
acagaaatccaaacac

SEQ ID NO: 24933 - DNA, 16 bp, H. sapiens
acagaaatctggagaa

SEQ ID NO: 24934 - DNA, 16 bp, H. sapiens
acagaaatgaaagcat

SEQ ID NO: 24935 - DNA, 16 bp, H. sapiens
acagaaatgcaaaaat

SEQ ID NO: 24936 - DNA, 16 bp, H. sapiens
acagaaatgcaaaaga

SEQ ID NO: 24937 - DNA, 16 bp, H. sapiens
acagaaatgcaaacta

SEQ ID NO: 24938 - DNA, 16 bp, H. sapiens
acagaaatgcaaagga

SEQ ID NO: 24939 - DNA, 16 bp, H. sapiens
acagaaatgcaaataa

SEQ ID NO: 24940 - DNA, 16 bp, H. sapiens
acagaaatggaaatgt

SEQ ID NO: 24941 - DNA, 16 bp, H. sapiens
acagaaatggaatcat

SEQ ID NO: 24942 - DNA, 16 bp, H. sapiens
acagaaatggattctc

SEQ ID NO: 24943 - DNA, 16 bp, H. sapiens
acagaaatgggaaaat

SEQ ID NO: 24944 - DNA, 16 bp, H. sapiens
acagaaatgtaaaata

SEQ ID NO: 24945 - DNA, 16 bp, H. sapiens
acagaaatgtattctg

SEQ ID NO: 24946 - DNA, 16 bp, H. sapiens
acagaaatgtatttgg

SEQ ID NO: 24947 - DNA, 16 bp, H. sapiens
acagaaatgtttttct

SEQ ID NO: 24948 - DNA, 16 bp, H. sapiens
acagaaattaaataat

SEQ ID NO: 24949 - DNA, 16 bp, H. sapiens
acagaaattcataaag

SEQ ID NO: 24950 - DNA, 16 bp, H. sapiens
acagaaatttaaaaat

SEQ ID NO: 24951 - DNA, 16 bp, H. sapiens
acagaaatttaaaatt

SEQ ID NO: 24952 - DNA, 16 bp, H. sapiens
acagaacaagaccctg

SEQ ID NO: 24953 - DNA, 16 bp, H. sapiens
acagaacaagactcag

SEQ ID NO: 24954 - DNA, 16 bp, H. sapiens
acagaacaagactctg

SEQ ID NO: 24955 - DNA, 17 bp, H. sapiens
acagaacaagattccgt

SEQ ID NO: 24956 - DNA, 16 bp, H. sapiens
acagaacacttcatcc

SEQ ID NO: 24957 - DNA, 16 bp, H. sapiens
acagaacagagacctc

SEQ ID NO: 24958 - DNA, 16 bp, H. sapiens
acagaacagaggcttc

SEQ ID NO: 24959 - DNA, 16 bp, H. sapiens
acagaacagatgcctc

SEQ ID NO: 24960 - DNA, 16 bp, H. sapiens
acagaacaggacaggg

SEQ ID NO: 24961 - DNA, 16 bp, H. sapiens
acagaacataccagaa

SEQ ID NO: 24962 - DNA, 16 bp, H. sapiens
acagaacatttccatt

SEQ ID NO: 24963 - DNA, 16 bp, H. sapiens
acagaaccaggattca

SEQ ID NO: 24964 - DNA, 16 bp, H. sapiens
acagaacccagcagca

SEQ ID NO: 24965 - DNA, 16 bp, H. sapiens
acagaactcaagaaag

SEQ ID NO: 24966 - DNA, 16 bp, H. sapiens
acagaactcagggaag

SEQ ID NO: 24967 - DNA, 16 bp, H. sapiens
acagaactctccatcc

SEQ ID NO: 24968 - DNA, 16 bp, H. sapiens
acagaactggagaaaa

SEQ ID NO: 24969 - DNA, 16 bp, H. sapiens
acagaactgtaagcca

SEQ ID NO: 24970 - DNA, 16 bp, H. sapiens
acagaacttctggaaa

SEQ ID NO: 24971 - DNA, 16 bp, H. sapiens
acagaacttgaaaaaa

SEQ ID NO: 24972 - DNA, 16 bp, H. sapiens
acagaactttattttc

SEQ ID NO: 24973 - DNA, 16 bp, H. sapiens
acagaagaaaaattta

SEQ ID NO: 24974 - DNA, 16 bp, H. sapiens
acagaagaaaacttaa

SEQ ID NO: 24975 - DNA, 16 bp, H. sapiens
acagaagaaaataatt

SEQ ID NO: 24976 - DNA, 16 bp, H. sapiens
acagaagaaagaatca

SEQ ID NO: 24977 - DNA, 16 bp, H. sapiens
acagaagaagaaatga

SEQ ID NO: 24978 - DNA, 16 bp, H. sapiens
acagaagaattgcttg

SEQ ID NO: 24979 - DNA, 16 bp, H. sapiens
acagaagacttctgtg

SEQ ID NO: 24980 - DNA, 16 bp, H. sapiens
acagaagagcccttgg

SEQ ID NO: 24981 - DNA, 16 bp, H. sapiens
acagaagcaagagcaa

SEQ ID NO: 24982 - DNA, 16 bp, H. sapiens
acagaagcagagattg

SEQ ID NO: 24983 - DNA, 16 bp, H. sapiens
acagaagcaggcttca

SEQ ID NO: 24984 - DNA, 16 bp, H. sapiens
acagaagctcttaagt

SEQ ID NO: 24985 - DNA, 16 bp, H. sapiens
acagaagctttattca

SEQ ID NO: 24986 - DNA, 16 bp, H. sapiens
acagaaggagacagag

SEQ ID NO: 24987 - DNA, 16 bp, H. sapiens
acagaaggattctgag

SEQ ID NO: 24988 - DNA, 16 bp, H. sapiens
acagaaggcaaaggag

SEQ ID NO: 24989 - DNA, 16 bp, H. sapiens
acagaaggccacatat

SEQ ID NO: 24990 - DNA, 16 bp, H. sapiens
acagaaggtgaaggag

SEQ ID NO: 24991 - DNA, 16 bp, H. sapiens
acagaagtaggattca

SEQ ID NO: 24992 - DNA, 16 bp, H. sapiens
acagaagtcaagaatg

SEQ ID NO: 24993 - DNA, 16 bp, H. sapiens
acagaagtttgagacc

SEQ ID NO: 24994 - DNA, 16 bp, H. sapiens
acagaagttttttttt

SEQ ID NO: 24995 - DNA, 16 bp, H. sapiens
acagaataaaaatttt

SEQ ID NO: 24996 - DNA, 16 bp, H. sapiens
acagaataaattttta

SEQ ID NO: 24997 - DNA, 16 bp, H. sapiens
acagaataagactccg

SEQ ID NO: 24998 - DNA, 16 bp, H. sapiens
acagaataccacagat

SEQ ID NO: 24999 - DNA, 16 bp, H. sapiens
acagaataccagagac

SEQ ID NO: 25000 - DNA, 16 bp, H. sapiens
acagaatatacagtct

SEQ ID NO: 25001 - DNA, 16 bp, H. sapiens
acagaatatacattct

SEQ ID NO: 25002 - DNA, 16 bp, H. sapiens
acagaatatacattgt

SEQ ID NO: 25003 - DNA, 16 bp, H. sapiens
acagaatattgtaaca

SEQ ID NO: 25004 - DNA, 16 bp, H. sapiens
acagaatatttagaaa

SEQ ID NO: 25005 - DNA, 16 bp, H. sapiens
acagaatatttcaaaa

SEQ ID NO: 25006 - DNA, 16 bp, H. sapiens
acagaatccagcagca

SEQ ID NO: 25007 - DNA, 16 bp, H. sapiens
acagaatcctccctaa

SEQ ID NO: 25008 - DNA, 16 bp, H. sapiens
acagaatctaagaaaa

SEQ ID NO: 25009 - DNA, 16 bp, H. sapiens
acagaatctcagtctg

SEQ ID NO: 25010 - DNA, 17 bp, H. sapiens
acagaatctccctctgt

SEQ ID NO: 25011 - DNA, 16 bp, H. sapiens
acagaatctgaaaaga

SEQ ID NO: 25012 - DNA, 16 bp, H. sapiens
acagaatctgctggtg

SEQ ID NO: 25013 - DNA, 16 bp, H. sapiens
acagaatgaaagagaa

SEQ ID NO: 25014 - DNA, 16 bp, H. sapiens
acagaatgaaatcctg

SEQ ID NO: 25015 - DNA, 16 bp, H. sapiens
acagaatgaagaataa

SEQ ID NO: 25016 - DNA, 16 bp, H. sapiens
acagaatgagaccccg

SEQ ID NO: 25017 - DNA, 16 bp, H. sapiens
acagaatgagaccctg

SEQ ID NO: 25018 - DNA, 16 bp, H. sapiens
acagaatgaggaagaa

SEQ ID NO: 25019 - DNA, 16 bp, H. sapiens
acagaatgattttttt

SEQ ID NO: 25020 - DNA, 16 bp, H. sapiens
acagaatggaagaaat

SEQ ID NO: 25021 - DNA, 16 bp, H. sapiens
acagaatggaagagaa

SEQ ID NO: 25022 - DNA, 16 bp, H. sapiens
acagaatggaataaaa

SEQ ID NO: 25023 - DNA, 16 bp, H. sapiens
acagaatggataaaga

SEQ ID NO: 25024 - DNA, 16 bp, H. sapiens
acagaatggggaaaaa

SEQ ID NO: 25025 - DNA, 16 bp, H. sapiens
acagaattagaaagaa

SEQ ID NO: 25026 - DNA, 16 bp, H. sapiens
acagaattatttaaaa

SEQ ID NO: 25027 - DNA, 16 bp, H. sapiens
acagaattctccaccc

SEQ ID NO: 25028 - DNA, 16 bp, H. sapiens
acagaattgaagaaag

SEQ ID NO: 25029 - DNA, 16 bp, H. sapiens
acagaattggaaaaat

SEQ ID NO: 25030 - DNA, 16 bp, H. sapiens
acagaattggaaaata

SEQ ID NO: 25031 - DNA, 16 bp, H. sapiens
acagaatttattttct

SEQ ID NO: 25032 - DNA, 16 bp, H. sapiens
acagaatttccctctt

SEQ ID NO: 25033 - DNA, 16 bp, H. sapiens
acagaattttaaaata

SEQ ID NO: 25034 - DNA, 16 bp, H. sapiens
acagacaaacacagag

SEQ ID NO: 25035 - DNA, 16 bp, H. sapiens
acagacaaacagagac

SEQ ID NO: 25036 - DNA, 16 bp, H. sapiens
acagacaaatgggatt

SEQ ID NO: 25037 - DNA, 16 bp, H. sapiens
acagacaaccccatca

SEQ ID NO: 25038 - DNA, 16 bp, H. sapiens
acagacaaggaaacag

SEQ ID NO: 25039 - DNA, 16 bp, H. sapiens
acagacacacaactct

SEQ ID NO: 25040 - DNA, 16 bp, H. sapiens
acagacacacacaatg

SEQ ID NO: 25041 - DNA, 16 bp, H. sapiens
acagacacacagacac

SEQ ID NO: 25042 - DNA, 16 bp, H. sapiens
acagacacacagatgc

SEQ ID NO: 25043 - DNA, 16 bp, H. sapiens
acagacacagacacat

SEQ ID NO: 25044 - DNA, 16 bp, H. sapiens
acagacacagagacca

SEQ ID NO: 25045 - DNA, 16 bp, H. sapiens
acagacacagccagaa

SEQ ID NO: 25046 - DNA, 16 bp, H. sapiens
acagacacatatgcac

SEQ ID NO: 25047 - DNA, 16 bp, H. sapiens
acagacacatgaaaat

SEQ ID NO: 25048 - DNA, 16 bp, H. sapiens
acagacacatggacca

SEQ ID NO: 25049 - DNA, 16 bp, H. sapiens
acagacacatggatca

SEQ ID NO: 25050 - DNA, 16 bp, H. sapiens
acagacaccactgaca

SEQ ID NO: 25051 - DNA, 16 bp, H. sapiens
acagacactcaataaa

SEQ ID NO: 25052 - DNA, 16 bp, H. sapiens
acagacactgaatctg

SEQ ID NO: 25053 - DNA, 16 bp, H. sapiens
acagacactggagtct

SEQ ID NO: 25054 - DNA, 16 bp, H. sapiens
acagacactgggtcct

SEQ ID NO: 25055 - DNA, 16 bp, H. sapiens
acagacagacacagac

SEQ ID NO: 25056 - DNA, 16 bp, H. sapiens
acagacagacacagag

SEQ ID NO: 25057 - DNA, 16 bp, H. sapiens
acagacagacagacaa

SEQ ID NO: 25058 - DNA, 16 bp, H. sapiens
acagacagacagacac

SEQ ID NO: 25059 - DNA, 16 bp, H. sapiens
acagacagacagacag

SEQ ID NO: 25060 - DNA, 16 bp, H. sapiens
acagacagagacagag

SEQ ID NO: 25061 - DNA, 16 bp, H. sapiens
acagacagagcagccc

SEQ ID NO: 25062 - DNA, 16 bp, H. sapiens
acagacaggagacagg

SEQ ID NO: 25063 - DNA, 16 bp, H. sapiens
acagacaggcagaaga

SEQ ID NO: 25064 - DNA, 16 bp, H. sapiens
acagacagggaaactg

SEQ ID NO: 25065 - DNA, 16 bp, H. sapiens
acagacagggtttccc

SEQ ID NO: 25066 - DNA, 16 bp, H. sapiens
acagacatacatacat

SEQ ID NO: 25067 - DNA, 16 bp, H. sapiens
acagacatatagaaca

SEQ ID NO: 25068 - DNA, 16 bp, H. sapiens
acagacatatgccacc

SEQ ID NO: 25069 - DNA, 17 bp, H. sapiens
acagacatcaagtactt

SEQ ID NO: 25070 - DNA, 16 bp, H. sapiens
acagacatgaaaaaat

SEQ ID NO: 25071 - DNA, 16 bp, H. sapiens
acagacatgagacacc

SEQ ID NO: 25072 - DNA, 16 bp, H. sapiens
acagacatgagccaac

SEQ ID NO: 25073 - DNA, 16 bp, H. sapiens
acagacatgtgccacc

SEQ ID NO: 25074 - DNA, 17 bp, H. sapiens
acagacatgtgccacca

SEQ ID NO: 25075 - DNA, 16 bp, H. sapiens
acagacattaaaagaa

SEQ ID NO: 25076 - DNA, 16 bp, H. sapiens
acagacatttcccaaa

SEQ ID NO: 25077 - DNA, 16 bp, H. sapiens
acagaccacagactgt

SEQ ID NO: 25078 - DNA, 16 bp, H. sapiens
acagaccccacagagg

SEQ ID NO: 25079 - DNA, 16 bp, H. sapiens
acagaccctttgaagg

SEQ ID NO: 25080 - DNA, 16 bp, H. sapiens
acagaccgagactctg

SEQ ID NO: 25081 - DNA, 16 bp, H. sapiens
acagacctgcagctca

SEQ ID NO: 25082 - DNA, 16 bp, H. sapiens
acagacctgggttcaa

SEQ ID NO: 25083 - DNA, 16 bp, H. sapiens
acagaccttacaccct

SEQ ID NO: 25084 - DNA, 16 bp, H. sapiens
acagacggacagacag

SEQ ID NO: 25085 - DNA, 16 bp, H. sapiens
acagacgtgagccact

SEQ ID NO: 25086 - DNA, 16 bp, H. sapiens
acagactaagacaaaa

SEQ ID NO: 25087 - DNA, 16 bp, H. sapiens
acagactgaaggctgt

SEQ ID NO: 25088 - DNA, 16 bp, H. sapiens
acagactgaatggctt

SEQ ID NO: 25089 - DNA, 16 bp, H. sapiens
acagactgagactcca

SEQ ID NO: 25090 - DNA, 16 bp, H. sapiens
acagactgggaggaaa

SEQ ID NO: 25091 - DNA, 16 bp, H. sapiens
acagactgggcaacat

SEQ ID NO: 25092 - DNA, 16 bp, H. sapiens
acagacttaaacataa

SEQ ID NO: 25093 - DNA, 16 bp, H. sapiens
acagactttaaaaata

SEQ ID NO: 25094 - DNA, 16 bp, H. sapiens
acagactttaaaacaa

SEQ ID NO: 25095 - DNA, 16 bp, H. sapiens
acagactttattcaga

SEQ ID NO: 25096 - DNA, 16 bp, H. sapiens
acagagaaaaactctg

SEQ ID NO: 25097 - DNA, 16 bp, H. sapiens
acagagaaagaattca

SEQ ID NO: 25098 - DNA, 16 bp, H. sapiens
acagagaaagactcag

SEQ ID NO: 25099 - DNA, 16 bp, H. sapiens
acagagaaaggaaagt

SEQ ID NO: 25100 - DNA, 16 bp, H. sapiens
acagagaaaggaaata

SEQ ID NO: 25101 - DNA, 16 bp, H. sapiens
acagagaacaccacag

SEQ ID NO: 25102 - DNA, 16 bp, H. sapiens
acagagaacaccatta

SEQ ID NO: 25103 - DNA, 16 bp, H. sapiens
acagagaagaaaatga

SEQ ID NO: 25104 - DNA, 16 bp, H. sapiens
acagagaagactggaa

SEQ ID NO: 25105 - DNA, 16 bp, H. sapiens
acagagaaggtgctca

SEQ ID NO: 25106 - DNA, 16 bp, H. sapiens
acagagaagtgaaaaa

SEQ ID NO: 25107 - DNA, 16 bp, H. sapiens
acagagaatgaagaaa

SEQ ID NO: 25108 - DNA, 16 bp, H. sapiens
acagagaatttaaaat

SEQ ID NO: 25109 - DNA, 16 bp, H. sapiens
acagagacacacagga

SEQ ID NO: 25110 - DNA, 16 bp, H. sapiens
acagagacagagacag

SEQ ID NO: 25111 - DNA, 16 bp, H. sapiens
acagagacagaggaga

SEQ ID NO: 25112 - DNA, 16 bp, H. sapiens
acagagaccaccacaa

SEQ ID NO: 25113 - DNA, 16 bp, H. sapiens
acagagacccagagag

SEQ ID NO: 25114 - DNA, 16 bp, H. sapiens
acagagactctgtctc

SEQ ID NO: 25115 - DNA, 16 bp, H. sapiens
acagagactttttttt

SEQ ID NO: 25116 - DNA, 16 bp, H. sapiens
acagagagaaaataga

SEQ ID NO: 25117 - DNA, 16 bp, H. sapiens
acagagagaaactcca

SEQ ID NO: 25118 - DNA, 16 bp, H. sapiens
acagagagaaagccag

SEQ ID NO: 25119 - DNA, 16 bp, H. sapiens
acagagagaaataaga

SEQ ID NO: 25120 - DNA, 16 bp, H. sapiens
acagagagaagcaatc

SEQ ID NO: 25121 - DNA, 16 bp, H. sapiens
acagagagaatgagag

SEQ ID NO: 25122 - DNA, 16 bp, H. sapiens
acagagagacacagag

SEQ ID NO: 25123 - DNA, 16 bp, H. sapiens
acagagagacactgtc

SEQ ID NO: 25124 - DNA, 16 bp, H. sapiens
acagagagacagagag

SEQ ID NO: 25125 - DNA, 16 bp, H. sapiens
acagagagagaaacac

SEQ ID NO: 25126 - DNA, 16 bp, H. sapiens
acagagagagaccttg

SEQ ID NO: 25127 - DNA, 16 bp, H. sapiens
acagagagagactcct

SEQ ID NO: 25128 - DNA, 16 bp, H. sapiens
acagagagaggaagtg

SEQ ID NO: 25129 - DNA, 16 bp, H. sapiens
acagagagaggctctc

SEQ ID NO: 25130 - DNA, 16 bp, H. sapiens
acagagagcttctttc

SEQ ID NO: 25131 - DNA, 16 bp, H. sapiens
acagagagggaccctg

SEQ ID NO: 25132 - DNA, 16 bp, H. sapiens
acagagatagaaagta

SEQ ID NO: 25133 - DNA, 16 bp, H. sapiens
acagagatgccaagaa

SEQ ID NO: 25134 - DNA, 16 bp, H. sapiens
acagagatttttcaaa

SEQ ID NO: 25135 - DNA, 16 bp, H. sapiens
acagagcaaaaccata

SEQ ID NO: 25136 - DNA, 16 bp, H. sapiens
acagagcaaaactcca

SEQ ID NO: 25137 - DNA, 16 bp, H. sapiens
acagagcaaaactctg

SEQ ID NO: 25138 - DNA, 16 bp, H. sapiens
acagagcaagaacctg

SEQ ID NO: 25139 - DNA, 16 bp, H. sapiens
acagagcaagacaatg

SEQ ID NO: 25140 - DNA, 16 bp, H. sapiens
acagagcaagacccca

SEQ ID NO: 25141 - DNA, 16 bp, H. sapiens
acagagcaagactagg

SEQ ID NO: 25142 - DNA, 16 bp, H. sapiens
acagagcaagactcta

SEQ ID NO: 25143 - DNA, 16 bp, H. sapiens
acagagcaagactctc

SEQ ID NO: 25144 - DNA, 17 bp, H. sapiens
acagagcaagactctgc

SEQ ID NO: 25145 - DNA, 16 bp, H. sapiens
acagagcaagactctt

SEQ ID NO: 25146 - DNA, 16 bp, H. sapiens
acagagcaagactgtc

SEQ ID NO: 25147 - DNA, 16 bp, H. sapiens
acagagcaagagagag

SEQ ID NO: 25148 - DNA, 16 bp, H. sapiens
acagagcaagatctgt

SEQ ID NO: 25149 - DNA, 16 bp, H. sapiens
acagagcaagatgctg

SEQ ID NO: 25150 - DNA, 16 bp, H. sapiens
acagagcaaggccttg

SEQ ID NO: 25151 - DNA, 16 bp, H. sapiens
acagagcaagtctcca

SEQ ID NO: 25152 - DNA, 16 bp, H. sapiens
acagagcacctgggga

SEQ ID NO: 25153 - DNA, 16 bp, H. sapiens
acagagcagaaaaact

SEQ ID NO: 25154 - DNA, 16 bp, H. sapiens
acagagcagaccctgt

SEQ ID NO: 25155 - DNA, 16 bp, H. sapiens
acagagcagagccctc

SEQ ID NO: 25156 - DNA, 16 bp, H. sapiens
acagagcagaggccag

SEQ ID NO: 25157 - DNA, 16 bp, H. sapiens
acagagcagaggcctc

SEQ ID NO: 25158 - DNA, 16 bp, H. sapiens
acagagcaggagcacc

SEQ ID NO: 25159 - DNA, 16 bp, H. sapiens
acagagcaggggggcc

SEQ ID NO: 25160 - DNA, 16 bp, H. sapiens
acagagcatgaccctg

SEQ ID NO: 25161 - DNA, 16 bp, H. sapiens
acagagccaaagacaa

SEQ ID NO: 25162 - DNA, 16 bp, H. sapiens
acagagccagaccctg

SEQ ID NO: 25163 - DNA, 16 bp, H. sapiens
acagagccagaccttg

SEQ ID NO: 25164 - DNA, 16 bp, H. sapiens
acagagccagattcca

SEQ ID NO: 25165 - DNA, 16 bp, H. sapiens
acagagccagcaggag

SEQ ID NO: 25166 - DNA, 16 bp, H. sapiens
acagagccaggccctg

SEQ ID NO: 25167 - DNA, 16 bp, H. sapiens
acagagccccaaaata

SEQ ID NO: 25168 - DNA, 16 bp, H. sapiens
acagagcccccactgg

SEQ ID NO: 25169 - DNA, 16 bp, H. sapiens
acagagcccccagaaa

SEQ ID NO: 25170 - DNA, 16 bp, H. sapiens
acagagcctccctctg

SEQ ID NO: 25171 - DNA, 16 bp, H. sapiens
acagagcctggctctg

SEQ ID NO: 25172 - DNA, 16 bp, H. sapiens
acagagcctttgattt

SEQ ID NO: 25173 - DNA, 16 bp, H. sapiens
acagagcgagaacctg

SEQ ID NO: 25174 - DNA, 16 bp, H. sapiens
acagagcgagaccccg

SEQ ID NO: 25175 - DNA, 17 bp, H. sapiens
acagagcgagacgctgt

SEQ ID NO: 25176 - DNA, 16 bp, H. sapiens
acagagcgagactgtc

SEQ ID NO: 25177 - DNA, 16 bp, H. sapiens
acagagcgagactgtg

SEQ ID NO: 25178 - DNA, 17 bp, H. sapiens
acagagcgagagtctgt

SEQ ID NO: 25179 - DNA, 17 bp, H. sapiens
acagagcgagattctgc

SEQ ID NO: 25180 - DNA, 16 bp, H. sapiens
acagagctaagaaata

SEQ ID NO: 25181 - DNA, 16 bp, H. sapiens
acagagctagactctg

SEQ ID NO: 25182 - DNA, 16 bp, H. sapiens
acagagctcccaagag

SEQ ID NO: 25183 - DNA, 16 bp, H. sapiens
acagagctgaaaaaca

SEQ ID NO: 25184 - DNA, 16 bp, H. sapiens
acagagctgaaaacca

SEQ ID NO: 25185 - DNA, 16 bp, H. sapiens
acagagctgcccaagg

SEQ ID NO: 25186 - DNA, 16 bp, H. sapiens
acagagctggaggcat

SEQ ID NO: 25187 - DNA, 16 bp, H. sapiens
acagagctggctgtgc

SEQ ID NO: 25188 - DNA, 16 bp, H. sapiens
acagaggaaagcagag

SEQ ID NO: 25189 - DNA, 16 bp, H. sapiens
acagaggaagaaaatg

SEQ ID NO: 25190 - DNA, 16 bp, H. sapiens
acagaggaagacagag

SEQ ID NO: 25191 - DNA, 16 bp, H. sapiens
acagaggaagaccttg

SEQ ID NO: 25192 - DNA, 16 bp, H. sapiens
acagaggaagattctg

SEQ ID NO: 25193 - DNA, 16 bp, H. sapiens
acagaggaaggtggca

SEQ ID NO: 25194 - DNA, 16 bp, H. sapiens
acagaggacagagaag

SEQ ID NO: 25195 - DNA, 16 bp, H. sapiens
acagaggactttctgt

SEQ ID NO: 25196 - DNA, 16 bp, H. sapiens
acagaggagagacaca

SEQ ID NO: 25197 - DNA, 16 bp, H. sapiens
acagaggaggaaacag

SEQ ID NO: 25198 - DNA, 16 bp, H. sapiens
acagaggatgctcaca

SEQ ID NO: 25199 - DNA, 16 bp, H. sapiens
acagaggcacagagaa

SEQ ID NO: 25200 - DNA, 16 bp, H. sapiens
acagaggcagaccctg

SEQ ID NO: 25201 - DNA, 16 bp, H. sapiens
acagaggcctcaaaaa

SEQ ID NO: 25202 - DNA, 16 bp, H. sapiens
acagaggctgagaagt

SEQ ID NO: 25203 - DNA, 16 bp, H. sapiens
acagaggctggaggag

SEQ ID NO: 25204 - DNA, 16 bp, H. sapiens
acagaggctggtgagg

SEQ ID NO: 25205 - DNA, 16 bp, H. sapiens
acagagggaaactctg

SEQ ID NO: 25206 - DNA, 16 bp, H. sapiens
acagagggaagacagc

SEQ ID NO: 25207 - DNA, 16 bp, H. sapiens
acagagggagaatctg

SEQ ID NO: 25208 - DNA, 16 bp, H. sapiens
acagagggagactatg

SEQ ID NO: 25209 - DNA, 16 bp, H. sapiens
acagagggagactctg

SEQ ID NO: 25210 - DNA, 16 bp, H. sapiens
acagagggaggccctg

SEQ ID NO: 25211 - DNA, 16 bp, H. sapiens
acagaggggaacatca

SEQ ID NO: 25212 - DNA, 16 bp, H. sapiens
acagaggggagccagg

SEQ ID NO: 25213 - DNA, 16 bp, H. sapiens
acagaggtggaaactg

SEQ ID NO: 25214 - DNA, 16 bp, H. sapiens
acagaggtggcagtga

SEQ ID NO: 25215 - DNA, 16 bp, H. sapiens
acagaggtggctgggg

SEQ ID NO: 25216 - DNA, 16 bp, H. sapiens
acagaggttgcagtga

SEQ ID NO: 25217 - DNA, 16 bp, H. sapiens
acagagtaacactctg

SEQ ID NO: 25218 - DNA, 16 bp, H. sapiens
acagagtaagaccttg

SEQ ID NO: 25219 - DNA, 16 bp, H. sapiens
acagagtaagtgctca

SEQ ID NO: 25220 - DNA, 16 bp, H. sapiens
acagagtacaaaagag

SEQ ID NO: 25221 - DNA, 16 bp, H. sapiens
acagagtactgattgg

SEQ ID NO: 25222 - DNA, 16 bp, H. sapiens
acagagtagaagaaaa

SEQ ID NO: 25223 - DNA, 16 bp, H. sapiens
acagagtaggtgctca

SEQ ID NO: 25224 - DNA, 16 bp, H. sapiens
acagagtccagctctg

SEQ ID NO: 25225 - DNA, 16 bp, H. sapiens
acagagtccccactag

SEQ ID NO: 25226 - DNA, 16 bp, H. sapiens
acagagtccttactgg

SEQ ID NO: 25227 - DNA, 16 bp, H. sapiens
acagagtctcactatt

SEQ ID NO: 25228 - DNA, 16 bp, H. sapiens
acagagtctcagtcac

SEQ ID NO: 25229 - DNA, 18 bp, H. sapiens
acagagtctcattctgtt

SEQ ID NO: 25230 - DNA, 16 bp, H. sapiens
acagagtctcctctgt

SEQ ID NO: 25231 - DNA, 16 bp, H. sapiens
acagagtctctccctg

SEQ ID NO: 25232 - DNA, 16 bp, H. sapiens
acagagtctctctgtc

SEQ ID NO: 25233 - DNA, 16 bp, H. sapiens
acagagtgaaacccag

SEQ ID NO: 25234 - DNA, 16 bp, H. sapiens
acagagtgaaaccctg

SEQ ID NO: 25235 - DNA, 16 bp, H. sapiens
acagagtgaaactcca

SEQ ID NO: 25236 - DNA, 16 bp, H. sapiens
acagagtgagacccag

SEQ ID NO: 25237 - DNA, 16 bp, H. sapiens
acagagtgagacccca

SEQ ID NO: 25238 - DNA, 16 bp, H. sapiens
acagagtgagacccct

SEQ ID NO: 25239 - DNA, 16 bp, H. sapiens
acagagtgagaccctt

SEQ ID NO: 25240 - DNA, 16 bp, H. sapiens
acagagtgagaccttg

SEQ ID NO: 25241 - DNA, 16 bp, H. sapiens
acagagtgagactcag

SEQ ID NO: 25242 - DNA, 16 bp, H. sapiens
acagagtgagactctt

SEQ ID NO: 25243 - DNA, 16 bp, H. sapiens
acagagtgagactgtc

SEQ ID NO: 25244 - DNA, 16 bp, H. sapiens
acagagtgagatccca

SEQ ID NO: 25245 - DNA, 18 bp, H. sapiens
acagagtgagattccgcc

SEQ ID NO: 25246 - DNA, 18 bp, H. sapiens
acagagtgccgattggtg

SEQ ID NO: 25247 - DNA, 17 bp, H. sapiens
acagagtgctgattggt

SEQ ID NO: 25248 - DNA, 16 bp, H. sapiens
acagagtggaagaaaa

SEQ ID NO: 25249 - DNA, 16 bp, H. sapiens
acagagtgggaaaaaa

SEQ ID NO: 25250 - DNA, 16 bp, H. sapiens
acagagtgtttccaaa

SEQ ID NO: 25251 - DNA, 16 bp, H. sapiens
acagagtttaaaaaaa

SEQ ID NO: 25252 - DNA, 16 bp, H. sapiens
acagagtttcaccctt

SEQ ID NO: 25253 - DNA, 16 bp, H. sapiens
acagagtttccttttg

SEQ ID NO: 25254 - DNA, 16 bp, H. sapiens
acagagtttctctctg

SEQ ID NO: 25255 - DNA, 16 bp, H. sapiens
acagagttttaaaaat

SEQ ID NO: 25256 - DNA, 16 bp, H. sapiens
acagagtttttatttt

SEQ ID NO: 25257 - DNA, 16 bp, H. sapiens
acagataaagaaactg

SEQ ID NO: 25258 - DNA, 16 bp, H. sapiens
acagataaagaagctg

SEQ ID NO: 25259 - DNA, 16 bp, H. sapiens
acagataaataaactg

SEQ ID NO: 25260 - DNA, 16 bp, H. sapiens
acagataacataaaat

SEQ ID NO: 25261 - DNA, 16 bp, H. sapiens
acagataattcagaaa

SEQ ID NO: 25262 - DNA, 16 bp, H. sapiens
acagatactggggcct

SEQ ID NO: 25263 - DNA, 16 bp, H. sapiens
acagatactttaaaaa

SEQ ID NO: 25264 - DNA, 16 bp, H. sapiens
acagatataaaaatga

SEQ ID NO: 25265 - DNA, 16 bp, H. sapiens
acagatatataaagca

SEQ ID NO: 25266 - DNA, 17 bp, H. sapiens
acagatatataggccaa

SEQ ID NO: 25267 - DNA, 16 bp, H. sapiens
acagatatatatatat

SEQ ID NO: 25268 - DNA, 16 bp, H. sapiens
acagatatctctttaa

SEQ ID NO: 25269 - DNA, 16 bp, H. sapiens
acagatatttacagaa

SEQ ID NO: 25270 - DNA, 16 bp, H. sapiens
acagatatttactgag

SEQ ID NO: 25271 - DNA, 16 bp, H. sapiens
acagatcaagaaactg

SEQ ID NO: 25272 - DNA, 16 bp, H. sapiens
acagatcatcccatca

SEQ ID NO: 25273 - DNA, 16 bp, H. sapiens
acagatctgtggaaaa

SEQ ID NO: 25274 - DNA, 16 bp, H. sapiens
acagatgaaaaactga

SEQ ID NO: 25275 - DNA, 16 bp, H. sapiens
acagatgaaaatgaaa

SEQ ID NO: 25276 - DNA, 16 bp, H. sapiens
acagatgaaaatggaa

SEQ ID NO: 25277 - DNA, 16 bp, H. sapiens
acagatgaaacaagat

SEQ ID NO: 25278 - DNA, 16 bp, H. sapiens
acagatgaaattatat

SEQ ID NO: 25279 - DNA, 16 bp, H. sapiens
acagatgaacagccag

SEQ ID NO: 25280 - DNA, 16 bp, H. sapiens
acagatgaagaaaatg

SEQ ID NO: 25281 - DNA, 16 bp, H. sapiens
acagatgaagaaacaa

SEQ ID NO: 25282 - DNA, 16 bp, H. sapiens
acagatgaagaaactg

SEQ ID NO: 25283 - DNA, 16 bp, H. sapiens
acagatgaagaaagag

SEQ ID NO: 25284 - DNA, 16 bp, H. sapiens
acagatgaagaaataa

SEQ ID NO: 25285 - DNA, 16 bp, H. sapiens
acagatgaatgaattt

SEQ ID NO: 25286 - DNA, 16 bp, H. sapiens
acagatgaatggataa

SEQ ID NO: 25287 - DNA, 16 bp, H. sapiens
acagatgagaaaacag

SEQ ID NO: 25288 - DNA, 16 bp, H. sapiens
acagatgagaaaatta

SEQ ID NO: 25289 - DNA, 16 bp, H. sapiens
acagatgagaaagaag

SEQ ID NO: 25290 - DNA, 16 bp, H. sapiens
acagatgaggaaacta

SEQ ID NO: 25291 - DNA, 16 bp, H. sapiens
acagatgaggaaactg

SEQ ID NO: 25292 - DNA, 16 bp, H. sapiens
acagatgaggaaccag

SEQ ID NO: 25293 - DNA, 16 bp, H. sapiens
acagatgaggaagcag

SEQ ID NO: 25294 - DNA, 16 bp, H. sapiens
acagatgaggagactg

SEQ ID NO: 25295 - DNA, 16 bp, H. sapiens
acagatgaggatgaaa

SEQ ID NO: 25296 - DNA, 16 bp, H. sapiens
acagatgaggtctcac

SEQ ID NO: 25297 - DNA, 16 bp, H. sapiens
acagatgagtgccacc

SEQ ID NO: 25298 - DNA, 16 bp, H. sapiens
acagatgatagataga

SEQ ID NO: 25299 - DNA, 16 bp, H. sapiens
acagatgcaaaaactg

SEQ ID NO: 25300 - DNA, 16 bp, H. sapiens
acagatgcacacacag

SEQ ID NO: 25301 - DNA, 16 bp, H. sapiens
acagatgcagaaaaga

SEQ ID NO: 25302 - DNA, 16 bp, H. sapiens
acagatgctaaaatcc

SEQ ID NO: 25303 - DNA, 16 bp, H. sapiens
acagatgctagtgagg

SEQ ID NO: 25304 - DNA, 16 bp, H. sapiens
acagatgctggagagc

SEQ ID NO: 25305 - DNA, 16 bp, H. sapiens
acagatggcttcactg

SEQ ID NO: 25306 - DNA, 16 bp, H. sapiens
acagatggggaagctg

SEQ ID NO: 25307 - DNA, 16 bp, H. sapiens
acagatggggtctccc

SEQ ID NO: 25308 - DNA, 16 bp, H. sapiens
acagatgtccaccacc

SEQ ID NO: 25309 - DNA, 16 bp, H. sapiens
acagatgtgagccatc

SEQ ID NO: 25310 - DNA, 16 bp, H. sapiens
acagatgtggtggaaa

SEQ ID NO: 25311 - DNA, 16 bp, H. sapiens
acagatgttggtgagg

SEQ ID NO: 25312 - DNA, 16 bp, H. sapiens
acagattattttgtca

SEQ ID NO: 25313 - DNA, 16 bp, H. sapiens
acagattcaattcaat

SEQ ID NO: 25314 - DNA, 16 bp, H. sapiens
acagattcagtgtctg

SEQ ID NO: 25315 - DNA, 16 bp, H. sapiens
acagattctacaaaca

SEQ ID NO: 25316 - DNA, 16 bp, H. sapiens
acagattgaaaaggaa

SEQ ID NO: 25317 - DNA, 16 bp, H. sapiens
acagattgagactcca

SEQ ID NO: 25318 - DNA, 16 bp, H. sapiens
acagattgggagaaaa

SEQ ID NO: 25319 - DNA, 16 bp, H. sapiens
acagattgtgaagatt

SEQ ID NO: 25320 - DNA, 16 bp, H. sapiens
acagattgtttcatca

SEQ ID NO: 25321 - DNA, 16 bp, H. sapiens
acagattttaaaactt

SEQ ID NO: 25322 - DNA, 16 bp, H. sapiens
acagattttatttatt

SEQ ID NO: 25323 - DNA, 16 bp, H. sapiens
acagatttttaaattt

SEQ ID NO: 25324 - DNA, 16 bp, H. sapiens
acagattttttaaaaa

SEQ ID NO: 25325 - DNA, 16 bp, H. sapiens
acagattttttaaatt

SEQ ID NO: 25326 - DNA, 16 bp, H. sapiens
acagatttttttaaaa

SEQ ID NO: 25327 - DNA, 16 bp, H. sapiens
acagatttttttttcc

SEQ ID NO: 25328 - DNA, 16 bp, H. sapiens
acagcaaaactgagtg

SEQ ID NO: 25329 - DNA, 16 bp, H. sapiens
acagcaaaagaaatga

SEQ ID NO: 25330 - DNA, 16 bp, H. sapiens
acagcaaaagaaatta

SEQ ID NO: 25331 - DNA, 16 bp, H. sapiens
acagcaaaagcaatgg

SEQ ID NO: 25332 - DNA, 16 bp, H. sapiens
acagcaaaaggaacta

SEQ ID NO: 25333 - DNA, 16 bp, H. sapiens
acagcaaaattgagaa

SEQ ID NO: 25334 - DNA, 16 bp, H. sapiens
acagcaaaattgagag

SEQ ID NO: 25335 - DNA, 16 bp, H. sapiens
acagcaaactcatttt

SEQ ID NO: 25336 - DNA, 16 bp, H. sapiens
acagcaaagatgacag

SEQ ID NO: 25337 - DNA, 16 bp, H. sapiens
acagcaaagatttctg

SEQ ID NO: 25338 - DNA, 16 bp, H. sapiens
acagcaaaggaaatag

SEQ ID NO: 25339 - DNA, 16 bp, H. sapiens
acagcaaaggcaacaa

SEQ ID NO: 25340 - DNA, 16 bp, H. sapiens
acagcaaagggaacaa

SEQ ID NO: 25341 - DNA, 16 bp, H. sapiens
acagcaaaggggaagt

SEQ ID NO: 25342 - DNA, 16 bp, H. sapiens
acagcaacaacaggaa

SEQ ID NO: 25343 - DNA, 16 bp, H. sapiens
acagcaacctcaaact

SEQ ID NO: 25344 - DNA, 16 bp, H. sapiens
acagcaacctcagcct

SEQ ID NO: 25345 - DNA, 16 bp, H. sapiens
acagcaacctctacct

SEQ ID NO: 25346 - DNA, 16 bp, H. sapiens
acagcaacctggatga

SEQ ID NO: 25347 - DNA, 16 bp, H. sapiens
acagcaagaaggctct

SEQ ID NO: 25348 - DNA, 16 bp, H. sapiens
acagcaagaaggtgac

SEQ ID NO: 25349 - DNA, 16 bp, H. sapiens
acagcaagaaggtgct

SEQ ID NO: 25350 - DNA, 16 bp, H. sapiens
acagcaagaaggtggc

SEQ ID NO: 25351 - DNA, 16 bp, H. sapiens
acagcaagaccagccc

SEQ ID NO: 25352 - DNA, 21 bp, H. sapiens
acagcaagaccccatctctaa

SEQ ID NO: 25353 - DNA, 16 bp, H. sapiens
acagcaagactccatc

SEQ ID NO: 25354 - DNA, 17 bp, H. sapiens
acagcaagactccgtct

SEQ ID NO: 25355 - DNA, 16 bp, H. sapiens
acagcaagactgtctc

SEQ ID NO: 25356 - DNA, 16 bp, H. sapiens
acagcaagagagagag

SEQ ID NO: 25357 - DNA, 16 bp, H. sapiens
acagcaagatcctgtc

SEQ ID NO: 25358 - DNA, 16 bp, H. sapiens
acagcaagatttattg

SEQ ID NO: 25359 - DNA, 16 bp, H. sapiens
acagcaagtttacact

SEQ ID NO: 25360 - DNA, 16 bp, H. sapiens
acagcaatattcacaa

SEQ ID NO: 25361 - DNA, 16 bp, H. sapiens
acagcacaagactctg

SEQ ID NO: 25362 - DNA, 16 bp, H. sapiens
acagcacagctgctct

SEQ ID NO: 25363 - DNA, 16 bp, H. sapiens
acagcacaggcagagt

SEQ ID NO: 25364 - DNA, 16 bp, H. sapiens
acagcacatctgttta

SEQ ID NO: 25365 - DNA, 16 bp, H. sapiens
acagcacccagcctca

SEQ ID NO: 25366 - DNA, 16 bp, H. sapiens
acagcacccagcctgg

SEQ ID NO: 25367 - DNA, 16 bp, H. sapiens
acagcacccaggctca

SEQ ID NO: 25368 - DNA, 16 bp, H. sapiens
acagcacctggaaaat

SEQ ID NO: 25369 - DNA, 16 bp, H. sapiens
acagcacgagaaagac

SEQ ID NO: 25370 - DNA, 16 bp, H. sapiens
acagcactccaggcag

SEQ ID NO: 25371 - DNA, 16 bp, H. sapiens
acagcagaacacacat

SEQ ID NO: 25372 - DNA, 16 bp, H. sapiens
acagcagacctttcag

SEQ ID NO: 25373 - DNA, 16 bp, H. sapiens
acagcagagaaggaga

SEQ ID NO: 25374 - DNA, 16 bp, H. sapiens
acagcagagctgggat

SEQ ID NO: 25375 - DNA, 16 bp, H. sapiens
acagcagagggaggag

SEQ ID NO: 25376 - DNA, 16 bp, H. sapiens
acagcagagtgactat

SEQ ID NO: 25377 - DNA, 16 bp, H. sapiens
acagcagatatttatt

SEQ ID NO: 25378 - DNA, 22 bp, H. sapiens
acagcagatctctcagcagaaa

SEQ ID NO: 25379 - DNA, 16 bp, H. sapiens
acagcagatgctggtg

SEQ ID NO: 25380 - DNA, 16 bp, H. sapiens
acagcagcaaacagca

SEQ ID NO: 25381 - DNA, 16 bp, H. sapiens
acagcagcaacagcaa

SEQ ID NO: 25382 - DNA, 16 bp, H. sapiens
acagcagcaacaggaa

SEQ ID NO: 25383 - DNA, 19 bp, H. sapiens
acagcagcagcaacaacaa

SEQ ID NO: 25384 - DNA, 16 bp, H. sapiens
acagcagcagcagaag

SEQ ID NO: 25385 - DNA, 16 bp, H. sapiens
acagcagcagcagagg

SEQ ID NO: 25386 - DNA, 16 bp, H. sapiens
acagcagcagcagcaa

SEQ ID NO: 25387 - DNA, 16 bp, H. sapiens
acagcagcagcagcac

SEQ ID NO: 25388 - DNA, 16 bp, H. sapiens
acagcagcagtggtgg

SEQ ID NO: 25389 - DNA, 16 bp, H. sapiens
acagcagccacagtga

SEQ ID NO: 25390 - DNA, 16 bp, H. sapiens
acagcagccccaggaa

SEQ ID NO: 25391 - DNA, 16 bp, H. sapiens
acagcagcccttccca

SEQ ID NO: 25392 - DNA, 16 bp, H. sapiens
acagcagcctcagcaa

SEQ ID NO: 25393 - DNA, 16 bp, H. sapiens
acagcagcctgagcca

SEQ ID NO: 25394 - DNA, 16 bp, H. sapiens
acagcagcctggacct

SEQ ID NO: 25395 - DNA, 16 bp, H. sapiens
acagcagctctgagaa

SEQ ID NO: 25396 - DNA, 16 bp, H. sapiens
acagcagctgtgccat

SEQ ID NO: 25397 - DNA, 16 bp, H. sapiens
acagcagctgtggcag

SEQ ID NO: 25398 - DNA, 16 bp, H. sapiens
acagcaggaaggccct

SEQ ID NO: 25399 - DNA, 16 bp, H. sapiens
acagcagggagaagcc

SEQ ID NO: 25400 - DNA, 16 bp, H. sapiens
acagcagtgaacaaac

SEQ ID NO: 25401 - DNA, 16 bp, H. sapiens
acagcagttttttttt

SEQ ID NO: 25402 - DNA, 16 bp, H. sapiens
acagcatatacaaaaa

SEQ ID NO: 25403 - DNA, 16 bp, H. sapiens
acagcatcaggaagaa

SEQ ID NO: 25404 - DNA, 16 bp, H. sapiens
acagcatctggcacat

SEQ ID NO: 25405 - DNA, 16 bp, H. sapiens
acagcatcttcatcag

SEQ ID NO: 25406 - DNA, 16 bp, H. sapiens
acagcatggtcctggt

SEQ ID NO: 25407 - DNA, 16 bp, H. sapiens
acagcatggtgctggc

SEQ ID NO: 25408 - DNA, 16 bp, H. sapiens
acagcatggtggctgg

SEQ ID NO: 25409 - DNA, 16 bp, H. sapiens
acagcatgtgcaaagg

SEQ ID NO: 25410 - DNA, 16 bp, H. sapiens
acagcattaggagaaa

SEQ ID NO: 25411 - DNA, 16 bp, H. sapiens
acagcattgcttctga

SEQ ID NO: 25412 - DNA, 16 bp, H. sapiens
acagcattgggagata

SEQ ID NO: 25413 - DNA, 16 bp, H. sapiens
acagccaaagaaataa

SEQ ID NO: 25414 - DNA, 16 bp, H. sapiens
acagccaaagaaatta

SEQ ID NO: 25415 - DNA, 16 bp, H. sapiens
acagccaaattctgcc

SEQ ID NO: 25416 - DNA, 16 bp, H. sapiens
acagccaacaaacata

SEQ ID NO: 25417 - DNA, 16 bp, H. sapiens
acagccaagagaagcc

SEQ ID NO: 25418 - DNA, 16 bp, H. sapiens
acagccaaggaaacaa

SEQ ID NO: 25419 - DNA, 16 bp, H. sapiens
acagccaataataatc

SEQ ID NO: 25420 - DNA, 16 bp, H. sapiens
acagccaattgatttt

SEQ ID NO: 25421 - DNA, 16 bp, H. sapiens
acagccaatttggata

SEQ ID NO: 25422 - DNA, 16 bp, H. sapiens
acagccacacccattc

SEQ ID NO: 25423 - DNA, 16 bp, H. sapiens
acagccacctgccacc

SEQ ID NO: 25424 - DNA, 16 bp, H. sapiens
acagccactgtgaaaa

SEQ ID NO: 25425 - DNA, 16 bp, H. sapiens
acagccagaccctgtc

SEQ ID NO: 25426 - DNA, 16 bp, H. sapiens
acagccagatcttgtg

SEQ ID NO: 25427 - DNA, 16 bp, H. sapiens
acagccagcaccaggg

SEQ ID NO: 25428 - DNA, 16 bp, H. sapiens
acagccagccagccaa

SEQ ID NO: 25429 - DNA, 16 bp, H. sapiens
acagccagctctgcat

SEQ ID NO: 25430 - DNA, 16 bp, H. sapiens
acagccagctctgtgt

SEQ ID NO: 25431 - DNA, 16 bp, H. sapiens
acagccagctgatctt

SEQ ID NO: 25432 - DNA, 16 bp, H. sapiens
acagccaggcacactg

SEQ ID NO: 25433 - DNA, 16 bp, H. sapiens
acagcccgcagaacca

SEQ ID NO: 25434 - DNA, 16 bp, H. sapiens
acagccctcaggagat

SEQ ID NO: 25435 - DNA, 16 bp, H. sapiens
acagccctgctggcac

SEQ ID NO: 25436 - DNA, 16 bp, H. sapiens
acagccctgtgaggta

SEQ ID NO: 25437 - DNA, 16 bp, H. sapiens
acagccggctaatttt

SEQ ID NO: 25438 - DNA, 16 bp, H. sapiens
acagccgggtgcccct

SEQ ID NO: 25439 - DNA, 16 bp, H. sapiens
acagcctacagaactg

SEQ ID NO: 25440 - DNA, 16 bp, H. sapiens
acagcctcaccagcat

SEQ ID NO: 25441 - DNA, 16 bp, H. sapiens
acagcctccacctccc

SEQ ID NO: 25442 - DNA, 16 bp, H. sapiens
acagcctcccaagact

SEQ ID NO: 25443 - DNA, 16 bp, H. sapiens
acagcctcccatctct

SEQ ID NO: 25444 - DNA, 16 bp, H. sapiens
acagcctccccttccc

SEQ ID NO: 25445 - DNA, 16 bp, H. sapiens
acagcctctctctctc

SEQ ID NO: 25446 - DNA, 16 bp, H. sapiens
acagcctgagcaacag

SEQ ID NO: 25447 - DNA, 16 bp, H. sapiens
acagcctgcagaacaa

SEQ ID NO: 25448 - DNA, 16 bp, H. sapiens
acagcctgcagaatca

SEQ ID NO: 25449 - DNA, 16 bp, H. sapiens
acagcctgcagagcca

SEQ ID NO: 25450 - DNA, 16 bp, H. sapiens
acagcctggacctcct

SEQ ID NO: 25451 - DNA, 16 bp, H. sapiens
acagcctggagcagca

SEQ ID NO: 25452 - DNA, 16 bp, H. sapiens
acagcctggccaagat

SEQ ID NO: 25453 - DNA, 16 bp, H. sapiens
acagcctggctaacat

SEQ ID NO: 25454 - DNA, 16 bp, H. sapiens
acagcctgggaaacat

SEQ ID NO: 25455 - DNA, 16 bp, H. sapiens
acagcctgggcaccat

SEQ ID NO: 25456 - DNA, 17 bp, H. sapiens
acagcctgggcgacaca

SEQ ID NO: 25457 - DNA, 16 bp, H. sapiens
acagcctgggctacag

SEQ ID NO: 25458 - DNA, 16 bp, H. sapiens
acagcctgggctccag

SEQ ID NO: 25459 - DNA, 16 bp, H. sapiens
acagcctgggtgacgg

SEQ ID NO: 25460 - DNA, 16 bp, H. sapiens
acagcctggtcaacat

SEQ ID NO: 25461 - DNA, 16 bp, H. sapiens
acagcctgtggaactg

SEQ ID NO: 25462 - DNA, 16 bp, H. sapiens
acagcctgttgctcct

SEQ ID NO: 25463 - DNA, 16 bp, H. sapiens
acagccttaggcaggt

SEQ ID NO: 25464 - DNA, 16 bp, H. sapiens
acagccttcccaaaat

SEQ ID NO: 25465 - DNA, 16 bp, H. sapiens
acagccttctgtatcc

SEQ ID NO: 25466 - DNA, 16 bp, H. sapiens
acagccttgacctccc

SEQ ID NO: 25467 - DNA, 16 bp, H. sapiens
acagccttggcctccc

SEQ ID NO: 25468 - DNA, 17 bp, H. sapiens
acagcgagaccttgtct

SEQ ID NO: 25469 - DNA, 17 bp, H. sapiens
acagcgagactccatct

SEQ ID NO: 25470 - DNA, 18 bp, H. sapiens
acagcgagactccgtctc

SEQ ID NO: 25471 - DNA, 16 bp, H. sapiens
acagcgagactgtctc

SEQ ID NO: 25472 - DNA, 16 bp, H. sapiens
acagcgagattccatc

SEQ ID NO: 25473 - DNA, 16 bp, H. sapiens
acagctaaccagggag

SEQ ID NO: 25474 - DNA, 16 bp, H. sapiens
acagctaatgtttatt

SEQ ID NO: 25475 - DNA, 16 bp, H. sapiens
acagctactcgggagg

SEQ ID NO: 25476 - DNA, 18 bp, H. sapiens
acagctagactccatctc

SEQ ID NO: 25477 - DNA, 16 bp, H. sapiens
acagctattttgaaat

SEQ ID NO: 25478 - DNA, 16 bp, H. sapiens
acagctcaatagcaaa

SEQ ID NO: 25479 - DNA, 16 bp, H. sapiens
acagctcactgcagac

SEQ ID NO: 25480 - DNA, 16 bp, H. sapiens
acagctcactgcagca

SEQ ID NO: 25481 - DNA, 21 bp, H. sapiens
acagctcactgcagcctccac

SEQ ID NO: 25482 - DNA, 16 bp, H. sapiens
acagctcactgcagtc

SEQ ID NO: 25483 - DNA, 16 bp, H. sapiens
acagctcagcaaggcc

SEQ ID NO: 25484 - DNA, 16 bp, H. sapiens
acagctctgaagagag

SEQ ID NO: 25485 - DNA, 16 bp, H. sapiens
acagctctgcaggctg

SEQ ID NO: 25486 - DNA, 16 bp, H. sapiens
acagctctgggggctg

SEQ ID NO: 25487 - DNA, 16 bp, H. sapiens
acagctgaagctggag

SEQ ID NO: 25488 - DNA, 16 bp, H. sapiens
acagctgacatttatt

SEQ ID NO: 25489 - DNA, 16 bp, H. sapiens
acagctgcagctgcct

SEQ ID NO: 25490 - DNA, 16 bp, H. sapiens
acagctgcagtttggg

SEQ ID NO: 25491 - DNA, 16 bp, H. sapiens
acagctgcctggaaga

SEQ ID NO: 25492 - DNA, 16 bp, H. sapiens
acagctgctgctgctg

SEQ ID NO: 25493 - DNA, 16 bp, H. sapiens
acagctgctggcattt

SEQ ID NO: 25494 - DNA, 16 bp, H. sapiens
acagctggagacttca

SEQ ID NO: 25495 - DNA, 16 bp, H. sapiens
acagctggatccaggg

SEQ ID NO: 25496 - DNA, 16 bp, H. sapiens
acagctggattctcat

SEQ ID NO: 25497 - DNA, 16 bp, H. sapiens
acagctggctaatttt

SEQ ID NO: 25498 - DNA, 16 bp, H. sapiens
acagctgggagacctg

SEQ ID NO: 25499 - DNA, 16 bp, H. sapiens
acagctgggccactgg

SEQ ID NO: 25500 - DNA, 16 bp, H. sapiens
acagctgggcccaggg

SEQ ID NO: 25501 - DNA, 16 bp, H. sapiens
acagctgggtgcagtg

SEQ ID NO: 25502 - DNA, 28 bp, H. sapiens
acagctgtaaatcatgtgcttaatgcaa

SEQ ID NO: 25503 - DNA, 16 bp, H. sapiens
acagctgtcttcttgc

SEQ ID NO: 25504 - DNA, 16 bp, H. sapiens
acagctgtgagccatg

SEQ ID NO: 25505 - DNA, 16 bp, H. sapiens
acagcttccctttgct

SEQ ID NO: 25506 - DNA, 16 bp, H. sapiens
acagcttctacatcag

SEQ ID NO: 25507 - DNA, 16 bp, H. sapiens
acagcttctccatcag

SEQ ID NO: 25508 - DNA, 16 bp, H. sapiens
acagcttgaaggggac

SEQ ID NO: 25509 - DNA, 16 bp, H. sapiens
acagcttgcacagtgt

SEQ ID NO: 25510 - DNA, 16 bp, H. sapiens
acagcttggaagagag

SEQ ID NO: 25511 - DNA, 16 bp, H. sapiens
acagcttgtttttttt

SEQ ID NO: 25512 - DNA, 16 bp, H. sapiens
acagctttatttttat

SEQ ID NO: 25513 - DNA, 16 bp, H. sapiens
acagctttgaagagag

SEQ ID NO: 25514 - DNA, 16 bp, H. sapiens
acagctttgaggcctt

SEQ ID NO: 25515 - DNA, 16 bp, H. sapiens
acagctttgcagggct

SEQ ID NO: 25516 - DNA, 16 bp, H. sapiens
acagcttttaacaatt

SEQ ID NO: 25517 - DNA, 16 bp, H. sapiens
acagcttttcccaaga

SEQ ID NO: 25518 - DNA, 16 bp, H. sapiens
acaggaaaaactggag

SEQ ID NO: 25519 - DNA, 16 bp, H. sapiens
acaggaaaaggaaagt

SEQ ID NO: 25520 - DNA, 18 bp, H. sapiens
acaggaaaaggcttctga

SEQ ID NO: 25521 - DNA, 16 bp, H. sapiens
acaggaaatatcttca

SEQ ID NO: 25522 - DNA, 16 bp, H. sapiens
acaggaaatgaaacat

SEQ ID NO: 25523 - DNA, 16 bp, H. sapiens
acaggaaatggataaa

SEQ ID NO: 25524 - DNA, 16 bp, H. sapiens
acaggaaatttttaaa

SEQ ID NO: 25525 - DNA, 16 bp, H. sapiens
acaggaacagctccag

SEQ ID NO: 25526 - DNA, 16 bp, H. sapiens
acaggaactgaagagg

SEQ ID NO: 25527 - DNA, 16 bp, H. sapiens
acaggaagaaatagaa

SEQ ID NO: 25528 - DNA, 16 bp, H. sapiens
acaggaagacaaacat

SEQ ID NO: 25529 - DNA, 16 bp, H. sapiens
acaggaagacaggaag

SEQ ID NO: 25530 - DNA, 16 bp, H. sapiens
acaggaagatgtagga

SEQ ID NO: 25531 - DNA, 16 bp, H. sapiens
acaggaagatgtgggg

SEQ ID NO: 25532 - DNA, 16 bp, H. sapiens
acaggaagcaatgtga

SEQ ID NO: 25533 - DNA, 16 bp, H. sapiens
acaggaagcacagcag

SEQ ID NO: 25534 - DNA, 16 bp, H. sapiens
acaggaagcagagtgg

SEQ ID NO: 25535 - DNA, 16 bp, H. sapiens
acaggaagtatggctg

SEQ ID NO: 25536 - DNA, 16 bp, H. sapiens
acaggaagtcaacaaa

SEQ ID NO: 25537 - DNA, 16 bp, H. sapiens
acaggaagtggagctc

SEQ ID NO: 25538 - DNA, 16 bp, H. sapiens
acaggaatgaaaggaa

SEQ ID NO: 25539 - DNA, 16 bp, H. sapiens
acaggaatgaagaaaa

SEQ ID NO: 25540 - DNA, 16 bp, H. sapiens
acaggacaaggatgcc

SEQ ID NO: 25541 - DNA, 16 bp, H. sapiens
acaggacaatgaaaca

SEQ ID NO: 25542 - DNA, 16 bp, H. sapiens
acaggacacaactgga

SEQ ID NO: 25543 - DNA, 16 bp, H. sapiens
acaggacagcccccaa

SEQ ID NO: 25544 - DNA, 16 bp, H. sapiens
acaggacatgatctca

SEQ ID NO: 25545 - DNA, 17 bp, H. sapiens
acaggaccaaatacaca

SEQ ID NO: 25546 - DNA, 16 bp, H. sapiens
acaggaccttcagctg

SEQ ID NO: 25547 - DNA, 17 bp, H. sapiens
acaggactggggtgaaa

SEQ ID NO: 25548 - DNA, 16 bp, H. sapiens
acaggagaaaaatctt

SEQ ID NO: 25549 - DNA, 16 bp, H. sapiens
acaggagaaaaatgaa

SEQ ID NO: 25550 - DNA, 16 bp, H. sapiens
acaggagaaagcagga

SEQ ID NO: 25551 - DNA, 16 bp, H. sapiens
acaggagaatcacatg

SEQ ID NO: 25552 - DNA, 17 bp, H. sapiens
acaggagaatcacttga

SEQ ID NO: 25553 - DNA, 16 bp, H. sapiens
acaggagaatggataa

SEQ ID NO: 25554 - DNA, 17 bp, H. sapiens
acaggagaatggcgtga

SEQ ID NO: 25555 - DNA, 17 bp, H. sapiens
acaggagaattgcttga

SEQ ID NO: 25556 - DNA, 16 bp, H. sapiens
acaggagacagggaaa

SEQ ID NO: 25557 - DNA, 16 bp, H. sapiens
acaggagactggggct

SEQ ID NO: 25558 - DNA, 16 bp, H. sapiens
acaggagagaaaccct

SEQ ID NO: 25559 - DNA, 16 bp, H. sapiens
acaggagagagccacc

SEQ ID NO: 25560 - DNA, 16 bp, H. sapiens
acaggagagtccctga

SEQ ID NO: 25561 - DNA, 16 bp, H. sapiens
acaggagatattacaa

SEQ ID NO: 25562 - DNA, 16 bp, H. sapiens
acaggagatccattag

SEQ ID NO: 25563 - DNA, 16 bp, H. sapiens
acaggagatgaaagat

SEQ ID NO: 25564 - DNA, 16 bp, H. sapiens
acaggagcacaaaccc

SEQ ID NO: 25565 - DNA, 17 bp, H. sapiens
acaggagcacccacatt

SEQ ID NO: 25566 - DNA, 16 bp, H. sapiens
acaggagcccacagag

SEQ ID NO: 25567 - DNA, 16 bp, H. sapiens
acaggagctgaaggat

SEQ ID NO: 25568 - DNA, 16 bp, H. sapiens
acaggaggaggagctc

SEQ ID NO: 25569 - DNA, 16 bp, H. sapiens
acaggaggatcactta

SEQ ID NO: 25570 - DNA, 17 bp, H. sapiens
acaggaggatcacttga

SEQ ID NO: 25571 - DNA, 16 bp, H. sapiens
acaggaggatcacttt

SEQ ID NO: 25572 - DNA, 16 bp, H. sapiens
acaggaggctggggag

SEQ ID NO: 25573 - DNA, 16 bp, H. sapiens
acaggagggggagctc

SEQ ID NO: 25574 - DNA, 16 bp, H. sapiens
acaggagtcacctttg

SEQ ID NO: 25575 - DNA, 16 bp, H. sapiens
acaggagtcttgctga

SEQ ID NO: 25576 - DNA, 16 bp, H. sapiens
acaggagttcaaaacc

SEQ ID NO: 25577 - DNA, 16 bp, H. sapiens
acaggagtttgaaacc

SEQ ID NO: 25578 - DNA, 16 bp, H. sapiens
acaggatcaaattcat

SEQ ID NO: 25579 - DNA, 16 bp, H. sapiens
acaggatctcattctt

SEQ ID NO: 25580 - DNA, 16 bp, H. sapiens
acaggatctgactctg

SEQ ID NO: 25581 - DNA, 16 bp, H. sapiens
acaggatgactacagt

SEQ ID NO: 25582 - DNA, 16 bp, H. sapiens
acaggatgagagaaaa

SEQ ID NO: 25583 - DNA, 16 bp, H. sapiens
acaggatgcccagtta

SEQ ID NO: 25584 - DNA, 16 bp, H. sapiens
acaggatgggagaaaa

SEQ ID NO: 25585 - DNA, 16 bp, H. sapiens
acaggatggtctcgat

SEQ ID NO: 25586 - DNA, 16 bp, H. sapiens
acaggatgtcactctg

SEQ ID NO: 25587 - DNA, 16 bp, H. sapiens
acaggattagaaaaaa

SEQ ID NO: 25588 - DNA, 16 bp, H. sapiens
acaggatttgcgcttg

SEQ ID NO: 25589 - DNA, 16 bp, H. sapiens
acaggattttttaaaa

SEQ ID NO: 25590 - DNA, 16 bp, H. sapiens
acaggattttttaaat

SEQ ID NO: 25591 - DNA, 16 bp, H. sapiens
acaggcaaaaactgga

SEQ ID NO: 25592 - DNA, 16 bp, H. sapiens
acaggcaacagaaaca

SEQ ID NO: 25593 - DNA, 16 bp, H. sapiens
acaggcaactgccatc

SEQ ID NO: 25594 - DNA, 16 bp, H. sapiens
acaggcacacacagag

SEQ ID NO: 25595 - DNA, 16 bp, H. sapiens
acaggcacatgcacac

SEQ ID NO: 25596 - DNA, 17 bp, H. sapiens
acaggcacatgccacca

SEQ ID NO: 25597 - DNA, 17 bp, H. sapiens
acaggcacccacaacca

SEQ ID NO: 25598 - DNA, 19 bp, H. sapiens
acaggcacgtgccaccaca

SEQ ID NO: 25599 - DNA, 16 bp, H. sapiens
acaggcaggcaccacc

SEQ ID NO: 25600 - DNA, 16 bp, H. sapiens
acaggcaggcagacag

SEQ ID NO: 25601 - DNA, 16 bp, H. sapiens
acaggcagtgtgccca

SEQ ID NO: 25602 - DNA, 16 bp, H. sapiens
acaggcatataccacc

SEQ ID NO: 25603 - DNA, 17 bp, H. sapiens
acaggcatatgccacca

SEQ ID NO: 25604 - DNA, 16 bp, H. sapiens
acaggcatgaatcact

SEQ ID NO: 25605 - DNA, 16 bp, H. sapiens
acaggcatgagccatc

SEQ ID NO: 25606 - DNA, 16 bp, H. sapiens
acaggcatgagccgcc

SEQ ID NO: 25607 - DNA, 17 bp, H. sapiens
acaggcatgagctacca

SEQ ID NO: 25608 - DNA, 16 bp, H. sapiens
acaggcatgagctgtc

SEQ ID NO: 25609 - DNA, 16 bp, H. sapiens
acaggcatgcaatgtg

SEQ ID NO: 25610 - DNA, 17 bp, H. sapiens
acaggcatgcaccacca

SEQ ID NO: 25611 - DNA, 16 bp, H. sapiens
acaggcatgcacccca

SEQ ID NO: 25612 - DNA, 16 bp, H. sapiens
acaggcatgccaccat

SEQ ID NO: 25613 - DNA, 17 bp, H. sapiens
acaggcatgcgctacca

SEQ ID NO: 25614 - DNA, 16 bp, H. sapiens
acaggcatgctccacc

SEQ ID NO: 25615 - DNA, 16 bp, H. sapiens
acaggcatgcttcacc

SEQ ID NO: 25616 - DNA, 16 bp, H. sapiens
acaggcatgggaatgg

SEQ ID NO: 25617 - DNA, 17 bp, H. sapiens
acaggcatgtaccacca

SEQ ID NO: 25618 - DNA, 16 bp, H. sapiens
acaggcatgtgacact

SEQ ID NO: 25619 - DNA, 16 bp, H. sapiens
acaggcatgtgccaca

SEQ ID NO: 25620 - DNA, 17 bp, H. sapiens
acaggcatgtgccacct

SEQ ID NO: 25621 - DNA, 16 bp, H. sapiens
acaggcatgtgccgct

SEQ ID NO: 25622 - DNA, 16 bp, H. sapiens
acaggccaaaattcaa

SEQ ID NO: 25623 - DNA, 27 bp, H. sapiens
acaggccagcaggcagttcccagtgta

SEQ ID NO: 25624 - DNA, 17 bp, H. sapiens
acaggccaggcgtggtg

SEQ ID NO: 25625 - DNA, 16 bp, H. sapiens
acaggccaggtgtggt

SEQ ID NO: 25626 - DNA, 16 bp, H. sapiens
acaggcccagaggttt

SEQ ID NO: 25627 - DNA, 16 bp, H. sapiens
acaggcccagcctctg

SEQ ID NO: 25628 - DNA, 16 bp, H. sapiens
acaggcccaggtgtgt

SEQ ID NO: 25629 - DNA, 16 bp, H. sapiens
acaggccccacctcca

SEQ ID NO: 25630 - DNA, 17 bp, H. sapiens
acaggccccagtgtgtg

SEQ ID NO: 25631 - DNA, 16 bp, H. sapiens
acaggccccattgtgt

SEQ ID NO: 25632 - DNA, 16 bp, H. sapiens
acaggccccggagtgt

SEQ ID NO: 25633 - DNA, 18 bp, H. sapiens
acaggccccggtgtgtga

SEQ ID NO: 25634 - DNA, 16 bp, H. sapiens
acaggcccctctgctg

SEQ ID NO: 25635 - DNA, 16 bp, H. sapiens
acaggccctggggcct

SEQ ID NO: 25636 - DNA, 16 bp, H. sapiens
acaggccctggggtgt

SEQ ID NO: 25637 - DNA, 16 bp, H. sapiens
acaggcctctgccacc

SEQ ID NO: 25638 - DNA, 16 bp, H. sapiens
acaggcctgagccaac

SEQ ID NO: 25639 - DNA, 16 bp, H. sapiens
acaggcctgcgccacc

SEQ ID NO: 25640 - DNA, 16 bp, H. sapiens
acaggcctgggtttga

SEQ ID NO: 25641 - DNA, 17 bp, H. sapiens
acaggcctgtgccacca

SEQ ID NO: 25642 - DNA, 16 bp, H. sapiens
acaggccttgctgggt

SEQ ID NO: 25643 - DNA, 16 bp, H. sapiens
acaggcctttgaaaag

SEQ ID NO: 25644 - DNA, 16 bp, H. sapiens
acaggcgcccccacca

SEQ ID NO: 25645 - DNA, 16 bp, H. sapiens
acaggcgcctgccccc

SEQ ID NO: 25646 - DNA, 16 bp, H. sapiens
acaggcgtgagcccct

SEQ ID NO: 25647 - DNA, 16 bp, H. sapiens
acaggctatttaaaaa

SEQ ID NO: 25648 - DNA, 16 bp, H. sapiens
acaggctatttgaaaa

SEQ ID NO: 25649 - DNA, 16 bp, H. sapiens
acaggctcaaaataaa

SEQ ID NO: 25650 - DNA, 16 bp, H. sapiens
acaggctcacatcacc

SEQ ID NO: 25651 - DNA, 16 bp, H. sapiens
acaggctcctgccacc

SEQ ID NO: 25652 - DNA, 16 bp, H. sapiens
acaggctctcattctg

SEQ ID NO: 25653 - DNA, 16 bp, H. sapiens
acaggctctggctctg

SEQ ID NO: 25654 - DNA, 16 bp, H. sapiens
acaggctgaaggcagc

SEQ ID NO: 25655 - DNA, 16 bp, H. sapiens
acaggctgacattgag

SEQ ID NO: 25656 - DNA, 16 bp, H. sapiens
acaggctgactctctt

SEQ ID NO: 25657 - DNA, 17 bp, H. sapiens
acaggctggagtgcaat

SEQ ID NO: 25658 - DNA, 21 bp, H. sapiens
acaggctggagtgcagtggcg

SEQ ID NO: 25659 - DNA, 16 bp, H. sapiens
acaggctgggaagtgt

SEQ ID NO: 25660 - DNA, 16 bp, H. sapiens
acaggctgggcactgt

SEQ ID NO: 25661 - DNA, 26 bp, H. sapiens
acaggctggtctcaaactcctgacct

SEQ ID NO: 25662 - DNA, 18 bp, H. sapiens
acaggctggtctcgaact

SEQ ID NO: 25663 - DNA, 18 bp, H. sapiens
acaggctggtcttgaact

SEQ ID NO: 25664 - DNA, 16 bp, H. sapiens
acaggcttgagccatt

SEQ ID NO: 25665 - DNA, 16 bp, H. sapiens
acaggctttacaggaa

SEQ ID NO: 25666 - DNA, 16 bp, H. sapiens
acaggctttctgtgag

SEQ ID NO: 25667 - DNA, 16 bp, H. sapiens
acaggcttttgctctg

SEQ ID NO: 25668 - DNA, 16 bp, H. sapiens
acagggaaagtttaat

SEQ ID NO: 25669 - DNA, 16 bp, H. sapiens
acagggaagaaggcca

SEQ ID NO: 25670 - DNA, 16 bp, H. sapiens
acagggacacacacag

SEQ ID NO: 25671 - DNA, 16 bp, H. sapiens
acagggacagagacag

SEQ ID NO: 25672 - DNA, 16 bp, H. sapiens
acagggacagagggag

SEQ ID NO: 25673 - DNA, 17 bp, H. sapiens
acagggacatggatgaa

SEQ ID NO: 25674 - DNA, 16 bp, H. sapiens
acagggaccctgggcc

SEQ ID NO: 25675 - DNA, 16 bp, H. sapiens
acagggacctgccacc

SEQ ID NO: 25676 - DNA, 16 bp, H. sapiens
acagggagaaggaaac

SEQ ID NO: 25677 - DNA, 16 bp, H. sapiens
acagggatatccagga

SEQ ID NO: 25678 - DNA, 16 bp, H. sapiens
acagggattttcacag

SEQ ID NO: 25679 - DNA, 16 bp, H. sapiens
acagggatttttacaa

SEQ ID NO: 25680 - DNA, 16 bp, H. sapiens
acagggatttttgtct

SEQ ID NO: 25681 - DNA, 16 bp, H. sapiens
acagggcaagactcca

SEQ ID NO: 25682 - DNA, 16 bp, H. sapiens
acagggcaccaggcag

SEQ ID NO: 25683 - DNA, 16 bp, H. sapiens
acagggcagggctggg

SEQ ID NO: 25684 - DNA, 16 bp, H. sapiens
acagggccagactctg

SEQ ID NO: 25685 - DNA, 16 bp, H. sapiens
acagggccaggcacag

SEQ ID NO: 25686 - DNA, 16 bp, H. sapiens
acagggccaggcgcag

SEQ ID NO: 25687 - DNA, 16 bp, H. sapiens
acagggccgggtgtgg

SEQ ID NO: 25688 - DNA, 16 bp, H. sapiens
acagggcctcactctg

SEQ ID NO: 25689 - DNA, 16 bp, H. sapiens
acagggcctccctctg

SEQ ID NO: 25690 - DNA, 16 bp, H. sapiens
acaggggctcacacct

SEQ ID NO: 25691 - DNA, 16 bp, H. sapiens
acaggggtggtgtaca

SEQ ID NO: 25692 - DNA, 16 bp, H. sapiens
acagggtctcgccatg

SEQ ID NO: 25693 - DNA, 16 bp, H. sapiens
acagggtctcgctcta

SEQ ID NO: 25694 - DNA, 16 bp, H. sapiens
acagggtctctctttg

SEQ ID NO: 25695 - DNA, 16 bp, H. sapiens
acagggtctggagtgg

SEQ ID NO: 25696 - DNA, 16 bp, H. sapiens
acagggtcttcctgtg

SEQ ID NO: 25697 - DNA, 16 bp, H. sapiens
acagggtcttgctctt

SEQ ID NO: 25698 - DNA, 16 bp, H. sapiens
acagggtgagactccg

SEQ ID NO: 25699 - DNA, 16 bp, H. sapiens
acagggtgcggtggct

SEQ ID NO: 25700 - DNA, 16 bp, H. sapiens
acagggtgtacacaca

SEQ ID NO: 25701 - DNA, 16 bp, H. sapiens
acagggtttctccacg

SEQ ID NO: 25702 - DNA, 16 bp, H. sapiens
acagggtttctccgtg

SEQ ID NO: 25703 - DNA, 16 bp, H. sapiens
acagggtttttctctg

SEQ ID NO: 25704 - DNA, 16 bp, H. sapiens
acaggtaaggaaacag

SEQ ID NO: 25705 - DNA, 16 bp, H. sapiens
acaggtacaatttgac

SEQ ID NO: 25706 - DNA, 16 bp, H. sapiens
acaggtatgtaccacc

SEQ ID NO: 25707 - DNA, 16 bp, H. sapiens
acaggtattaaaggac

SEQ ID NO: 25708 - DNA, 16 bp, H. sapiens
acaggtccccaccacc

SEQ ID NO: 25709 - DNA, 16 bp, H. sapiens
acaggtcttttaaaat

SEQ ID NO: 25710 - DNA, 16 bp, H. sapiens
acaggtgaggaaacag

SEQ ID NO: 25711 - DNA, 16 bp, H. sapiens
acaggtgaggagactg

SEQ ID NO: 25712 - DNA, 16 bp, H. sapiens
acaggtgatgtttggt

SEQ ID NO: 25713 - DNA, 16 bp, H. sapiens
acaggtgcaagccaca

SEQ ID NO: 25714 - DNA, 16 bp, H. sapiens
acaggtgcacgacacc

SEQ ID NO: 25715 - DNA, 16 bp, H. sapiens
acaggtgcccagcacc

SEQ ID NO: 25716 - DNA, 16 bp, H. sapiens
acaggtgcccgacacc

SEQ ID NO: 25717 - DNA, 17 bp, H. sapiens
acaggtgcctgcaacca

SEQ ID NO: 25718 - DNA, 16 bp, H. sapiens
acaggtgcgagccact

SEQ ID NO: 25719 - DNA, 16 bp, H. sapiens
acaggtgctggccacc

SEQ ID NO: 25720 - DNA, 16 bp, H. sapiens
acaggtggcctctaga

SEQ ID NO: 25721 - DNA, 16 bp, H. sapiens
acaggtgggaaatgaa

SEQ ID NO: 25722 - DNA, 16 bp, H. sapiens
acaggtgggggaagaa

SEQ ID NO: 25723 - DNA, 16 bp, H. sapiens
acaggtggtgccacca

SEQ ID NO: 25724 - DNA, 16 bp, H. sapiens
acaggtgtgcaccaca

SEQ ID NO: 25725 - DNA, 16 bp, H. sapiens
acaggtgtgcaccacc

SEQ ID NO: 25726 - DNA, 16 bp, H. sapiens
acaggtgtgcaccgcc

SEQ ID NO: 25727 - DNA, 16 bp, H. sapiens
acaggtgtgcatcact

SEQ ID NO: 25728 - DNA, 16 bp, H. sapiens
acaggtgtggaggggc

SEQ ID NO: 25729 - DNA, 16 bp, H. sapiens
acaggtgtggccacca

SEQ ID NO: 25730 - DNA, 16 bp, H. sapiens
acaggtgtgtgccacg

SEQ ID NO: 25731 - DNA, 16 bp, H. sapiens
acaggtgtgtgccatc

SEQ ID NO: 25732 - DNA, 16 bp, H. sapiens
acaggtgtgtgccccc

SEQ ID NO: 25733 - DNA, 16 bp, H. sapiens
acaggtgtgtgtgcca

SEQ ID NO: 25734 - DNA, 16 bp, H. sapiens
acaggttcaagcaatt

SEQ ID NO: 25735 - DNA, 18 bp, H. sapiens
acaggttcaagcgattct

SEQ ID NO: 25736 - DNA, 16 bp, H. sapiens
acaggttcctgggcag

SEQ ID NO: 25737 - DNA, 16 bp, H. sapiens
acaggttcttgctctg

SEQ ID NO: 25738 - DNA, 16 bp, H. sapiens
acaggttgtggtaaag

SEQ ID NO: 25739 - DNA, 16 bp, H. sapiens
acaggtttgtagcctg

SEQ ID NO: 25740 - DNA, 16 bp, H. sapiens
acaggtttgttacctg

SEQ ID NO: 25741 - DNA, 16 bp, H. sapiens
acaggttttcaccata

SEQ ID NO: 25742 - DNA, 16 bp, H. sapiens
acaggtttttgagaat

SEQ ID NO: 25743 - DNA, 16 bp, H. sapiens
acaggttttttgtttt

SEQ ID NO: 25744 - DNA, 16 bp, H. sapiens
acagtaaaaatgcagt

SEQ ID NO: 25745 - DNA, 16 bp, H. sapiens
acagtaaaataaagca

SEQ ID NO: 25746 - DNA, 16 bp, H. sapiens
acagtaaatattttag

SEQ ID NO: 25747 - DNA, 16 bp, H. sapiens
acagtaaatgaaaata

SEQ ID NO: 25748 - DNA, 16 bp, H. sapiens
acagtaacaagtgttg

SEQ ID NO: 25749 - DNA, 16 bp, H. sapiens
acagtaagagattaat

SEQ ID NO: 25750 - DNA, 16 bp, H. sapiens
acagtaataatgggag

SEQ ID NO: 25751 - DNA, 16 bp, H. sapiens
acagtacctggcacag

SEQ ID NO: 25752 - DNA, 16 bp, H. sapiens
acagtacctggcatgt

SEQ ID NO: 25753 - DNA, 16 bp, H. sapiens
acagtacgagactctg

SEQ ID NO: 25754 - DNA, 16 bp, H. sapiens
acagtagaatggtggt

SEQ ID NO: 25755 - DNA, 16 bp, H. sapiens
acagtagatgctcagt

SEQ ID NO: 25756 - DNA, 16 bp, H. sapiens
acagtagcatcaccag

SEQ ID NO: 25757 - DNA, 16 bp, H. sapiens
acagtataacaactgt

SEQ ID NO: 25758 - DNA, 16 bp, H. sapiens
acagtatataactttt

SEQ ID NO: 25759 - DNA, 16 bp, H. sapiens
acagtatctttttttt

SEQ ID NO: 25760 - DNA, 16 bp, H. sapiens
acagtatgaaaatgga

SEQ ID NO: 25761 - DNA, 16 bp, H. sapiens
acagtatgctcctgaa

SEQ ID NO: 25762 - DNA, 16 bp, H. sapiens
acagtatggagtttcc

SEQ ID NO: 25763 - DNA, 16 bp, H. sapiens
acagtatgggggaaaa

SEQ ID NO: 25764 - DNA, 16 bp, H. sapiens
acagtatgtaacattt

SEQ ID NO: 25765 - DNA, 16 bp, H. sapiens
acagtatgtactacag

SEQ ID NO: 25766 - DNA, 16 bp, H. sapiens
acagtattacagtatt

SEQ ID NO: 25767 - DNA, 16 bp, H. sapiens
acagtattcatatttt

SEQ ID NO: 25768 - DNA, 16 bp, H. sapiens
acagtattgcactaaa

SEQ ID NO: 25769 - DNA, 16 bp, H. sapiens
acagtatttattttct

SEQ ID NO: 25770 - DNA, 16 bp, H. sapiens
acagtattttcttttt

SEQ ID NO: 25771 - DNA, 16 bp, H. sapiens
acagtattttgttata

SEQ ID NO: 25772 - DNA, 16 bp, H. sapiens
acagtattttttaaat

SEQ ID NO: 25773 - DNA, 16 bp, H. sapiens
acagtcacaaggtgaa

SEQ ID NO: 25774 - DNA, 16 bp, H. sapiens
acagtcccaccagcag

SEQ ID NO: 25775 - DNA, 19 bp, H. sapiens
acagtccccagagtgtgat

SEQ ID NO: 25776 - DNA, 16 bp, H. sapiens
acagtcctgatttggc

SEQ ID NO: 25777 - DNA, 16 bp, H. sapiens
acagtcgcatgccacc

SEQ ID NO: 25778 - DNA, 16 bp, H. sapiens
acagtcgctcatgcct

SEQ ID NO: 25779 - DNA, 16 bp, H. sapiens
acagtctaaagtctca

SEQ ID NO: 25780 - DNA, 16 bp, H. sapiens
acagtctcactctgtc

SEQ ID NO: 25781 - DNA, 16 bp, H. sapiens
acagtctctcagacaa

SEQ ID NO: 25782 - DNA, 16 bp, H. sapiens
acagtctctctctgtc

SEQ ID NO: 25783 - DNA, 16 bp, H. sapiens
acagtctctgaaattg

SEQ ID NO: 25784 - DNA, 16 bp, H. sapiens
acagtctctgtctttt

SEQ ID NO: 25785 - DNA, 16 bp, H. sapiens
acagtctgtcatggct

SEQ ID NO: 25786 - DNA, 16 bp, H. sapiens
acagtcttactctgtc

SEQ ID NO: 25787 - DNA, 16 bp, H. sapiens
acagtgaaaaaggaaa

SEQ ID NO: 25788 - DNA, 16 bp, H. sapiens
acagtgaaaaggaaaa

SEQ ID NO: 25789 - DNA, 16 bp, H. sapiens
acagtgaaacccctgt

SEQ ID NO: 25790 - DNA, 18 bp, H. sapiens
acagtgaaactccgtctc

SEQ ID NO: 25791 - DNA, 16 bp, H. sapiens
acagtgaaataaaatt

SEQ ID NO: 25792 - DNA, 16 bp, H. sapiens
acagtgaaatatcatt

SEQ ID NO: 25793 - DNA, 16 bp, H. sapiens
acagtgaactatgatt

SEQ ID NO: 25794 - DNA, 16 bp, H. sapiens
acagtgaagaaacctg

SEQ ID NO: 25795 - DNA, 16 bp, H. sapiens
acagtgaccaaaacag

SEQ ID NO: 25796 - DNA, 16 bp, H. sapiens
acagtgacctggatga

SEQ ID NO: 25797 - DNA, 16 bp, H. sapiens
acagtgactggcatat

SEQ ID NO: 25798 - DNA, 16 bp, H. sapiens
acagtgagaaggtggc

SEQ ID NO: 25799 - DNA, 16 bp, H. sapiens
acagtgagaaggtggt

SEQ ID NO: 25800 - DNA, 16 bp, H. sapiens
acagtgagaatctgtc

SEQ ID NO: 25801 - DNA, 16 bp, H. sapiens
acagtgagacctccat

SEQ ID NO: 25802 - DNA, 17 bp, H. sapiens
acagtgagactccatct

SEQ ID NO: 25803 - DNA, 17 bp, H. sapiens
acagtgagactccgtct

SEQ ID NO: 25804 - DNA, 16 bp, H. sapiens
acagtgagactgtctc

SEQ ID NO: 25805 - DNA, 16 bp, H. sapiens
acagtgagagactcca

SEQ ID NO: 25806 - DNA, 17 bp, H. sapiens
acagtgagccgagatcg

SEQ ID NO: 25807 - DNA, 18 bp, H. sapiens
acagtgagccgagattgc

SEQ ID NO: 25808 - DNA, 16 bp, H. sapiens
acagtgagccgtgatt

SEQ ID NO: 25809 - DNA, 16 bp, H. sapiens
acagtgagctatgatc

SEQ ID NO: 25810 - DNA, 18 bp, H. sapiens
acagtgagctgagatcac

SEQ ID NO: 25811 - DNA, 18 bp, H. sapiens
acagtgagctgagattgc

SEQ ID NO: 25812 - DNA, 16 bp, H. sapiens
acagtgagctgtgatc

SEQ ID NO: 25813 - DNA, 16 bp, H. sapiens
acagtgaggaccctca

SEQ ID NO: 25814 - DNA, 16 bp, H. sapiens
acagtgaggccccatc

SEQ ID NO: 25815 - DNA, 16 bp, H. sapiens
acagtgaggccctgtc

SEQ ID NO: 25816 - DNA, 16 bp, H. sapiens
acagtgagtaagtctc

SEQ ID NO: 25817 - DNA, 16 bp, H. sapiens
acagtgatcaaaacag

SEQ ID NO: 25818 - DNA, 16 bp, H. sapiens
acagtgcacacacaca

SEQ ID NO: 25819 - DNA, 16 bp, H. sapiens
acagtgcatggcacat

SEQ ID NO: 25820 - DNA, 16 bp, H. sapiens
acagtgccacatggct

SEQ ID NO: 25821 - DNA, 16 bp, H. sapiens
acagtgcctcatgcct

SEQ ID NO: 25822 - DNA, 16 bp, H. sapiens
acagtgcctgacacaa

SEQ ID NO: 25823 - DNA, 16 bp, H. sapiens
acagtgcctgacacat

SEQ ID NO: 25824 - DNA, 16 bp, H. sapiens
acagtgcctgctgcat

SEQ ID NO: 25825 - DNA, 16 bp, H. sapiens
acagtgcctggcactg

SEQ ID NO: 25826 - DNA, 16 bp, H. sapiens
acagtgcctggcatat

SEQ ID NO: 25827 - DNA, 16 bp, H. sapiens
acagtgcctggtacaa

SEQ ID NO: 25828 - DNA, 16 bp, H. sapiens
acagtgctctgtgtct

SEQ ID NO: 25829 - DNA, 16 bp, H. sapiens
acagtgctggcatctg

SEQ ID NO: 25830 - DNA, 16 bp, H. sapiens
acagtggaaaacaaaa

SEQ ID NO: 25831 - DNA, 16 bp, H. sapiens
acagtggacaccctgc

SEQ ID NO: 25832 - DNA, 16 bp, H. sapiens
acagtggagaagcctg

SEQ ID NO: 25833 - DNA, 16 bp, H. sapiens
acagtggagatggaga

SEQ ID NO: 25834 - DNA, 16 bp, H. sapiens
acagtggatcatgcct

SEQ ID NO: 25835 - DNA, 16 bp, H. sapiens
acagtggatctctctg

SEQ ID NO: 25836 - DNA, 16 bp, H. sapiens
acagtggcacaatcat

SEQ ID NO: 25837 - DNA, 16 bp, H. sapiens
acagtggcacaatctc

SEQ ID NO: 25838 - DNA, 16 bp, H. sapiens
acagtggcacgatctc

SEQ ID NO: 25839 - DNA, 16 bp, H. sapiens
acagtggcacgatctt

SEQ ID NO: 25840 - DNA, 16 bp, H. sapiens
acagtggcaggcacct

SEQ ID NO: 25841 - DNA, 16 bp, H. sapiens
acagtggcaggcaggc

SEQ ID NO: 25842 - DNA, 16 bp, H. sapiens
acagtggcataatctc

SEQ ID NO: 25843 - DNA, 16 bp, H. sapiens
acagtggccattatta

SEQ ID NO: 25844 - DNA, 16 bp, H. sapiens
acagtggctcatacct

SEQ ID NO: 25845 - DNA, 16 bp, H. sapiens
acagtggctcatgtct

SEQ ID NO: 25846 - DNA, 16 bp, H. sapiens
acagtggctgtgccat

SEQ ID NO: 25847 - DNA, 16 bp, H. sapiens
acagtggcttacatct

SEQ ID NO: 25848 - DNA, 16 bp, H. sapiens
acagtgggaggagaga

SEQ ID NO: 25849 - DNA, 16 bp, H. sapiens
acagtgggccttgggc

SEQ ID NO: 25850 - DNA, 17 bp, H. sapiens
acagtggggaccaatat

SEQ ID NO: 25851 - DNA, 16 bp, H. sapiens
acagtggggactacta

SEQ ID NO: 25852 - DNA, 16 bp, H. sapiens
acagtgggtgtatacc

SEQ ID NO: 25853 - DNA, 16 bp, H. sapiens
acagtggtgcaatcat

SEQ ID NO: 25854 - DNA, 16 bp, H. sapiens
acagtggttctcaaac

SEQ ID NO: 25855 - DNA, 16 bp, H. sapiens
acagtggttttcaaac

SEQ ID NO: 25856 - DNA, 16 bp, H. sapiens
acagtgtaaaagtatt

SEQ ID NO: 25857 - DNA, 16 bp, H. sapiens
acagtgtataaatgtt

SEQ ID NO: 25858 - DNA, 16 bp, H. sapiens
acagtgtcacttctgc

SEQ ID NO: 25859 - DNA, 16 bp, H. sapiens
acagtgtccccactgg

SEQ ID NO: 25860 - DNA, 16 bp, H. sapiens
acagtgtcttcctctg

SEQ ID NO: 25861 - DNA, 16 bp, H. sapiens
acagtgtctttctctg

SEQ ID NO: 25862 - DNA, 16 bp, H. sapiens
acagtgtcttttgaag

SEQ ID NO: 25863 - DNA, 16 bp, H. sapiens
acagtgtgaaactctg

SEQ ID NO: 25864 - DNA, 16 bp, H. sapiens
acagtgtgagacttca

SEQ ID NO: 25865 - DNA, 16 bp, H. sapiens
acagtgtggaagcttt

SEQ ID NO: 25866 - DNA, 16 bp, H. sapiens
acagtgtggcactggc

SEQ ID NO: 25867 - DNA, 16 bp, H. sapiens
acagtgtggcatttcc

SEQ ID NO: 25868 - DNA, 16 bp, H. sapiens
acagtgttaaagtgtt

SEQ ID NO: 25869 - DNA, 16 bp, H. sapiens
acagtgttatttgaaa

SEQ ID NO: 25870 - DNA, 16 bp, H. sapiens
acagtgttgcccaggc

SEQ ID NO: 25871 - DNA, 16 bp, H. sapiens
acagtgtttacaaact

SEQ ID NO: 25872 - DNA, 16 bp, H. sapiens
acagtgtttacaaagt

SEQ ID NO: 25873 - DNA, 16 bp, H. sapiens
acagtgtttataaagt

SEQ ID NO: 25874 - DNA, 16 bp, H. sapiens
acagtgtttcaccgtg

SEQ ID NO: 25875 - DNA, 16 bp, H. sapiens
acagtgttttcttttt

SEQ ID NO: 25876 - DNA, 16 bp, H. sapiens
acagtgttttgcacat

SEQ ID NO: 25877 - DNA, 16 bp, H. sapiens
acagtgttttttattt

SEQ ID NO: 25878 - DNA, 16 bp, H. sapiens
acagtgtttttttgtt

SEQ ID NO: 25879 - DNA, 16 bp, H. sapiens
acagttaaaagaacta

SEQ ID NO: 25880 - DNA, 16 bp, H. sapiens
acagttagccaagttg

SEQ ID NO: 25881 - DNA, 16 bp, H. sapiens
acagttatcaaaacag

SEQ ID NO: 25882 - DNA, 16 bp, H. sapiens
acagttatttatttta

SEQ ID NO: 25883 - DNA, 16 bp, H. sapiens
acagttcagtggcatt

SEQ ID NO: 25884 - DNA, 16 bp, H. sapiens
acagttctaggggctg

SEQ ID NO: 25885 - DNA, 16 bp, H. sapiens
acagttctggaggatg

SEQ ID NO: 25886 - DNA, 16 bp, H. sapiens
acagttctggagggta

SEQ ID NO: 25887 - DNA, 16 bp, H. sapiens
acagttctggaggtgg

SEQ ID NO: 25888 - DNA, 16 bp, H. sapiens
acagttcttcaggctt

SEQ ID NO: 25889 - DNA, 16 bp, H. sapiens
acagttgcattttttt

SEQ ID NO: 25890 - DNA, 16 bp, H. sapiens
acagttggcagtttct

SEQ ID NO: 25891 - DNA, 16 bp, H. sapiens
acagttgtgcaggttg

SEQ ID NO: 25892 - DNA, 16 bp, H. sapiens
acagtttaaaagcatt

SEQ ID NO: 25893 - DNA, 16 bp, H. sapiens
acagtttaatttaaaa

SEQ ID NO: 25894 - DNA, 16 bp, H. sapiens
acagtttattataaag

SEQ ID NO: 25895 - DNA, 16 bp, H. sapiens
acagtttattttatgt

SEQ ID NO: 25896 - DNA, 16 bp, H. sapiens
acagtttcactctgtc

SEQ ID NO: 25897 - DNA, 16 bp, H. sapiens
acagtttcaggcatcc

SEQ ID NO: 25898 - DNA, 16 bp, H. sapiens
acagtttcattttttt

SEQ ID NO: 25899 - DNA, 16 bp, H. sapiens
acagtttcctcatctg

SEQ ID NO: 25900 - DNA, 16 bp, H. sapiens
acagtttccttttgct

SEQ ID NO: 25901 - DNA, 16 bp, H. sapiens
acagtttctacaaaaa

SEQ ID NO: 25902 - DNA, 16 bp, H. sapiens
acagtttcttttcttt

SEQ ID NO: 25903 - DNA, 16 bp, H. sapiens
acagtttgaatatttg

SEQ ID NO: 25904 - DNA, 16 bp, H. sapiens
acagtttgaatgtgtc

SEQ ID NO: 25905 - DNA, 16 bp, H. sapiens
acagtttggaaaattt

SEQ ID NO: 25906 - DNA, 16 bp, H. sapiens
acagtttggagggctt

SEQ ID NO: 25907 - DNA, 16 bp, H. sapiens
acagtttggatgtttg

SEQ ID NO: 25908 - DNA, 16 bp, H. sapiens
acagtttggtatgttt

SEQ ID NO: 25909 - DNA, 16 bp, H. sapiens
acagtttggtggtttc

SEQ ID NO: 25910 - DNA, 16 bp, H. sapiens
acagttttaagaaata

SEQ ID NO: 25911 - DNA, 16 bp, H. sapiens
acagttttcagtgtac

SEQ ID NO: 25912 - DNA, 16 bp, H. sapiens
acagttttccaaagaa

SEQ ID NO: 25913 - DNA, 16 bp, H. sapiens
acagttttgaagaaaa

SEQ ID NO: 25914 - DNA, 16 bp, H. sapiens
acagttttgtttcttc

SEQ ID NO: 25915 - DNA, 16 bp, H. sapiens
acagtttttaaaatca

SEQ ID NO: 25916 - DNA, 16 bp, H. sapiens
acagtttttaaaatta

SEQ ID NO: 25917 - DNA, 16 bp, H. sapiens
acagtttttaaataaa

SEQ ID NO: 25918 - DNA, 16 bp, H. sapiens
acagtttttatatttt

SEQ ID NO: 25919 - DNA, 16 bp, H. sapiens
acagtttttattaaaa

SEQ ID NO: 25920 - DNA, 16 bp, H. sapiens
acagtttttccaaact

SEQ ID NO: 25921 - DNA, 16 bp, H. sapiens
acagtttttccatgga

SEQ ID NO: 25922 - DNA, 16 bp, H. sapiens
acagtttttgttttgt

SEQ ID NO: 25923 - DNA, 16 bp, H. sapiens
acagtttttttgtgtg

SEQ ID NO: 25924 - DNA, 16 bp, H. sapiens
acataaaaacagacac

SEQ ID NO: 25925 - DNA, 16 bp, H. sapiens
acataaaaaccagaca

SEQ ID NO: 25926 - DNA, 16 bp, H. sapiens
acataaaaagatattc

SEQ ID NO: 25927 - DNA, 16 bp, H. sapiens
acataaaaatgtttat

SEQ ID NO: 25928 - DNA, 16 bp, H. sapiens
acataaaacttacatt

SEQ ID NO: 25929 - DNA, 16 bp, H. sapiens
acataaaagaattcat

SEQ ID NO: 25930 - DNA, 16 bp, H. sapiens
acataaaatatctttt

SEQ ID NO: 25931 - DNA, 16 bp, H. sapiens
acataaaatcaaccta

SEQ ID NO: 25932 - DNA, 16 bp, H. sapiens
acataaaatgttaata

SEQ ID NO: 25933 - DNA, 16 bp, H. sapiens
acataaaatttaccat

SEQ ID NO: 25934 - DNA, 16 bp, H. sapiens
acataaaatttgccat

SEQ ID NO: 25935 - DNA, 16 bp, H. sapiens
acataaacaaaaatgt

SEQ ID NO: 25936 - DNA, 16 bp, H. sapiens
acataaacagaatcaa

SEQ ID NO: 25937 - DNA, 16 bp, H. sapiens
acataaagatgagaac

SEQ ID NO: 25938 - DNA, 16 bp, H. sapiens
acataaatatattttg

SEQ ID NO: 25939 - DNA, 16 bp, H. sapiens
acataaatgaaaatat

SEQ ID NO: 25940 - DNA, 16 bp, H. sapiens
acataaatgaaaattt

SEQ ID NO: 25941 - DNA, 16 bp, H. sapiens
acataaatgcccatca

SEQ ID NO: 25942 - DNA, 16 bp, H. sapiens
acataaatgggatcat

SEQ ID NO: 25943 - DNA, 18 bp, H. sapiens
acataaatgtcttctttt

SEQ ID NO: 25944 - DNA, 16 bp, H. sapiens
acataaatgttttaaa

SEQ ID NO: 25945 - DNA, 16 bp, H. sapiens
acataaattgattttt

SEQ ID NO: 25946 - DNA, 16 bp, H. sapiens
acataactaactccat

SEQ ID NO: 25947 - DNA, 16 bp, H. sapiens
acataagaagaatata

SEQ ID NO: 25948 - DNA, 16 bp, H. sapiens
acataagagaattcat

SEQ ID NO: 25949 - DNA, 16 bp, H. sapiens
acataagcaaataaat

SEQ ID NO: 25950 - DNA, 16 bp, H. sapiens
acataagctttcattt

SEQ ID NO: 25951 - DNA, 16 bp, H. sapiens
acataagtgtgtgtgt

SEQ ID NO: 25952 - DNA, 16 bp, H. sapiens
acataataaatatttg

SEQ ID NO: 25953 - DNA, 16 bp, H. sapiens
acataataataatggg

SEQ ID NO: 25954 - DNA, 16 bp, H. sapiens
acataatacaatgtaa

SEQ ID NO: 25955 - DNA, 16 bp, H. sapiens
acataataggtgctca

SEQ ID NO: 25956 - DNA, 16 bp, H. sapiens
acataatgacttccag

SEQ ID NO: 25957 - DNA, 16 bp, H. sapiens
acataatgagaccttg

SEQ ID NO: 25958 - DNA, 16 bp, H. sapiens
acataatgagacttca

SEQ ID NO: 25959 - DNA, 16 bp, H. sapiens
acataatgagatgtct

SEQ ID NO: 25960 - DNA, 16 bp, H. sapiens
acataattctatattt

SEQ ID NO: 25961 - DNA, 16 bp, H. sapiens
acataattgtttcttt

SEQ ID NO: 25962 - DNA, 16 bp, H. sapiens
acataattttgaaaat

SEQ ID NO: 25963 - DNA, 16 bp, H. sapiens
acatacaaggaactca

SEQ ID NO: 25964 - DNA, 16 bp, H. sapiens
acatacaagtggctaa

SEQ ID NO: 25965 - DNA, 16 bp, H. sapiens
acatacaatgcatgaa

SEQ ID NO: 25966 - DNA, 16 bp, H. sapiens
acatacacacacacgg

SEQ ID NO: 25967 - DNA, 16 bp, H. sapiens
acatacacacacatag

SEQ ID NO: 25968 - DNA, 16 bp, H. sapiens
acatacacacatgcat

SEQ ID NO: 25969 - DNA, 16 bp, H. sapiens
acatacacacattttt

SEQ ID NO: 25970 - DNA, 17 bp, H. sapiens
acatacacaccatggaa

SEQ ID NO: 25971 - DNA, 16 bp, H. sapiens
acatacacacgcacac

SEQ ID NO: 25972 - DNA, 16 bp, H. sapiens
acatacacagagagaa

SEQ ID NO: 25973 - DNA, 16 bp, H. sapiens
acatacacataaatac

SEQ ID NO: 25974 - DNA, 16 bp, H. sapiens
acatacacatacacag

SEQ ID NO: 25975 - DNA, 16 bp, H. sapiens
acatacacatacacat

SEQ ID NO: 25976 - DNA, 16 bp, H. sapiens
acatacactacacaca

SEQ ID NO: 25977 - DNA, 16 bp, H. sapiens
acatacagaaaacaga

SEQ ID NO: 25978 - DNA, 16 bp, H. sapiens
acatacagacacacat

SEQ ID NO: 25979 - DNA, 16 bp, H. sapiens
acatacagagaagagc

SEQ ID NO: 25980 - DNA, 16 bp, H. sapiens
acatacagtttttaaa

SEQ ID NO: 25981 - DNA, 16 bp, H. sapiens
acatacatacacacat

SEQ ID NO: 25982 - DNA, 16 bp, H. sapiens
acatacatacatacac

SEQ ID NO: 25983 - DNA, 16 bp, H. sapiens
acatacatactttttt

SEQ ID NO: 25984 - DNA, 16 bp, H. sapiens
acatacatatatatag

SEQ ID NO: 25985 - DNA, 16 bp, H. sapiens
acatacatatatatgt

SEQ ID NO: 25986 - DNA, 16 bp, H. sapiens
acatacatatattaat

SEQ ID NO: 25987 - DNA, 16 bp, H. sapiens
acatacatatgtgtgt

SEQ ID NO: 25988 - DNA, 16 bp, H. sapiens
acatacatgcacatac

SEQ ID NO: 25989 - DNA, 16 bp, H. sapiens
acatacatgtgtatgt

SEQ ID NO: 25990 - DNA, 16 bp, H. sapiens
acatacatttttacat

SEQ ID NO: 25991 - DNA, 16 bp, H. sapiens
acatacattttttaaa

SEQ ID NO: 25992 - DNA, 16 bp, H. sapiens
acataccaaattataa

SEQ ID NO: 25993 - DNA, 16 bp, H. sapiens
acataccacattttct

SEQ ID NO: 25994 - DNA, 16 bp, H. sapiens
acatacccgagactga

SEQ ID NO: 25995 - DNA, 16 bp, H. sapiens
acatacctatgataaa

SEQ ID NO: 25996 - DNA, 16 bp, H. sapiens
acatacctcattttat

SEQ ID NO: 25997 - DNA, 16 bp, H. sapiens
acatacctgaaaatgt

SEQ ID NO: 25998 - DNA, 16 bp, H. sapiens
acatacctgacaaaaa

SEQ ID NO: 25999 - DNA, 16 bp, H. sapiens
acatactacagagaaa

SEQ ID NO: 26000 - DNA, 16 bp, H. sapiens
acatactatatatata

SEQ ID NO: 26001 - DNA, 16 bp, H. sapiens
acatactatgttcatg

SEQ ID NO: 26002 - DNA, 16 bp, H. sapiens
acatactgtatgattc

SEQ ID NO: 26003 - DNA, 16 bp, H. sapiens
acatagaaaaggcaca

SEQ ID NO: 26004 - DNA, 16 bp, H. sapiens
acatagaaaatctgaa

SEQ ID NO: 26005 - DNA, 16 bp, H. sapiens
acatagaaatgaaaat

SEQ ID NO: 26006 - DNA, 16 bp, H. sapiens
acatagaaatggccaa

SEQ ID NO: 26007 - DNA, 16 bp, H. sapiens
acatagaagcaaaaat

SEQ ID NO: 26008 - DNA, 16 bp, H. sapiens
acatagacacacagac

SEQ ID NO: 26009 - DNA, 16 bp, H. sapiens
acatagacatagatat

SEQ ID NO: 26010 - DNA, 16 bp, H. sapiens
acatagactaatagaa

SEQ ID NO: 26011 - DNA, 17 bp, H. sapiens
acatagagaaaccccat

SEQ ID NO: 26012 - DNA, 16 bp, H. sapiens
acatagagaatagaag

SEQ ID NO: 26013 - DNA, 16 bp, H. sapiens
acatagagacagagag

SEQ ID NO: 26014 - DNA, 16 bp, H. sapiens
acatagaggagaacaa

SEQ ID NO: 26015 - DNA, 16 bp, H. sapiens
acatagataaatataa

SEQ ID NO: 26016 - DNA, 16 bp, H. sapiens
acatagatgaaattgg

SEQ ID NO: 26017 - DNA, 17 bp, H. sapiens
acatagatgaagctgga

SEQ ID NO: 26018 - DNA, 16 bp, H. sapiens
acatagatgtgaaaat

SEQ ID NO: 26019 - DNA, 16 bp, H. sapiens
acatagcaagagccca

SEQ ID NO: 26020 - DNA, 16 bp, H. sapiens
acatagcaggtgctca

SEQ ID NO: 26021 - DNA, 16 bp, H. sapiens
acatagcatttattat

SEQ ID NO: 26022 - DNA, 16 bp, H. sapiens
acatagccaagacaat

SEQ ID NO: 26023 - DNA, 16 bp, H. sapiens
acatagcgaaaccctg

SEQ ID NO: 26024 - DNA, 16 bp, H. sapiens
acatagcgagatcctg

SEQ ID NO: 26025 - DNA, 16 bp, H. sapiens
acatagctagaaagtg

SEQ ID NO: 26026 - DNA, 16 bp, H. sapiens
acataggaggtgctca

SEQ ID NO: 26027 - DNA, 16 bp, H. sapiens
acataggctcaaagta

SEQ ID NO: 26028 - DNA, 17 bp, H. sapiens
acataggtgtgtagata

SEQ ID NO: 26029 - DNA, 16 bp, H. sapiens
acatagtaagaccctg

SEQ ID NO: 26030 - DNA, 16 bp, H. sapiens
acatagtagatattca

SEQ ID NO: 26031 - DNA, 16 bp, H. sapiens
acatagtagatgctta

SEQ ID NO: 26032 - DNA, 16 bp, H. sapiens
acatagtaggaactca

SEQ ID NO: 26033 - DNA, 16 bp, H. sapiens
acatagtaggtgctca

SEQ ID NO: 26034 - DNA, 16 bp, H. sapiens
acatagtatatacata

SEQ ID NO: 26035 - DNA, 16 bp, H. sapiens
acatagtatttttatt

SEQ ID NO: 26036 - DNA, 16 bp, H. sapiens
acatagtgagacctga

SEQ ID NO: 26037 - DNA, 16 bp, H. sapiens
acatagtggaaccctg

SEQ ID NO: 26038 - DNA, 16 bp, H. sapiens
acatagtggctcacac

SEQ ID NO: 26039 - DNA, 16 bp, H. sapiens
acatagtttttttgtt

SEQ ID NO: 26040 - DNA, 16 bp, H. sapiens
acatataaaaatgtat

SEQ ID NO: 26041 - DNA, 16 bp, H. sapiens
acatataaaagttaaa

SEQ ID NO: 26042 - DNA, 16 bp, H. sapiens
acatataaatatgtat

SEQ ID NO: 26043 - DNA, 16 bp, H. sapiens
acatataacatgcaaa

SEQ ID NO: 26044 - DNA, 16 bp, H. sapiens
acatatacacatacat

SEQ ID NO: 26045 - DNA, 16 bp, H. sapiens
acatatacactgaaaa

SEQ ID NO: 26046 - DNA, 16 bp, H. sapiens
acatatacatatattt

SEQ ID NO: 26047 - DNA, 16 bp, H. sapiens
acatatacatatttta

SEQ ID NO: 26048 - DNA, 16 bp, H. sapiens
acatatacatgtatac

SEQ ID NO: 26049 - DNA, 16 bp, H. sapiens
acatatacattcatat

SEQ ID NO: 26050 - DNA, 16 bp, H. sapiens
acatatacatttttaa

SEQ ID NO: 26051 - DNA, 16 bp, H. sapiens
acatatagatatataa

SEQ ID NO: 26052 - DNA, 16 bp, H. sapiens
acatatatacacacac

SEQ ID NO: 26053 - DNA, 16 bp, H. sapiens
acatatatacacatat

SEQ ID NO: 26054 - DNA, 16 bp, H. sapiens
acatatatacatacaa

SEQ ID NO: 26055 - DNA, 16 bp, H. sapiens
acatatatacatatgt

SEQ ID NO: 26056 - DNA, 16 bp, H. sapiens
acatatatacatgtgt

SEQ ID NO: 26057 - DNA, 16 bp, H. sapiens
acatatatagatacat

SEQ ID NO: 26058 - DNA, 16 bp, H. sapiens
acatatatatatatag

SEQ ID NO: 26059 - DNA, 16 bp, H. sapiens
acatatatatatatgg

SEQ ID NO: 26060 - DNA, 16 bp, H. sapiens
acatatatatcctatt

SEQ ID NO: 26061 - DNA, 16 bp, H. sapiens
acatatatatgtatat

SEQ ID NO: 26062 - DNA, 16 bp, H. sapiens
acatatatatgtatgt

SEQ ID NO: 26063 - DNA, 16 bp, H. sapiens
acatatatgaagaaaa

SEQ ID NO: 26064 - DNA, 16 bp, H. sapiens
acatatatgagagaga

SEQ ID NO: 26065 - DNA, 16 bp, H. sapiens
acatatatgcatacat

SEQ ID NO: 26066 - DNA, 16 bp, H. sapiens
acatatatgtaattta

SEQ ID NO: 26067 - DNA, 16 bp, H. sapiens
acatatatgtatatta

SEQ ID NO: 26068 - DNA, 16 bp, H. sapiens
acatatatgtatgtaa

SEQ ID NO: 26069 - DNA, 17 bp, H. sapiens
acatatatgtatgtatg

SEQ ID NO: 26070 - DNA, 16 bp, H. sapiens
acatatatgtttatat

SEQ ID NO: 26071 - DNA, 16 bp, H. sapiens
acatatattagtatta

SEQ ID NO: 26072 - DNA, 16 bp, H. sapiens
acatatattcatatat

SEQ ID NO: 26073 - DNA, 16 bp, H. sapiens
acatatatttattgag

SEQ ID NO: 26074 - DNA, 16 bp, H. sapiens
acatatatttattgca

SEQ ID NO: 26075 - DNA, 16 bp, H. sapiens
acatatatttgcatgt

SEQ ID NO: 26076 - DNA, 16 bp, H. sapiens
acatatatttgtgtgt

SEQ ID NO: 26077 - DNA, 16 bp, H. sapiens
acatatcatagtcaaa

SEQ ID NO: 26078 - DNA, 16 bp, H. sapiens
acatatcatataattc

SEQ ID NO: 26079 - DNA, 16 bp, H. sapiens
acatatctaaaaatag

SEQ ID NO: 26080 - DNA, 16 bp, H. sapiens
acatatctatgataaa

SEQ ID NO: 26081 - DNA, 16 bp, H. sapiens
acatatctgaaaataa

SEQ ID NO: 26082 - DNA, 16 bp, H. sapiens
acatatgaaaaaatgt

SEQ ID NO: 26083 - DNA, 16 bp, H. sapiens
acatatgaaaaatgct

SEQ ID NO: 26084 - DNA, 16 bp, H. sapiens
acatatgaatttgcag

SEQ ID NO: 26085 - DNA, 16 bp, H. sapiens
acatatgaatttggaa

SEQ ID NO: 26086 - DNA, 16 bp, H. sapiens
acatatgagaaaacta

SEQ ID NO: 26087 - DNA, 16 bp, H. sapiens
acatatgagtacatgt

SEQ ID NO: 26088 - DNA, 16 bp, H. sapiens
acatatgcaaaaatat

SEQ ID NO: 26089 - DNA, 16 bp, H. sapiens
acatatgcacacaaaa

SEQ ID NO: 26090 - DNA, 16 bp, H. sapiens
acatatgcacacatat

SEQ ID NO: 26091 - DNA, 16 bp, H. sapiens
acatatgcatacatgt

SEQ ID NO: 26092 - DNA, 16 bp, H. sapiens
acatatgcatgcatgt

SEQ ID NO: 26093 - DNA, 16 bp, H. sapiens
acatatgcgtgcatgt

SEQ ID NO: 26094 - DNA, 16 bp, H. sapiens
acatatgctttctttt

SEQ ID NO: 26095 - DNA, 16 bp, H. sapiens
acatatgtacacatat

SEQ ID NO: 26096 - DNA, 16 bp, H. sapiens
acatatgtacataaat

SEQ ID NO: 26097 - DNA, 16 bp, H. sapiens
acatatgtactatata

SEQ ID NO: 26098 - DNA, 16 bp, H. sapiens
acatatgtatacaaat

SEQ ID NO: 26099 - DNA, 16 bp, H. sapiens
acatatgtatatgtat

SEQ ID NO: 26100 - DNA, 16 bp, H. sapiens
acatatgtattatata

SEQ ID NO: 26101 - DNA, 16 bp, H. sapiens
acatatgtgcatgtat

SEQ ID NO: 26102 - DNA, 16 bp, H. sapiens
acatatgtgtgtacac

SEQ ID NO: 26103 - DNA, 16 bp, H. sapiens
acatatgtgtgtacat

SEQ ID NO: 26104 - DNA, 16 bp, H. sapiens
acatattactggaagt

SEQ ID NO: 26105 - DNA, 16 bp, H. sapiens
acatattatctcattt

SEQ ID NO: 26106 - DNA, 16 bp, H. sapiens
acatattatttcatca

SEQ ID NO: 26107 - DNA, 16 bp, H. sapiens
acatattcatatattt

SEQ ID NO: 26108 - DNA, 16 bp, H. sapiens
acatattgaccaatgg

SEQ ID NO: 26109 - DNA, 16 bp, H. sapiens
acatattgtatgattc

SEQ ID NO: 26110 - DNA, 16 bp, H. sapiens
acatatttaaagtgta

SEQ ID NO: 26111 - DNA, 16 bp, H. sapiens
acatatttaaatacat

SEQ ID NO: 26112 - DNA, 16 bp, H. sapiens
acatatttacaagaaa

SEQ ID NO: 26113 - DNA, 16 bp, H. sapiens
acatatttacatatat

SEQ ID NO: 26114 - DNA, 16 bp, H. sapiens
acatatttatacattt

SEQ ID NO: 26115 - DNA, 16 bp, H. sapiens
acatatttatatatct

SEQ ID NO: 26116 - DNA, 16 bp, H. sapiens
acatatttatgtaata

SEQ ID NO: 26117 - DNA, 16 bp, H. sapiens
acatatttatgtattt

SEQ ID NO: 26118 - DNA, 16 bp, H. sapiens
acatatttcaggatat

SEQ ID NO: 26119 - DNA, 16 bp, H. sapiens
acatatttgaagaaat

SEQ ID NO: 26120 - DNA, 16 bp, H. sapiens
acatatttgcaaatca

SEQ ID NO: 26121 - DNA, 16 bp, H. sapiens
acatatttgtaaataa

SEQ ID NO: 26122 - DNA, 16 bp, H. sapiens
acatatttgtatattt

SEQ ID NO: 26123 - DNA, 16 bp, H. sapiens
acatatttgtgtatat

SEQ ID NO: 26124 - DNA, 16 bp, H. sapiens
acatatttgttaattt

SEQ ID NO: 26125 - DNA, 16 bp, H. sapiens
acatattttaaattct

SEQ ID NO: 26126 - DNA, 16 bp, H. sapiens
acatattttagaattt

SEQ ID NO: 26127 - DNA, 16 bp, H. sapiens
acatattttagtattt

SEQ ID NO: 26128 - DNA, 16 bp, H. sapiens
acatattttcaaaaat

SEQ ID NO: 26129 - DNA, 16 bp, H. sapiens
acatattttcttcata

SEQ ID NO: 26130 - DNA, 16 bp, H. sapiens
acatattttgaaaatg

SEQ ID NO: 26131 - DNA, 16 bp, H. sapiens
acatattttgaaatgg

SEQ ID NO: 26132 - DNA, 16 bp, H. sapiens
acatattttgttagat

SEQ ID NO: 26133 - DNA, 16 bp, H. sapiens
acatatttttatgtaa

SEQ ID NO: 26134 - DNA, 16 bp, H. sapiens
acatatttttctgaat

SEQ ID NO: 26135 - DNA, 16 bp, H. sapiens
acatatttttttgaga

SEQ ID NO: 26136 - DNA, 16 bp, H. sapiens
acatcaaaaaatggaa

SEQ ID NO: 26137 - DNA, 16 bp, H. sapiens
acatcaaaaagctaat

SEQ ID NO: 26138 - DNA, 16 bp, H. sapiens
acatcaaaaagctttt

SEQ ID NO: 26139 - DNA, 16 bp, H. sapiens
acatcaaaacagaact

SEQ ID NO: 26140 - DNA, 16 bp, H. sapiens
acatcaaaatatacta

SEQ ID NO: 26141 - DNA, 16 bp, H. sapiens
acatcaaagatcacag

SEQ ID NO: 26142 - DNA, 16 bp, H. sapiens
acatcaagggaacacc

SEQ ID NO: 26143 - DNA, 16 bp, H. sapiens
acatcaagtgatctgc

SEQ ID NO: 26144 - DNA, 16 bp, H. sapiens
acatcaagttgaaaag

SEQ ID NO: 26145 - DNA, 16 bp, H. sapiens
acatcaagtttaaaag

SEQ ID NO: 26146 - DNA, 16 bp, H. sapiens
acatcaataaaaagga

SEQ ID NO: 26147 - DNA, 16 bp, H. sapiens
acatcacaatcctaaa

SEQ ID NO: 26148 - DNA, 16 bp, H. sapiens
acatcacacatggggg

SEQ ID NO: 26149 - DNA, 19 bp, H. sapiens
acatcacactctggggact

SEQ ID NO: 26150 - DNA, 16 bp, H. sapiens
acatcaccatcaccac

SEQ ID NO: 26151 - DNA, 16 bp, H. sapiens
acatcaccatcatcaa

SEQ ID NO: 26152 - DNA, 16 bp, H. sapiens
acatcactaatcacta

SEQ ID NO: 26153 - DNA, 16 bp, H. sapiens
acatcacttaggtgct

SEQ ID NO: 26154 - DNA, 16 bp, H. sapiens
acatcagaacttcagg

SEQ ID NO: 26155 - DNA, 16 bp, H. sapiens
acatcagagaacaaaa

SEQ ID NO: 26156 - DNA, 16 bp, H. sapiens
acatcaggagtttgag

SEQ ID NO: 26157 - DNA, 17 bp, H. sapiens
acatcaggtgatccgcc

SEQ ID NO: 26158 - DNA, 16 bp, H. sapiens
acatcagtgctcctgg

SEQ ID NO: 26159 - DNA, 16 bp, H. sapiens
acatcagttagaatgg

SEQ ID NO: 26160 - DNA, 16 bp, H. sapiens
acatcataatcaaatt

SEQ ID NO: 26161 - DNA, 16 bp, H. sapiens
acatcatatcaacaga

SEQ ID NO: 26162 - DNA, 16 bp, H. sapiens
acatcatcatcaccca

SEQ ID NO: 26163 - DNA, 16 bp, H. sapiens
acatcatgtcaacaga

SEQ ID NO: 26164 - DNA, 16 bp, H. sapiens
acatcatgttgtacat

SEQ ID NO: 26165 - DNA, 16 bp, H. sapiens
acatcattatcatcca

SEQ ID NO: 26166 - DNA, 16 bp, H. sapiens
acatcatttcatttaa

SEQ ID NO: 26167 - DNA, 16 bp, H. sapiens
acatccaagtagagat

SEQ ID NO: 26168 - DNA, 16 bp, H. sapiens
acatccaagtggagat

SEQ ID NO: 26169 - DNA, 16 bp, H. sapiens
acatccacaagcatca

SEQ ID NO: 26170 - DNA, 16 bp, H. sapiens
acatccagacaatgag

SEQ ID NO: 26171 - DNA, 16 bp, H. sapiens
acatccagctaatttt

SEQ ID NO: 26172 - DNA, 16 bp, H. sapiens
acatccagctgcttct

SEQ ID NO: 26173 - DNA, 16 bp, H. sapiens
acatccaggtcatgct

SEQ ID NO: 26174 - DNA, 16 bp, H. sapiens
acatccatacacacac

SEQ ID NO: 26175 - DNA, 16 bp, H. sapiens
acatccatccatccat

SEQ ID NO: 26176 - DNA, 16 bp, H. sapiens
acatcccaggttcaag

SEQ ID NO: 26177 - DNA, 16 bp, H. sapiens
acatcccatactcatg

SEQ ID NO: 26178 - DNA, 16 bp, H. sapiens
acatcccctgaaatct

SEQ ID NO: 26179 - DNA, 16 bp, H. sapiens
acatccctaggaaaag

SEQ ID NO: 26180 - DNA, 16 bp, H. sapiens
acatccctgtcttgtg

SEQ ID NO: 26181 - DNA, 16 bp, H. sapiens
acatcccttcctgata

SEQ ID NO: 26182 - DNA, 16 bp, H. sapiens
acatccggctaatttt

SEQ ID NO: 26183 - DNA, 16 bp, H. sapiens
acatcctacaatgcat

SEQ ID NO: 26184 - DNA, 16 bp, H. sapiens
acatcctcaccaacaa

SEQ ID NO: 26185 - DNA, 16 bp, H. sapiens
acatcctcaccaacat

SEQ ID NO: 26186 - DNA, 16 bp, H. sapiens
acatcctcaccacctg

SEQ ID NO: 26187 - DNA, 16 bp, H. sapiens
acatcctcaccagcac

SEQ ID NO: 26188 - DNA, 16 bp, H. sapiens
acatcctcatcaacac

SEQ ID NO: 26189 - DNA, 16 bp, H. sapiens
acatcctcgtcagcat

SEQ ID NO: 26190 - DNA, 16 bp, H. sapiens
acatcctcttgtatac

SEQ ID NO: 26191 - DNA, 16 bp, H. sapiens
acatcctgcacatgta

SEQ ID NO: 26192 - DNA, 16 bp, H. sapiens
acatcctgcattcatg

SEQ ID NO: 26193 - DNA, 16 bp, H. sapiens
acatccttcaaaagga

SEQ ID NO: 26194 - DNA, 16 bp, H. sapiens
acatccttgtcttttt

SEQ ID NO: 26195 - DNA, 16 bp, H. sapiens
acatcgctaatgagga

SEQ ID NO: 26196 - DNA, 16 bp, H. sapiens
acatctacaaagaccc

SEQ ID NO: 26197 - DNA, 16 bp, H. sapiens
acatctatgcagccaa

SEQ ID NO: 26198 - DNA, 16 bp, H. sapiens
acatctcagacaatgg

SEQ ID NO: 26199 - DNA, 16 bp, H. sapiens
acatctccacctggat

SEQ ID NO: 26200 - DNA, 16 bp, H. sapiens
acatctccacttggat

SEQ ID NO: 26201 - DNA, 16 bp, H. sapiens
acatctccatttggat

SEQ ID NO: 26202 - DNA, 16 bp, H. sapiens
acatctctccctttct

SEQ ID NO: 26203 - DNA, 16 bp, H. sapiens
acatctgcaaagacct

SEQ ID NO: 26204 - DNA, 16 bp, H. sapiens
acatctggacaatgag

SEQ ID NO: 26205 - DNA, 16 bp, H. sapiens
acatctggatgtccag

SEQ ID NO: 26206 - DNA, 16 bp, H. sapiens
acatctggctaatgtt

SEQ ID NO: 26207 - DNA, 16 bp, H. sapiens
acatctggctaatttt

SEQ ID NO: 26208 - DNA, 16 bp, H. sapiens
acatctggcttatttt

SEQ ID NO: 26209 - DNA, 16 bp, H. sapiens
acatctggtaaaattc

SEQ ID NO: 26210 - DNA, 16 bp, H. sapiens
acatctggtcacagaa

SEQ ID NO: 26211 - DNA, 16 bp, H. sapiens
acatctgtaattccaa

SEQ ID NO: 26212 - DNA, 16 bp, H. sapiens
acatctgtgaatagcc

SEQ ID NO: 26213 - DNA, 16 bp, H. sapiens
acatctgtgtatatat

SEQ ID NO: 26214 - DNA, 16 bp, H. sapiens
acatctgttcccttgg

SEQ ID NO: 26215 - DNA, 16 bp, H. sapiens
acatctgtttgttttt

SEQ ID NO: 26216 - DNA, 16 bp, H. sapiens
acatcttattgaatga

SEQ ID NO: 26217 - DNA, 16 bp, H. sapiens
acatcttcctggttta

SEQ ID NO: 26218 - DNA, 16 bp, H. sapiens
acatcttctccagcat

SEQ ID NO: 26219 - DNA, 16 bp, H. sapiens
acatcttgaaaatatt

SEQ ID NO: 26220 - DNA, 16 bp, H. sapiens
acatcttgaatatata

SEQ ID NO: 26221 - DNA, 16 bp, H. sapiens
acatcttggccaacat

SEQ ID NO: 26222 - DNA, 16 bp, H. sapiens
acatcttggctcctcc

SEQ ID NO: 26223 - DNA, 16 bp, H. sapiens
acatctttaaagtgct

SEQ ID NO: 26224 - DNA, 16 bp, H. sapiens
acatctttatttttgc

SEQ ID NO: 26225 - DNA, 16 bp, H. sapiens
acatctttctcctgtg

SEQ ID NO: 26226 - DNA, 16 bp, H. sapiens
acatctttgccagcat

SEQ ID NO: 26227 - DNA, 16 bp, H. sapiens
acatctttgctttgtt

SEQ ID NO: 26228 - DNA, 16 bp, H. sapiens
acatctttggggagcc

SEQ ID NO: 26229 - DNA, 16 bp, H. sapiens
acatctttgttaattt

SEQ ID NO: 26230 - DNA, 16 bp, H. sapiens
acatctttgttttgtt

SEQ ID NO: 26231 - DNA, 16 bp, H. sapiens
acatcttttaaaacaa

SEQ ID NO: 26232 - DNA, 16 bp, H. sapiens
acatcttttcatttct

SEQ ID NO: 26233 - DNA, 16 bp, H. sapiens
acatctttttctgttt

SEQ ID NO: 26234 - DNA, 17 bp, H. sapiens
acatgaaaaaatgctca

SEQ ID NO: 26235 - DNA, 17 bp, H. sapiens
acatgaaaaaatgctcc

SEQ ID NO: 26236 - DNA, 16 bp, H. sapiens
acatgaaaaaccctcc

SEQ ID NO: 26237 - DNA, 16 bp, H. sapiens
acatgaaaaaggaaat

SEQ ID NO: 26238 - DNA, 16 bp, H. sapiens
acatgaaaataataat

SEQ ID NO: 26239 - DNA, 16 bp, H. sapiens
acatgaaaataattta

SEQ ID NO: 26240 - DNA, 16 bp, H. sapiens
acatgaaaatattaaa

SEQ ID NO: 26241 - DNA, 16 bp, H. sapiens
acatgaaaatcctgtt

SEQ ID NO: 26242 - DNA, 16 bp, H. sapiens
acatgaaaatttaatt

SEQ ID NO: 26243 - DNA, 16 bp, H. sapiens
acatgaaacattttcc

SEQ ID NO: 26244 - DNA, 16 bp, H. sapiens
acatgaaacttcatca

SEQ ID NO: 26245 - DNA, 16 bp, H. sapiens
acatgaaagaaaaatg

SEQ ID NO: 26246 - DNA, 16 bp, H. sapiens
acatgaaagggagttt

SEQ ID NO: 26247 - DNA, 16 bp, H. sapiens
acatgaaataaagaat

SEQ ID NO: 26248 - DNA, 16 bp, H. sapiens
acatgaaatggacaaa

SEQ ID NO: 26249 - DNA, 16 bp, H. sapiens
acatgaaattttaaat

SEQ ID NO: 26250 - DNA, 16 bp, H. sapiens
acatgaacaaatattt

SEQ ID NO: 26251 - DNA, 16 bp, H. sapiens
acatgaacaaatggaa

SEQ ID NO: 26252 - DNA, 16 bp, H. sapiens
acatgaacacatcctt

SEQ ID NO: 26253 - DNA, 16 bp, H. sapiens
acatgaacagacattt

SEQ ID NO: 26254 - DNA, 16 bp, H. sapiens
acatgaacccaggagg

SEQ ID NO: 26255 - DNA, 16 bp, H. sapiens
acatgaactcatcatg

SEQ ID NO: 26256 - DNA, 16 bp, H. sapiens
acatgaacttgaaaaa

SEQ ID NO: 26257 - DNA, 16 bp, H. sapiens
acatgaagaaaaatga

SEQ ID NO: 26258 - DNA, 16 bp, H. sapiens
acatgaagaaacagaa

SEQ ID NO: 26259 - DNA, 16 bp, H. sapiens
acatgaagatatttgt

SEQ ID NO: 26260 - DNA, 16 bp, H. sapiens
acatgaaggaaaaata

SEQ ID NO: 26261 - DNA, 16 bp, H. sapiens
acatgaaggagaaatg

SEQ ID NO: 26262 - DNA, 16 bp, H. sapiens
acatgaaggcaataag

SEQ ID NO: 26263 - DNA, 16 bp, H. sapiens
acatgaagggatgctg

SEQ ID NO: 26264 - DNA, 16 bp, H. sapiens
acatgaataaatacat

SEQ ID NO: 26265 - DNA, 16 bp, H. sapiens
acatgaatatatttat

SEQ ID NO: 26266 - DNA, 16 bp, H. sapiens
acatgaatccacacat

SEQ ID NO: 26267 - DNA, 16 bp, H. sapiens
acatgaatgaattata

SEQ ID NO: 26268 - DNA, 16 bp, H. sapiens
acatgaatggcagcag

SEQ ID NO: 26269 - DNA, 16 bp, H. sapiens
acatgaatttggaggg

SEQ ID NO: 26270 - DNA, 16 bp, H. sapiens
acatgaattttataat

SEQ ID NO: 26271 - DNA, 16 bp, H. sapiens
acatgaattttggaag

SEQ ID NO: 26272 - DNA, 16 bp, H. sapiens
acatgaattttgggga

SEQ ID NO: 26273 - DNA, 16 bp, H. sapiens
acatgaatttttggag

SEQ ID NO: 26274 - DNA, 16 bp, H. sapiens
acatgacaccaaaagc

SEQ ID NO: 26275 - DNA, 16 bp, H. sapiens
acatgacatattttga

SEQ ID NO: 26276 - DNA, 16 bp, H. sapiens
acatgaccaagtggga

SEQ ID NO: 26277 - DNA, 16 bp, H. sapiens
acatgagatttgaaga

SEQ ID NO: 26278 - DNA, 16 bp, H. sapiens
acatgagatttgaggg

SEQ ID NO: 26279 - DNA, 16 bp, H. sapiens
acatgagatttggatg

SEQ ID NO: 26280 - DNA, 16 bp, H. sapiens
acatgagatttgggca

SEQ ID NO: 26281 - DNA, 16 bp, H. sapiens
acatgagatttgggtg

SEQ ID NO: 26282 - DNA, 16 bp, H. sapiens
acatgagcagacattt

SEQ ID NO: 26283 - DNA, 16 bp, H. sapiens
acatgagccactgcac

SEQ ID NO: 26284 - DNA, 16 bp, H. sapiens
acatgaggaagctgag

SEQ ID NO: 26285 - DNA, 16 bp, H. sapiens
acatgagtaatgtgtt

SEQ ID NO: 26286 - DNA, 16 bp, H. sapiens
acatgataaatacata

SEQ ID NO: 26287 - DNA, 16 bp, H. sapiens
acatgatccagcaatt

SEQ ID NO: 26288 - DNA, 16 bp, H. sapiens
acatgatctcattcct

SEQ ID NO: 26289 - DNA, 16 bp, H. sapiens
acatgatgaaaaatac

SEQ ID NO: 26290 - DNA, 16 bp, H. sapiens
acatgatgaagctgga

SEQ ID NO: 26291 - DNA, 16 bp, H. sapiens
acatgattatctaaat

SEQ ID NO: 26292 - DNA, 16 bp, H. sapiens
acatgattatcttaat

SEQ ID NO: 26293 - DNA, 27 bp, H. sapiens
acatgattgtatatctagaaaacccca

SEQ ID NO: 26294 - DNA, 16 bp, H. sapiens
acatgatttgaaaata

SEQ ID NO: 26295 - DNA, 16 bp, H. sapiens
acatgattttatattt

SEQ ID NO: 26296 - DNA, 16 bp, H. sapiens
acatgattttgatttt

SEQ ID NO: 26297 - DNA, 16 bp, H. sapiens
acatgatttttcttct

SEQ ID NO: 26298 - DNA, 16 bp, H. sapiens
acatgattttttttaa

SEQ ID NO: 26299 - DNA, 16 bp, H. sapiens
acatgcaaaataatga

SEQ ID NO: 26300 - DNA, 16 bp, H. sapiens
acatgcaaagacaaac

SEQ ID NO: 26301 - DNA, 16 bp, H. sapiens
acatgcaaatattcca

SEQ ID NO: 26302 - DNA, 16 bp, H. sapiens
acatgcaaatgtatgt

SEQ ID NO: 26303 - DNA, 16 bp, H. sapiens
acatgcaatgacatcc

SEQ ID NO: 26304 - DNA, 16 bp, H. sapiens
acatgcacacacaaag

SEQ ID NO: 26305 - DNA, 17 bp, H. sapiens
acatgcacacacacact

SEQ ID NO: 26306 - DNA, 16 bp, H. sapiens
acatgcacacacacat

SEQ ID NO: 26307 - DNA, 16 bp, H. sapiens
acatgcacacacagac

SEQ ID NO: 26308 - DNA, 16 bp, H. sapiens
acatgcacacacgtgc

SEQ ID NO: 26309 - DNA, 17 bp, H. sapiens
acatgcacacatacaca

SEQ ID NO: 26310 - DNA, 16 bp, H. sapiens
acatgcacacccacat

SEQ ID NO: 26311 - DNA, 16 bp, H. sapiens
acatgcacagcctccc

SEQ ID NO: 26312 - DNA, 16 bp, H. sapiens
acatgcacatgaatgt

SEQ ID NO: 26313 - DNA, 16 bp, H. sapiens
acatgcacatgtactc

SEQ ID NO: 26314 - DNA, 17 bp, H. sapiens
acatgcacatgtatgtt

SEQ ID NO: 26315 - DNA, 16 bp, H. sapiens
acatgcacatgtgtgt

SEQ ID NO: 26316 - DNA, 16 bp, H. sapiens
acatgcaccaccacac

SEQ ID NO: 26317 - DNA, 16 bp, H. sapiens
acatgcacgcacacat

SEQ ID NO: 26318 - DNA, 16 bp, H. sapiens
acatgcacgcatatgt

SEQ ID NO: 26319 - DNA, 16 bp, H. sapiens
acatgcactcctatgt

SEQ ID NO: 26320 - DNA, 16 bp, H. sapiens
acatgcagaacatgca

SEQ ID NO: 26321 - DNA, 16 bp, H. sapiens
acatgcagtctttggt

SEQ ID NO: 26322 - DNA, 16 bp, H. sapiens
acatgcatacacacaa

SEQ ID NO: 26323 - DNA, 16 bp, H. sapiens
acatgcatacacacat

SEQ ID NO: 26324 - DNA, 16 bp, H. sapiens
acatgcatatgcaagt

SEQ ID NO: 26325 - DNA, 16 bp, H. sapiens
acatgcatatgtatgt

SEQ ID NO: 26326 - DNA, 16 bp, H. sapiens
acatgcatgaaccttg

SEQ ID NO: 26327 - DNA, 16 bp, H. sapiens
acatgcatgtttacag

SEQ ID NO: 26328 - DNA, 16 bp, H. sapiens
acatgcattctttttt

SEQ ID NO: 26329 - DNA, 16 bp, H. sapiens
acatgcatttttaaaa

SEQ ID NO: 26330 - DNA, 16 bp, H. sapiens
acatgcattttttttt

SEQ ID NO: 26331 - DNA, 16 bp, H. sapiens
acatgccaaaatgtaa

SEQ ID NO: 26332 - DNA, 16 bp, H. sapiens
acatgccaaagaatga

SEQ ID NO: 26333 - DNA, 16 bp, H. sapiens
acatgccaaattgtaa

SEQ ID NO: 26334 - DNA, 16 bp, H. sapiens
acatgccaacaaattg

SEQ ID NO: 26335 - DNA, 16 bp, H. sapiens
acatgccaccacacct

SEQ ID NO: 26336 - DNA, 16 bp, H. sapiens
acatgcccaaggccac

SEQ ID NO: 26337 - DNA, 18 bp, H. sapiens
acatgcccagctaatttt

SEQ ID NO: 26338 - DNA, 16 bp, H. sapiens
acatgcctgtaatcca

SEQ ID NO: 26339 - DNA, 17 bp, H. sapiens
acatgcctgtattccca

SEQ ID NO: 26340 - DNA, 16 bp, H. sapiens
acatgccttcctcact

SEQ ID NO: 26341 - DNA, 16 bp, H. sapiens
acatgcgtgtgcatgt

SEQ ID NO: 26342 - DNA, 16 bp, H. sapiens
acatgctaggcactgt

SEQ ID NO: 26343 - DNA, 16 bp, H. sapiens
acatgctcacatacac

SEQ ID NO: 26344 - DNA, 17 bp, H. sapiens
acatgctcctgctgcag

SEQ ID NO: 26345 - DNA, 16 bp, H. sapiens
acatgctgaaacctca

SEQ ID NO: 26346 - DNA, 16 bp, H. sapiens
acatgctgagaccaga

SEQ ID NO: 26347 - DNA, 16 bp, H. sapiens
acatgctggagaggat

SEQ ID NO: 26348 - DNA, 16 bp, H. sapiens
acatgctggggcctgt

SEQ ID NO: 26349 - DNA, 16 bp, H. sapiens
acatgctggtgcgctg

SEQ ID NO: 26350 - DNA, 16 bp, H. sapiens
acatgctgtgtttggt

SEQ ID NO: 26351 - DNA, 16 bp, H. sapiens
acatgctgttctctct

SEQ ID NO: 26352 - DNA, 16 bp, H. sapiens
acatgctgttggaaaa

SEQ ID NO: 26353 - DNA, 16 bp, H. sapiens
acatgctgttttgttt

SEQ ID NO: 26354 - DNA, 16 bp, H. sapiens
acatgcttattataaa

SEQ ID NO: 26355 - DNA, 16 bp, H. sapiens
acatgcttttaaaaaa

SEQ ID NO: 26356 - DNA, 16 bp, H. sapiens
acatgcttttaaaaat

SEQ ID NO: 26357 - DNA, 16 bp, H. sapiens
acatgcttttaaaata

SEQ ID NO: 26358 - DNA, 16 bp, H. sapiens
acatggaaaaatgctc

SEQ ID NO: 26359 - DNA, 16 bp, H. sapiens
acatggaaaatatatt

SEQ ID NO: 26360 - DNA, 16 bp, H. sapiens
acatggaaacagaaaa

SEQ ID NO: 26361 - DNA, 26 bp, H. sapiens
acatggaaactgaacaacctgctccc

SEQ ID NO: 26362 - DNA, 16 bp, H. sapiens
acatggaaactgaaga

SEQ ID NO: 26363 - DNA, 16 bp, H. sapiens
acatggaaacttaaca

SEQ ID NO: 26364 - DNA, 16 bp, H. sapiens
acatggaaataataaa

SEQ ID NO: 26365 - DNA, 16 bp, H. sapiens
acatggaaatatatat

SEQ ID NO: 26366 - DNA, 16 bp, H. sapiens
acatggaaatgataaa

SEQ ID NO: 26367 - DNA, 16 bp, H. sapiens
acatggaagaaccttg

SEQ ID NO: 26368 - DNA, 16 bp, H. sapiens
acatggaagcaaccaa

SEQ ID NO: 26369 - DNA, 26 bp, H. sapiens
acatggaatactatgcagccataaaa

SEQ ID NO: 26370 - DNA, 16 bp, H. sapiens
acatggaatttctttt

SEQ ID NO: 26371 - DNA, 16 bp, H. sapiens
acatggacacagggag

SEQ ID NO: 26372 - DNA, 16 bp, H. sapiens
acatggacacaggtag

SEQ ID NO: 26373 - DNA, 16 bp, H. sapiens
acatggacacagtgag

SEQ ID NO: 26374 - DNA, 16 bp, H. sapiens
acatggacatggggag

SEQ ID NO: 26375 - DNA, 17 bp, H. sapiens
acatggaccctagaact

SEQ ID NO: 26376 - DNA, 18 bp, H. sapiens
acatggagaaaccccgtt

SEQ ID NO: 26377 - DNA, 16 bp, H. sapiens
acatggagaaacctgt

SEQ ID NO: 26378 - DNA, 17 bp, H. sapiens
acatggagaaactctgt

SEQ ID NO: 26379 - DNA, 16 bp, H. sapiens
acatggagaaattgga

SEQ ID NO: 26380 - DNA, 16 bp, H. sapiens
acatggagaagccctg

SEQ ID NO: 26381 - DNA, 16 bp, H. sapiens
acatggagagagagaa

SEQ ID NO: 26382 - DNA, 16 bp, H. sapiens
acatggagctgtcatc

SEQ ID NO: 26383 - DNA, 16 bp, H. sapiens
acatggaggtgctggg

SEQ ID NO: 26384 - DNA, 16 bp, H. sapiens
acatggatgaacttga

SEQ ID NO: 26385 - DNA, 16 bp, H. sapiens
acatggatgaactttg

SEQ ID NO: 26386 - DNA, 29 bp, H. sapiens
acatggatgaagctggaaaccatcattct

SEQ ID NO: 26387 - DNA, 21 bp, H. sapiens
acatggatgaagctggaaact

SEQ ID NO: 26388 - DNA, 16 bp, H. sapiens
acatggatgagctgga

SEQ ID NO: 26389 - DNA, 16 bp, H. sapiens
acatggatggagatgg

SEQ ID NO: 26390 - DNA, 16 bp, H. sapiens
acatggcaaaacgctg

SEQ ID NO: 26391 - DNA, 16 bp, H. sapiens
acatggcaagacccta

SEQ ID NO: 26392 - DNA, 16 bp, H. sapiens
acatggcaataaaatg

SEQ ID NO: 26393 - DNA, 16 bp, H. sapiens
acatggcagagcagga

SEQ ID NO: 26394 - DNA, 16 bp, H. sapiens
acatggcagcaagcaa

SEQ ID NO: 26395 - DNA, 16 bp, H. sapiens
acatggcagcaggcag

SEQ ID NO: 26396 - DNA, 16 bp, H. sapiens
acatggccttcttccc

SEQ ID NO: 26397 - DNA, 16 bp, H. sapiens
acatggccttttctct

SEQ ID NO: 26398 - DNA, 16 bp, H. sapiens
acatggctaaaccctg

SEQ ID NO: 26399 - DNA, 16 bp, H. sapiens
acatggctggggtggc

SEQ ID NO: 26400 - DNA, 16 bp, H. sapiens
acatggctgtgctgga

SEQ ID NO: 26401 - DNA, 21 bp, H. sapiens
acatgggaaatagggaaggtg

SEQ ID NO: 26402 - DNA, 16 bp, H. sapiens
acatgggaagcattgt

SEQ ID NO: 26403 - DNA, 16 bp, H. sapiens
acatgggagaaaatat

SEQ ID NO: 26404 - DNA, 29 bp, H. sapiens
acatgggagaaaattttcgcaacctactc

SEQ ID NO: 26405 - DNA, 16 bp, H. sapiens
acatgggcatgcagat

SEQ ID NO: 26406 - DNA, 16 bp, H. sapiens
acatgggccaggctgg

SEQ ID NO: 26407 - DNA, 16 bp, H. sapiens
acatggggaaactgag

SEQ ID NO: 26408 - DNA, 16 bp, H. sapiens
acatggggattatgag

SEQ ID NO: 26409 - DNA, 17 bp, H. sapiens
acatgggtgaagctgga

SEQ ID NO: 26410 - DNA, 16 bp, H. sapiens
acatgggtttcaccat

SEQ ID NO: 26411 - DNA, 16 bp, H. sapiens
acatggtaactctatg

SEQ ID NO: 26412 - DNA, 16 bp, H. sapiens
acatggtagatattaa

SEQ ID NO: 26413 - DNA, 16 bp, H. sapiens
acatggtaggactgtt

SEQ ID NO: 26414 - DNA, 16 bp, H. sapiens
acatggtaggtgctca

SEQ ID NO: 26415 - DNA, 16 bp, H. sapiens
acatggtctcaaaaaa

SEQ ID NO: 26416 - DNA, 16 bp, H. sapiens
acatggtcttgctttg

SEQ ID NO: 26417 - DNA, 16 bp, H. sapiens
acatggtcttttgtga

SEQ ID NO: 26418 - DNA, 16 bp, H. sapiens
acatggtgaaaaacca

SEQ ID NO: 26419 - DNA, 16 bp, H. sapiens
acatggtgaaacacct

SEQ ID NO: 26420 - DNA, 16 bp, H. sapiens
acatggtgaaacgctg

SEQ ID NO: 26421 - DNA, 16 bp, H. sapiens
acatggtgctgggaaa

SEQ ID NO: 26422 - DNA, 16 bp, H. sapiens
acatggtggaagggat

SEQ ID NO: 26423 - DNA, 16 bp, H. sapiens
acatggtggaaggggt

SEQ ID NO: 26424 - DNA, 16 bp, H. sapiens
acatggtggcacatgt

SEQ ID NO: 26425 - DNA, 16 bp, H. sapiens
acatggtggcatgcac

SEQ ID NO: 26426 - DNA, 18 bp, H. sapiens
acatggtggctcatgcct

SEQ ID NO: 26427 - DNA, 16 bp, H. sapiens
acatggtggtgcatgc

SEQ ID NO: 26428 - DNA, 16 bp, H. sapiens
acatggttgcagctgg

SEQ ID NO: 26429 - DNA, 16 bp, H. sapiens
acatggttgtttattt

SEQ ID NO: 26430 - DNA, 16 bp, H. sapiens
acatggtttgcaaata

SEQ ID NO: 26431 - DNA, 16 bp, H. sapiens
acatgtaaaaatcaat

SEQ ID NO: 26432 - DNA, 16 bp, H. sapiens
acatgtaaaatattta

SEQ ID NO: 26433 - DNA, 16 bp, H. sapiens
acatgtaaaatgttta

SEQ ID NO: 26434 - DNA, 16 bp, H. sapiens
acatgtaaatataaat

SEQ ID NO: 26435 - DNA, 16 bp, H. sapiens
acatgtaacaaacctg

SEQ ID NO: 26436 - DNA, 16 bp, H. sapiens
acatgtacacatgtat

SEQ ID NO: 26437 - DNA, 16 bp, H. sapiens
acatgtacagacattt

SEQ ID NO: 26438 - DNA, 16 bp, H. sapiens
acatgtacagactttt

SEQ ID NO: 26439 - DNA, 16 bp, H. sapiens
acatgtacatacacac

SEQ ID NO: 26440 - DNA, 16 bp, H. sapiens
acatgtacccaaaaac

SEQ ID NO: 26441 - DNA, 16 bp, H. sapiens
acatgtacccctgaac

SEQ ID NO: 26442 - DNA, 16 bp, H. sapiens
acatgtatacctatat

SEQ ID NO: 26443 - DNA, 16 bp, H. sapiens
acatgtatataaacat

SEQ ID NO: 26444 - DNA, 16 bp, H. sapiens
acatgtatatatttgt

SEQ ID NO: 26445 - DNA, 16 bp, H. sapiens
acatgtatatgtatat

SEQ ID NO: 26446 - DNA, 16 bp, H. sapiens
acatgtatgcatgtat

SEQ ID NO: 26447 - DNA, 16 bp, H. sapiens
acatgtatgtacacat

SEQ ID NO: 26448 - DNA, 16 bp, H. sapiens
acatgtatgtatacat

SEQ ID NO: 26449 - DNA, 16 bp, H. sapiens
acatgtatgtttatag

SEQ ID NO: 26450 - DNA, 16 bp, H. sapiens
acatgtattcatcatt

SEQ ID NO: 26451 - DNA, 16 bp, H. sapiens
acatgtatttataaaa

SEQ ID NO: 26452 - DNA, 16 bp, H. sapiens
acatgtcacaaagcag

SEQ ID NO: 26453 - DNA, 16 bp, H. sapiens
acatgtccttcacatg

SEQ ID NO: 26454 - DNA, 16 bp, H. sapiens
acatgtctggctaatt

SEQ ID NO: 26455 - DNA, 16 bp, H. sapiens
acatgtgaagaatgtg

SEQ ID NO: 26456 - DNA, 16 bp, H. sapiens
acatgtgatttgcaaa

SEQ ID NO: 26457 - DNA, 16 bp, H. sapiens
acatgtgatttttttt

SEQ ID NO: 26458 - DNA, 18 bp, H. sapiens
acatgtgcacaacttgca

SEQ ID NO: 26459 - DNA, 16 bp, H. sapiens
acatgtgcacacatgt

SEQ ID NO: 26460 - DNA, 16 bp, H. sapiens
acatgtgcacacgtgc

SEQ ID NO: 26461 - DNA, 16 bp, H. sapiens
acatgtgcagaatgta

SEQ ID NO: 26462 - DNA, 16 bp, H. sapiens
acatgtgcaggcttgt

SEQ ID NO: 26463 - DNA, 16 bp, H. sapiens
acatgtgcaggtgtct

SEQ ID NO: 26464 - DNA, 16 bp, H. sapiens
acatgtgcaggtgtgt

SEQ ID NO: 26465 - DNA, 16 bp, H. sapiens
acatgtgcatgtttgt

SEQ ID NO: 26466 - DNA, 16 bp, H. sapiens
acatgtgccaggttgg

SEQ ID NO: 26467 - DNA, 29 bp, H. sapiens
acatgtgccatgctggtgtgctgcaccca

SEQ ID NO: 26468 - DNA, 16 bp, H. sapiens
acatgtggagattaca

SEQ ID NO: 26469 - DNA, 16 bp, H. sapiens
acatgtggatatccag

SEQ ID NO: 26470 - DNA, 16 bp, H. sapiens
acatgtgggaattaca

SEQ ID NO: 26471 - DNA, 16 bp, H. sapiens
acatgtgggaattgtg

SEQ ID NO: 26472 - DNA, 16 bp, H. sapiens
acatgtggggattata

SEQ ID NO: 26473 - DNA, 16 bp, H. sapiens
acatgtgtacatattt

SEQ ID NO: 26474 - DNA, 16 bp, H. sapiens
acatgtgtagaatgtg

SEQ ID NO: 26475 - DNA, 16 bp, H. sapiens
acatgtgtgtacatat

SEQ ID NO: 26476 - DNA, 16 bp, H. sapiens
acatgtgtgtatatgt

SEQ ID NO: 26477 - DNA, 16 bp, H. sapiens
acatgttaaaaataat

SEQ ID NO: 26478 - DNA, 16 bp, H. sapiens
acatgttaaaaatatt

SEQ ID NO: 26479 - DNA, 16 bp, H. sapiens
acatgttatattttga

SEQ ID NO: 26480 - DNA, 17 bp, H. sapiens
acatgttcataatggcc

SEQ ID NO: 26481 - DNA, 16 bp, H. sapiens
acatgttctcacctat

SEQ ID NO: 26482 - DNA, 16 bp, H. sapiens
acatgttctcactcac

SEQ ID NO: 26483 - DNA, 17 bp, H. sapiens
acatgttctcactcata

SEQ ID NO: 26484 - DNA, 16 bp, H. sapiens
acatgttgaaggaggg

SEQ ID NO: 26485 - DNA, 16 bp, H. sapiens
acatgtttactttttt

SEQ ID NO: 26486 - DNA, 16 bp, H. sapiens
acatgtttatttttat

SEQ ID NO: 26487 - DNA, 16 bp, H. sapiens
acatgtttgtatatct

SEQ ID NO: 26488 - DNA, 16 bp, H. sapiens
acatgttttattaaaa

SEQ ID NO: 26489 - DNA, 16 bp, H. sapiens
acatgttttcatttct

SEQ ID NO: 26490 - DNA, 16 bp, H. sapiens
acatgttttgtatgtt

SEQ ID NO: 26491 - DNA, 16 bp, H. sapiens
acatgtttttttaaaa

SEQ ID NO: 26492 - DNA, 16 bp, H. sapiens
acattaaaaaactgaa

SEQ ID NO: 26493 - DNA, 16 bp, H. sapiens
acattaaaaaggagaa

SEQ ID NO: 26494 - DNA, 16 bp, H. sapiens
acattaaaaatgtaaa

SEQ ID NO: 26495 - DNA, 16 bp, H. sapiens
acattaaaaatgtttt

SEQ ID NO: 26496 - DNA, 16 bp, H. sapiens
acattaaaaattagaa

SEQ ID NO: 26497 - DNA, 16 bp, H. sapiens
acattaaaacagagat

SEQ ID NO: 26498 - DNA, 16 bp, H. sapiens
acattaaaacagttgc

SEQ ID NO: 26499 - DNA, 16 bp, H. sapiens
acattaaaacagttgt

SEQ ID NO: 26500 - DNA, 16 bp, H. sapiens
acattaaaaggaaaat

SEQ ID NO: 26501 - DNA, 16 bp, H. sapiens
acattaaaattgtttt

SEQ ID NO: 26502 - DNA, 16 bp, H. sapiens
acattaaagcaaaaat

SEQ ID NO: 26503 - DNA, 16 bp, H. sapiens
acattaaaggaaaaat

SEQ ID NO: 26504 - DNA, 16 bp, H. sapiens
acattaaataaatttg

SEQ ID NO: 26505 - DNA, 16 bp, H. sapiens
acattaaatagcaaat

SEQ ID NO: 26506 - DNA, 16 bp, H. sapiens
acattaaatataaatg

SEQ ID NO: 26507 - DNA, 16 bp, H. sapiens
acattaaatgtaaatg

SEQ ID NO: 26508 - DNA, 16 bp, H. sapiens
acattaaatttcatat

SEQ ID NO: 26509 - DNA, 16 bp, H. sapiens
acattaacatttgaat

SEQ ID NO: 26510 - DNA, 16 bp, H. sapiens
acattaagaaaataat

SEQ ID NO: 26511 - DNA, 16 bp, H. sapiens
acattaagtaaaataa

SEQ ID NO: 26512 - DNA, 16 bp, H. sapiens
acattaatatcagaca

SEQ ID NO: 26513 - DNA, 16 bp, H. sapiens
acattaattcattaat

SEQ ID NO: 26514 - DNA, 16 bp, H. sapiens
acattaattttatatc

SEQ ID NO: 26515 - DNA, 16 bp, H. sapiens
acattacaactaaaag

SEQ ID NO: 26516 - DNA, 16 bp, H. sapiens
acattacccagcttca

SEQ ID NO: 26517 - DNA, 16 bp, H. sapiens
acattacgttctgctg

SEQ ID NO: 26518 - DNA, 16 bp, H. sapiens
acattactgaatttgt

SEQ ID NO: 26519 - DNA, 16 bp, H. sapiens
acattagacacatcaa

SEQ ID NO: 26520 - DNA, 16 bp, H. sapiens
acattagattctcata

SEQ ID NO: 26521 - DNA, 16 bp, H. sapiens
acattagcaaagacat

SEQ ID NO: 26522 - DNA, 16 bp, H. sapiens
acattatatcatttaa

SEQ ID NO: 26523 - DNA, 16 bp, H. sapiens
acattatatgatttca

SEQ ID NO: 26524 - DNA, 16 bp, H. sapiens
acattatattaaatga

SEQ ID NO: 26525 - DNA, 16 bp, H. sapiens
acattatcaggctgca

SEQ ID NO: 26526 - DNA, 16 bp, H. sapiens
acattatctaatttaa

SEQ ID NO: 26527 - DNA, 27 bp, H. sapiens
acattattagattccattgctcatgga

SEQ ID NO: 26528 - DNA, 16 bp, H. sapiens
acattattcacagaaa

SEQ ID NO: 26529 - DNA, 16 bp, H. sapiens
acattatttcattaaa

SEQ ID NO: 26530 - DNA, 16 bp, H. sapiens
acattattttgtatat

SEQ ID NO: 26531 - DNA, 16 bp, H. sapiens
acattatttttcaaaa

SEQ ID NO: 26532 - DNA, 16 bp, H. sapiens
acattcaaagcactgt

SEQ ID NO: 26533 - DNA, 16 bp, H. sapiens
acattcaaattctgga

SEQ ID NO: 26534 - DNA, 16 bp, H. sapiens
acattcaataaaattc

SEQ ID NO: 26535 - DNA, 16 bp, H. sapiens
acattcaatgccagcc

SEQ ID NO: 26536 - DNA, 16 bp, H. sapiens
acattcacaatgttgt

SEQ ID NO: 26537 - DNA, 16 bp, H. sapiens
acattcacaggtacca

SEQ ID NO: 26538 - DNA, 16 bp, H. sapiens
acattcacattgtttt

SEQ ID NO: 26539 - DNA, 16 bp, H. sapiens
acattcagaacccagc

SEQ ID NO: 26540 - DNA, 16 bp, H. sapiens
acattcagaatctgaa

SEQ ID NO: 26541 - DNA, 16 bp, H. sapiens
acattcagcagtttgg

SEQ ID NO: 26542 - DNA, 16 bp, H. sapiens
acattcatcctcagct

SEQ ID NO: 26543 - DNA, 16 bp, H. sapiens
acattcattcacttaa

SEQ ID NO: 26544 - DNA, 16 bp, H. sapiens
acattccacaggcatc

SEQ ID NO: 26545 - DNA, 16 bp, H. sapiens
acattccagaaaaggc

SEQ ID NO: 26546 - DNA, 16 bp, H. sapiens
acattcccaccaacag

SEQ ID NO: 26547 - DNA, 16 bp, H. sapiens
acattcccaccagcca

SEQ ID NO: 26548 - DNA, 16 bp, H. sapiens
acattcccaccatgga

SEQ ID NO: 26549 - DNA, 16 bp, H. sapiens
acattcctggaaacac

SEQ ID NO: 26550 - DNA, 16 bp, H. sapiens
acattcctttccattg

SEQ ID NO: 26551 - DNA, 16 bp, H. sapiens
acattccttttgatgg

SEQ ID NO: 26552 - DNA, 16 bp, H. sapiens
acattcgtgtacaagt

SEQ ID NO: 26553 - DNA, 16 bp, H. sapiens
acattctagaaaagac

SEQ ID NO: 26554 - DNA, 16 bp, H. sapiens
acattctagtggggaa

SEQ ID NO: 26555 - DNA, 16 bp, H. sapiens
acattctcacagacac

SEQ ID NO: 26556 - DNA, 16 bp, H. sapiens
acattctcctcagcac

SEQ ID NO: 26557 - DNA, 16 bp, H. sapiens
acattctgaaaaataa

SEQ ID NO: 26558 - DNA, 16 bp, H. sapiens
acattctgaattctat

SEQ ID NO: 26559 - DNA, 16 bp, H. sapiens
acattctgactggtgt

SEQ ID NO: 26560 - DNA, 16 bp, H. sapiens
acattctgctgattgg

SEQ ID NO: 26561 - DNA, 16 bp, H. sapiens
acattctgggaggcca

SEQ ID NO: 26562 - DNA, 16 bp, H. sapiens
acattctgtagagaat

SEQ ID NO: 26563 - DNA, 16 bp, H. sapiens
acattcttaaaagaaa

SEQ ID NO: 26564 - DNA, 16 bp, H. sapiens
acattcttaaagagaa

SEQ ID NO: 26565 - DNA, 16 bp, H. sapiens
acattcttaaaggaaa

SEQ ID NO: 26566 - DNA, 16 bp, H. sapiens
acattcttaaatattt

SEQ ID NO: 26567 - DNA, 16 bp, H. sapiens
acattcttaatgaaaa

SEQ ID NO: 26568 - DNA, 16 bp, H. sapiens
acattcttcaagaaaa

SEQ ID NO: 26569 - DNA, 16 bp, H. sapiens
acattcttcacagaat

SEQ ID NO: 26570 - DNA, 16 bp, H. sapiens
acattcttcccagaaa

SEQ ID NO: 26571 - DNA, 16 bp, H. sapiens
acattcttggctcact

SEQ ID NO: 26572 - DNA, 16 bp, H. sapiens
acattcttgtacatat

SEQ ID NO: 26573 - DNA, 16 bp, H. sapiens
acattctttcatatat

SEQ ID NO: 26574 - DNA, 16 bp, H. sapiens
acattcttttcctcag

SEQ ID NO: 26575 - DNA, 16 bp, H. sapiens
acattctttttctgtt

SEQ ID NO: 26576 - DNA, 16 bp, H. sapiens
acattcttttttaaaa

SEQ ID NO: 26577 - DNA, 16 bp, H. sapiens
acattgaaaaatatat

SEQ ID NO: 26578 - DNA, 16 bp, H. sapiens
acattgaaaataattt

SEQ ID NO: 26579 - DNA, 16 bp, H. sapiens
acattgaaaccacagc

SEQ ID NO: 26580 - DNA, 16 bp, H. sapiens
acattgaaagaagaat

SEQ ID NO: 26581 - DNA, 16 bp, H. sapiens
acattgaacatttttt

SEQ ID NO: 26582 - DNA, 16 bp, H. sapiens
acattgaatctgtaga

SEQ ID NO: 26583 - DNA, 16 bp, H. sapiens
acattgaatgtgaatg

SEQ ID NO: 26584 - DNA, 16 bp, H. sapiens
acattgacagaattga

SEQ ID NO: 26585 - DNA, 16 bp, H. sapiens
acattgacatttttaa

SEQ ID NO: 26586 - DNA, 16 bp, H. sapiens
acattgatgaaaaaaa

SEQ ID NO: 26587 - DNA, 16 bp, H. sapiens
acattgatgaaagaag

SEQ ID NO: 26588 - DNA, 16 bp, H. sapiens
acattgatgaagctgg

SEQ ID NO: 26589 - DNA, 16 bp, H. sapiens
acattgatgagagaaa

SEQ ID NO: 26590 - DNA, 16 bp, H. sapiens
acattgattttgtatt

SEQ ID NO: 26591 - DNA, 16 bp, H. sapiens
acattgatttttaaaa

SEQ ID NO: 26592 - DNA, 16 bp, H. sapiens
acattgatttttgtat

SEQ ID NO: 26593 - DNA, 19 bp, H. sapiens
acattgcacttcagcctgg

SEQ ID NO: 26594 - DNA, 16 bp, H. sapiens
acattgcatgcatgta

SEQ ID NO: 26595 - DNA, 16 bp, H. sapiens
acattgccaaggcaat

SEQ ID NO: 26596 - DNA, 16 bp, H. sapiens
acattgcttttctaga

SEQ ID NO: 26597 - DNA, 16 bp, H. sapiens
acattggaaaaaccct

SEQ ID NO: 26598 - DNA, 16 bp, H. sapiens
acattggaatcacctg

SEQ ID NO: 26599 - DNA, 16 bp, H. sapiens
acattggagcactcag

SEQ ID NO: 26600 - DNA, 16 bp, H. sapiens
acattggctcacacct

SEQ ID NO: 26601 - DNA, 16 bp, H. sapiens
acattgtaaatatgta

SEQ ID NO: 26602 - DNA, 16 bp, H. sapiens
acattgtaatatatat

SEQ ID NO: 26603 - DNA, 16 bp, H. sapiens
acattgtacaccttga

SEQ ID NO: 26604 - DNA, 16 bp, H. sapiens
acattgtataatgata

SEQ ID NO: 26605 - DNA, 16 bp, H. sapiens
acattgtattttattt

SEQ ID NO: 26606 - DNA, 16 bp, H. sapiens
acattgtcatcagatt

SEQ ID NO: 26607 - DNA, 16 bp, H. sapiens
acattgtctctacaaa

SEQ ID NO: 26608 - DNA, 16 bp, H. sapiens
acattgtctctttttt

SEQ ID NO: 26609 - DNA, 16 bp, H. sapiens
acattgtctttatttt

SEQ ID NO: 26610 - DNA, 16 bp, H. sapiens
acattgtgaaatggct

SEQ ID NO: 26611 - DNA, 16 bp, H. sapiens
acattgtgaagatttt

SEQ ID NO: 26612 - DNA, 16 bp, H. sapiens
acattgtgaattttat

SEQ ID NO: 26613 - DNA, 16 bp, H. sapiens
acattgttaaaataaa

SEQ ID NO: 26614 - DNA, 16 bp, H. sapiens
acattgttgcaaatga

SEQ ID NO: 26615 - DNA, 16 bp, H. sapiens
acattgtttagaattg

SEQ ID NO: 26616 - DNA, 16 bp, H. sapiens
acattgttttaaatat

SEQ ID NO: 26617 - DNA, 16 bp, H. sapiens
acattgttttcagaat

SEQ ID NO: 26618 - DNA, 16 bp, H. sapiens
acattgttttccaaag

SEQ ID NO: 26619 - DNA, 16 bp, H. sapiens
acattgttttcttaga

SEQ ID NO: 26620 - DNA, 16 bp, H. sapiens
acattgtttttgtaga

SEQ ID NO: 26621 - DNA, 16 bp, H. sapiens
acatttaaaaaatctt

SEQ ID NO: 26622 - DNA, 16 bp, H. sapiens
acatttaaaaaggaaa

SEQ ID NO: 26623 - DNA, 16 bp, H. sapiens
acatttaaaaatactt

SEQ ID NO: 26624 - DNA, 16 bp, H. sapiens
acatttaaaacatttg

SEQ ID NO: 26625 - DNA, 16 bp, H. sapiens
acatttaaaagtaatt

SEQ ID NO: 26626 - DNA, 16 bp, H. sapiens
acatttaaaatatgta

SEQ ID NO: 26627 - DNA, 16 bp, H. sapiens
acatttaaaatccact

SEQ ID NO: 26628 - DNA, 16 bp, H. sapiens
acatttaaaattactt

SEQ ID NO: 26629 - DNA, 16 bp, H. sapiens
acatttaaagaaatat

SEQ ID NO: 26630 - DNA, 16 bp, H. sapiens
acatttaaagaagaag

SEQ ID NO: 26631 - DNA, 16 bp, H. sapiens
acatttaaagaagtaa

SEQ ID NO: 26632 - DNA, 16 bp, H. sapiens
acatttaaagaataaa

SEQ ID NO: 26633 - DNA, 16 bp, H. sapiens
acatttaaagaattaa

SEQ ID NO: 26634 - DNA, 16 bp, H. sapiens
acatttaaatctttaa

SEQ ID NO: 26635 - DNA, 16 bp, H. sapiens
acatttaaattgtttt

SEQ ID NO: 26636 - DNA, 16 bp, H. sapiens
acatttaaattttcat

SEQ ID NO: 26637 - DNA, 16 bp, H. sapiens
acatttaacattctct

SEQ ID NO: 26638 - DNA, 16 bp, H. sapiens
acatttaagataatta

SEQ ID NO: 26639 - DNA, 16 bp, H. sapiens
acatttaagtatttaa

SEQ ID NO: 26640 - DNA, 16 bp, H. sapiens
acatttaagtcttaaa

SEQ ID NO: 26641 - DNA, 16 bp, H. sapiens
acatttaagtcttgaa

SEQ ID NO: 26642 - DNA, 16 bp, H. sapiens
acatttaattttcaaa

SEQ ID NO: 26643 - DNA, 16 bp, H. sapiens
acatttacaaccatct

SEQ ID NO: 26644 - DNA, 16 bp, H. sapiens
acatttacaagaaaaa

SEQ ID NO: 26645 - DNA, 16 bp, H. sapiens
acatttacataaaatt

SEQ ID NO: 26646 - DNA, 16 bp, H. sapiens
acatttacatatttaa

SEQ ID NO: 26647 - DNA, 16 bp, H. sapiens
acatttacattaaaat

SEQ ID NO: 26648 - DNA, 16 bp, H. sapiens
acatttaccaaaatag

SEQ ID NO: 26649 - DNA, 16 bp, H. sapiens
acatttaccctaaaac

SEQ ID NO: 26650 - DNA, 16 bp, H. sapiens
acatttacgcagccaa

SEQ ID NO: 26651 - DNA, 16 bp, H. sapiens
acatttagaaaatatt

SEQ ID NO: 26652 - DNA, 16 bp, H. sapiens
acatttagaattgtta

SEQ ID NO: 26653 - DNA, 16 bp, H. sapiens
acatttagattatttt

SEQ ID NO: 26654 - DNA, 16 bp, H. sapiens
acatttagattgtttc

SEQ ID NO: 26655 - DNA, 16 bp, H. sapiens
acatttagtacattca

SEQ ID NO: 26656 - DNA, 16 bp, H. sapiens
acatttagtccattta

SEQ ID NO: 26657 - DNA, 16 bp, H. sapiens
acatttagtttttaat

SEQ ID NO: 26658 - DNA, 16 bp, H. sapiens
acatttatagaatatt

SEQ ID NO: 26659 - DNA, 16 bp, H. sapiens
acatttatataacttt

SEQ ID NO: 26660 - DNA, 16 bp, H. sapiens
acatttatcatttgtg

SEQ ID NO: 26661 - DNA, 16 bp, H. sapiens
acatttatcttgcctt

SEQ ID NO: 26662 - DNA, 16 bp, H. sapiens
acatttatgcaggcaa

SEQ ID NO: 26663 - DNA, 16 bp, H. sapiens
acatttatggggcaca

SEQ ID NO: 26664 - DNA, 16 bp, H. sapiens
acatttatgttttaaa

SEQ ID NO: 26665 - DNA, 16 bp, H. sapiens
acatttatgttttctt

SEQ ID NO: 26666 - DNA, 16 bp, H. sapiens
acatttattaaatgtt

SEQ ID NO: 26667 - DNA, 16 bp, H. sapiens
acatttattaagcacc

SEQ ID NO: 26668 - DNA, 16 bp, H. sapiens
acatttattaagtacc

SEQ ID NO: 26669 - DNA, 16 bp, H. sapiens
acatttattaagtatc

SEQ ID NO: 26670 - DNA, 16 bp, H. sapiens
acatttattgagcacc

SEQ ID NO: 26671 - DNA, 16 bp, H. sapiens
acatttattgagctcc

SEQ ID NO: 26672 - DNA, 16 bp, H. sapiens
acatttatttgagaaa

SEQ ID NO: 26673 - DNA, 16 bp, H. sapiens
acatttattttaaaga

SEQ ID NO: 26674 - DNA, 16 bp, H. sapiens
acatttattttgcttt

SEQ ID NO: 26675 - DNA, 16 bp, H. sapiens
acatttattttgtatc

SEQ ID NO: 26676 - DNA, 16 bp, H. sapiens
acatttcaaaattaat

SEQ ID NO: 26677 - DNA, 16 bp, H. sapiens
acatttcaaatgttca

SEQ ID NO: 26678 - DNA, 16 bp, H. sapiens
acatttcaacatttca

SEQ ID NO: 26679 - DNA, 16 bp, H. sapiens
acatttcaagtgctca

SEQ ID NO: 26680 - DNA, 16 bp, H. sapiens
acatttcaagtgcttg

SEQ ID NO: 26681 - DNA, 16 bp, H. sapiens
acatttcaatccctgt

SEQ ID NO: 26682 - DNA, 16 bp, H. sapiens
acatttcacaaatatt

SEQ ID NO: 26683 - DNA, 16 bp, H. sapiens
acatttcacagatgag

SEQ ID NO: 26684 - DNA, 16 bp, H. sapiens
acatttcacatttcac

SEQ ID NO: 26685 - DNA, 16 bp, H. sapiens
acatttcacattttat

SEQ ID NO: 26686 - DNA, 16 bp, H. sapiens
acatttcagaagaaaa

SEQ ID NO: 26687 - DNA, 16 bp, H. sapiens
acatttcagaataaaa

SEQ ID NO: 26688 - DNA, 16 bp, H. sapiens
acatttcagagcccac

SEQ ID NO: 26689 - DNA, 16 bp, H. sapiens
acatttcatattgctc

SEQ ID NO: 26690 - DNA, 16 bp, H. sapiens
acatttcatcaatacc

SEQ ID NO: 26691 - DNA, 16 bp, H. sapiens
acatttcatctaattt

SEQ ID NO: 26692 - DNA, 16 bp, H. sapiens
acatttcatgatgaag

SEQ ID NO: 26693 - DNA, 16 bp, H. sapiens
acatttcattaaaaat

SEQ ID NO: 26694 - DNA, 16 bp, H. sapiens
acatttcatttcattt

SEQ ID NO: 26695 - DNA, 16 bp, H. sapiens
acatttccaaaaatat

SEQ ID NO: 26696 - DNA, 16 bp, H. sapiens
acatttccatataaat

SEQ ID NO: 26697 - DNA, 16 bp, H. sapiens
acatttccatcatccc

SEQ ID NO: 26698 - DNA, 16 bp, H. sapiens
acatttccattggaaa

SEQ ID NO: 26699 - DNA, 16 bp, H. sapiens
acatttcccagaatcc

SEQ ID NO: 26700 - DNA, 16 bp, H. sapiens
acatttccccattcag

SEQ ID NO: 26701 - DNA, 16 bp, H. sapiens
acatttcccctctgca

SEQ ID NO: 26702 - DNA, 16 bp, H. sapiens
acatttcccttctgca

SEQ ID NO: 26703 - DNA, 16 bp, H. sapiens
acatttctaaagaaaa

SEQ ID NO: 26704 - DNA, 16 bp, H. sapiens
acatttctattgtttt

SEQ ID NO: 26705 - DNA, 16 bp, H. sapiens
acatttctctctctct

SEQ ID NO: 26706 - DNA, 16 bp, H. sapiens
acatttctctgaagaa

SEQ ID NO: 26707 - DNA, 16 bp, H. sapiens
acatttctgcaagcag

SEQ ID NO: 26708 - DNA, 16 bp, H. sapiens
acatttctgcagccaa

SEQ ID NO: 26709 - DNA, 16 bp, H. sapiens
acatttcttcaaggaa

SEQ ID NO: 26710 - DNA, 16 bp, H. sapiens
acatttcttccttcat

SEQ ID NO: 26711 - DNA, 16 bp, H. sapiens
acatttcttctctgct

SEQ ID NO: 26712 - DNA, 16 bp, H. sapiens
acatttctttacattt

SEQ ID NO: 26713 - DNA, 16 bp, H. sapiens
acatttctttgaattt

SEQ ID NO: 26714 - DNA, 16 bp, H. sapiens
acatttgaaaaacata

SEQ ID NO: 26715 - DNA, 16 bp, H. sapiens
acatttgaaaataaat

SEQ ID NO: 26716 - DNA, 16 bp, H. sapiens
acatttgaaaatattt

SEQ ID NO: 26717 - DNA, 16 bp, H. sapiens
acatttgaaaattaat

SEQ ID NO: 26718 - DNA, 16 bp, H. sapiens
acatttgaaagaaaat

SEQ ID NO: 26719 - DNA, 16 bp, H. sapiens
acatttgaaataaaaa

SEQ ID NO: 26720 - DNA, 16 bp, H. sapiens
acatttgaaatattgc

SEQ ID NO: 26721 - DNA, 16 bp, H. sapiens
acatttgaaattattt

SEQ ID NO: 26722 - DNA, 16 bp, H. sapiens
acatttgaagaaaaat

SEQ ID NO: 26723 - DNA, 16 bp, H. sapiens
acatttgaagagataa

SEQ ID NO: 26724 - DNA, 16 bp, H. sapiens
acatttgaattcattt

SEQ ID NO: 26725 - DNA, 16 bp, H. sapiens
acatttgaattgtttc

SEQ ID NO: 26726 - DNA, 16 bp, H. sapiens
acatttgaattttata

SEQ ID NO: 26727 - DNA, 16 bp, H. sapiens
acatttgacaatgtct

SEQ ID NO: 26728 - DNA, 16 bp, H. sapiens
acatttgataaataaa

SEQ ID NO: 26729 - DNA, 16 bp, H. sapiens
acatttgataaatgtt

SEQ ID NO: 26730 - DNA, 16 bp, H. sapiens
acatttgatttctttt

SEQ ID NO: 26731 - DNA, 16 bp, H. sapiens
acatttgcatatatat

SEQ ID NO: 26732 - DNA, 16 bp, H. sapiens
acatttgcattgtttt

SEQ ID NO: 26733 - DNA, 16 bp, H. sapiens
acatttgcatttttat

SEQ ID NO: 26734 - DNA, 16 bp, H. sapiens
acatttgctaacttgc

SEQ ID NO: 26735 - DNA, 16 bp, H. sapiens
acatttgcttattttt

SEQ ID NO: 26736 - DNA, 16 bp, H. sapiens
acatttgcttttaaaa

SEQ ID NO: 26737 - DNA, 16 bp, H. sapiens
acatttgctttttttc

SEQ ID NO: 26738 - DNA, 16 bp, H. sapiens
acatttggcaatgtct

SEQ ID NO: 26739 - DNA, 16 bp, H. sapiens
acatttggctcctctt

SEQ ID NO: 26740 - DNA, 16 bp, H. sapiens
acatttggctgggcac

SEQ ID NO: 26741 - DNA, 16 bp, H. sapiens
acatttgggaaaaaaa

SEQ ID NO: 26742 - DNA, 16 bp, H. sapiens
acatttgggttatttc

SEQ ID NO: 26743 - DNA, 16 bp, H. sapiens
acatttgggttgtttt

SEQ ID NO: 26744 - DNA, 16 bp, H. sapiens
acatttggtctctgcc

SEQ ID NO: 26745 - DNA, 16 bp, H. sapiens
acatttgtaaatgttt

SEQ ID NO: 26746 - DNA, 16 bp, H. sapiens
acatttgtaatttatt

SEQ ID NO: 26747 - DNA, 16 bp, H. sapiens
acatttgtatacaaat

SEQ ID NO: 26748 - DNA, 16 bp, H. sapiens
acatttgtatgtgtgt

SEQ ID NO: 26749 - DNA, 16 bp, H. sapiens
acatttgtattatttt

SEQ ID NO: 26750 - DNA, 16 bp, H. sapiens
acatttgtccaaactc

SEQ ID NO: 26751 - DNA, 16 bp, H. sapiens
acatttgtccattttt

SEQ ID NO: 26752 - DNA, 16 bp, H. sapiens
acatttgtgaataaaa

SEQ ID NO: 26753 - DNA, 16 bp, H. sapiens
acatttgtgaattttc

SEQ ID NO: 26754 - DNA, 16 bp, H. sapiens
acatttgtggtaattt

SEQ ID NO: 26755 - DNA, 16 bp, H. sapiens
acatttgtgtgcagat

SEQ ID NO: 26756 - DNA, 16 bp, H. sapiens
acatttgtgttatttt

SEQ ID NO: 26757 - DNA, 16 bp, H. sapiens
acatttgttaaatgaa

SEQ ID NO: 26758 - DNA, 16 bp, H. sapiens
acatttgttaatatca

SEQ ID NO: 26759 - DNA, 16 bp, H. sapiens
acatttgttatttctt

SEQ ID NO: 26760 - DNA, 16 bp, H. sapiens
acatttgttgaaataa

SEQ ID NO: 26761 - DNA, 16 bp, H. sapiens
acatttgttgaataaa

SEQ ID NO: 26762 - DNA, 16 bp, H. sapiens
acatttgtttaatatt

SEQ ID NO: 26763 - DNA, 16 bp, H. sapiens
acatttgtttgtttgt

SEQ ID NO: 26764 - DNA, 16 bp, H. sapiens
acatttgttttaaaaa

SEQ ID NO: 26765 - DNA, 16 bp, H. sapiens
acatttgttttcaaaa

SEQ ID NO: 26766 - DNA, 16 bp, H. sapiens
acattttaaaaaatct

SEQ ID NO: 26767 - DNA, 16 bp, H. sapiens
acattttaaaaactga

SEQ ID NO: 26768 - DNA, 16 bp, H. sapiens
acattttaaaaaggaa

SEQ ID NO: 26769 - DNA, 16 bp, H. sapiens
acattttaaaaatctg

SEQ ID NO: 26770 - DNA, 16 bp, H. sapiens
acattttaaaacttgc

SEQ ID NO: 26771 - DNA, 16 bp, H. sapiens
acattttaaaagatgt

SEQ ID NO: 26772 - DNA, 16 bp, H. sapiens
acattttaaaataact

SEQ ID NO: 26773 - DNA, 16 bp, H. sapiens
acattttaaaatagaa

SEQ ID NO: 26774 - DNA, 16 bp, H. sapiens
acattttaaaatatca

SEQ ID NO: 26775 - DNA, 16 bp, H. sapiens
acattttaaaatattg

SEQ ID NO: 26776 - DNA, 16 bp, H. sapiens
acattttaaacaaatg

SEQ ID NO: 26777 - DNA, 16 bp, H. sapiens
acattttaaacacatt

SEQ ID NO: 26778 - DNA, 16 bp, H. sapiens
acattttaaagtattt

SEQ ID NO: 26779 - DNA, 16 bp, H. sapiens
acattttaaataacat

SEQ ID NO: 26780 - DNA, 16 bp, H. sapiens
acattttaaatggatg

SEQ ID NO: 26781 - DNA, 16 bp, H. sapiens
acattttaacagtttt

SEQ ID NO: 26782 - DNA, 16 bp, H. sapiens
acattttaactttaaa

SEQ ID NO: 26783 - DNA, 16 bp, H. sapiens
acattttaagatattt

SEQ ID NO: 26784 - DNA, 16 bp, H. sapiens
acattttaagattttt

SEQ ID NO: 26785 - DNA, 16 bp, H. sapiens
acattttaagcaaaaa

SEQ ID NO: 26786 - DNA, 16 bp, H. sapiens
acattttaagcatttt

SEQ ID NO: 26787 - DNA, 16 bp, H. sapiens
acattttaaggaaaaa

SEQ ID NO: 26788 - DNA, 16 bp, H. sapiens
acattttaaggtattt

SEQ ID NO: 26789 - DNA, 16 bp, H. sapiens
acattttaaggttttt

SEQ ID NO: 26790 - DNA, 16 bp, H. sapiens
acattttaataaactt

SEQ ID NO: 26791 - DNA, 16 bp, H. sapiens
acattttaatggaaat

SEQ ID NO: 26792 - DNA, 16 bp, H. sapiens
acattttaatttacat

SEQ ID NO: 26793 - DNA, 16 bp, H. sapiens
acattttaattttaga

SEQ ID NO: 26794 - DNA, 16 bp, H. sapiens
acattttaattttcct

SEQ ID NO: 26795 - DNA, 16 bp, H. sapiens
acattttaattttgtt

SEQ ID NO: 26796 - DNA, 16 bp, H. sapiens
acattttacatttcta

SEQ ID NO: 26797 - DNA, 16 bp, H. sapiens
acattttacattttca

SEQ ID NO: 26798 - DNA, 16 bp, H. sapiens
acattttacctataaa

SEQ ID NO: 26799 - DNA, 16 bp, H. sapiens
acattttactgtattt

SEQ ID NO: 26800 - DNA, 16 bp, H. sapiens
acattttagaaacatt

SEQ ID NO: 26801 - DNA, 16 bp, H. sapiens
acattttagaaagtaa

SEQ ID NO: 26802 - DNA, 16 bp, H. sapiens
acattttagaaatgct

SEQ ID NO: 26803 - DNA, 16 bp, H. sapiens
acattttagataaaat

SEQ ID NO: 26804 - DNA, 16 bp, H. sapiens
acattttagttcttaa

SEQ ID NO: 26805 - DNA, 16 bp, H. sapiens
acattttataaactat

SEQ ID NO: 26806 - DNA, 16 bp, H. sapiens
acattttataatgttt

SEQ ID NO: 26807 - DNA, 16 bp, H. sapiens
acattttatacaattt

SEQ ID NO: 26808 - DNA, 16 bp, H. sapiens
acattttatagattta

SEQ ID NO: 26809 - DNA, 16 bp, H. sapiens
acattttatagtttta

SEQ ID NO: 26810 - DNA, 16 bp, H. sapiens
acattttattatacat

SEQ ID NO: 26811 - DNA, 16 bp, H. sapiens
acattttatttaagaa

SEQ ID NO: 26812 - DNA, 16 bp, H. sapiens
acattttatttcaaaa

SEQ ID NO: 26813 - DNA, 16 bp, H. sapiens
acattttatttcaaag

SEQ ID NO: 26814 - DNA, 16 bp, H. sapiens
acattttatttcttca

SEQ ID NO: 26815 - DNA, 16 bp, H. sapiens
acattttatttttgag

SEQ ID NO: 26816 - DNA, 16 bp, H. sapiens
acattttcaaaattat

SEQ ID NO: 26817 - DNA, 16 bp, H. sapiens
acattttcaaagaaat

SEQ ID NO: 26818 - DNA, 16 bp, H. sapiens
acattttcaaatgttt

SEQ ID NO: 26819 - DNA, 16 bp, H. sapiens
acattttcacatttct

SEQ ID NO: 26820 - DNA, 16 bp, H. sapiens
acattttcacattttt

SEQ ID NO: 26821 - DNA, 16 bp, H. sapiens
acattttcacttttta

SEQ ID NO: 26822 - DNA, 16 bp, H. sapiens
acattttcagaaaaaa

SEQ ID NO: 26823 - DNA, 16 bp, H. sapiens
acattttcagaaataa

SEQ ID NO: 26824 - DNA, 16 bp, H. sapiens
acattttcataaaata

SEQ ID NO: 26825 - DNA, 16 bp, H. sapiens
acattttcatatgctt

SEQ ID NO: 26826 - DNA, 16 bp, H. sapiens
acattttcatcacccc

SEQ ID NO: 26827 - DNA, 16 bp, H. sapiens
acattttcatcaccct

SEQ ID NO: 26828 - DNA, 16 bp, H. sapiens
acattttcatcagccc

SEQ ID NO: 26829 - DNA, 16 bp, H. sapiens
acattttcatgatatt

SEQ ID NO: 26830 - DNA, 16 bp, H. sapiens
acattttcatgtaaaa

SEQ ID NO: 26831 - DNA, 16 bp, H. sapiens
acattttcatttcatt

SEQ ID NO: 26832 - DNA, 16 bp, H. sapiens
acattttccaaaatgt

SEQ ID NO: 26833 - DNA, 16 bp, H. sapiens
acattttcccaaagaa

SEQ ID NO: 26834 - DNA, 16 bp, H. sapiens
acattttcccctttgt

SEQ ID NO: 26835 - DNA, 16 bp, H. sapiens
acattttcctgttttt

SEQ ID NO: 26836 - DNA, 16 bp, H. sapiens
acattttctaaatttc

SEQ ID NO: 26837 - DNA, 16 bp, H. sapiens
acattttctacaatga

SEQ ID NO: 26838 - DNA, 16 bp, H. sapiens
acattttctctttgtt

SEQ ID NO: 26839 - DNA, 16 bp, H. sapiens
acattttcttaatcct

SEQ ID NO: 26840 - DNA, 16 bp, H. sapiens
acattttcttcattca

SEQ ID NO: 26841 - DNA, 16 bp, H. sapiens
acattttcttctgttt

SEQ ID NO: 26842 - DNA, 16 bp, H. sapiens
acattttcttgaaaat

SEQ ID NO: 26843 - DNA, 16 bp, H. sapiens
acattttctttatcca

SEQ ID NO: 26844 - DNA, 16 bp, H. sapiens
acattttctttctcta

SEQ ID NO: 26845 - DNA, 16 bp, H. sapiens
acattttgaaaggaat

SEQ ID NO: 26846 - DNA, 16 bp, H. sapiens
acattttgaagaaata

SEQ ID NO: 26847 - DNA, 16 bp, H. sapiens
acattttgagccagat

SEQ ID NO: 26848 - DNA, 16 bp, H. sapiens
acattttgatgagttt

SEQ ID NO: 26849 - DNA, 16 bp, H. sapiens
acattttgattttatt

SEQ ID NO: 26850 - DNA, 16 bp, H. sapiens
acattttgcacatgta

SEQ ID NO: 26851 - DNA, 16 bp, H. sapiens
acattttgcttatcca

SEQ ID NO: 26852 - DNA, 16 bp, H. sapiens
acattttgcttatctg

SEQ ID NO: 26853 - DNA, 16 bp, H. sapiens
acattttggaaaagac

SEQ ID NO: 26854 - DNA, 16 bp, H. sapiens
acattttggaaggctg

SEQ ID NO: 26855 - DNA, 16 bp, H. sapiens
acattttggcatgttt

SEQ ID NO: 26856 - DNA, 16 bp, H. sapiens
acattttggtatgttg

SEQ ID NO: 26857 - DNA, 16 bp, H. sapiens
acattttggtatgttt

SEQ ID NO: 26858 - DNA, 16 bp, H. sapiens
acattttggtcaatga

SEQ ID NO: 26859 - DNA, 16 bp, H. sapiens
acattttggtcatttt

SEQ ID NO: 26860 - DNA, 16 bp, H. sapiens
acattttggtgaattt

SEQ ID NO: 26861 - DNA, 16 bp, H. sapiens
acattttgtgtttctt

SEQ ID NO: 26862 - DNA, 16 bp, H. sapiens
acattttgttaaatat

SEQ ID NO: 26863 - DNA, 16 bp, H. sapiens
acattttgttaaatga

SEQ ID NO: 26864 - DNA, 16 bp, H. sapiens
acattttgttgatttt

SEQ ID NO: 26865 - DNA, 16 bp, H. sapiens
acattttgtttaaaaa

SEQ ID NO: 26866 - DNA, 16 bp, H. sapiens
acattttgttttaaaa

SEQ ID NO: 26867 - DNA, 16 bp, H. sapiens
acattttgttttaatt

SEQ ID NO: 26868 - DNA, 16 bp, H. sapiens
acatttttaaaaagaa

SEQ ID NO: 26869 - DNA, 16 bp, H. sapiens
acatttttaaaaatca

SEQ ID NO: 26870 - DNA, 16 bp, H. sapiens
acatttttaaaaggaa

SEQ ID NO: 26871 - DNA, 16 bp, H. sapiens
acatttttaaaatgct

SEQ ID NO: 26872 - DNA, 16 bp, H. sapiens
acatttttaaagcttt

SEQ ID NO: 26873 - DNA, 16 bp, H. sapiens
acatttttaaagggtt

SEQ ID NO: 26874 - DNA, 16 bp, H. sapiens
acatttttaaagtttt

SEQ ID NO: 26875 - DNA, 16 bp, H. sapiens
acatttttaaatagag

SEQ ID NO: 26876 - DNA, 16 bp, H. sapiens
acatttttaaatggat

SEQ ID NO: 26877 - DNA, 16 bp, H. sapiens
acatttttaaatgtga

SEQ ID NO: 26878 - DNA, 16 bp, H. sapiens
acatttttaaattgtt

SEQ ID NO: 26879 - DNA, 16 bp, H. sapiens
acatttttaacaaaat

SEQ ID NO: 26880 - DNA, 16 bp, H. sapiens
acatttttacactgct

SEQ ID NO: 26881 - DNA, 16 bp, H. sapiens
acatttttacatatat

SEQ ID NO: 26882 - DNA, 16 bp, H. sapiens
acatttttataaagta

SEQ ID NO: 26883 - DNA, 16 bp, H. sapiens
acatttttatatatgt

SEQ ID NO: 26884 - DNA, 16 bp, H. sapiens
acatttttatatcaaa

SEQ ID NO: 26885 - DNA, 16 bp, H. sapiens
acatttttatccattc

SEQ ID NO: 26886 - DNA, 16 bp, H. sapiens
acatttttatgaaaaa

SEQ ID NO: 26887 - DNA, 16 bp, H. sapiens
acatttttatgattat

SEQ ID NO: 26888 - DNA, 16 bp, H. sapiens
acatttttatttgtaa

SEQ ID NO: 26889 - DNA, 16 bp, H. sapiens
acatttttctcacttt

SEQ ID NO: 26890 - DNA, 16 bp, H. sapiens
acatttttctcagtgc

SEQ ID NO: 26891 - DNA, 16 bp, H. sapiens
acatttttctcctcag

SEQ ID NO: 26892 - DNA, 16 bp, H. sapiens
acatttttctttgcat

SEQ ID NO: 26893 - DNA, 16 bp, H. sapiens
acatttttgaaatgaa

SEQ ID NO: 26894 - DNA, 16 bp, H. sapiens
acatttttgaagaaaa

SEQ ID NO: 26895 - DNA, 16 bp, H. sapiens
acatttttgaagatta

SEQ ID NO: 26896 - DNA, 16 bp, H. sapiens
acatttttgcaaatct

SEQ ID NO: 26897 - DNA, 16 bp, H. sapiens
acatttttgccttcat

SEQ ID NO: 26898 - DNA, 16 bp, H. sapiens
acatttttggttttca

SEQ ID NO: 26899 - DNA, 16 bp, H. sapiens
acatttttgtctttat

SEQ ID NO: 26900 - DNA, 16 bp, H. sapiens
acatttttgtggtttt

SEQ ID NO: 26901 - DNA, 16 bp, H. sapiens
acatttttgtgtatat

SEQ ID NO: 26902 - DNA, 16 bp, H. sapiens
acatttttgttaacta

SEQ ID NO: 26903 - DNA, 16 bp, H. sapiens
acatttttgttccttt

SEQ ID NO: 26904 - DNA, 16 bp, H. sapiens
acattttttaaagcta

SEQ ID NO: 26905 - DNA, 16 bp, H. sapiens
acattttttaaagtgt

SEQ ID NO: 26906 - DNA, 16 bp, H. sapiens
acattttttaaagttc

SEQ ID NO: 26907 - DNA, 16 bp, H. sapiens
acattttttaatagtt

SEQ ID NO: 26908 - DNA, 16 bp, H. sapiens
acattttttagcaata

SEQ ID NO: 26909 - DNA, 16 bp, H. sapiens
acattttttattgtgg

SEQ ID NO: 26910 - DNA, 16 bp, H. sapiens
acattttttattttga

SEQ ID NO: 26911 - DNA, 16 bp, H. sapiens
acattttttcaacttt

SEQ ID NO: 26912 - DNA, 16 bp, H. sapiens
acattttttccttcat

SEQ ID NO: 26913 - DNA, 16 bp, H. sapiens
acattttttctaataa

SEQ ID NO: 26914 - DNA, 16 bp, H. sapiens
acattttttgaaagaa

SEQ ID NO: 26915 - DNA, 16 bp, H. sapiens
acattttttgagacag

SEQ ID NO: 26916 - DNA, 16 bp, H. sapiens
acattttttgtgtgtg

SEQ ID NO: 26917 - DNA, 16 bp, H. sapiens
acatttttttaaagaa

SEQ ID NO: 26918 - DNA, 16 bp, H. sapiens
acatttttttcagcat

SEQ ID NO: 26919 - DNA, 16 bp, H. sapiens
acatttttttcccagt

SEQ ID NO: 26920 - DNA, 16 bp, H. sapiens
acatttttttctcact

SEQ ID NO: 26921 - DNA, 16 bp, H. sapiens
acattttttttcaagt

SEQ ID NO: 26922 - DNA, 16 bp, H. sapiens
accaaaaaagaccctg

SEQ ID NO: 26923 - DNA, 16 bp, H. sapiens
accaaaaaatagccca

SEQ ID NO: 26924 - DNA, 16 bp, H. sapiens
accaaaaaatgtttta

SEQ ID NO: 26925 - DNA, 16 bp, H. sapiens
accaaaaatttattag

SEQ ID NO: 26926 - DNA, 16 bp, H. sapiens
accaaaacagaacctc

SEQ ID NO: 26927 - DNA, 16 bp, H. sapiens
accaaaacagatgtat

SEQ ID NO: 26928 - DNA, 16 bp, H. sapiens
accaaaaccaagatgg

SEQ ID NO: 26929 - DNA, 16 bp, H. sapiens
accaaaaccagaaaat

SEQ ID NO: 26930 - DNA, 16 bp, H. sapiens
accaaaacttatggga

SEQ ID NO: 26931 - DNA, 16 bp, H. sapiens
accaaaagaagtccag

SEQ ID NO: 26932 - DNA, 16 bp, H. sapiens
accaaaagcaagcagg

SEQ ID NO: 26933 - DNA, 16 bp, H. sapiens
accaaaagcaatggga

SEQ ID NO: 26934 - DNA, 16 bp, H. sapiens
accaaaagccacttgt

SEQ ID NO: 26935 - DNA, 16 bp, H. sapiens
accaaaaggaaatgaa

SEQ ID NO: 26936 - DNA, 16 bp, H. sapiens
accaaaagtaatggca

SEQ ID NO: 26937 - DNA, 16 bp, H. sapiens
accaaaatatcagaaa

SEQ ID NO: 26938 - DNA, 16 bp, H. sapiens
accaaaatctgtgcat

SEQ ID NO: 26939 - DNA, 16 bp, H. sapiens
accaaaatgctgataa

SEQ ID NO: 26940 - DNA, 16 bp, H. sapiens
accaaaatgtgaaccc

SEQ ID NO: 26941 - DNA, 16 bp, H. sapiens
accaaaatgtggcaca

SEQ ID NO: 26942 - DNA, 16 bp, H. sapiens
accaaaatgttcatca

SEQ ID NO: 26943 - DNA, 16 bp, H. sapiens
accaaaattattttaa

SEQ ID NO: 26944 - DNA, 16 bp, H. sapiens
accaaacaccagatgt

SEQ ID NO: 26945 - DNA, 16 bp, H. sapiens
accaaacagatgaggg

SEQ ID NO: 26946 - DNA, 18 bp, H. sapiens
accaaacaggctttgtgt

SEQ ID NO: 26947 - DNA, 16 bp, H. sapiens
accaaacagttagcca

SEQ ID NO: 26948 - DNA, 16 bp, H. sapiens
accaaacctggctaat

SEQ ID NO: 26949 - DNA, 16 bp, H. sapiens
accaaactaaaatgga

SEQ ID NO: 26950 - DNA, 16 bp, H. sapiens
accaaagaggatatat

SEQ ID NO: 26951 - DNA, 16 bp, H. sapiens
accaaagataaagaga

SEQ ID NO: 26952 - DNA, 16 bp, H. sapiens
accaaagccaagcacc

SEQ ID NO: 26953 - DNA, 16 bp, H. sapiens
accaaaggaagataaa

SEQ ID NO: 26954 - DNA, 16 bp, H. sapiens
accaaaggcaaagaga

SEQ ID NO: 26955 - DNA, 16 bp, H. sapiens
accaaagtctggcaga

SEQ ID NO: 26956 - DNA, 18 bp, H. sapiens
accaaagtgctgggatta

SEQ ID NO: 26957 - DNA, 17 bp, H. sapiens
accaaagttctgggatt

SEQ ID NO: 26958 - DNA, 16 bp, H. sapiens
accaaataaaagcctt

SEQ ID NO: 26959 - DNA, 16 bp, H. sapiens
accaaatagttatttt

SEQ ID NO: 26960 - DNA, 16 bp, H. sapiens
accaaatatgtatttc

SEQ ID NO: 26961 - DNA, 16 bp, H. sapiens
accaaatattcaaatt

SEQ ID NO: 26962 - DNA, 30 bp, H. sapiens
accaaatcatgagtgaactcccattcacaa

SEQ ID NO: 26963 - DNA, 16 bp, H. sapiens
accaaatgctggtgag

SEQ ID NO: 26964 - DNA, 16 bp, H. sapiens
accaaatgggagaaaa

SEQ ID NO: 26965 - DNA, 17 bp, H. sapiens
accaacaaagggaagcc

SEQ ID NO: 26966 - DNA, 16 bp, H. sapiens
accaacacacccagct

SEQ ID NO: 26967 - DNA, 16 bp, H. sapiens
accaacacagatacat

SEQ ID NO: 26968 - DNA, 17 bp, H. sapiens
accaacagccaatatca

SEQ ID NO: 26969 - DNA, 16 bp, H. sapiens
accaacagcttgcact

SEQ ID NO: 26970 - DNA, 16 bp, H. sapiens
accaacagtgcacaag

SEQ ID NO: 26971 - DNA, 16 bp, H. sapiens
accaacagtgtgcaag

SEQ ID NO: 26972 - DNA, 16 bp, H. sapiens
accaacatagcacatg

SEQ ID NO: 26973 - DNA, 16 bp, H. sapiens
accaacatccttgatg

SEQ ID NO: 26974 - DNA, 17 bp, H. sapiens
accaacatggcccatgt

SEQ ID NO: 26975 - DNA, 16 bp, H. sapiens
accaacattcaaattc

SEQ ID NO: 26976 - DNA, 16 bp, H. sapiens
accaacatttaaagaa

SEQ ID NO: 26977 - DNA, 16 bp, H. sapiens
accaaccatcagagaa

SEQ ID NO: 26978 - DNA, 16 bp, H. sapiens
accaacccagatgccc

SEQ ID NO: 26979 - DNA, 17 bp, H. sapiens
accaacccagatgtcca

SEQ ID NO: 26980 - DNA, 16 bp, H. sapiens
accaaccctgctgaca

SEQ ID NO: 26981 - DNA, 16 bp, H. sapiens
accaacctaggcaaca

SEQ ID NO: 26982 - DNA, 16 bp, H. sapiens
accaacctctccccat

SEQ ID NO: 26983 - DNA, 16 bp, H. sapiens
accaacctgaacaaca

SEQ ID NO: 26984 - DNA, 16 bp, H. sapiens
accaacctgacaaaaa

SEQ ID NO: 26985 - DNA, 16 bp, H. sapiens
accaacctgagcaaca

SEQ ID NO: 26986 - DNA, 16 bp, H. sapiens
accaacctggccaaca

SEQ ID NO: 26987 - DNA, 16 bp, H. sapiens
accaacctggccaacc

SEQ ID NO: 26988 - DNA, 16 bp, H. sapiens
accaacctggccatca

SEQ ID NO: 26989 - DNA, 16 bp, H. sapiens
accaacctggccgaca

SEQ ID NO: 26990 - DNA, 16 bp, H. sapiens
accaacctgggcaata

SEQ ID NO: 26991 - DNA, 16 bp, H. sapiens
accaacctgggcgaca

SEQ ID NO: 26992 - DNA, 16 bp, H. sapiens
accaactaccacttct

SEQ ID NO: 26993 - DNA, 16 bp, H. sapiens
accaactgatgaatgg

SEQ ID NO: 26994 - DNA, 16 bp, H. sapiens
accaactgtgtgacct

SEQ ID NO: 26995 - DNA, 16 bp, H. sapiens
accaacttgccagcca

SEQ ID NO: 26996 - DNA, 16 bp, H. sapiens
accaacttttggcttt

SEQ ID NO: 26997 - DNA, 16 bp, H. sapiens
accaactttttgtttc

SEQ ID NO: 26998 - DNA, 16 bp, H. sapiens
accaagaaccaggaaa

SEQ ID NO: 26999 - DNA, 16 bp, H. sapiens
accaagaacccagaag

SEQ ID NO: 27000 - DNA, 16 bp, H. sapiens
accaagaacctaaaag

SEQ ID NO: 27001 - DNA, 16 bp, H. sapiens
accaagaagaaatcca

SEQ ID NO: 27002 - DNA, 16 bp, H. sapiens
accaagaagtttctga

SEQ ID NO: 27003 - DNA, 16 bp, H. sapiens
accaagaccccatctc

SEQ ID NO: 27004 - DNA, 16 bp, H. sapiens
accaagagcaaaactc

SEQ ID NO: 27005 - DNA, 16 bp, H. sapiens
accaagaggaataagg

SEQ ID NO: 27006 - DNA, 16 bp, H. sapiens
accaagatgtccttta

SEQ ID NO: 27007 - DNA, 16 bp, H. sapiens
accaagatgtttttca

SEQ ID NO: 27008 - DNA, 16 bp, H. sapiens
accaagcaaatagaaa

SEQ ID NO: 27009 - DNA, 16 bp, H. sapiens
accaagcaaattgaaa

SEQ ID NO: 27010 - DNA, 16 bp, H. sapiens
accaagcagaagaaag

SEQ ID NO: 27011 - DNA, 16 bp, H. sapiens
accaagcatgagccaa

SEQ ID NO: 27012 - DNA, 16 bp, H. sapiens
accaagcccagccaag

SEQ ID NO: 27013 - DNA, 16 bp, H. sapiens
accaagcccagcctga

SEQ ID NO: 27014 - DNA, 18 bp, H. sapiens
accaagcccggctaattt

SEQ ID NO: 27015 - DNA, 16 bp, H. sapiens
accaagcctggccaat

SEQ ID NO: 27016 - DNA, 16 bp, H. sapiens
accaagctcagcctcc

SEQ ID NO: 27017 - DNA, 16 bp, H. sapiens
accaagcttgagtgtc

SEQ ID NO: 27018 - DNA, 16 bp, H. sapiens
accaaggaaatagaaa

SEQ ID NO: 27019 - DNA, 16 bp, H. sapiens
accaaggaaatcacag

SEQ ID NO: 27020 - DNA, 16 bp, H. sapiens
accaaggaaatgaaag

SEQ ID NO: 27021 - DNA, 16 bp, H. sapiens
accaaggaagtgaaag

SEQ ID NO: 27022 - DNA, 16 bp, H. sapiens
accaaggaggcggagg

SEQ ID NO: 27023 - DNA, 16 bp, H. sapiens
accaaggaggctgagg

SEQ ID NO: 27024 - DNA, 16 bp, H. sapiens
accaaggcaccagcag

SEQ ID NO: 27025 - DNA, 18 bp, H. sapiens
accaaggcgggcggatca

SEQ ID NO: 27026 - DNA, 17 bp, H. sapiens
accaagggagctaacca

SEQ ID NO: 27027 - DNA, 16 bp, H. sapiens
accaagggggatggtg

SEQ ID NO: 27028 - DNA, 16 bp, H. sapiens
accaagtagctgggac

SEQ ID NO: 27029 - DNA, 16 bp, H. sapiens
accaagtctttttttt

SEQ ID NO: 27030 - DNA, 16 bp, H. sapiens
accaagtgctgatgag

SEQ ID NO: 27031 - DNA, 16 bp, H. sapiens
accaagtggaatttat

SEQ ID NO: 27032 - DNA, 16 bp, H. sapiens
accaagtgttgtgttt

SEQ ID NO: 27033 - DNA, 17 bp, H. sapiens
accaagttgtagaagga

SEQ ID NO: 27034 - DNA, 16 bp, H. sapiens
accaagtttcagatgt

SEQ ID NO: 27035 - DNA, 16 bp, H. sapiens
accaatagtatacaag

SEQ ID NO: 27036 - DNA, 22 bp, H. sapiens
accaatattcaacattcttaaa

SEQ ID NO: 27037 - DNA, 16 bp, H. sapiens
accaatcagacacaga

SEQ ID NO: 27038 - DNA, 17 bp, H. sapiens
accaatcagcactctgt

SEQ ID NO: 27039 - DNA, 17 bp, H. sapiens
accaatcagcaggatgt

SEQ ID NO: 27040 - DNA, 17 bp, H. sapiens
accaatcagcgctctgt

SEQ ID NO: 27041 - DNA, 16 bp, H. sapiens
accaatcagtgtgctg

SEQ ID NO: 27042 - DNA, 16 bp, H. sapiens
accaatcagtgttctg

SEQ ID NO: 27043 - DNA, 16 bp, H. sapiens
accaatcatcagagaa

SEQ ID NO: 27044 - DNA, 16 bp, H. sapiens
accaatctgcactctg

SEQ ID NO: 27045 - DNA, 16 bp, H. sapiens
accaatctgggcaaca

SEQ ID NO: 27046 - DNA, 16 bp, H. sapiens
accaatgaaagaaatt

SEQ ID NO: 27047 - DNA, 16 bp, H. sapiens
accaatgcagcagcag

SEQ ID NO: 27048 - DNA, 16 bp, H. sapiens
accaatgctggctgca

SEQ ID NO: 27049 - DNA, 16 bp, H. sapiens
accaatgtatatctta

SEQ ID NO: 27050 - DNA, 16 bp, H. sapiens
accaatgtggtgaaac

SEQ ID NO: 27051 - DNA, 16 bp, H. sapiens
accaatgtgtaaaaga

SEQ ID NO: 27052 - DNA, 16 bp, H. sapiens
accaattcttcttaaa

SEQ ID NO: 27053 - DNA, 16 bp, H. sapiens
accaatttgctttatt

SEQ ID NO: 27054 - DNA, 16 bp, H. sapiens
accaattttctatatt

SEQ ID NO: 27055 - DNA, 16 bp, H. sapiens
accacaaaaacccctg

SEQ ID NO: 27056 - DNA, 16 bp, H. sapiens
accacaaaacaactag

SEQ ID NO: 27057 - DNA, 16 bp, H. sapiens
accacaaagctagcag

SEQ ID NO: 27058 - DNA, 16 bp, H. sapiens
accacaaggcctgcct

SEQ ID NO: 27059 - DNA, 16 bp, H. sapiens
accacaataaaatgaa

SEQ ID NO: 27060 - DNA, 16 bp, H. sapiens
accacaataaagcaaa

SEQ ID NO: 27061 - DNA, 16 bp, H. sapiens
accacaatgaggtatt

SEQ ID NO: 27062 - DNA, 16 bp, H. sapiens
accacaatggaaaaca

SEQ ID NO: 27063 - DNA, 16 bp, H. sapiens
accacaatttgtttaa

SEQ ID NO: 27064 - DNA, 16 bp, H. sapiens
accacaattttaaaaa

SEQ ID NO: 27065 - DNA, 16 bp, H. sapiens
accacacaatttcatg

SEQ ID NO: 27066 - DNA, 16 bp, H. sapiens
accacacacatttatt

SEQ ID NO: 27067 - DNA, 16 bp, H. sapiens
accacacatacataca

SEQ ID NO: 27068 - DNA, 16 bp, H. sapiens
accacacatctacacc

SEQ ID NO: 27069 - DNA, 16 bp, H. sapiens
accacacatggctaat

SEQ ID NO: 27070 - DNA, 16 bp, H. sapiens
accacacatttttaaa

SEQ ID NO: 27071 - DNA, 16 bp, H. sapiens
accacacccagccaga

SEQ ID NO: 27072 - DNA, 16 bp, H. sapiens
accacacccagcctca

SEQ ID NO: 27073 - DNA, 16 bp, H. sapiens
accacacccagcttat

SEQ ID NO: 27074 - DNA, 16 bp, H. sapiens
accacacctggccaaa

SEQ ID NO: 27075 - DNA, 16 bp, H. sapiens
accacacctggccaat

SEQ ID NO: 27076 - DNA, 16 bp, H. sapiens
accacacctggccaga

SEQ ID NO: 27077 - DNA, 16 bp, H. sapiens
accacacctggccagt

SEQ ID NO: 27078 - DNA, 16 bp, H. sapiens
accacacctggctaaa

SEQ ID NO: 27079 - DNA, 16 bp, H. sapiens
accacacctggctaat

SEQ ID NO: 27080 - DNA, 16 bp, H. sapiens
accacacctggttaat

SEQ ID NO: 27081 - DNA, 16 bp, H. sapiens
accacactacagcctg

SEQ ID NO: 27082 - DNA, 16 bp, H. sapiens
accacactcagctaat

SEQ ID NO: 27083 - DNA, 16 bp, H. sapiens
accacactggccaaca

SEQ ID NO: 27084 - DNA, 16 bp, H. sapiens
accacactgttttggt

SEQ ID NO: 27085 - DNA, 16 bp, H. sapiens
accacactttgaggag

SEQ ID NO: 27086 - DNA, 16 bp, H. sapiens
accacagaaactgtga

SEQ ID NO: 27087 - DNA, 16 bp, H. sapiens
accacagaaatgcaaa

SEQ ID NO: 27088 - DNA, 16 bp, H. sapiens
accacagaaatgtatt

SEQ ID NO: 27089 - DNA, 16 bp, H. sapiens
accacagacttggtgg

SEQ ID NO: 27090 - DNA, 16 bp, H. sapiens
accacagcactccagc

SEQ ID NO: 27091 - DNA, 16 bp, H. sapiens
accacagccagctaat

SEQ ID NO: 27092 - DNA, 16 bp, H. sapiens
accacagcctcagcct

SEQ ID NO: 27093 - DNA, 16 bp, H. sapiens
accacagctgcagctg

SEQ ID NO: 27094 - DNA, 17 bp, H. sapiens
accacagctggctaatt

SEQ ID NO: 27095 - DNA, 16 bp, H. sapiens
accacaggccccagtg

SEQ ID NO: 27096 - DNA, 16 bp, H. sapiens
accacaggtgtacacc

SEQ ID NO: 27097 - DNA, 16 bp, H. sapiens
accacaggttctcact

SEQ ID NO: 27098 - DNA, 16 bp, H. sapiens
accacagtcagtttta

SEQ ID NO: 27099 - DNA, 16 bp, H. sapiens
accacagtgcccagct

SEQ ID NO: 27100 - DNA, 16 bp, H. sapiens
accacagtggaataaa

SEQ ID NO: 27101 - DNA, 16 bp, H. sapiens
accacagttgactgtg

SEQ ID NO: 27102 - DNA, 16 bp, H. sapiens
accacagttgtgtgcc

SEQ ID NO: 27103 - DNA, 16 bp, H. sapiens
accacagtttctttat

SEQ ID NO: 27104 - DNA, 16 bp, H. sapiens
accacataagcagaat

SEQ ID NO: 27105 - DNA, 16 bp, H. sapiens
accacatattcataat

SEQ ID NO: 27106 - DNA, 16 bp, H. sapiens
accacatattctcact

SEQ ID NO: 27107 - DNA, 16 bp, H. sapiens
accacatccagcctac

SEQ ID NO: 27108 - DNA, 16 bp, H. sapiens
accacatccagctcat

SEQ ID NO: 27109 - DNA, 16 bp, H. sapiens
accacatctgcaatta

SEQ ID NO: 27110 - DNA, 17 bp, H. sapiens
accacatctggctaatt

SEQ ID NO: 27111 - DNA, 16 bp, H. sapiens
accacatgactcagca

SEQ ID NO: 27112 - DNA, 16 bp, H. sapiens
accacatggctgggct

SEQ ID NO: 27113 - DNA, 16 bp, H. sapiens
accacatggtcaggct

SEQ ID NO: 27114 - DNA, 16 bp, H. sapiens
accacattgtccaggc

SEQ ID NO: 27115 - DNA, 16 bp, H. sapiens
accacatttcctttat

SEQ ID NO: 27116 - DNA, 16 bp, H. sapiens
accacatttgtttatt

SEQ ID NO: 27117 - DNA, 16 bp, H. sapiens
accacattttctttaa

SEQ ID NO: 27118 - DNA, 16 bp, H. sapiens
accacatttttaaaaa

SEQ ID NO: 27119 - DNA, 16 bp, H. sapiens
accacatttttaaaat

SEQ ID NO: 27120 - DNA, 16 bp, H. sapiens
accaccaaattgtttt

SEQ ID NO: 27121 - DNA, 16 bp, H. sapiens
accaccaagacgcaga

SEQ ID NO: 27122 - DNA, 16 bp, H. sapiens
accaccaagcccagct

SEQ ID NO: 27123 - DNA, 16 bp, H. sapiens
accaccaagcctggct

SEQ ID NO: 27124 - DNA, 16 bp, H. sapiens
accaccacaccaggct

SEQ ID NO: 27125 - DNA, 16 bp, H. sapiens
accaccacacccagct

SEQ ID NO: 27126 - DNA, 16 bp, H. sapiens
accaccacacctgact

SEQ ID NO: 27127 - DNA, 16 bp, H. sapiens
accaccacacctggcc

SEQ ID NO: 27128 - DNA, 18 bp, H. sapiens
accaccacacctggctag

SEQ ID NO: 27129 - DNA, 17 bp, H. sapiens
accaccacacctggctt

SEQ ID NO: 27130 - DNA, 16 bp, H. sapiens
accaccacactgggct

SEQ ID NO: 27131 - DNA, 16 bp, H. sapiens
accaccacagtcaaga

SEQ ID NO: 27132 - DNA, 16 bp, H. sapiens
accaccacatgcagct

SEQ ID NO: 27133 - DNA, 16 bp, H. sapiens
accaccaccaccactg

SEQ ID NO: 27134 - DNA, 16 bp, H. sapiens
accaccaccaccatga

SEQ ID NO: 27135 - DNA, 19 bp, H. sapiens
accaccaccacgcctggct

SEQ ID NO: 27136 - DNA, 16 bp, H. sapiens
accaccaccagcagca

SEQ ID NO: 27137 - DNA, 16 bp, H. sapiens
accaccacccccagct

SEQ ID NO: 27138 - DNA, 16 bp, H. sapiens
accaccaccgccatca

SEQ ID NO: 27139 - DNA, 16 bp, H. sapiens
accaccacctccagca

SEQ ID NO: 27140 - DNA, 16 bp, H. sapiens
accaccacctcccagg

SEQ ID NO: 27141 - DNA, 16 bp, H. sapiens
accaccaccttgatca

SEQ ID NO: 27142 - DNA, 16 bp, H. sapiens
accaccacgcccagtt

SEQ ID NO: 27143 - DNA, 16 bp, H. sapiens
accaccacgcctagct

SEQ ID NO: 27144 - DNA, 16 bp, H. sapiens
accaccacgcctggcc

SEQ ID NO: 27145 - DNA, 18 bp, H. sapiens
accaccacgcctggctat

SEQ ID NO: 27146 - DNA, 16 bp, H. sapiens
accaccacgctcggct

SEQ ID NO: 27147 - DNA, 16 bp, H. sapiens
accaccacggcacatg

SEQ ID NO: 27148 - DNA, 16 bp, H. sapiens
accaccactaccatca

SEQ ID NO: 27149 - DNA, 16 bp, H. sapiens
accaccactcccggct

SEQ ID NO: 27150 - DNA, 16 bp, H. sapiens
accaccactccctgct

SEQ ID NO: 27151 - DNA, 16 bp, H. sapiens
accaccactgtcacca

SEQ ID NO: 27152 - DNA, 16 bp, H. sapiens
accaccagacccagct

SEQ ID NO: 27153 - DNA, 16 bp, H. sapiens
accaccagacctgccc

SEQ ID NO: 27154 - DNA, 16 bp, H. sapiens
accaccagcagcagca

SEQ ID NO: 27155 - DNA, 16 bp, H. sapiens
accaccaggcccggct

SEQ ID NO: 27156 - DNA, 16 bp, H. sapiens
accaccaggcctacct

SEQ ID NO: 27157 - DNA, 16 bp, H. sapiens
accaccaggcctggct

SEQ ID NO: 27158 - DNA, 16 bp, H. sapiens
accaccatacccggct

SEQ ID NO: 27159 - DNA, 16 bp, H. sapiens
accaccatcacaatca

SEQ ID NO: 27160 - DNA, 16 bp, H. sapiens
accaccatcaccatta

SEQ ID NO: 27161 - DNA, 16 bp, H. sapiens
accaccatcatctcca

SEQ ID NO: 27162 - DNA, 16 bp, H. sapiens
accaccatcctccaga

SEQ ID NO: 27163 - DNA, 16 bp, H. sapiens
accaccatgaccacca

SEQ ID NO: 27164 - DNA, 16 bp, H. sapiens
accaccatgactggct

SEQ ID NO: 27165 - DNA, 16 bp, H. sapiens
accaccatgcctggcc

SEQ ID NO: 27166 - DNA, 16 bp, H. sapiens
accaccatgcctggct

SEQ ID NO: 27167 - DNA, 16 bp, H. sapiens
accaccatgcctggtt

SEQ ID NO: 27168 - DNA, 16 bp, H. sapiens
accaccatgctcagct

SEQ ID NO: 27169 - DNA, 16 bp, H. sapiens
accaccatgctcggct

SEQ ID NO: 27170 - DNA, 16 bp, H. sapiens
accaccatggccaaca

SEQ ID NO: 27171 - DNA, 16 bp, H. sapiens
accaccatgtccggct

SEQ ID NO: 27172 - DNA, 16 bp, H. sapiens
accaccattctatttt

SEQ ID NO: 27173 - DNA, 16 bp, H. sapiens
accaccattgtatatg

SEQ ID NO: 27174 - DNA, 16 bp, H. sapiens
accacccaaaggctga

SEQ ID NO: 27175 - DNA, 16 bp, H. sapiens
accacccaggtcaaga

SEQ ID NO: 27176 - DNA, 16 bp, H. sapiens
accaccccctgctcca

SEQ ID NO: 27177 - DNA, 16 bp, H. sapiens
accaccctgactaaca

SEQ ID NO: 27178 - DNA, 16 bp, H. sapiens
accaccctgagcaaca

SEQ ID NO: 27179 - DNA, 16 bp, H. sapiens
accaccctgcccagcc

SEQ ID NO: 27180 - DNA, 16 bp, H. sapiens
accaccctgggcaaca

SEQ ID NO: 27181 - DNA, 17 bp, H. sapiens
accaccgcacctggcct

SEQ ID NO: 27182 - DNA, 16 bp, H. sapiens
accaccgccaccatca

SEQ ID NO: 27183 - DNA, 16 bp, H. sapiens
accaccgcgcctggcc

SEQ ID NO: 27184 - DNA, 16 bp, H. sapiens
accacctcagcctccc

SEQ ID NO: 27185 - DNA, 16 bp, H. sapiens
accacctcagcctgga

SEQ ID NO: 27186 - DNA, 16 bp, H. sapiens
accacctcagcctggg

SEQ ID NO: 27187 - DNA, 16 bp, H. sapiens
accacctcatacccat

SEQ ID NO: 27188 - DNA, 16 bp, H. sapiens
accacctccatcatca

SEQ ID NO: 27189 - DNA, 16 bp, H. sapiens
accacctccatgattc

SEQ ID NO: 27190 - DNA, 16 bp, H. sapiens
accacctcccaaaggc

SEQ ID NO: 27191 - DNA, 16 bp, H. sapiens
accacctcctcaagct

SEQ ID NO: 27192 - DNA, 16 bp, H. sapiens
accacctcctccagga

SEQ ID NO: 27193 - DNA, 16 bp, H. sapiens
accacctctgcctcct

SEQ ID NO: 27194 - DNA, 16 bp, H. sapiens
accacctgctccccca

SEQ ID NO: 27195 - DNA, 16 bp, H. sapiens
accacctgttccccaa

SEQ ID NO: 27196 - DNA, 16 bp, H. sapiens
accaccttgggcacct

SEQ ID NO: 27197 - DNA, 16 bp, H. sapiens
accaccttttgaagag

SEQ ID NO: 27198 - DNA, 16 bp, H. sapiens
accacgagaacagcac

SEQ ID NO: 27199 - DNA, 19 bp, H. sapiens
accacgcacagctaatttt

SEQ ID NO: 27200 - DNA, 19 bp, H. sapiens
accacgcatggctaatttt

SEQ ID NO: 27201 - DNA, 17 bp, H. sapiens
accacgcccagcctcaa

SEQ ID NO: 27202 - DNA, 19 bp, H. sapiens
accacgcccggataatttt

SEQ ID NO: 27203 - DNA, 16 bp, H. sapiens
accacgcccggctaat

SEQ ID NO: 27204 - DNA, 16 bp, H. sapiens
accacgcccggctgat

SEQ ID NO: 27205 - DNA, 16 bp, H. sapiens
accacgcccgggtaat

SEQ ID NO: 27206 - DNA, 16 bp, H. sapiens
accacgcccggttaat

SEQ ID NO: 27207 - DNA, 17 bp, H. sapiens
accacgcctggctaatg

SEQ ID NO: 27208 - DNA, 17 bp, H. sapiens
accacgcctggctaatt

SEQ ID NO: 27209 - DNA, 17 bp, H. sapiens
accacggccagctaatt

SEQ ID NO: 27210 - DNA, 16 bp, H. sapiens
accactaagaaaataa

SEQ ID NO: 27211 - DNA, 16 bp, H. sapiens
accactaagatactcc

SEQ ID NO: 27212 - DNA, 16 bp, H. sapiens
accactacactctggc

SEQ ID NO: 27213 - DNA, 16 bp, H. sapiens
accactacatctggct

SEQ ID NO: 27214 - DNA, 16 bp, H. sapiens
accactacgcccagct

SEQ ID NO: 27215 - DNA, 16 bp, H. sapiens
accactatcatcacca

SEQ ID NO: 27216 - DNA, 16 bp, H. sapiens
accactatcctgaatt

SEQ ID NO: 27217 - DNA, 16 bp, H. sapiens
accactatgaaaaaca

SEQ ID NO: 27218 - DNA, 16 bp, H. sapiens
accactatgcaatata

SEQ ID NO: 27219 - DNA, 16 bp, H. sapiens
accactatgctcagct

SEQ ID NO: 27220 - DNA, 16 bp, H. sapiens
accactatgcttggct

SEQ ID NO: 27221 - DNA, 16 bp, H. sapiens
accactcagcctcttt

SEQ ID NO: 27222 - DNA, 16 bp, H. sapiens
accactcctattcaat

SEQ ID NO: 27223 - DNA, 16 bp, H. sapiens
accactcctggctttt

SEQ ID NO: 27224 - DNA, 16 bp, H. sapiens
accactctcctgcctc

SEQ ID NO: 27225 - DNA, 16 bp, H. sapiens
accactctggtgaggg

SEQ ID NO: 27226 - DNA, 16 bp, H. sapiens
accactgaaaattccc

SEQ ID NO: 27227 - DNA, 16 bp, H. sapiens
accactgaacctaaaa

SEQ ID NO: 27228 - DNA, 16 bp, H. sapiens
accactgaactccagc

SEQ ID NO: 27229 - DNA, 16 bp, H. sapiens
accactgaactgtaca

SEQ ID NO: 27230 - DNA, 16 bp, H. sapiens
accactgactttcttt

SEQ ID NO: 27231 - DNA, 16 bp, H. sapiens
accactgcaccccagc

SEQ ID NO: 27232 - DNA, 16 bp, H. sapiens
accactgcactcaaac

SEQ ID NO: 27233 - DNA, 16 bp, H. sapiens
accactgcactccagg

SEQ ID NO: 27234 - DNA, 18 bp, H. sapiens
accactgcactgcagcct

SEQ ID NO: 27235 - DNA, 16 bp, H. sapiens
accactgcactgggtg

SEQ ID NO: 27236 - DNA, 16 bp, H. sapiens
accactgccaccactg

SEQ ID NO: 27237 - DNA, 16 bp, H. sapiens
accactgcgcccagct

SEQ ID NO: 27238 - DNA, 16 bp, H. sapiens
accactggctttcctg

SEQ ID NO: 27239 - DNA, 16 bp, H. sapiens
accactgtactacagc

SEQ ID NO: 27240 - DNA, 16 bp, H. sapiens
accactgtactccaac

SEQ ID NO: 27241 - DNA, 16 bp, H. sapiens
accactgtgcccagcc

SEQ ID NO: 27242 - DNA, 16 bp, H. sapiens
accactgtgtccagct

SEQ ID NO: 27243 - DNA, 16 bp, H. sapiens
accactgttctccagc

SEQ ID NO: 27244 - DNA, 16 bp, H. sapiens
accacttcctccttgt

SEQ ID NO: 27245 - DNA, 16 bp, H. sapiens
accactttggaagaca

SEQ ID NO: 27246 - DNA, 16 bp, H. sapiens
accactttggcctccc

SEQ ID NO: 27247 - DNA, 16 bp, H. sapiens
accacttttattttct

SEQ ID NO: 27248 - DNA, 16 bp, H. sapiens
accagaaaccataaaa

SEQ ID NO: 27249 - DNA, 16 bp, H. sapiens
accagaaactgagcag

SEQ ID NO: 27250 - DNA, 16 bp, H. sapiens
accagaaactggaaga

SEQ ID NO: 27251 - DNA, 16 bp, H. sapiens
accagaaactgtaaaa

SEQ ID NO: 27252 - DNA, 16 bp, H. sapiens
accagaaagaagcttt

SEQ ID NO: 27253 - DNA, 16 bp, H. sapiens
accagaaaggacatct

SEQ ID NO: 27254 - DNA, 16 bp, H. sapiens
accagaagagtgcagt

SEQ ID NO: 27255 - DNA, 16 bp, H. sapiens
accagaagctaggaga

SEQ ID NO: 27256 - DNA, 16 bp, H. sapiens
accagaagctggggag

SEQ ID NO: 27257 - DNA, 16 bp, H. sapiens
accagaagctggggga

SEQ ID NO: 27258 - DNA, 16 bp, H. sapiens
accagaatagaacctc

SEQ ID NO: 27259 - DNA, 16 bp, H. sapiens
accagaatctctggga

SEQ ID NO: 27260 - DNA, 16 bp, H. sapiens
accagaatctgcattt

SEQ ID NO: 27261 - DNA, 16 bp, H. sapiens
accagaattgccctta

SEQ ID NO: 27262 - DNA, 16 bp, H. sapiens
accagaattttattat

SEQ ID NO: 27263 - DNA, 16 bp, H. sapiens
accagacacagtggct

SEQ ID NO: 27264 - DNA, 16 bp, H. sapiens
accagaccctgtctct

SEQ ID NO: 27265 - DNA, 16 bp, H. sapiens
accagacctaccttac

SEQ ID NO: 27266 - DNA, 16 bp, H. sapiens
accagactgcccttca

SEQ ID NO: 27267 - DNA, 16 bp, H. sapiens
accagagaaaagtgaa

SEQ ID NO: 27268 - DNA, 16 bp, H. sapiens
accagagaaaataacc

SEQ ID NO: 27269 - DNA, 16 bp, H. sapiens
accagagaaagacaca

SEQ ID NO: 27270 - DNA, 16 bp, H. sapiens
accagagaaatgaaaa

SEQ ID NO: 27271 - DNA, 16 bp, H. sapiens
accagagaagcaagag

SEQ ID NO: 27272 - DNA, 16 bp, H. sapiens
accagagatacaaaga

SEQ ID NO: 27273 - DNA, 16 bp, H. sapiens
accagagatgcaggga

SEQ ID NO: 27274 - DNA, 16 bp, H. sapiens
accagagatttttttt

SEQ ID NO: 27275 - DNA, 16 bp, H. sapiens
accagagcccagggag

SEQ ID NO: 27276 - DNA, 16 bp, H. sapiens
accagagcctgggagg

SEQ ID NO: 27277 - DNA, 16 bp, H. sapiens
accagagcctgtcagg

SEQ ID NO: 27278 - DNA, 16 bp, H. sapiens
accagaggaagcagag

SEQ ID NO: 27279 - DNA, 16 bp, H. sapiens
accagaggaatctaca

SEQ ID NO: 27280 - DNA, 16 bp, H. sapiens
accagaggctgaagtg

SEQ ID NO: 27281 - DNA, 16 bp, H. sapiens
accagaggctggaagg

SEQ ID NO: 27282 - DNA, 16 bp, H. sapiens
accagaggctggagag

SEQ ID NO: 27283 - DNA, 16 bp, H. sapiens
accagagggtgggaag

SEQ ID NO: 27284 - DNA, 16 bp, H. sapiens
accagaggtcactctc

SEQ ID NO: 27285 - DNA, 16 bp, H. sapiens
accagaggtcagcaaa

SEQ ID NO: 27286 - DNA, 16 bp, H. sapiens
accagatgatccagca

SEQ ID NO: 27287 - DNA, 16 bp, H. sapiens
accagatgcattcaca

SEQ ID NO: 27288 - DNA, 16 bp, H. sapiens
accagatggagctgaa

SEQ ID NO: 27289 - DNA, 16 bp, H. sapiens
accagattaagggtgg

SEQ ID NO: 27290 - DNA, 16 bp, H. sapiens
accagattgagaacct

SEQ ID NO: 27291 - DNA, 16 bp, H. sapiens
accagattggctacag

SEQ ID NO: 27292 - DNA, 16 bp, H. sapiens
accagcaaaaagatta

SEQ ID NO: 27293 - DNA, 16 bp, H. sapiens
accagcaaaaagattg

SEQ ID NO: 27294 - DNA, 16 bp, H. sapiens
accagcaaatgctgag

SEQ ID NO: 27295 - DNA, 16 bp, H. sapiens
accagcaacagcagca

SEQ ID NO: 27296 - DNA, 16 bp, H. sapiens
accagcaagacagaac

SEQ ID NO: 27297 - DNA, 16 bp, H. sapiens
accagcaagtttttta

SEQ ID NO: 27298 - DNA, 16 bp, H. sapiens
accagcacagccacag

SEQ ID NO: 27299 - DNA, 16 bp, H. sapiens
accagcacattctgca

SEQ ID NO: 27300 - DNA, 16 bp, H. sapiens
accagcactttgggaa

SEQ ID NO: 27301 - DNA, 16 bp, H. sapiens
accagcactttgggag

SEQ ID NO: 27302 - DNA, 16 bp, H. sapiens
accagcagaccaggag

SEQ ID NO: 27303 - DNA, 17 bp, H. sapiens
accagcagaggctgcag

SEQ ID NO: 27304 - DNA, 16 bp, H. sapiens
accagcagcaacagca

SEQ ID NO: 27305 - DNA, 16 bp, H. sapiens
accagcagcaccagca

SEQ ID NO: 27306 - DNA, 16 bp, H. sapiens
accagcagcagcaaca

SEQ ID NO: 27307 - DNA, 16 bp, H. sapiens
accagcagcagcagca

SEQ ID NO: 27308 - DNA, 16 bp, H. sapiens
accagcagcagtgttc

SEQ ID NO: 27309 - DNA, 16 bp, H. sapiens
accagcagcatcacca

SEQ ID NO: 27310 - DNA, 16 bp, H. sapiens
accagcagcatcagca

SEQ ID NO: 27311 - DNA, 16 bp, H. sapiens
accagcagcatcagta

SEQ ID NO: 27312 - DNA, 16 bp, H. sapiens
accagcagcatctgca

SEQ ID NO: 27313 - DNA, 16 bp, H. sapiens
accagcagcctggcca

SEQ ID NO: 27314 - DNA, 16 bp, H. sapiens
accagcagtgtatgag

SEQ ID NO: 27315 - DNA, 16 bp, H. sapiens
accagcagtgtgacct

SEQ ID NO: 27316 - DNA, 16 bp, H. sapiens
accagcagtttgggag

SEQ ID NO: 27317 - DNA, 16 bp, H. sapiens
accagcatcaccacag

SEQ ID NO: 27318 - DNA, 16 bp, H. sapiens
accagcatcaccatca

SEQ ID NO: 27319 - DNA, 16 bp, H. sapiens
accagcatcagcatca

SEQ ID NO: 27320 - DNA, 16 bp, H. sapiens
accagcatctgttact

SEQ ID NO: 27321 - DNA, 17 bp, H. sapiens
accagcatgacacatgt

SEQ ID NO: 27322 - DNA, 16 bp, H. sapiens
accagcatggccacag

SEQ ID NO: 27323 - DNA, 17 bp, H. sapiens
accagccactgcaaaac

SEQ ID NO: 27324 - DNA, 16 bp, H. sapiens
accagccagagcaaca

SEQ ID NO: 27325 - DNA, 16 bp, H. sapiens
accagccagcccccag

SEQ ID NO: 27326 - DNA, 16 bp, H. sapiens
accagccaggcatggt

SEQ ID NO: 27327 - DNA, 16 bp, H. sapiens
accagccaggccaata

SEQ ID NO: 27328 - DNA, 16 bp, H. sapiens
accagccaggtgcagt

SEQ ID NO: 27329 - DNA, 16 bp, H. sapiens
accagccattccccca

SEQ ID NO: 27330 - DNA, 16 bp, H. sapiens
accagccatttctcca

SEQ ID NO: 27331 - DNA, 16 bp, H. sapiens
accagcccaaagtcac

SEQ ID NO: 27332 - DNA, 16 bp, H. sapiens
accagcccagagccag

SEQ ID NO: 27333 - DNA, 16 bp, H. sapiens
accagcccaggaagcc

SEQ ID NO: 27334 - DNA, 16 bp, H. sapiens
accagcccaggcaaca

SEQ ID NO: 27335 - DNA, 16 bp, H. sapiens
accagcccaggcaata

SEQ ID NO: 27336 - DNA, 16 bp, H. sapiens
accagccccagcaaca

SEQ ID NO: 27337 - DNA, 16 bp, H. sapiens
accagcccctgcaaaa

SEQ ID NO: 27338 - DNA, 16 bp, H. sapiens
accagccctgccaaca

SEQ ID NO: 27339 - DNA, 16 bp, H. sapiens
accagccctgcccaca

SEQ ID NO: 27340 - DNA, 16 bp, H. sapiens
accagccctggcaaca

SEQ ID NO: 27341 - DNA, 16 bp, H. sapiens
accagcctaagcagca

SEQ ID NO: 27342 - DNA, 16 bp, H. sapiens
accagcctaggtaaca

SEQ ID NO: 27343 - DNA, 16 bp, H. sapiens
accagcctagtcaaca

SEQ ID NO: 27344 - DNA, 16 bp, H. sapiens
accagcctcaccaata

SEQ ID NO: 27345 - DNA, 16 bp, H. sapiens
accagcctcagcaaca

SEQ ID NO: 27346 - DNA, 16 bp, H. sapiens
accagcctctgcctcc

SEQ ID NO: 27347 - DNA, 16 bp, H. sapiens
accagcctgaccagta

SEQ ID NO: 27348 - DNA, 16 bp, H. sapiens
accagcctgagcaaga

SEQ ID NO: 27349 - DNA, 16 bp, H. sapiens
accagcctgagctaca

SEQ ID NO: 27350 - DNA, 16 bp, H. sapiens
accagcctgatcaaca

SEQ ID NO: 27351 - DNA, 16 bp, H. sapiens
accagcctgcccagca

SEQ ID NO: 27352 - DNA, 18 bp, H. sapiens
accagcctggccaacatt

SEQ ID NO: 27353 - DNA, 16 bp, H. sapiens
accagcctggccagct

SEQ ID NO: 27354 - DNA, 16 bp, H. sapiens
accagcctggctggcc

SEQ ID NO: 27355 - DNA, 16 bp, H. sapiens
accagcctgggcaaaa

SEQ ID NO: 27356 - DNA, 16 bp, H. sapiens
accagcctgggcacca

SEQ ID NO: 27357 - DNA, 16 bp, H. sapiens
accagcctgggcatca

SEQ ID NO: 27358 - DNA, 16 bp, H. sapiens
accagcctgggccaca

SEQ ID NO: 27359 - DNA, 16 bp, H. sapiens
accagcctgggtgaca

SEQ ID NO: 27360 - DNA, 16 bp, H. sapiens
accagcctgtccaata

SEQ ID NO: 27361 - DNA, 16 bp, H. sapiens
accagccttgcaaccc

SEQ ID NO: 27362 - DNA, 16 bp, H. sapiens
accagccttgtcaaca

SEQ ID NO: 27363 - DNA, 16 bp, H. sapiens
accagcgtggccaaga

SEQ ID NO: 27364 - DNA, 47 bp, H. sapiens
accagcgttcagcatatggaggatcccgccagcctctgagttccctt

SEQ ID NO: 27365 - DNA, 16 bp, H. sapiens
accagctcagccaaca

SEQ ID NO: 27366 - DNA, 16 bp, H. sapiens
accagctcagccacag

SEQ ID NO: 27367 - DNA, 16 bp, H. sapiens
accagctcatctttgt

SEQ ID NO: 27368 - DNA, 16 bp, H. sapiens
accagctcctccctgt

SEQ ID NO: 27369 - DNA, 16 bp, H. sapiens
accagctcctggattg

SEQ ID NO: 27370 - DNA, 16 bp, H. sapiens
accagctcctggcttc

SEQ ID NO: 27371 - DNA, 16 bp, H. sapiens
accagctcttctctgt

SEQ ID NO: 27372 - DNA, 16 bp, H. sapiens
accagctcttcttcat

SEQ ID NO: 27373 - DNA, 16 bp, H. sapiens
accagctcttctttct

SEQ ID NO: 27374 - DNA, 16 bp, H. sapiens
accagctgcagaaatt

SEQ ID NO: 27375 - DNA, 16 bp, H. sapiens
accagctgcatgacct

SEQ ID NO: 27376 - DNA, 16 bp, H. sapiens
accagctggccaacat

SEQ ID NO: 27377 - DNA, 16 bp, H. sapiens
accagctgggcaacat

SEQ ID NO: 27378 - DNA, 16 bp, H. sapiens
accagctgggctcctg

SEQ ID NO: 27379 - DNA, 16 bp, H. sapiens
accagctgggtgtcct

SEQ ID NO: 27380 - DNA, 16 bp, H. sapiens
accagctgtggagagg

SEQ ID NO: 27381 - DNA, 16 bp, H. sapiens
accagcttgtccaaca

SEQ ID NO: 27382 - DNA, 16 bp, H. sapiens
accagctttggcaaca

SEQ ID NO: 27383 - DNA, 16 bp, H. sapiens
accagcttttgctgca

SEQ ID NO: 27384 - DNA, 16 bp, H. sapiens
accaggaaacaggccc

SEQ ID NO: 27385 - DNA, 16 bp, H. sapiens
accaggaagaagtcaa

SEQ ID NO: 27386 - DNA, 17 bp, H. sapiens
accaggaagaagtccaa

SEQ ID NO: 27387 - DNA, 16 bp, H. sapiens
accaggaagaagttta

SEQ ID NO: 27388 - DNA, 16 bp, H. sapiens
accaggaaggagttga

SEQ ID NO: 27389 - DNA, 16 bp, H. sapiens
accaggacccgggagg

SEQ ID NO: 27390 - DNA, 16 bp, H. sapiens
accaggagaaaaatca

SEQ ID NO: 27391 - DNA, 16 bp, H. sapiens
accaggagctggaaga

SEQ ID NO: 27392 - DNA, 16 bp, H. sapiens
accaggaggagaggct

SEQ ID NO: 27393 - DNA, 16 bp, H. sapiens
accaggaggcagaggt

SEQ ID NO: 27394 - DNA, 16 bp, H. sapiens
accaggaggcagggat

SEQ ID NO: 27395 - DNA, 16 bp, H. sapiens
accaggaggcggagct

SEQ ID NO: 27396 - DNA, 16 bp, H. sapiens
accaggaggcggaggc

SEQ ID NO: 27397 - DNA, 16 bp, H. sapiens
accaggaggtggagat

SEQ ID NO: 27398 - DNA, 16 bp, H. sapiens
accaggaggtggaggc

SEQ ID NO: 27399 - DNA, 17 bp, H. sapiens
accaggaggtggaggct

SEQ ID NO: 27400 - DNA, 24 bp, H. sapiens
accaggagttcaagaccagcctgg

SEQ ID NO: 27401 - DNA, 16 bp, H. sapiens
accaggatggtctgga

SEQ ID NO: 27402 - DNA, 16 bp, H. sapiens
accaggatggtcttga

SEQ ID NO: 27403 - DNA, 16 bp, H. sapiens
accaggcacagtgtct

SEQ ID NO: 27404 - DNA, 16 bp, H. sapiens
accaggcactgaatct

SEQ ID NO: 27405 - DNA, 16 bp, H. sapiens
accaggcagagtcatg

SEQ ID NO: 27406 - DNA, 18 bp, H. sapiens
accaggcatggtggctca

SEQ ID NO: 27407 - DNA, 16 bp, H. sapiens
accaggccaccacaca

SEQ ID NO: 27408 - DNA, 16 bp, H. sapiens
accaggccatgggggc

SEQ ID NO: 27409 - DNA, 16 bp, H. sapiens
accaggcccagggccc

SEQ ID NO: 27410 - DNA, 16 bp, H. sapiens
accaggccccagctcc

SEQ ID NO: 27411 - DNA, 16 bp, H. sapiens
accaggccctgcctcc

SEQ ID NO: 27412 - DNA, 16 bp, H. sapiens
accaggccgggcgcgg

SEQ ID NO: 27413 - DNA, 16 bp, H. sapiens
accaggcctaccttac

SEQ ID NO: 27414 - DNA, 16 bp, H. sapiens
accaggcctggctaat

SEQ ID NO: 27415 - DNA, 17 bp, H. sapiens
accaggcgcggtggctc

SEQ ID NO: 27416 - DNA, 16 bp, H. sapiens
accaggctaatttttt

SEQ ID NO: 27417 - DNA, 16 bp, H. sapiens
accaggctagagtgca

SEQ ID NO: 27418 - DNA, 16 bp, H. sapiens
accaggctccaggctg

SEQ ID NO: 27419 - DNA, 16 bp, H. sapiens
accaggctctgggctg

SEQ ID NO: 27420 - DNA, 16 bp, H. sapiens
accaggctggaatgca

SEQ ID NO: 27421 - DNA, 16 bp, H. sapiens
accaggctggacaaca

SEQ ID NO: 27422 - DNA, 16 bp, H. sapiens
accaggctggagtgca

SEQ ID NO: 27423 - DNA, 16 bp, H. sapiens
accaggctggcctcga

SEQ ID NO: 27424 - DNA, 16 bp, H. sapiens
accagggagactgagg

SEQ ID NO: 27425 - DNA, 16 bp, H. sapiens
accagggagctggagg

SEQ ID NO: 27426 - DNA, 16 bp, H. sapiens
accagggaggcagagg

SEQ ID NO: 27427 - DNA, 16 bp, H. sapiens
accagggatgcaggga

SEQ ID NO: 27428 - DNA, 16 bp, H. sapiens
accagggcacgtgtat

SEQ ID NO: 27429 - DNA, 16 bp, H. sapiens
accagggcttcttgga

SEQ ID NO: 27430 - DNA, 16 bp, H. sapiens
accaggtcccacctcc

SEQ ID NO: 27431 - DNA, 16 bp, H. sapiens
accaggtccctcccca

SEQ ID NO: 27432 - DNA, 16 bp, H. sapiens
accaggtgcactgctt

SEQ ID NO: 27433 - DNA, 16 bp, H. sapiens
accaggtgccaggcac

SEQ ID NO: 27434 - DNA, 16 bp, H. sapiens
accaggtgctgtggct

SEQ ID NO: 27435 - DNA, 16 bp, H. sapiens
accaggttcaagagat

SEQ ID NO: 27436 - DNA, 16 bp, H. sapiens
accaggttcctccctc

SEQ ID NO: 27437 - DNA, 16 bp, H. sapiens
accagtacttctcaaa

SEQ ID NO: 27438 - DNA, 16 bp, H. sapiens
accagtagcatcagca

SEQ ID NO: 27439 - DNA, 16 bp, H. sapiens
accagtagttctcaaa

SEQ ID NO: 27440 - DNA, 16 bp, H. sapiens
accagtatgatcctga

SEQ ID NO: 27441 - DNA, 16 bp, H. sapiens
accagtcacaaaaaga

SEQ ID NO: 27442 - DNA, 16 bp, H. sapiens
accagtcacaaaagga

SEQ ID NO: 27443 - DNA, 17 bp, H. sapiens
accagtctctactaaaa

SEQ ID NO: 27444 - DNA, 16 bp, H. sapiens
accagtctctggtgcc

SEQ ID NO: 27445 - DNA, 16 bp, H. sapiens
accagtctgggaaaca

SEQ ID NO: 27446 - DNA, 17 bp, H. sapiens
accagtctgggcaacag

SEQ ID NO: 27447 - DNA, 17 bp, H. sapiens
accagtgactttcttca

SEQ ID NO: 27448 - DNA, 16 bp, H. sapiens
accagtgatgatgacc

SEQ ID NO: 27449 - DNA, 16 bp, H. sapiens
accagtgatttgccag

SEQ ID NO: 27450 - DNA, 18 bp, H. sapiens
accagtgcatgcagcccc

SEQ ID NO: 27451 - DNA, 16 bp, H. sapiens
accagtggttcccaaa

SEQ ID NO: 27452 - DNA, 16 bp, H. sapiens
accagttattaaatag

SEQ ID NO: 27453 - DNA, 16 bp, H. sapiens
accagttccactccca

SEQ ID NO: 27454 - DNA, 16 bp, H. sapiens
accagttcctccttgt

SEQ ID NO: 27455 - DNA, 16 bp, H. sapiens
accagtttctttctga

SEQ ID NO: 27456 - DNA, 16 bp, H. sapiens
accagtttggccaaca

SEQ ID NO: 27457 - DNA, 16 bp, H. sapiens
accagtttgtttgttt

SEQ ID NO: 27458 - DNA, 16 bp, H. sapiens
accataaaaaatgatg

SEQ ID NO: 27459 - DNA, 16 bp, H. sapiens
accataaagacacatg

SEQ ID NO: 27460 - DNA, 16 bp, H. sapiens
accataagccaattaa

SEQ ID NO: 27461 - DNA, 16 bp, H. sapiens
accataatctaagccc

SEQ ID NO: 27462 - DNA, 16 bp, H. sapiens
accataatttatttaa

SEQ ID NO: 27463 - DNA, 16 bp, H. sapiens
accatacacacataca

SEQ ID NO: 27464 - DNA, 17 bp, H. sapiens
accataccctgctaatt

SEQ ID NO: 27465 - DNA, 16 bp, H. sapiens
accatactgtcttcca

SEQ ID NO: 27466 - DNA, 16 bp, H. sapiens
accatagctcactgca

SEQ ID NO: 27467 - DNA, 16 bp, H. sapiens
accataggcttcaatg

SEQ ID NO: 27468 - DNA, 16 bp, H. sapiens
accatatgatagacca

SEQ ID NO: 27469 - DNA, 16 bp, H. sapiens
accatatggcctaggt

SEQ ID NO: 27470 - DNA, 16 bp, H. sapiens
accatattttataaat

SEQ ID NO: 27471 - DNA, 16 bp, H. sapiens
accatcaaaaagtggg

SEQ ID NO: 27472 - DNA, 16 bp, H. sapiens
accatcaacaaagtga

SEQ ID NO: 27473 - DNA, 16 bp, H. sapiens
accatcaacatcaaca

SEQ ID NO: 27474 - DNA, 16 bp, H. sapiens
accatcaagaaagtaa

SEQ ID NO: 27475 - DNA, 16 bp, H. sapiens
accatcaaggacttga

SEQ ID NO: 27476 - DNA, 18 bp, H. sapiens
accatcacagctgtaaat

SEQ ID NO: 27477 - DNA, 16 bp, H. sapiens
accatcaccacaatca

SEQ ID NO: 27478 - DNA, 16 bp, H. sapiens
accatcaccaccatca

SEQ ID NO: 27479 - DNA, 16 bp, H. sapiens
accatcaccaccatct

SEQ ID NO: 27480 - DNA, 16 bp, H. sapiens
accatcaccaccatga

SEQ ID NO: 27481 - DNA, 16 bp, H. sapiens
accatcaccactgcca

SEQ ID NO: 27482 - DNA, 16 bp, H. sapiens
accatcaccatcacca

SEQ ID NO: 27483 - DNA, 16 bp, H. sapiens
accatcaccatcactg

SEQ ID NO: 27484 - DNA, 16 bp, H. sapiens
accatcaccatcatca

SEQ ID NO: 27485 - DNA, 16 bp, H. sapiens
accatcacccaggctg

SEQ ID NO: 27486 - DNA, 16 bp, H. sapiens
accatcaccgccacca

SEQ ID NO: 27487 - DNA, 16 bp, H. sapiens
accatcacctcctcca

SEQ ID NO: 27488 - DNA, 16 bp, H. sapiens
accatcacctgatggt

SEQ ID NO: 27489 - DNA, 16 bp, H. sapiens
accatcacgcccagct

SEQ ID NO: 27490 - DNA, 16 bp, H. sapiens
accatcactgccatca

SEQ ID NO: 27491 - DNA, 16 bp, H. sapiens
accatcactgtcacca

SEQ ID NO: 27492 - DNA, 16 bp, H. sapiens
accatcactgtcatca

SEQ ID NO: 27493 - DNA, 16 bp, H. sapiens
accatcagaaaatact

SEQ ID NO: 27494 - DNA, 16 bp, H. sapiens
accatcagaaactact

SEQ ID NO: 27495 - DNA, 16 bp, H. sapiens
accatcagagaattct

SEQ ID NO: 27496 - DNA, 16 bp, H. sapiens
accatcagagcatact

SEQ ID NO: 27497 - DNA, 16 bp, H. sapiens
accatcagagtgagca

SEQ ID NO: 27498 - DNA, 16 bp, H. sapiens
accatcagcaccatca

SEQ ID NO: 27499 - DNA, 16 bp, H. sapiens
accatcagcaccatcc

SEQ ID NO: 27500 - DNA, 16 bp, H. sapiens
accatcaggaaaatgc

SEQ ID NO: 27501 - DNA, 16 bp, H. sapiens
accatcaggacaaaca

SEQ ID NO: 27502 - DNA, 17 bp, H. sapiens
accatcaggcctgcctt

SEQ ID NO: 27503 - DNA, 16 bp, H. sapiens
accatcatacccagct

SEQ ID NO: 27504 - DNA, 16 bp, H. sapiens
accatcatcacagtca

SEQ ID NO: 27505 - DNA, 16 bp, H. sapiens
accatcatcactgcca

SEQ ID NO: 27506 - DNA, 16 bp, H. sapiens
accatcatcatcatcc

SEQ ID NO: 27507 - DNA, 16 bp, H. sapiens
accatcatcatcatga

SEQ ID NO: 27508 - DNA, 16 bp, H. sapiens
accatcatcatcttca

SEQ ID NO: 27509 - DNA, 16 bp, H. sapiens
accatcatctcagccc

SEQ ID NO: 27510 - DNA, 16 bp, H. sapiens
accatcatgcccagct

SEQ ID NO: 27511 - DNA, 16 bp, H. sapiens
accatcatgcctggtt

SEQ ID NO: 27512 - DNA, 16 bp, H. sapiens
accatcatgggcaaca

SEQ ID NO: 27513 - DNA, 16 bp, H. sapiens
accatcattctcaaca

SEQ ID NO: 27514 - DNA, 16 bp, H. sapiens
accatcattctcatca

SEQ ID NO: 27515 - DNA, 16 bp, H. sapiens
accatccaagaaaaca

SEQ ID NO: 27516 - DNA, 16 bp, H. sapiens
accatccatccatcca

SEQ ID NO: 27517 - DNA, 16 bp, H. sapiens
accatccatctctaga

SEQ ID NO: 27518 - DNA, 16 bp, H. sapiens
accatccccatgatcc

SEQ ID NO: 27519 - DNA, 16 bp, H. sapiens
accatcctcagcctcc

SEQ ID NO: 27520 - DNA, 16 bp, H. sapiens
accatcctggacacag

SEQ ID NO: 27521 - DNA, 16 bp, H. sapiens
accatcctggataaca

SEQ ID NO: 27522 - DNA, 16 bp, H. sapiens
accatcctggccaatg

SEQ ID NO: 27523 - DNA, 16 bp, H. sapiens
accatcctggccagca

SEQ ID NO: 27524 - DNA, 16 bp, H. sapiens
accatcctggctacca

SEQ ID NO: 27525 - DNA, 16 bp, H. sapiens
accatcctgggcaaca

SEQ ID NO: 27526 - DNA, 16 bp, H. sapiens
accatcctggtgaaca

SEQ ID NO: 27527 - DNA, 18 bp, H. sapiens
accatcctggttaacaca

SEQ ID NO: 27528 - DNA, 16 bp, H. sapiens
accatccttctattct

SEQ ID NO: 27529 - DNA, 16 bp, H. sapiens
accatcgtcaaagacc

SEQ ID NO: 27530 - DNA, 16 bp, H. sapiens
accatctatctccaga

SEQ ID NO: 27531 - DNA, 16 bp, H. sapiens
accatctatgaaccag

SEQ ID NO: 27532 - DNA, 16 bp, H. sapiens
accatctcagcctgga

SEQ ID NO: 27533 - DNA, 16 bp, H. sapiens
accatctgggtctgga

SEQ ID NO: 27534 - DNA, 16 bp, H. sapiens
accatctgtgggtctc

SEQ ID NO: 27535 - DNA, 16 bp, H. sapiens
accatcttcatcatca

SEQ ID NO: 27536 - DNA, 16 bp, H. sapiens
accatcttggctaata

SEQ ID NO: 27537 - DNA, 16 bp, H. sapiens
accatcttggctcagt

SEQ ID NO: 27538 - DNA, 16 bp, H. sapiens
accatgaaaaataaat

SEQ ID NO: 27539 - DNA, 16 bp, H. sapiens
accatgaaaacagtat

SEQ ID NO: 27540 - DNA, 21 bp, H. sapiens
accatgaaaatcgaacctccc

SEQ ID NO: 27541 - DNA, 16 bp, H. sapiens
accatgaaataccatg

SEQ ID NO: 27542 - DNA, 16 bp, H. sapiens
accatgaagaaatcca

SEQ ID NO: 27543 - DNA, 17 bp, H. sapiens
accatgactggctaatt

SEQ ID NO: 27544 - DNA, 16 bp, H. sapiens
accatgaggctttcaa

SEQ ID NO: 27545 - DNA, 16 bp, H. sapiens
accatgagtaaaagtt

SEQ ID NO: 27546 - DNA, 16 bp, H. sapiens
accatgatcaagtgga

SEQ ID NO: 27547 - DNA, 16 bp, H. sapiens
accatgatcatgccac

SEQ ID NO: 27548 - DNA, 16 bp, H. sapiens
accatgatcgagtggg

SEQ ID NO: 27549 - DNA, 16 bp, H. sapiens
accatgattctgaggc

SEQ ID NO: 27550 - DNA, 16 bp, H. sapiens
accatgattgtgagga

SEQ ID NO: 27551 - DNA, 16 bp, H. sapiens
accatgcccagcaact

SEQ ID NO: 27552 - DNA, 17 bp, H. sapiens
accatgcccagccaatt

SEQ ID NO: 27553 - DNA, 16 bp, H. sapiens
accatgcccagcccct

SEQ ID NO: 27554 - DNA, 16 bp, H. sapiens
accatgcccagcctca

SEQ ID NO: 27555 - DNA, 16 bp, H. sapiens
accatgcccagtttat

SEQ ID NO: 27556 - DNA, 16 bp, H. sapiens
accatgcccggctcaa

SEQ ID NO: 27557 - DNA, 17 bp, H. sapiens
accatgcccggctgatg

SEQ ID NO: 27558 - DNA, 16 bp, H. sapiens
accatgcctgacccaa

SEQ ID NO: 27559 - DNA, 16 bp, H. sapiens
accatgcctggcacac

SEQ ID NO: 27560 - DNA, 16 bp, H. sapiens
accatgcctggccaat

SEQ ID NO: 27561 - DNA, 16 bp, H. sapiens
accatgcctggccctt

SEQ ID NO: 27562 - DNA, 16 bp, H. sapiens
accatgcctggccttg

SEQ ID NO: 27563 - DNA, 17 bp, H. sapiens
accatgcctggctaatc

SEQ ID NO: 27564 - DNA, 21 bp, H. sapiens
accatgcctggctgatttttt

SEQ ID NO: 27565 - DNA, 16 bp, H. sapiens
accatgcctggtctgt

SEQ ID NO: 27566 - DNA, 16 bp, H. sapiens
accatgcctggtcttt

SEQ ID NO: 27567 - DNA, 16 bp, H. sapiens
accatgctggcaccct

SEQ ID NO: 27568 - DNA, 16 bp, H. sapiens
accatgctggccaaca

SEQ ID NO: 27569 - DNA, 16 bp, H. sapiens
accatgctgggctaat

SEQ ID NO: 27570 - DNA, 16 bp, H. sapiens
accatgctgggttaat

SEQ ID NO: 27571 - DNA, 16 bp, H. sapiens
accatgctgtcttcca

SEQ ID NO: 27572 - DNA, 16 bp, H. sapiens
accatggaaactggca

SEQ ID NO: 27573 - DNA, 16 bp, H. sapiens
accatggaggcagagg

SEQ ID NO: 27574 - DNA, 16 bp, H. sapiens
accatggcactccagc

SEQ ID NO: 27575 - DNA, 16 bp, H. sapiens
accatggctggggagg

SEQ ID NO: 27576 - DNA, 16 bp, H. sapiens
accatggttttgattt

SEQ ID NO: 27577 - DNA, 16 bp, H. sapiens
accatgtaagccagga

SEQ ID NO: 27578 - DNA, 16 bp, H. sapiens
accatgtagtagaaaa

SEQ ID NO: 27579 - DNA, 16 bp, H. sapiens
accatgtcaaaaaaaa

SEQ ID NO: 27580 - DNA, 16 bp, H. sapiens
accatgtcattccacc

SEQ ID NO: 27581 - DNA, 16 bp, H. sapiens
accatgtccggctaat

SEQ ID NO: 27582 - DNA, 16 bp, H. sapiens
accatgtctcagaaaa

SEQ ID NO: 27583 - DNA, 16 bp, H. sapiens
accatgtgaagatgaa

SEQ ID NO: 27584 - DNA, 16 bp, H. sapiens
accatgtgacccagaa

SEQ ID NO: 27585 - DNA, 16 bp, H. sapiens
accatgtgaggaaaca

SEQ ID NO: 27586 - DNA, 16 bp, H. sapiens
accatgtgaggataca

SEQ ID NO: 27587 - DNA, 16 bp, H. sapiens
accatgtgccaggcac

SEQ ID NO: 27588 - DNA, 16 bp, H. sapiens
accatgtgcccagcac

SEQ ID NO: 27589 - DNA, 16 bp, H. sapiens
accatgtgtcaggcat

SEQ ID NO: 27590 - DNA, 16 bp, H. sapiens
accatgttctccatca

SEQ ID NO: 27591 - DNA, 16 bp, H. sapiens
accatgttggccacgg

SEQ ID NO: 27592 - DNA, 16 bp, H. sapiens
accatgtttgcctggg

SEQ ID NO: 27593 - DNA, 16 bp, H. sapiens
accattaaatataatg

SEQ ID NO: 27594 - DNA, 16 bp, H. sapiens
accattaacatttttt

SEQ ID NO: 27595 - DNA, 16 bp, H. sapiens
accattaactttcttc

SEQ ID NO: 27596 - DNA, 16 bp, H. sapiens
accattatagtatcat

SEQ ID NO: 27597 - DNA, 16 bp, H. sapiens
accattatcaccacca

SEQ ID NO: 27598 - DNA, 16 bp, H. sapiens
accattatcagccact

SEQ ID NO: 27599 - DNA, 16 bp, H. sapiens
accattatgaaaaaca

SEQ ID NO: 27600 - DNA, 16 bp, H. sapiens
accattatgttacagt

SEQ ID NO: 27601 - DNA, 16 bp, H. sapiens
accattattttatgta

SEQ ID NO: 27602 - DNA, 16 bp, H. sapiens
accattcaggacacag

SEQ ID NO: 27603 - DNA, 16 bp, H. sapiens
accattcagtggtttt

SEQ ID NO: 27604 - DNA, 16 bp, H. sapiens
accattccatctgaaa

SEQ ID NO: 27605 - DNA, 16 bp, H. sapiens
accattcctactgaaa

SEQ ID NO: 27606 - DNA, 16 bp, H. sapiens
accattccttcagaaa

SEQ ID NO: 27607 - DNA, 19 bp, H. sapiens
accattctcctgcctcagc

SEQ ID NO: 27608 - DNA, 16 bp, H. sapiens
accattctcctgtctc

SEQ ID NO: 27609 - DNA, 16 bp, H. sapiens
accattctggacatca

SEQ ID NO: 27610 - DNA, 16 bp, H. sapiens
accattctggacatgg

SEQ ID NO: 27611 - DNA, 16 bp, H. sapiens
accattctggacattg

SEQ ID NO: 27612 - DNA, 16 bp, H. sapiens
accattctgggatctg

SEQ ID NO: 27613 - DNA, 16 bp, H. sapiens
accattctgtaggttg

SEQ ID NO: 27614 - DNA, 16 bp, H. sapiens
accattgcccaggctg

SEQ ID NO: 27615 - DNA, 16 bp, H. sapiens
accattggccattggt

SEQ ID NO: 27616 - DNA, 16 bp, H. sapiens
accattgtaaagtcaa

SEQ ID NO: 27617 - DNA, 16 bp, H. sapiens
accattgtgggagaca

SEQ ID NO: 27618 - DNA, 16 bp, H. sapiens
accattgttgaagaca

SEQ ID NO: 27619 - DNA, 16 bp, H. sapiens
accatttaaaaatgtt

SEQ ID NO: 27620 - DNA, 16 bp, H. sapiens
accatttataaaaatt

SEQ ID NO: 27621 - DNA, 16 bp, H. sapiens
accatttattaaaaag

SEQ ID NO: 27622 - DNA, 16 bp, H. sapiens
accatttattaaataa

SEQ ID NO: 27623 - DNA, 16 bp, H. sapiens
accatttattgaaaag

SEQ ID NO: 27624 - DNA, 16 bp, H. sapiens
accatttcacacccac

SEQ ID NO: 27625 - DNA, 16 bp, H. sapiens
accatttcccactaaa

SEQ ID NO: 27626 - DNA, 16 bp, H. sapiens
accatttctagctttt

SEQ ID NO: 27627 - DNA, 16 bp, H. sapiens
accatttgaccaagca

SEQ ID NO: 27628 - DNA, 16 bp, H. sapiens
accatttgataaaatt

SEQ ID NO: 27629 - DNA, 16 bp, H. sapiens
accatttggccaggct

SEQ ID NO: 27630 - DNA, 16 bp, H. sapiens
accatttgttaaatag

SEQ ID NO: 27631 - DNA, 16 bp, H. sapiens
accatttgttgaaaat

SEQ ID NO: 27632 - DNA, 16 bp, H. sapiens
accattttaagcattt

SEQ ID NO: 27633 - DNA, 16 bp, H. sapiens
accattttaataattt

SEQ ID NO: 27634 - DNA, 16 bp, H. sapiens
accattttacattcct

SEQ ID NO: 27635 - DNA, 16 bp, H. sapiens
accattttataaaagg

SEQ ID NO: 27636 - DNA, 16 bp, H. sapiens
accattttattaaaaa

SEQ ID NO: 27637 - DNA, 16 bp, H. sapiens
accattttgcatttcc

SEQ ID NO: 27638 - DNA, 16 bp, H. sapiens
accattttttaaaaag

SEQ ID NO: 27639 - DNA, 16 bp, H. sapiens
accattttttaaatag

SEQ ID NO: 27640 - DNA, 16 bp, H. sapiens
acccaaaagaatgaaa

SEQ ID NO: 27641 - DNA, 16 bp, H. sapiens
acccaaaagaatggaa

SEQ ID NO: 27642 - DNA, 16 bp, H. sapiens
acccaaaagaattaaa

SEQ ID NO: 27643 - DNA, 16 bp, H. sapiens
acccaaaagtcatttg

SEQ ID NO: 27644 - DNA, 18 bp, H. sapiens
acccaaaatctccttaag

SEQ ID NO: 27645 - DNA, 16 bp, H. sapiens
acccaaaggattaaaa

SEQ ID NO: 27646 - DNA, 16 bp, H. sapiens
acccaaagtcacacaa

SEQ ID NO: 27647 - DNA, 16 bp, H. sapiens
acccaaagtgctagga

SEQ ID NO: 27648 - DNA, 19 bp, H. sapiens
acccaaagtgctgggatta

SEQ ID NO: 27649 - DNA, 16 bp, H. sapiens
acccaaataagactac

SEQ ID NO: 27650 - DNA, 16 bp, H. sapiens
acccaaatacccatca

SEQ ID NO: 27651 - DNA, 16 bp, H. sapiens
acccaaatactcatca

SEQ ID NO: 27652 - DNA, 16 bp, H. sapiens
acccaaatatcatctt

SEQ ID NO: 27653 - DNA, 16 bp, H. sapiens
acccaaatctcacctg

SEQ ID NO: 27654 - DNA, 16 bp, H. sapiens
acccaaatgaaaagaa

SEQ ID NO: 27655 - DNA, 16 bp, H. sapiens
acccaaatgagaagaa

SEQ ID NO: 27656 - DNA, 16 bp, H. sapiens
acccaaatggccatca

SEQ ID NO: 27657 - DNA, 16 bp, H. sapiens
acccaaatgtgcaaca

SEQ ID NO: 27658 - DNA, 16 bp, H. sapiens
acccaaatttcatgtt

SEQ ID NO: 27659 - DNA, 16 bp, H. sapiens
acccaacacaggagca

SEQ ID NO: 27660 - DNA, 16 bp, H. sapiens
acccaaccatatcaat

SEQ ID NO: 27661 - DNA, 16 bp, H. sapiens
acccaactcctgagat

SEQ ID NO: 27662 - DNA, 16 bp, H. sapiens
acccaacttaaaacta

SEQ ID NO: 27663 - DNA, 16 bp, H. sapiens
acccaagaggtggaag

SEQ ID NO: 27664 - DNA, 16 bp, H. sapiens
acccaagatatggaat

SEQ ID NO: 27665 - DNA, 16 bp, H. sapiens
acccaagatcatgcca

SEQ ID NO: 27666 - DNA, 16 bp, H. sapiens
acccaagatggtgcca

SEQ ID NO: 27667 - DNA, 16 bp, H. sapiens
acccaagccagcagtg

SEQ ID NO: 27668 - DNA, 16 bp, H. sapiens
acccaagcccagcaga

SEQ ID NO: 27669 - DNA, 16 bp, H. sapiens
acccaaggagagtctg

SEQ ID NO: 27670 - DNA, 16 bp, H. sapiens
acccaaggaggcagag

SEQ ID NO: 27671 - DNA, 16 bp, H. sapiens
acccaataacagcaga

SEQ ID NO: 27672 - DNA, 16 bp, H. sapiens
acccaataagctgctt

SEQ ID NO: 27673 - DNA, 16 bp, H. sapiens
acccaatttctacaaa

SEQ ID NO: 27674 - DNA, 16 bp, H. sapiens
acccacaaaatggaag

SEQ ID NO: 27675 - DNA, 16 bp, H. sapiens
acccacaaccatgccc

SEQ ID NO: 27676 - DNA, 16 bp, H. sapiens
acccacacctgcacac

SEQ ID NO: 27677 - DNA, 16 bp, H. sapiens
acccacagaatcatga

SEQ ID NO: 27678 - DNA, 16 bp, H. sapiens
acccacagagaacaga

SEQ ID NO: 27679 - DNA, 16 bp, H. sapiens
acccacaggcccaaca

SEQ ID NO: 27680 - DNA, 16 bp, H. sapiens
acccacagtcacacag

SEQ ID NO: 27681 - DNA, 16 bp, H. sapiens
acccacagtcccagct

SEQ ID NO: 27682 - DNA, 16 bp, H. sapiens
acccacagtcctccag

SEQ ID NO: 27683 - DNA, 16 bp, H. sapiens
acccacatatttattg

SEQ ID NO: 27684 - DNA, 16 bp, H. sapiens
acccacccattcatcc

SEQ ID NO: 27685 - DNA, 16 bp, H. sapiens
acccaccccagggcct

SEQ ID NO: 27686 - DNA, 16 bp, H. sapiens
acccacccccatgatt

SEQ ID NO: 27687 - DNA, 16 bp, H. sapiens
acccaccgagccaggc

SEQ ID NO: 27688 - DNA, 16 bp, H. sapiens
acccacctcaacttcc

SEQ ID NO: 27689 - DNA, 17 bp, H. sapiens
acccacctcagcctcct

SEQ ID NO: 27690 - DNA, 16 bp, H. sapiens
acccacctcccagctg

SEQ ID NO: 27691 - DNA, 16 bp, H. sapiens
acccacctctgcctcc

SEQ ID NO: 27692 - DNA, 16 bp, H. sapiens
acccacctgcataata

SEQ ID NO: 27693 - DNA, 16 bp, H. sapiens
acccacctggccaaca

SEQ ID NO: 27694 - DNA, 19 bp, H. sapiens
acccaccttggcctcccag

SEQ ID NO: 27695 - DNA, 17 bp, H. sapiens
acccaccttggcctcct

SEQ ID NO: 27696 - DNA, 19 bp, H. sapiens
acccaccttggcttcccaa

SEQ ID NO: 27697 - DNA, 16 bp, H. sapiens
acccactagaatggct

SEQ ID NO: 27698 - DNA, 16 bp, H. sapiens
acccactccatgccag

SEQ ID NO: 27699 - DNA, 16 bp, H. sapiens
acccactgagccaggc

SEQ ID NO: 27700 - DNA, 16 bp, H. sapiens
acccactgcgcctggc

SEQ ID NO: 27701 - DNA, 16 bp, H. sapiens
acccactgctgggaga

SEQ ID NO: 27702 - DNA, 16 bp, H. sapiens
acccactgggctgcat

SEQ ID NO: 27703 - DNA, 16 bp, H. sapiens
acccacttcagcttcc

SEQ ID NO: 27704 - DNA, 16 bp, H. sapiens
acccacttgagaaggc

SEQ ID NO: 27705 - DNA, 16 bp, H. sapiens
acccactttgggtccc

SEQ ID NO: 27706 - DNA, 16 bp, H. sapiens
acccacttttggatgg

SEQ ID NO: 27707 - DNA, 16 bp, H. sapiens
acccagaaagaaatcc

SEQ ID NO: 27708 - DNA, 16 bp, H. sapiens
acccagaaattccatt

SEQ ID NO: 27709 - DNA, 16 bp, H. sapiens
acccagaactataaaa

SEQ ID NO: 27710 - DNA, 16 bp, H. sapiens
acccagaagaaaataa

SEQ ID NO: 27711 - DNA, 16 bp, H. sapiens
acccagaagaagaaag

SEQ ID NO: 27712 - DNA, 16 bp, H. sapiens
acccagaagctctcca

SEQ ID NO: 27713 - DNA, 16 bp, H. sapiens
acccagaaggcagaga

SEQ ID NO: 27714 - DNA, 16 bp, H. sapiens
acccagaaggtggagg

SEQ ID NO: 27715 - DNA, 16 bp, H. sapiens
acccagaataatgttt

SEQ ID NO: 27716 - DNA, 16 bp, H. sapiens
acccagactgaagtac

SEQ ID NO: 27717 - DNA, 16 bp, H. sapiens
acccagagaaaaccca

SEQ ID NO: 27718 - DNA, 16 bp, H. sapiens
acccagagaaaagatg

SEQ ID NO: 27719 - DNA, 16 bp, H. sapiens
acccagagaggttaag

SEQ ID NO: 27720 - DNA, 16 bp, H. sapiens
acccagagagtgagca

SEQ ID NO: 27721 - DNA, 16 bp, H. sapiens
acccagagattctgat

SEQ ID NO: 27722 - DNA, 16 bp, H. sapiens
acccagcaatccctct

SEQ ID NO: 27723 - DNA, 16 bp, H. sapiens
acccagcaatttcatt

SEQ ID NO: 27724 - DNA, 16 bp, H. sapiens
acccagcacacccagg

SEQ ID NO: 27725 - DNA, 16 bp, H. sapiens
acccagcactgtgctg

SEQ ID NO: 27726 - DNA, 16 bp, H. sapiens
acccagcactttggaa

SEQ ID NO: 27727 - DNA, 16 bp, H. sapiens
acccagcactttggga

SEQ ID NO: 27728 - DNA, 16 bp, H. sapiens
acccagcagaagaaaa

SEQ ID NO: 27729 - DNA, 16 bp, H. sapiens
acccagcagttccatt

SEQ ID NO: 27730 - DNA, 16 bp, H. sapiens
acccagccaggcacag

SEQ ID NO: 27731 - DNA, 16 bp, H. sapiens
acccagccagggaaac

SEQ ID NO: 27732 - DNA, 16 bp, H. sapiens
acccagccgtgtgagg

SEQ ID NO: 27733 - DNA, 16 bp, H. sapiens
acccagcctcaagttt

SEQ ID NO: 27734 - DNA, 16 bp, H. sapiens
acccagcctggagcgc

SEQ ID NO: 27735 - DNA, 16 bp, H. sapiens
acccagctaattgttt

SEQ ID NO: 27736 - DNA, 16 bp, H. sapiens
acccagctaattttcc

SEQ ID NO: 27737 - DNA, 16 bp, H. sapiens
acccagctaatttttt

SEQ ID NO: 27738 - DNA, 16 bp, H. sapiens
acccagctacttggga

SEQ ID NO: 27739 - DNA, 16 bp, H. sapiens
acccagctcatctcac

SEQ ID NO: 27740 - DNA, 16 bp, H. sapiens
acccaggaaatggagg

SEQ ID NO: 27741 - DNA, 16 bp, H. sapiens
acccaggaagagctga

SEQ ID NO: 27742 - DNA, 16 bp, H. sapiens
acccaggaaggggagg

SEQ ID NO: 27743 - DNA, 16 bp, H. sapiens
acccaggaatgtcttt

SEQ ID NO: 27744 - DNA, 16 bp, H. sapiens
acccaggaccagatgg

SEQ ID NO: 27745 - DNA, 16 bp, H. sapiens
acccaggacccaggac

SEQ ID NO: 27746 - DNA, 16 bp, H. sapiens
acccaggagaaggagc

SEQ ID NO: 27747 - DNA, 16 bp, H. sapiens
acccaggagacagatg

SEQ ID NO: 27748 - DNA, 16 bp, H. sapiens
acccaggagatggaag

SEQ ID NO: 27749 - DNA, 17 bp, H. sapiens
acccaggagatggagct

SEQ ID NO: 27750 - DNA, 16 bp, H. sapiens
acccaggagcagaggt

SEQ ID NO: 27751 - DNA, 16 bp, H. sapiens
acccaggaggaagagc

SEQ ID NO: 27752 - DNA, 16 bp, H. sapiens
acccaggaggagaagg

SEQ ID NO: 27753 - DNA, 16 bp, H. sapiens
acccaggaggaggtgg

SEQ ID NO: 27754 - DNA, 16 bp, H. sapiens
acccaggaggcggaag

SEQ ID NO: 27755 - DNA, 16 bp, H. sapiens
acccaggaggctgagg

SEQ ID NO: 27756 - DNA, 16 bp, H. sapiens
acccaggaggctggag

SEQ ID NO: 27757 - DNA, 16 bp, H. sapiens
acccaggagggtggag

SEQ ID NO: 27758 - DNA, 16 bp, H. sapiens
acccaggagggtgggg

SEQ ID NO: 27759 - DNA, 16 bp, H. sapiens
acccaggaggtagaag

SEQ ID NO: 27760 - DNA, 16 bp, H. sapiens
acccaggaggtggaga

SEQ ID NO: 27761 - DNA, 16 bp, H. sapiens
acccaggaggtggcag

SEQ ID NO: 27762 - DNA, 16 bp, H. sapiens
acccaggaggtgggag

SEQ ID NO: 27763 - DNA, 16 bp, H. sapiens
acccaggaggtggggc

SEQ ID NO: 27764 - DNA, 16 bp, H. sapiens
acccaggagtcagagg

SEQ ID NO: 27765 - DNA, 16 bp, H. sapiens
acccaggagtctgagg

SEQ ID NO: 27766 - DNA, 16 bp, H. sapiens
acccaggagtttgaga

SEQ ID NO: 27767 - DNA, 16 bp, H. sapiens
acccaggagtttgagg

SEQ ID NO: 27768 - DNA, 16 bp, H. sapiens
acccaggatgcggagg

SEQ ID NO: 27769 - DNA, 16 bp, H. sapiens
acccaggcaagcaggg

SEQ ID NO: 27770 - DNA, 16 bp, H. sapiens
acccaggcagaggagg

SEQ ID NO: 27771 - DNA, 16 bp, H. sapiens
acccaggcagatctcc

SEQ ID NO: 27772 - DNA, 16 bp, H. sapiens
acccaggcagcagagg

SEQ ID NO: 27773 - DNA, 16 bp, H. sapiens
acccaggcagcctggc

SEQ ID NO: 27774 - DNA, 16 bp, H. sapiens
acccaggcagcggagg

SEQ ID NO: 27775 - DNA, 16 bp, H. sapiens
acccaggcaggtggat

SEQ ID NO: 27776 - DNA, 16 bp, H. sapiens
acccaggctccaggcc

SEQ ID NO: 27777 - DNA, 16 bp, H. sapiens
acccaggctgcagtgt

SEQ ID NO: 27778 - DNA, 16 bp, H. sapiens
acccaggctggacttg

SEQ ID NO: 27779 - DNA, 16 bp, H. sapiens
acccaggctggagctg

SEQ ID NO: 27780 - DNA, 16 bp, H. sapiens
acccaggctggtctcg

SEQ ID NO: 27781 - DNA, 16 bp, H. sapiens
acccaggctttcccat

SEQ ID NO: 27782 - DNA, 16 bp, H. sapiens
acccagggaggagcaa

SEQ ID NO: 27783 - DNA, 16 bp, H. sapiens
acccagggggcagaga

SEQ ID NO: 27784 - DNA, 16 bp, H. sapiens
acccaggtacatgtcc

SEQ ID NO: 27785 - DNA, 16 bp, H. sapiens
acccaggtggtggagg

SEQ ID NO: 27786 - DNA, 16 bp, H. sapiens
acccaggtgtgtctga

SEQ ID NO: 27787 - DNA, 19 bp, H. sapiens
acccagtaactcgtcattt

SEQ ID NO: 27788 - DNA, 16 bp, H. sapiens
acccagtctcagacat

SEQ ID NO: 27789 - DNA, 16 bp, H. sapiens
acccagtctcaggcat

SEQ ID NO: 27790 - DNA, 16 bp, H. sapiens
acccagtctcaggtgt

SEQ ID NO: 27791 - DNA, 16 bp, H. sapiens
acccagtctgtggtat

SEQ ID NO: 27792 - DNA, 16 bp, H. sapiens
acccagtgaaaatatc

SEQ ID NO: 27793 - DNA, 16 bp, H. sapiens
acccagtgggaaataa

SEQ ID NO: 27794 - DNA, 16 bp, H. sapiens
acccagttaaatttga

SEQ ID NO: 27795 - DNA, 18 bp, H. sapiens
acccagttcctgatgaat

SEQ ID NO: 27796 - DNA, 16 bp, H. sapiens
acccagttctaaagtt

SEQ ID NO: 27797 - DNA, 16 bp, H. sapiens
acccagttttttgagg

SEQ ID NO: 27798 - DNA, 16 bp, H. sapiens
acccatacctgattta

SEQ ID NO: 27799 - DNA, 16 bp, H. sapiens
acccataggagtcctg

SEQ ID NO: 27800 - DNA, 16 bp, H. sapiens
acccatagtcccagct

SEQ ID NO: 27801 - DNA, 16 bp, H. sapiens
acccatcaacctgtca

SEQ ID NO: 27802 - DNA, 16 bp, H. sapiens
acccatcaccatgccc

SEQ ID NO: 27803 - DNA, 16 bp, H. sapiens
acccatcctaaaattc

SEQ ID NO: 27804 - DNA, 16 bp, H. sapiens
acccatctcaaatgca

SEQ ID NO: 27805 - DNA, 16 bp, H. sapiens
acccatctcacatgca

SEQ ID NO: 27806 - DNA, 16 bp, H. sapiens
acccatctcacgtgca

SEQ ID NO: 27807 - DNA, 16 bp, H. sapiens
acccatctctataaaa

SEQ ID NO: 27808 - DNA, 16 bp, H. sapiens
acccatctgacaatgg

SEQ ID NO: 27809 - DNA, 16 bp, H. sapiens
acccatcttatgtgca

SEQ ID NO: 27810 - DNA, 17 bp, H. sapiens
acccatgtccctgcaaa

SEQ ID NO: 27811 - DNA, 16 bp, H. sapiens
acccattaactagtca

SEQ ID NO: 27812 - DNA, 16 bp, H. sapiens
acccattagcagtcat

SEQ ID NO: 27813 - DNA, 16 bp, H. sapiens
acccattatttatttt

SEQ ID NO: 27814 - DNA, 16 bp, H. sapiens
acccattctctctcca

SEQ ID NO: 27815 - DNA, 16 bp, H. sapiens
acccattttgagttga

SEQ ID NO: 27816 - DNA, 16 bp, H. sapiens
accccaaaatatattt

SEQ ID NO: 27817 - DNA, 16 bp, H. sapiens
accccaaaatgtattt

SEQ ID NO: 27818 - DNA, 16 bp, H. sapiens
accccaaagccccaga

SEQ ID NO: 27819 - DNA, 16 bp, H. sapiens
accccaaatggaggga

SEQ ID NO: 27820 - DNA, 16 bp, H. sapiens
accccaaatgtccatc

SEQ ID NO: 27821 - DNA, 16 bp, H. sapiens
accccaagacaggccc

SEQ ID NO: 27822 - DNA, 16 bp, H. sapiens
accccaagggaagaat

SEQ ID NO: 27823 - DNA, 16 bp, H. sapiens
accccacaacagtccc

SEQ ID NO: 27824 - DNA, 19 bp, H. sapiens
accccacaaggtggcagtt

SEQ ID NO: 27825 - DNA, 17 bp, H. sapiens
accccacagaaatacaa

SEQ ID NO: 27826 - DNA, 16 bp, H. sapiens
accccacagcagtccc

SEQ ID NO: 27827 - DNA, 16 bp, H. sapiens
accccaccaggactgg

SEQ ID NO: 27828 - DNA, 16 bp, H. sapiens
accccaccccagacct

SEQ ID NO: 27829 - DNA, 16 bp, H. sapiens
accccacccccagctt

SEQ ID NO: 27830 - DNA, 16 bp, H. sapiens
accccaccctgggcaa

SEQ ID NO: 27831 - DNA, 16 bp, H. sapiens
accccaccctgggtga

SEQ ID NO: 27832 - DNA, 16 bp, H. sapiens
accccaccttcaagcc

SEQ ID NO: 27833 - DNA, 16 bp, H. sapiens
accccacctttactaa

SEQ ID NO: 27834 - DNA, 16 bp, H. sapiens
accccactgtggctga

SEQ ID NO: 27835 - DNA, 16 bp, H. sapiens
accccactgttaatat

SEQ ID NO: 27836 - DNA, 16 bp, H. sapiens
accccagaaagaaacc

SEQ ID NO: 27837 - DNA, 16 bp, H. sapiens
accccagaagaaaacc

SEQ ID NO: 27838 - DNA, 16 bp, H. sapiens
accccagaatgtgacc

SEQ ID NO: 27839 - DNA, 16 bp, H. sapiens
accccagacttactga

SEQ ID NO: 27840 - DNA, 16 bp, H. sapiens
accccagagactgagc

SEQ ID NO: 27841 - DNA, 16 bp, H. sapiens
accccagaggtggagt

SEQ ID NO: 27842 - DNA, 16 bp, H. sapiens
accccagatcaacaga

SEQ ID NO: 27843 - DNA, 16 bp, H. sapiens
accccagcaggttagg

SEQ ID NO: 27844 - DNA, 16 bp, H. sapiens
accccagccccaggca

SEQ ID NO: 27845 - DNA, 16 bp, H. sapiens
accccagcctcctgag

SEQ ID NO: 27846 - DNA, 16 bp, H. sapiens
accccagcctcttgag

SEQ ID NO: 27847 - DNA, 16 bp, H. sapiens
accccagcctggacaa

SEQ ID NO: 27848 - DNA, 16 bp, H. sapiens
accccagcctgggcca

SEQ ID NO: 27849 - DNA, 16 bp, H. sapiens
accccagcctgggtgg

SEQ ID NO: 27850 - DNA, 16 bp, H. sapiens
accccagctggtgtct

SEQ ID NO: 27851 - DNA, 16 bp, H. sapiens
accccagggggtggag

SEQ ID NO: 27852 - DNA, 16 bp, H. sapiens
accccagtcagaatgg

SEQ ID NO: 27853 - DNA, 16 bp, H. sapiens
accccagtctaatcat

SEQ ID NO: 27854 - DNA, 16 bp, H. sapiens
accccagtctcagccc

SEQ ID NO: 27855 - DNA, 16 bp, H. sapiens
accccagtgcctcctg

SEQ ID NO: 27856 - DNA, 16 bp, H. sapiens
accccagtgcctggca

SEQ ID NO: 27857 - DNA, 16 bp, H. sapiens
accccagtgtgtgatg

SEQ ID NO: 27858 - DNA, 16 bp, H. sapiens
accccataggcagtgt

SEQ ID NO: 27859 - DNA, 16 bp, H. sapiens
accccatcactacaaa

SEQ ID NO: 27860 - DNA, 16 bp, H. sapiens
accccatcccccacag

SEQ ID NO: 27861 - DNA, 16 bp, H. sapiens
accccatctcaaacaa

SEQ ID NO: 27862 - DNA, 16 bp, H. sapiens
accccatctcaaagaa

SEQ ID NO: 27863 - DNA, 16 bp, H. sapiens
accccatctctaaaac

SEQ ID NO: 27864 - DNA, 16 bp, H. sapiens
accccatctctacaat

SEQ ID NO: 27865 - DNA, 16 bp, H. sapiens
accccatctctctctt

SEQ ID NO: 27866 - DNA, 16 bp, H. sapiens
accccatctctgctga

SEQ ID NO: 27867 - DNA, 16 bp, H. sapiens
accccatcttccatga

SEQ ID NO: 27868 - DNA, 16 bp, H. sapiens
accccattctcccagt

SEQ ID NO: 27869 - DNA, 16 bp, H. sapiens
accccatttctagaaa

SEQ ID NO: 27870 - DNA, 16 bp, H. sapiens
accccattttgcagat

SEQ ID NO: 27871 - DNA, 16 bp, H. sapiens
acccccaaagtgctgg

SEQ ID NO: 27872 - DNA, 16 bp, H. sapiens
acccccacacctggct

SEQ ID NO: 27873 - DNA, 16 bp, H. sapiens
acccccacagggctgg

SEQ ID NO: 27874 - DNA, 16 bp, H. sapiens
acccccaccccatgac

SEQ ID NO: 27875 - DNA, 16 bp, H. sapiens
acccccacctccaggg

SEQ ID NO: 27876 - DNA, 16 bp, H. sapiens
acccccacctcccaag

SEQ ID NO: 27877 - DNA, 16 bp, H. sapiens
acccccagaggcccag

SEQ ID NO: 27878 - DNA, 16 bp, H. sapiens
acccccagaggtggag

SEQ ID NO: 27879 - DNA, 16 bp, H. sapiens
acccccagcaccctca

SEQ ID NO: 27880 - DNA, 16 bp, H. sapiens
acccccagctaatttt

SEQ ID NO: 27881 - DNA, 16 bp, H. sapiens
acccccaggacctcag

SEQ ID NO: 27882 - DNA, 16 bp, H. sapiens
acccccagtgcctgga

SEQ ID NO: 27883 - DNA, 16 bp, H. sapiens
acccccatctctattt

SEQ ID NO: 27884 - DNA, 16 bp, H. sapiens
acccccatgagtcaat

SEQ ID NO: 27885 - DNA, 16 bp, H. sapiens
acccccatgcccagct

SEQ ID NO: 27886 - DNA, 16 bp, H. sapiens
acccccatgcctggct

SEQ ID NO: 27887 - DNA, 16 bp, H. sapiens
accccccagcccctgg

SEQ ID NO: 27888 - DNA, 16 bp, H. sapiens
acccccgcctcccggg

SEQ ID NO: 27889 - DNA, 16 bp, H. sapiens
accccctccaccaagg

SEQ ID NO: 27890 - DNA, 16 bp, H. sapiens
accccctgataggccc

SEQ ID NO: 27891 - DNA, 16 bp, H. sapiens
acccccttagagttgt

SEQ ID NO: 27892 - DNA, 16 bp, H. sapiens
acccccttcctgcctg

SEQ ID NO: 27893 - DNA, 16 bp, H. sapiens
acccccttccttatca

SEQ ID NO: 27894 - DNA, 16 bp, H. sapiens
accccgccaccttgct

SEQ ID NO: 27895 - DNA, 16 bp, H. sapiens
accccggcctcccaaa

SEQ ID NO: 27896 - DNA, 16 bp, H. sapiens
accccgtctcaaaaat

SEQ ID NO: 27897 - DNA, 16 bp, H. sapiens
accccgtctccaccca

SEQ ID NO: 27898 - DNA, 16 bp, H. sapiens
accccgtctctacaca

SEQ ID NO: 27899 - DNA, 16 bp, H. sapiens
acccctcaccagattg

SEQ ID NO: 27900 - DNA, 16 bp, H. sapiens
acccctctctctgcag

SEQ ID NO: 27901 - DNA, 16 bp, H. sapiens
acccctctgacaaggg

SEQ ID NO: 27902 - DNA, 19 bp, H. sapiens
acccctgacctagcaactg

SEQ ID NO: 27903 - DNA, 16 bp, H. sapiens
acccctgacctcaagc

SEQ ID NO: 27904 - DNA, 16 bp, H. sapiens
acccctgagcacaaag

SEQ ID NO: 27905 - DNA, 16 bp, H. sapiens
acccctgccagccaga

SEQ ID NO: 27906 - DNA, 16 bp, H. sapiens
acccctgccctcctgg

SEQ ID NO: 27907 - DNA, 16 bp, H. sapiens
acccctgcctcccagg

SEQ ID NO: 27908 - DNA, 16 bp, H. sapiens
acccctgcctccctgg

SEQ ID NO: 27909 - DNA, 16 bp, H. sapiens
acccctgctgggaggt

SEQ ID NO: 27910 - DNA, 16 bp, H. sapiens
acccctggaccaaccc

SEQ ID NO: 27911 - DNA, 16 bp, H. sapiens
acccctggcagctgcg

SEQ ID NO: 27912 - DNA, 16 bp, H. sapiens
acccctgggctcaaga

SEQ ID NO: 27913 - DNA, 16 bp, H. sapiens
acccctgggctcaagt

SEQ ID NO: 27914 - DNA, 16 bp, H. sapiens
acccctgtactccagc

SEQ ID NO: 27915 - DNA, 16 bp, H. sapiens
acccctgtctcccagg

SEQ ID NO: 27916 - DNA, 16 bp, H. sapiens
acccctgtctctcacc

SEQ ID NO: 27917 - DNA, 16 bp, H. sapiens
acccctgtgacacaca

SEQ ID NO: 27918 - DNA, 16 bp, H. sapiens
acccctgtggctctgc

SEQ ID NO: 27919 - DNA, 16 bp, H. sapiens
acccctgtggtcacca

SEQ ID NO: 27920 - DNA, 16 bp, H. sapiens
accccttccccagcct

SEQ ID NO: 27921 - DNA, 16 bp, H. sapiens
accccttctacaaaac

SEQ ID NO: 27922 - DNA, 16 bp, H. sapiens
accccttctcctccaa

SEQ ID NO: 27923 - DNA, 16 bp, H. sapiens
accccttctctacaaa

SEQ ID NO: 27924 - DNA, 16 bp, H. sapiens
accccttgcacttccc

SEQ ID NO: 27925 - DNA, 16 bp, H. sapiens
acccctttcctgtaac

SEQ ID NO: 27926 - DNA, 16 bp, H. sapiens
acccctttctttgtgg

SEQ ID NO: 27927 - DNA, 16 bp, H. sapiens
acccgaaaatgtggaa

SEQ ID NO: 27928 - DNA, 16 bp, H. sapiens
acccgagaggtggaga

SEQ ID NO: 27929 - DNA, 16 bp, H. sapiens
acccgagattgtgcca

SEQ ID NO: 27930 - DNA, 27 bp, H. sapiens
acccgccaccatgcccggctaattttt

SEQ ID NO: 27931 - DNA, 16 bp, H. sapiens
acccgccaccatgtct

SEQ ID NO: 27932 - DNA, 16 bp, H. sapiens
acccgcctcagccacc

SEQ ID NO: 27933 - DNA, 16 bp, H. sapiens
acccggaactccagct

SEQ ID NO: 27934 - DNA, 17 bp, H. sapiens
acccggctaatttttta

SEQ ID NO: 27935 - DNA, 16 bp, H. sapiens
acccgggagaaggagg

SEQ ID NO: 27936 - DNA, 16 bp, H. sapiens
acccgggagctggagg

SEQ ID NO: 27937 - DNA, 17 bp, H. sapiens
acccgggaggccgagct

SEQ ID NO: 27938 - DNA, 16 bp, H. sapiens
acccgggaggcggtgg

SEQ ID NO: 27939 - DNA, 16 bp, H. sapiens
acccgggaggtggagg

SEQ ID NO: 27940 - DNA, 16 bp, H. sapiens
acccgggagtttgagg

SEQ ID NO: 27941 - DNA, 16 bp, H. sapiens
acccgggcggtggagg

SEQ ID NO: 27942 - DNA, 16 bp, H. sapiens
acccggggggctgagg

SEQ ID NO: 27943 - DNA, 16 bp, H. sapiens
acccgtgaggtggagg

SEQ ID NO: 27944 - DNA, 16 bp, H. sapiens
accctaaaactgaaag

SEQ ID NO: 27945 - DNA, 16 bp, H. sapiens
accctaaatcaacaga

SEQ ID NO: 27946 - DNA, 16 bp, H. sapiens
accctacaagctggaa

SEQ ID NO: 27947 - DNA, 16 bp, H. sapiens
accctacagtgcacag

SEQ ID NO: 27948 - DNA, 16 bp, H. sapiens
accctacctccattaa

SEQ ID NO: 27949 - DNA, 16 bp, H. sapiens
accctagctggagtgc

SEQ ID NO: 27950 - DNA, 16 bp, H. sapiens
accctataagccagaa

SEQ ID NO: 27951 - DNA, 16 bp, H. sapiens
accctatttaaaactg

SEQ ID NO: 27952 - DNA, 16 bp, H. sapiens
accctcaaagggaagc

SEQ ID NO: 27953 - DNA, 16 bp, H. sapiens
accctcaacctcccag

SEQ ID NO: 27954 - DNA, 16 bp, H. sapiens
accctcaataaatatt

SEQ ID NO: 27955 - DNA, 16 bp, H. sapiens
accctcacagagtcca

SEQ ID NO: 27956 - DNA, 16 bp, H. sapiens
accctcagaaactgtg

SEQ ID NO: 27957 - DNA, 16 bp, H. sapiens
accctcaggtcaggag

SEQ ID NO: 27958 - DNA, 16 bp, H. sapiens
accctcatggcctaat

SEQ ID NO: 27959 - DNA, 16 bp, H. sapiens
accctccagcctgggc

SEQ ID NO: 27960 - DNA, 16 bp, H. sapiens
accctccatcctgggc

SEQ ID NO: 27961 - DNA, 16 bp, H. sapiens
accctccgcagccact

SEQ ID NO: 27962 - DNA, 16 bp, H. sapiens
accctcctccctttgg

SEQ ID NO: 27963 - DNA, 16 bp, H. sapiens
accctctccccagaaa

SEQ ID NO: 27964 - DNA, 16 bp, H. sapiens
accctctctggaatgg

SEQ ID NO: 27965 - DNA, 16 bp, H. sapiens
accctctgcctcctgg

SEQ ID NO: 27966 - DNA, 16 bp, H. sapiens
accctctgcttcctgg

SEQ ID NO: 27967 - DNA, 16 bp, H. sapiens
accctctgggatgaag

SEQ ID NO: 27968 - DNA, 16 bp, H. sapiens
accctcttcagtgcct

SEQ ID NO: 27969 - DNA, 16 bp, H. sapiens
accctgaaaaagaaca

SEQ ID NO: 27970 - DNA, 16 bp, H. sapiens
accctgaagactccac

SEQ ID NO: 27971 - DNA, 16 bp, H. sapiens
accctgaaggcagagg

SEQ ID NO: 27972 - DNA, 16 bp, H. sapiens
accctgaataaccaaa

SEQ ID NO: 27973 - DNA, 16 bp, H. sapiens
accctgagaatgaccc

SEQ ID NO: 27974 - DNA, 16 bp, H. sapiens
accctgagaggcagag

SEQ ID NO: 27975 - DNA, 16 bp, H. sapiens
accctgagctgctggg

SEQ ID NO: 27976 - DNA, 16 bp, H. sapiens
accctgatgaagctgg

SEQ ID NO: 27977 - DNA, 16 bp, H. sapiens
accctgatgtgattac

SEQ ID NO: 27978 - DNA, 16 bp, H. sapiens
accctgatgtggttat

SEQ ID NO: 27979 - DNA, 16 bp, H. sapiens
accctgcaaagccaca

SEQ ID NO: 27980 - DNA, 16 bp, H. sapiens
accctgccatgtgagg

SEQ ID NO: 27981 - DNA, 16 bp, H. sapiens
accctgccgacacctt

SEQ ID NO: 27982 - DNA, 16 bp, H. sapiens
accctgcctgaaaaaa

SEQ ID NO: 27983 - DNA, 16 bp, H. sapiens
accctgcctgtactaa

SEQ ID NO: 27984 - DNA, 16 bp, H. sapiens
accctgctgaccaaaa

SEQ ID NO: 27985 - DNA, 16 bp, H. sapiens
accctgctggccaggc

SEQ ID NO: 27986 - DNA, 17 bp, H. sapiens
accctgcttattcctgt

SEQ ID NO: 27987 - DNA, 16 bp, H. sapiens
accctgcttcaaaaaa

SEQ ID NO: 27988 - DNA, 16 bp, H. sapiens
accctgctttggctca

SEQ ID NO: 27989 - DNA, 16 bp, H. sapiens
accctggagacagagg

SEQ ID NO: 27990 - DNA, 16 bp, H. sapiens
accctggaggaggagg

SEQ ID NO: 27991 - DNA, 16 bp, H. sapiens
accctggaggtggagc

SEQ ID NO: 27992 - DNA, 17 bp, H. sapiens
accctggaggtggagct

SEQ ID NO: 27993 - DNA, 16 bp, H. sapiens
accctggccaacaagg

SEQ ID NO: 27994 - DNA, 16 bp, H. sapiens
accctggccctggccc

SEQ ID NO: 27995 - DNA, 16 bp, H. sapiens
accctggcctctaccc

SEQ ID NO: 27996 - DNA, 21 bp, H. sapiens
accctggctaacatggtgaaa

SEQ ID NO: 27997 - DNA, 16 bp, H. sapiens
accctggctggagtgg

SEQ ID NO: 27998 - DNA, 16 bp, H. sapiens
accctgggcaacagag

SEQ ID NO: 27999 - DNA, 16 bp, H. sapiens
accctgggcaacgtgg

SEQ ID NO: 28000 - DNA, 16 bp, H. sapiens
accctgggccagaaag

SEQ ID NO: 28001 - DNA, 16 bp, H. sapiens
accctgggcctggccc

SEQ ID NO: 28002 - DNA, 16 bp, H. sapiens
accctgggctcaagtg

SEQ ID NO: 28003 - DNA, 16 bp, H. sapiens
accctggtgcttcccc

SEQ ID NO: 28004 - DNA, 16 bp, H. sapiens
accctgtcaagaaaga

SEQ ID NO: 28005 - DNA, 16 bp, H. sapiens
accctgtccctgccct

SEQ ID NO: 28006 - DNA, 16 bp, H. sapiens
accctgtctatggtat

SEQ ID NO: 28007 - DNA, 16 bp, H. sapiens
accctgtctcgaaaga

SEQ ID NO: 28008 - DNA, 16 bp, H. sapiens
accctgtctctaccag

SEQ ID NO: 28009 - DNA, 16 bp, H. sapiens
accctgtctgtaaaaa

SEQ ID NO: 28010 - DNA, 16 bp, H. sapiens
accctgtctttaaaaa

SEQ ID NO: 28011 - DNA, 16 bp, H. sapiens
accctgtcttttaaaa

SEQ ID NO: 28012 - DNA, 16 bp, H. sapiens
accctgtgtttaaaaa

SEQ ID NO: 28013 - DNA, 16 bp, H. sapiens
acccttaaaaaaatca

SEQ ID NO: 28014 - DNA, 16 bp, H. sapiens
acccttatctctttct

SEQ ID NO: 28015 - DNA, 16 bp, H. sapiens
acccttcaaaaaaatt

SEQ ID NO: 28016 - DNA, 16 bp, H. sapiens
acccttcaaaaaatga

SEQ ID NO: 28017 - DNA, 16 bp, H. sapiens
acccttcccagcctca

SEQ ID NO: 28018 - DNA, 16 bp, H. sapiens
acccttcccagcctct

SEQ ID NO: 28019 - DNA, 16 bp, H. sapiens
acccttccctgcctct

SEQ ID NO: 28020 - DNA, 17 bp, H. sapiens
acccttctatagaagta

SEQ ID NO: 28021 - DNA, 16 bp, H. sapiens
acccttgcagacacac

SEQ ID NO: 28022 - DNA, 16 bp, H. sapiens
acccttgcagtgagtg

SEQ ID NO: 28023 - DNA, 16 bp, H. sapiens
acccttggctcagccc

SEQ ID NO: 28024 - DNA, 16 bp, H. sapiens
acccttgtgcattgct

SEQ ID NO: 28025 - DNA, 16 bp, H. sapiens
accctttcaacaactc

SEQ ID NO: 28026 - DNA, 16 bp, H. sapiens
accctttgtgtgtgtg

SEQ ID NO: 28027 - DNA, 16 bp, H. sapiens
accgaggcgggtggat

SEQ ID NO: 28028 - DNA, 16 bp, H. sapiens
accgaggtgggtggat

SEQ ID NO: 28029 - DNA, 16 bp, H. sapiens
accgcatccacaccaa

SEQ ID NO: 28030 - DNA, 16 bp, H. sapiens
accgccacacccggct

SEQ ID NO: 28031 - DNA, 16 bp, H. sapiens
accgccacctcccagg

SEQ ID NO: 28032 - DNA, 16 bp, H. sapiens
accgcctgccttggcc

SEQ ID NO: 28033 - DNA, 16 bp, H. sapiens
accgcgcccagccgca

SEQ ID NO: 28034 - DNA, 16 bp, H. sapiens
accgcgcccggccgtg

SEQ ID NO: 28035 - DNA, 17 bp, H. sapiens
accgcgcccggctaatt

SEQ ID NO: 28036 - DNA, 16 bp, H. sapiens
accgcgcctggccaaa

SEQ ID NO: 28037 - DNA, 16 bp, H. sapiens
accgcgcctggccagc

SEQ ID NO: 28038 - DNA, 16 bp, H. sapiens
accgcgcctggccggg

SEQ ID NO: 28039 - DNA, 16 bp, H. sapiens
accgcgttggccaggc

SEQ ID NO: 28040 - DNA, 18 bp, H. sapiens
accggagctgttcctatt

SEQ ID NO: 28041 - DNA, 16 bp, H. sapiens
accgggacccgggagg

SEQ ID NO: 28042 - DNA, 16 bp, H. sapiens
accgggagacagaggt

SEQ ID NO: 28043 - DNA, 16 bp, H. sapiens
accgggaggcagaggc

SEQ ID NO: 28044 - DNA, 18 bp, H. sapiens
accgggcgcggtggctca

SEQ ID NO: 28045 - DNA, 16 bp, H. sapiens
accgggcgtggtggct

SEQ ID NO: 28046 - DNA, 16 bp, H. sapiens
accggggaggtggagg

SEQ ID NO: 28047 - DNA, 18 bp, H. sapiens
accgggttcaagagattc

SEQ ID NO: 28048 - DNA, 16 bp, H. sapiens
accgtcattctcagca

SEQ ID NO: 28049 - DNA, 16 bp, H. sapiens
accgtgcccagcctcc

SEQ ID NO: 28050 - DNA, 16 bp, H. sapiens
accgtgcccggcccac

SEQ ID NO: 28051 - DNA, 16 bp, H. sapiens
accgtgcccggctcca

SEQ ID NO: 28052 - DNA, 16 bp, H. sapiens
accgtgcctggctact

SEQ ID NO: 28053 - DNA, 16 bp, H. sapiens
accgtgcctggctgga

SEQ ID NO: 28054 - DNA, 16 bp, H. sapiens
acctaaaaatgtggaa

SEQ ID NO: 28055 - DNA, 16 bp, H. sapiens
acctaaaaccttaaaa

SEQ ID NO: 28056 - DNA, 16 bp, H. sapiens
acctaaaagggaaggg

SEQ ID NO: 28057 - DNA, 16 bp, H. sapiens
acctaaaattattttt

SEQ ID NO: 28058 - DNA, 16 bp, H. sapiens
acctaaacctcacacc

SEQ ID NO: 28059 - DNA, 16 bp, H. sapiens
acctaaaggaactaga

SEQ ID NO: 28060 - DNA, 16 bp, H. sapiens
acctaaatataaaagc

SEQ ID NO: 28061 - DNA, 16 bp, H. sapiens
acctaaatgtccagca

SEQ ID NO: 28062 - DNA, 16 bp, H. sapiens
acctaacaaaaacaag

SEQ ID NO: 28063 - DNA, 16 bp, H. sapiens
acctaagagtgaaatt

SEQ ID NO: 28064 - DNA, 16 bp, H. sapiens
acctaagagtgagaac

SEQ ID NO: 28065 - DNA, 16 bp, H. sapiens
acctaagcctcccaag

SEQ ID NO: 28066 - DNA, 17 bp, H. sapiens
acctaaggtcgggagtt

SEQ ID NO: 28067 - DNA, 16 bp, H. sapiens
acctaaggtgatccac

SEQ ID NO: 28068 - DNA, 16 bp, H. sapiens
acctaagtgtccagca

SEQ ID NO: 28069 - DNA, 16 bp, H. sapiens
acctaataaatattta

SEQ ID NO: 28070 - DNA, 16 bp, H. sapiens
acctaattaaactaaa

SEQ ID NO: 28071 - DNA, 16 bp, H. sapiens
acctaattaaagagct

SEQ ID NO: 28072 - DNA, 16 bp, H. sapiens
acctaattacctctca

SEQ ID NO: 28073 - DNA, 16 bp, H. sapiens
acctaatttggaaata

SEQ ID NO: 28074 - DNA, 16 bp, H. sapiens
acctaatttttgtatt

SEQ ID NO: 28075 - DNA, 16 bp, H. sapiens
acctacaactataaaa

SEQ ID NO: 28076 - DNA, 16 bp, H. sapiens
acctacagctatctga

SEQ ID NO: 28077 - DNA, 16 bp, H. sapiens
acctacaggatgggag

SEQ ID NO: 28078 - DNA, 16 bp, H. sapiens
acctaccagctgtgtg

SEQ ID NO: 28079 - DNA, 16 bp, H. sapiens
acctaccatgtaccca

SEQ ID NO: 28080 - DNA, 16 bp, H. sapiens
acctacctatgacctg

SEQ ID NO: 28081 - DNA, 16 bp, H. sapiens
acctacctcacagagt

SEQ ID NO: 28082 - DNA, 16 bp, H. sapiens
acctacgcctcccagg

SEQ ID NO: 28083 - DNA, 16 bp, H. sapiens
acctactaaaaataca

SEQ ID NO: 28084 - DNA, 16 bp, H. sapiens
acctactaaaggacat

SEQ ID NO: 28085 - DNA, 16 bp, H. sapiens
acctactaaattagaa

SEQ ID NO: 28086 - DNA, 16 bp, H. sapiens
acctactagatgccag

SEQ ID NO: 28087 - DNA, 16 bp, H. sapiens
acctactaggtaccca

SEQ ID NO: 28088 - DNA, 16 bp, H. sapiens
acctactaggtgccag

SEQ ID NO: 28089 - DNA, 16 bp, H. sapiens
acctactcatttgaca

SEQ ID NO: 28090 - DNA, 16 bp, H. sapiens
acctactcccccactg

SEQ ID NO: 28091 - DNA, 16 bp, H. sapiens
acctactgaatcagaa

SEQ ID NO: 28092 - DNA, 16 bp, H. sapiens
acctactgaattagaa

SEQ ID NO: 28093 - DNA, 16 bp, H. sapiens
acctactgagacacca

SEQ ID NO: 28094 - DNA, 16 bp, H. sapiens
acctactgggttcaag

SEQ ID NO: 28095 - DNA, 16 bp, H. sapiens
acctagaaaaaatgga

SEQ ID NO: 28096 - DNA, 16 bp, H. sapiens
acctagaaaaacctaa

SEQ ID NO: 28097 - DNA, 16 bp, H. sapiens
acctagagaatgggag

SEQ ID NO: 28098 - DNA, 16 bp, H. sapiens
acctagatgaaatgga

SEQ ID NO: 28099 - DNA, 16 bp, H. sapiens
acctagctaatttttt

SEQ ID NO: 28100 - DNA, 17 bp, H. sapiens
acctaggctggagtaca

SEQ ID NO: 28101 - DNA, 16 bp, H. sapiens
acctataaatatatac

SEQ ID NO: 28102 - DNA, 16 bp, H. sapiens
acctataatcctagct

SEQ ID NO: 28103 - DNA, 17 bp, H. sapiens
acctatatctgcctccc

SEQ ID NO: 28104 - DNA, 16 bp, H. sapiens
acctatcaactcatca

SEQ ID NO: 28105 - DNA, 16 bp, H. sapiens
acctatcaatccatca

SEQ ID NO: 28106 - DNA, 16 bp, H. sapiens
acctatgatcatgcca

SEQ ID NO: 28107 - DNA, 16 bp, H. sapiens
acctatgcctcctggg

SEQ ID NO: 28108 - DNA, 16 bp, H. sapiens
acctatggttccagct

SEQ ID NO: 28109 - DNA, 16 bp, H. sapiens
acctattgaaggatat

SEQ ID NO: 28110 - DNA, 16 bp, H. sapiens
acctattgaatcagaa

SEQ ID NO: 28111 - DNA, 16 bp, H. sapiens
acctattgggtactgt

SEQ ID NO: 28112 - DNA, 16 bp, H. sapiens
acctcaaaaacatcat

SEQ ID NO: 28113 - DNA, 16 bp, H. sapiens
acctcaaactcagcat

SEQ ID NO: 28114 - DNA, 16 bp, H. sapiens
acctcaaagactgaag

SEQ ID NO: 28115 - DNA, 16 bp, H. sapiens
acctcaaatatataca

SEQ ID NO: 28116 - DNA, 16 bp, H. sapiens
acctcaaatgacccac

SEQ ID NO: 28117 - DNA, 16 bp, H. sapiens
acctcaaattcctgag

SEQ ID NO: 28118 - DNA, 16 bp, H. sapiens
acctcaacaaatttaa

SEQ ID NO: 28119 - DNA, 16 bp, H. sapiens
acctcaacactttggg

SEQ ID NO: 28120 - DNA, 16 bp, H. sapiens
acctcaacctctggag

SEQ ID NO: 28121 - DNA, 16 bp, H. sapiens
acctcaacctggactt

SEQ ID NO: 28122 - DNA, 16 bp, H. sapiens
acctcaagatccacct

SEQ ID NO: 28123 - DNA, 16 bp, H. sapiens
acctcaaggaactaga

SEQ ID NO: 28124 - DNA, 16 bp, H. sapiens
acctcaagtgaactgc

SEQ ID NO: 28125 - DNA, 23 bp, H. sapiens
acctcaagtgatccacccgcctc

SEQ ID NO: 28126 - DNA, 16 bp, H. sapiens
acctcaatacaataaa

SEQ ID NO: 28127 - DNA, 16 bp, H. sapiens
acctcaatctcaaggc

SEQ ID NO: 28128 - DNA, 16 bp, H. sapiens
acctcaattcttggct

SEQ ID NO: 28129 - DNA, 16 bp, H. sapiens
acctcacacagccggg

SEQ ID NO: 28130 - DNA, 16 bp, H. sapiens
acctcacaccagtcag

SEQ ID NO: 28131 - DNA, 16 bp, H. sapiens
acctcacactgcaggg

SEQ ID NO: 28132 - DNA, 16 bp, H. sapiens
acctcacatggttgtt

SEQ ID NO: 28133 - DNA, 16 bp, H. sapiens
acctcacccagccaag

SEQ ID NO: 28134 - DNA, 16 bp, H. sapiens
acctcacccagcctaa

SEQ ID NO: 28135 - DNA, 16 bp, H. sapiens
acctcacccagctccc

SEQ ID NO: 28136 - DNA, 18 bp, H. sapiens
acctcacgtgcagagaca

SEQ ID NO: 28137 - DNA, 16 bp, H. sapiens
acctcactatgtcccc

SEQ ID NO: 28138 - DNA, 16 bp, H. sapiens
acctcactgcagcctc

SEQ ID NO: 28139 - DNA, 16 bp, H. sapiens
acctcagaacctctgc

SEQ ID NO: 28140 - DNA, 16 bp, H. sapiens
acctcagaatgtcact

SEQ ID NO: 28141 - DNA, 16 bp, H. sapiens
acctcagaatgtgact

SEQ ID NO: 28142 - DNA, 16 bp, H. sapiens
acctcagacaatccac

SEQ ID NO: 28143 - DNA, 16 bp, H. sapiens
acctcagaggcagagg

SEQ ID NO: 28144 - DNA, 16 bp, H. sapiens
acctcagcagcatctg

SEQ ID NO: 28145 - DNA, 16 bp, H. sapiens
acctcagccccactct

SEQ ID NO: 28146 - DNA, 16 bp, H. sapiens
acctcagccccccaga

SEQ ID NO: 28147 - DNA, 16 bp, H. sapiens
acctcagccgcctgag

SEQ ID NO: 28148 - DNA, 16 bp, H. sapiens
acctcagcctcagcct

SEQ ID NO: 28149 - DNA, 18 bp, H. sapiens
acctcagcctcccgagta

SEQ ID NO: 28150 - DNA, 16 bp, H. sapiens
acctcagcctccggag

SEQ ID NO: 28151 - DNA, 18 bp, H. sapiens
acctcagcctcctgagta

SEQ ID NO: 28152 - DNA, 23 bp, H. sapiens
acctcagcctcctgagtagctag

SEQ ID NO: 28153 - DNA, 24 bp, H. sapiens
acctcagcctcctgagtagctgga

SEQ ID NO: 28154 - DNA, 16 bp, H. sapiens
acctcagcctgaattt

SEQ ID NO: 28155 - DNA, 16 bp, H. sapiens
acctcagcctggattt

SEQ ID NO: 28156 - DNA, 16 bp, H. sapiens
acctcagctcactgca

SEQ ID NO: 28157 - DNA, 17 bp, H. sapiens
acctcagcttcccaaag

SEQ ID NO: 28158 - DNA, 16 bp, H. sapiens
acctcagcttcctgaa

SEQ ID NO: 28159 - DNA, 16 bp, H. sapiens
acctcaggaaacttac

SEQ ID NO: 28160 - DNA, 16 bp, H. sapiens
acctcaggaccactat

SEQ ID NO: 28161 - DNA, 16 bp, H. sapiens
acctcaggaccctgtg

SEQ ID NO: 28162 - DNA, 16 bp, H. sapiens
acctcaggcaaatcac

SEQ ID NO: 28163 - DNA, 16 bp, H. sapiens
acctcaggtaatctgc

SEQ ID NO: 28164 - DNA, 17 bp, H. sapiens
acctcaggtcatccgcc

SEQ ID NO: 28165 - DNA, 17 bp, H. sapiens
acctcaggtcctcagac

SEQ ID NO: 28166 - DNA, 16 bp, H. sapiens
acctcaggtgacccac

SEQ ID NO: 28167 - DNA, 17 bp, H. sapiens
acctcaggtgatccaca

SEQ ID NO: 28168 - DNA, 16 bp, H. sapiens
acctcaggtgattcac

SEQ ID NO: 28169 - DNA, 16 bp, H. sapiens
acctcagtctccagag

SEQ ID NO: 28170 - DNA, 16 bp, H. sapiens
acctcagtcttccaaa

SEQ ID NO: 28171 - DNA, 16 bp, H. sapiens
acctcagtgtcctgag

SEQ ID NO: 28172 - DNA, 16 bp, H. sapiens
acctcagttcttcact

SEQ ID NO: 28173 - DNA, 16 bp, H. sapiens
acctcagtttccccat

SEQ ID NO: 28174 - DNA, 16 bp, H. sapiens
acctcagtttcttcat

SEQ ID NO: 28175 - DNA, 16 bp, H. sapiens
acctcagttttatcat

SEQ ID NO: 28176 - DNA, 16 bp, H. sapiens
acctcatagagttgtt

SEQ ID NO: 28177 - DNA, 16 bp, H. sapiens
acctcatataagtgga

SEQ ID NO: 28178 - DNA, 16 bp, H. sapiens
acctcatcactactaa

SEQ ID NO: 28179 - DNA, 16 bp, H. sapiens
acctcatcagcatctg

SEQ ID NO: 28180 - DNA, 16 bp, H. sapiens
acctcatctctgaaaa

SEQ ID NO: 28181 - DNA, 16 bp, H. sapiens
acctcatcttaattta

SEQ ID NO: 28182 - DNA, 16 bp, H. sapiens
acctcatgatcagcct

SEQ ID NO: 28183 - DNA, 16 bp, H. sapiens
acctcatgatctgctt

SEQ ID NO: 28184 - DNA, 16 bp, H. sapiens
acctcatggagctgaa

SEQ ID NO: 28185 - DNA, 16 bp, H. sapiens
acctcattaaaattaa

SEQ ID NO: 28186 - DNA, 16 bp, H. sapiens
acctcatttctaaaaa

SEQ ID NO: 28187 - DNA, 16 bp, H. sapiens
acctcatttggaaatg

SEQ ID NO: 28188 - DNA, 16 bp, H. sapiens
acctcattttaacttt

SEQ ID NO: 28189 - DNA, 16 bp, H. sapiens
acctccaaactcttct

SEQ ID NO: 28190 - DNA, 16 bp, H. sapiens
acctccaacaagctgc

SEQ ID NO: 28191 - DNA, 16 bp, H. sapiens
acctccaagctgaaga

SEQ ID NO: 28192 - DNA, 16 bp, H. sapiens
acctccacccactggg

SEQ ID NO: 28193 - DNA, 16 bp, H. sapiens
acctccacctcccctg

SEQ ID NO: 28194 - DNA, 16 bp, H. sapiens
acctccacctcctgca

SEQ ID NO: 28195 - DNA, 16 bp, H. sapiens
acctccacctctggag

SEQ ID NO: 28196 - DNA, 16 bp, H. sapiens
acctccacctggtctc

SEQ ID NO: 28197 - DNA, 16 bp, H. sapiens
acctccaccttcccag

SEQ ID NO: 28198 - DNA, 16 bp, H. sapiens
acctccaccttccggg

SEQ ID NO: 28199 - DNA, 16 bp, H. sapiens
acctccacttcctggg

SEQ ID NO: 28200 - DNA, 16 bp, H. sapiens
acctccacttgttata

SEQ ID NO: 28201 - DNA, 16 bp, H. sapiens
acctccagaagtttcc

SEQ ID NO: 28202 - DNA, 16 bp, H. sapiens
acctccagcctcagcc

SEQ ID NO: 28203 - DNA, 16 bp, H. sapiens
acctccagctcctggg

SEQ ID NO: 28204 - DNA, 16 bp, H. sapiens
acctccagggctcaag

SEQ ID NO: 28205 - DNA, 16 bp, H. sapiens
acctccaggtacagga

SEQ ID NO: 28206 - DNA, 16 bp, H. sapiens
acctccatgcctggct

SEQ ID NO: 28207 - DNA, 16 bp, H. sapiens
acctccattttacaga

SEQ ID NO: 28208 - DNA, 16 bp, H. sapiens
acctcccaaaggcacc

SEQ ID NO: 28209 - DNA, 16 bp, H. sapiens
acctcccaaagtgttg

SEQ ID NO: 28210 - DNA, 16 bp, H. sapiens
acctcccaagctcaag

SEQ ID NO: 28211 - DNA, 16 bp, H. sapiens
acctcccacattcaag

SEQ ID NO: 28212 - DNA, 16 bp, H. sapiens
acctcccaccagaccc

SEQ ID NO: 28213 - DNA, 16 bp, H. sapiens
acctcccaccaggccc

SEQ ID NO: 28214 - DNA, 16 bp, H. sapiens
acctcccagattcaag

SEQ ID NO: 28215 - DNA, 16 bp, H. sapiens
acctcccagcaggagt

SEQ ID NO: 28216 - DNA, 16 bp, H. sapiens
acctcccagcctcagg

SEQ ID NO: 28217 - DNA, 16 bp, H. sapiens
acctcccagcctccag

SEQ ID NO: 28218 - DNA, 16 bp, H. sapiens
acctcccaggcccaag

SEQ ID NO: 28219 - DNA, 16 bp, H. sapiens
acctcccaggcccagg

SEQ ID NO: 28220 - DNA, 16 bp, H. sapiens
acctcccaggctcaag

SEQ ID NO: 28221 - DNA, 16 bp, H. sapiens
acctcccaggctcagg

SEQ ID NO: 28222 - DNA, 16 bp, H. sapiens
acctcccaggctccag

SEQ ID NO: 28223 - DNA, 16 bp, H. sapiens
acctcccaggttcaaa

SEQ ID NO: 28224 - DNA, 16 bp, H. sapiens
acctcccaggttcaag

SEQ ID NO: 28225 - DNA, 16 bp, H. sapiens
acctcccaggttcagg

SEQ ID NO: 28226 - DNA, 16 bp, H. sapiens
acctccccagactcca

SEQ ID NO: 28227 - DNA, 16 bp, H. sapiens
acctccccagcagctg

SEQ ID NO: 28228 - DNA, 16 bp, H. sapiens
acctccccagctcaag

SEQ ID NO: 28229 - DNA, 16 bp, H. sapiens
acctccccctcccggg

SEQ ID NO: 28230 - DNA, 16 bp, H. sapiens
acctccccggctcaag

SEQ ID NO: 28231 - DNA, 16 bp, H. sapiens
acctcccgagctcaag

SEQ ID NO: 28232 - DNA, 16 bp, H. sapiens
acctcccggattcaag

SEQ ID NO: 28233 - DNA, 16 bp, H. sapiens
acctcccgggttcaac

SEQ ID NO: 28234 - DNA, 16 bp, H. sapiens
acctcccgggttcaag

SEQ ID NO: 28235 - DNA, 16 bp, H. sapiens
acctccctaactcatt

SEQ ID NO: 28236 - DNA, 16 bp, H. sapiens
acctccctccaggtcc

SEQ ID NO: 28237 - DNA, 16 bp, H. sapiens
acctccctcctggctg

SEQ ID NO: 28238 - DNA, 16 bp, H. sapiens
acctccctctcccagg

SEQ ID NO: 28239 - DNA, 16 bp, H. sapiens
acctccctggctcaag

SEQ ID NO: 28240 - DNA, 16 bp, H. sapiens
acctccctgggcctca

SEQ ID NO: 28241 - DNA, 16 bp, H. sapiens
acctccctgggctctt

SEQ ID NO: 28242 - DNA, 16 bp, H. sapiens
acctccctgtgtccat

SEQ ID NO: 28243 - DNA, 16 bp, H. sapiens
acctccgaggttcaag

SEQ ID NO: 28244 - DNA, 16 bp, H. sapiens
acctccgcctccaagg

SEQ ID NO: 28245 - DNA, 16 bp, H. sapiens
acctccgcctccagga

SEQ ID NO: 28246 - DNA, 16 bp, H. sapiens
acctccgcctcctgag

SEQ ID NO: 28247 - DNA, 16 bp, H. sapiens
acctccgtttcctggg

SEQ ID NO: 28248 - DNA, 16 bp, H. sapiens
acctcctaaaggacct

SEQ ID NO: 28249 - DNA, 16 bp, H. sapiens
acctcctactccctgg

SEQ ID NO: 28250 - DNA, 16 bp, H. sapiens
acctcctagactcaag

SEQ ID NO: 28251 - DNA, 16 bp, H. sapiens
acctcctaggctcaag

SEQ ID NO: 28252 - DNA, 16 bp, H. sapiens
acctcctaggttcaag

SEQ ID NO: 28253 - DNA, 16 bp, H. sapiens
acctcctcaaggagaa

SEQ ID NO: 28254 - DNA, 16 bp, H. sapiens
acctcctcagcctggc

SEQ ID NO: 28255 - DNA, 16 bp, H. sapiens
acctcctccaagaagc

SEQ ID NO: 28256 - DNA, 16 bp, H. sapiens
acctcctcccatgaat

SEQ ID NO: 28257 - DNA, 16 bp, H. sapiens
acctcctcccccagga

SEQ ID NO: 28258 - DNA, 16 bp, H. sapiens
acctcctcctcccaaa

SEQ ID NO: 28259 - DNA, 16 bp, H. sapiens
acctcctcctcccgga

SEQ ID NO: 28260 - DNA, 16 bp, H. sapiens
acctcctcctccctgc

SEQ ID NO: 28261 - DNA, 16 bp, H. sapiens
acctcctcctctcagg

SEQ ID NO: 28262 - DNA, 16 bp, H. sapiens
acctcctcctgtgtgg

SEQ ID NO: 28263 - DNA, 16 bp, H. sapiens
acctcctccttctggg

SEQ ID NO: 28264 - DNA, 16 bp, H. sapiens
acctcctctgtgaagc

SEQ ID NO: 28265 - DNA, 16 bp, H. sapiens
acctcctctgtgccag

SEQ ID NO: 28266 - DNA, 16 bp, H. sapiens
acctcctcttcccggg

SEQ ID NO: 28267 - DNA, 16 bp, H. sapiens
acctcctgaagctgtg

SEQ ID NO: 28268 - DNA, 16 bp, H. sapiens
acctcctgacctcatg

SEQ ID NO: 28269 - DNA, 16 bp, H. sapiens
acctcctgagctcaag

SEQ ID NO: 28270 - DNA, 16 bp, H. sapiens
acctcctgagtggctg

SEQ ID NO: 28271 - DNA, 18 bp, H. sapiens
acctcctgagttcaagcg

SEQ ID NO: 28272 - DNA, 16 bp, H. sapiens
acctcctgcctcagcc

SEQ ID NO: 28273 - DNA, 16 bp, H. sapiens
acctcctggattcaag

SEQ ID NO: 28274 - DNA, 16 bp, H. sapiens
acctcctgggctcaaa

SEQ ID NO: 28275 - DNA, 16 bp, H. sapiens
acctcctgggctcaag

SEQ ID NO: 28276 - DNA, 16 bp, H. sapiens
acctcctgggctcagg

SEQ ID NO: 28277 - DNA, 16 bp, H. sapiens
acctcctgggctctag

SEQ ID NO: 28278 - DNA, 16 bp, H. sapiens
acctcctgggtccaag

SEQ ID NO: 28279 - DNA, 16 bp, H. sapiens
acctcctgggtcctga

SEQ ID NO: 28280 - DNA, 16 bp, H. sapiens
acctcctgggttaaag

SEQ ID NO: 28281 - DNA, 16 bp, H. sapiens
acctcctgggttcaaa

SEQ ID NO: 28282 - DNA, 16 bp, H. sapiens
acctcctgggttcaag

SEQ ID NO: 28283 - DNA, 16 bp, H. sapiens
acctccttaaaggccc

SEQ ID NO: 28284 - DNA, 16 bp, H. sapiens
acctccttcttttgta

SEQ ID NO: 28285 - DNA, 16 bp, H. sapiens
acctccttggctcaag

SEQ ID NO: 28286 - DNA, 19 bp, H. sapiens
acctcgcctggctaatttt

SEQ ID NO: 28287 - DNA, 16 bp, H. sapiens
acctcggaggtggagg

SEQ ID NO: 28288 - DNA, 18 bp, H. sapiens
acctcggcctcccaaagc

SEQ ID NO: 28289 - DNA, 20 bp, H. sapiens
acctcggcctcccaaagtgt

SEQ ID NO: 28290 - DNA, 16 bp, H. sapiens
acctcggcctctcgaa

SEQ ID NO: 28291 - DNA, 22 bp, H. sapiens
acctcggcttcccaaagtgctg

SEQ ID NO: 28292 - DNA, 16 bp, H. sapiens
acctcgggctcccaaa

SEQ ID NO: 28293 - DNA, 17 bp, H. sapiens
acctcgggtgatccgcc

SEQ ID NO: 28294 - DNA, 16 bp, H. sapiens
acctcgtctctacaaa

SEQ ID NO: 28295 - DNA, 16 bp, H. sapiens
acctcgtgatccaccc

SEQ ID NO: 28296 - DNA, 16 bp, H. sapiens
acctctacctcccagg

SEQ ID NO: 28297 - DNA, 16 bp, H. sapiens
acctctcagcctccat

SEQ ID NO: 28298 - DNA, 16 bp, H. sapiens
acctctcaggcccaag

SEQ ID NO: 28299 - DNA, 16 bp, H. sapiens
acctctcaggttcaag

SEQ ID NO: 28300 - DNA, 16 bp, H. sapiens
acctctcagtgcctca

SEQ ID NO: 28301 - DNA, 16 bp, H. sapiens
acctctccctcccaga

SEQ ID NO: 28302 - DNA, 16 bp, H. sapiens
acctctcctccctggg

SEQ ID NO: 28303 - DNA, 18 bp, H. sapiens
acctctcggggcagggca

SEQ ID NO: 28304 - DNA, 16 bp, H. sapiens
acctctcgggttcaag

SEQ ID NO: 28305 - DNA, 16 bp, H. sapiens
acctctctgaggaggt

SEQ ID NO: 28306 - DNA, 16 bp, H. sapiens
acctctctgggcctca

SEQ ID NO: 28307 - DNA, 16 bp, H. sapiens
acctctctgggctcaa

SEQ ID NO: 28308 - DNA, 16 bp, H. sapiens
acctctctgtcacctg

SEQ ID NO: 28309 - DNA, 16 bp, H. sapiens
acctctctgtgcctcg

SEQ ID NO: 28310 - DNA, 16 bp, H. sapiens
acctctgaacctaaaa

SEQ ID NO: 28311 - DNA, 16 bp, H. sapiens
acctctgacttcctgg

SEQ ID NO: 28312 - DNA, 16 bp, H. sapiens
acctctgattttattt

SEQ ID NO: 28313 - DNA, 16 bp, H. sapiens
acctctgccacctgga

SEQ ID NO: 28314 - DNA, 16 bp, H. sapiens
acctctgccactcctg

SEQ ID NO: 28315 - DNA, 16 bp, H. sapiens
acctctgcccagctgc

SEQ ID NO: 28316 - DNA, 16 bp, H. sapiens
acctctgcccccaggt

SEQ ID NO: 28317 - DNA, 16 bp, H. sapiens
acctctgccccccagg

SEQ ID NO: 28318 - DNA, 16 bp, H. sapiens
acctctgccccttggg

SEQ ID NO: 28319 - DNA, 16 bp, H. sapiens
acctctgcctaggaaa

SEQ ID NO: 28320 - DNA, 16 bp, H. sapiens
acctctgcctccagat

SEQ ID NO: 28321 - DNA, 16 bp, H. sapiens
acctctgcctccaggt

SEQ ID NO: 28322 - DNA, 16 bp, H. sapiens
acctctgcctcccaca

SEQ ID NO: 28323 - DNA, 16 bp, H. sapiens
acctctgcctcccaga

SEQ ID NO: 28324 - DNA, 16 bp, H. sapiens
acctctgcctcccagt

SEQ ID NO: 28325 - DNA, 16 bp, H. sapiens
acctctgcctccccaa

SEQ ID NO: 28326 - DNA, 16 bp, H. sapiens
acctctgcctccccgg

SEQ ID NO: 28327 - DNA, 16 bp, H. sapiens
acctctgcctccctca

SEQ ID NO: 28328 - DNA, 20 bp, H. sapiens
acctctgcctcctgagttca

SEQ ID NO: 28329 - DNA, 16 bp, H. sapiens
acctctgcctcctggt

SEQ ID NO: 28330 - DNA, 16 bp, H. sapiens
acctctgcctgcctca

SEQ ID NO: 28331 - DNA, 16 bp, H. sapiens
acctctgcctgctggg

SEQ ID NO: 28332 - DNA, 16 bp, H. sapiens
acctctgccttcctgg

SEQ ID NO: 28333 - DNA, 16 bp, H. sapiens
acctctgccttgcagg

SEQ ID NO: 28334 - DNA, 16 bp, H. sapiens
acctctgctgcctggg

SEQ ID NO: 28335 - DNA, 16 bp, H. sapiens
acctctgcttcccagc

SEQ ID NO: 28336 - DNA, 16 bp, H. sapiens
acctctgcttcccagt

SEQ ID NO: 28337 - DNA, 16 bp, H. sapiens
acctctgcttcctggt

SEQ ID NO: 28338 - DNA, 16 bp, H. sapiens
acctctgctttctggg

SEQ ID NO: 28339 - DNA, 16 bp, H. sapiens
acctctgctttttttg

SEQ ID NO: 28340 - DNA, 16 bp, H. sapiens
acctctggagccccag

SEQ ID NO: 28341 - DNA, 16 bp, H. sapiens
acctctggcaaccacc

SEQ ID NO: 28342 - DNA, 16 bp, H. sapiens
acctctggcagaattt

SEQ ID NO: 28343 - DNA, 16 bp, H. sapiens
acctctggctccctgg

SEQ ID NO: 28344 - DNA, 16 bp, H. sapiens
acctctggggagggga

SEQ ID NO: 28345 - DNA, 16 bp, H. sapiens
acctctgtcacctggg

SEQ ID NO: 28346 - DNA, 16 bp, H. sapiens
acctctgtgtgcctca

SEQ ID NO: 28347 - DNA, 16 bp, H. sapiens
acctcttacatcagtg

SEQ ID NO: 28348 - DNA, 16 bp, H. sapiens
acctcttcaaaaagaa

SEQ ID NO: 28349 - DNA, 16 bp, H. sapiens
acctcttcaaggacaa

SEQ ID NO: 28350 - DNA, 16 bp, H. sapiens
acctcttccaggaagc

SEQ ID NO: 28351 - DNA, 16 bp, H. sapiens
acctcttccaggacct

SEQ ID NO: 28352 - DNA, 16 bp, H. sapiens
acctcttccaggagaa

SEQ ID NO: 28353 - DNA, 16 bp, H. sapiens
acctcttccatcatgg

SEQ ID NO: 28354 - DNA, 16 bp, H. sapiens
acctcttcccggccgc

SEQ ID NO: 28355 - DNA, 16 bp, H. sapiens
acctcttcctcccaaa

SEQ ID NO: 28356 - DNA, 16 bp, H. sapiens
acctcttgaacacttt

SEQ ID NO: 28357 - DNA, 16 bp, H. sapiens
acctcttgaatatttt

SEQ ID NO: 28358 - DNA, 16 bp, H. sapiens
acctcttgatctgccc

SEQ ID NO: 28359 - DNA, 16 bp, H. sapiens
acctcttgggctcaag

SEQ ID NO: 28360 - DNA, 16 bp, H. sapiens
acctcttgggttcaag

SEQ ID NO: 28361 - DNA, 16 bp, H. sapiens
acctcttggtctgggt

SEQ ID NO: 28362 - DNA, 16 bp, H. sapiens
acctctttgaggcctt

SEQ ID NO: 28363 - DNA, 16 bp, H. sapiens
acctcttttctttaga

SEQ ID NO: 28364 - DNA, 16 bp, H. sapiens
acctcttttgtttgta

SEQ ID NO: 28365 - DNA, 16 bp, H. sapiens
acctgaaaaaaaatca

SEQ ID NO: 28366 - DNA, 16 bp, H. sapiens
acctgaaaaaccagtt

SEQ ID NO: 28367 - DNA, 16 bp, H. sapiens
acctgaaaataataaa

SEQ ID NO: 28368 - DNA, 16 bp, H. sapiens
acctgaaaccacagat

SEQ ID NO: 28369 - DNA, 16 bp, H. sapiens
acctgaaaccatggaa

SEQ ID NO: 28370 - DNA, 16 bp, H. sapiens
acctgaaatctcagca

SEQ ID NO: 28371 - DNA, 16 bp, H. sapiens
acctgaacccaggaag

SEQ ID NO: 28372 - DNA, 16 bp, H. sapiens
acctgaagctggtgat

SEQ ID NO: 28373 - DNA, 16 bp, H. sapiens
acctgaaggaagtgag

SEQ ID NO: 28374 - DNA, 16 bp, H. sapiens
acctgaaggtccagat

SEQ ID NO: 28375 - DNA, 16 bp, H. sapiens
acctgaagtcagaagt

SEQ ID NO: 28376 - DNA, 16 bp, H. sapiens
acctgaagtcaggagc

SEQ ID NO: 28377 - DNA, 16 bp, H. sapiens
acctgaatgtgtgttc

SEQ ID NO: 28378 - DNA, 16 bp, H. sapiens
acctgaattttggaga

SEQ ID NO: 28379 - DNA, 16 bp, H. sapiens
acctgacactgggcaa

SEQ ID NO: 28380 - DNA, 16 bp, H. sapiens
acctgacagagctgaa

SEQ ID NO: 28381 - DNA, 20 bp, H. sapiens
acctgaccaacatggagaaa

SEQ ID NO: 28382 - DNA, 16 bp, H. sapiens
acctgaccacctgcct

SEQ ID NO: 28383 - DNA, 16 bp, H. sapiens
acctgacccttctctc

SEQ ID NO: 28384 - DNA, 17 bp, H. sapiens
acctgacctcaggtgat

SEQ ID NO: 28385 - DNA, 16 bp, H. sapiens
acctgactaacatggt

SEQ ID NO: 28386 - DNA, 16 bp, H. sapiens
acctgacttttggttc

SEQ ID NO: 28387 - DNA, 16 bp, H. sapiens
acctgagaaaaacaag

SEQ ID NO: 28388 - DNA, 16 bp, H. sapiens
acctgagaagcagagg

SEQ ID NO: 28389 - DNA, 16 bp, H. sapiens
acctgagcactcctcc

SEQ ID NO: 28390 - DNA, 16 bp, H. sapiens
acctgagccagggagg

SEQ ID NO: 28391 - DNA, 16 bp, H. sapiens
acctgagcctcccaaa

SEQ ID NO: 28392 - DNA, 16 bp, H. sapiens
acctgagcctgagaag

SEQ ID NO: 28393 - DNA, 16 bp, H. sapiens
acctgagctccaacca

SEQ ID NO: 28394 - DNA, 16 bp, H. sapiens
acctgaggcccagaga

SEQ ID NO: 28395 - DNA, 16 bp, H. sapiens
acctgagggaaactgg

SEQ ID NO: 28396 - DNA, 17 bp, H. sapiens
acctgaggtagggagtt

SEQ ID NO: 28397 - DNA, 16 bp, H. sapiens
acctgaggtcaggtgt

SEQ ID NO: 28398 - DNA, 16 bp, H. sapiens
acctgaggtccagagt

SEQ ID NO: 28399 - DNA, 17 bp, H. sapiens
acctgaggtccggagtt

SEQ ID NO: 28400 - DNA, 16 bp, H. sapiens
acctgaggtcgggaga

SEQ ID NO: 28401 - DNA, 16 bp, H. sapiens
acctgaggtctggagt

SEQ ID NO: 28402 - DNA, 16 bp, H. sapiens
acctgagtgagcttgg

SEQ ID NO: 28403 - DNA, 16 bp, H. sapiens
acctgataaacaactt

SEQ ID NO: 28404 - DNA, 16 bp, H. sapiens
acctgatactgggtaa

SEQ ID NO: 28405 - DNA, 16 bp, H. sapiens
acctgcaaaccaggag

SEQ ID NO: 28406 - DNA, 16 bp, H. sapiens
acctgcacatcctgca

SEQ ID NO: 28407 - DNA, 16 bp, H. sapiens
acctgcacatctaccc

SEQ ID NO: 28408 - DNA, 17 bp, H. sapiens
acctgcaccggcaccgg

SEQ ID NO: 28409 - DNA, 16 bp, H. sapiens
acctgcagaatgggaa

SEQ ID NO: 28410 - DNA, 16 bp, H. sapiens
acctgcagccccagct

SEQ ID NO: 28411 - DNA, 16 bp, H. sapiens
acctgcagccccagtg

SEQ ID NO: 28412 - DNA, 18 bp, H. sapiens
acctgcagcctgccatgc

SEQ ID NO: 28413 - DNA, 16 bp, H. sapiens
acctgcaggaaaacca

SEQ ID NO: 28414 - DNA, 17 bp, H. sapiens
acctgcagtcaggagtt

SEQ ID NO: 28415 - DNA, 16 bp, H. sapiens
acctgcagtgccagct

SEQ ID NO: 28416 - DNA, 16 bp, H. sapiens
acctgcatgtcctgca

SEQ ID NO: 28417 - DNA, 16 bp, H. sapiens
acctgcatttgtatgt

SEQ ID NO: 28418 - DNA, 16 bp, H. sapiens
acctgccaagactgaa

SEQ ID NO: 28419 - DNA, 16 bp, H. sapiens
acctgccaagccaggc

SEQ ID NO: 28420 - DNA, 16 bp, H. sapiens
acctgccaagtagctg

SEQ ID NO: 28421 - DNA, 16 bp, H. sapiens
acctgccaccacactt

SEQ ID NO: 28422 - DNA, 16 bp, H. sapiens
acctgccaccatgcca

SEQ ID NO: 28423 - DNA, 26 bp, H. sapiens
acctgccaccatgcccggctaatttt

SEQ ID NO: 28424 - DNA, 16 bp, H. sapiens
acctgccaccatggcc

SEQ ID NO: 28425 - DNA, 16 bp, H. sapiens
acctgccaggttcaag

SEQ ID NO: 28426 - DNA, 16 bp, H. sapiens
acctgccattgctgag

SEQ ID NO: 28427 - DNA, 16 bp, H. sapiens
acctgcccagggtcac

SEQ ID NO: 28428 - DNA, 16 bp, H. sapiens
acctgcccccgtgatt

SEQ ID NO: 28429 - DNA, 16 bp, H. sapiens
acctgcccctcctgct

SEQ ID NO: 28430 - DNA, 16 bp, H. sapiens
acctgcccctgcctcc

SEQ ID NO: 28431 - DNA, 16 bp, H. sapiens
acctgccctgggccag

SEQ ID NO: 28432 - DNA, 16 bp, H. sapiens
acctgcctcagccccc

SEQ ID NO: 28433 - DNA, 17 bp, H. sapiens
acctgcctcagcctcca

SEQ ID NO: 28434 - DNA, 19 bp, H. sapiens
acctgcctcagcctcccag

SEQ ID NO: 28435 - DNA, 19 bp, H. sapiens
acctgcctcagcctctcaa

SEQ ID NO: 28436 - DNA, 16 bp, H. sapiens
acctgcctcagtctcc

SEQ ID NO: 28437 - DNA, 16 bp, H. sapiens
acctgcctccacctcc

SEQ ID NO: 28438 - DNA, 16 bp, H. sapiens
acctgcctcccagctg

SEQ ID NO: 28439 - DNA, 17 bp, H. sapiens
acctgcctcgacctccc

SEQ ID NO: 28440 - DNA, 16 bp, H. sapiens
acctgcctctcattct

SEQ ID NO: 28441 - DNA, 16 bp, H. sapiens
acctgcctgaggctgc

SEQ ID NO: 28442 - DNA, 16 bp, H. sapiens
acctgcctgcttcccc

SEQ ID NO: 28443 - DNA, 16 bp, H. sapiens
acctgcctggcctccc

SEQ ID NO: 28444 - DNA, 16 bp, H. sapiens
acctgccttcccccca

SEQ ID NO: 28445 - DNA, 16 bp, H. sapiens
acctgccttgcctccc

SEQ ID NO: 28446 - DNA, 20 bp, H. sapiens
acctgccttggcctcccaaa

SEQ ID NO: 28447 - DNA, 16 bp, H. sapiens
acctgccttggcttct

SEQ ID NO: 28448 - DNA, 16 bp, H. sapiens
acctgcggccccagtg

SEQ ID NO: 28449 - DNA, 16 bp, H. sapiens
acctgcggccctggtg

SEQ ID NO: 28450 - DNA, 17 bp, H. sapiens
acctgcggtcaggagtt

SEQ ID NO: 28451 - DNA, 16 bp, H. sapiens
acctgcggtcccagct

SEQ ID NO: 28452 - DNA, 16 bp, H. sapiens
acctgctcagcctccc

SEQ ID NO: 28453 - DNA, 16 bp, H. sapiens
acctgctcctcctgct

SEQ ID NO: 28454 - DNA, 16 bp, H. sapiens
acctgctccttttctc

SEQ ID NO: 28455 - DNA, 16 bp, H. sapiens
acctgctgaatcagaa

SEQ ID NO: 28456 - DNA, 16 bp, H. sapiens
acctgctgctcacctc

SEQ ID NO: 28457 - DNA, 16 bp, H. sapiens
acctgctgtatgccag

SEQ ID NO: 28458 - DNA, 16 bp, H. sapiens
acctgcttcagcctcc

SEQ ID NO: 28459 - DNA, 16 bp, H. sapiens
acctgcttcagcttcc

SEQ ID NO: 28460 - DNA, 16 bp, H. sapiens
acctgcttcaggggaa

SEQ ID NO: 28461 - DNA, 16 bp, H. sapiens
acctgcttggcctccc

SEQ ID NO: 28462 - DNA, 16 bp, H. sapiens
acctgctttggctgct

SEQ ID NO: 28463 - DNA, 16 bp, H. sapiens
acctggaaaatatatt

SEQ ID NO: 28464 - DNA, 16 bp, H. sapiens
acctggaagaaatgga

SEQ ID NO: 28465 - DNA, 16 bp, H. sapiens
acctggaagcagaggt

SEQ ID NO: 28466 - DNA, 16 bp, H. sapiens
acctggaagccctctc

SEQ ID NO: 28467 - DNA, 16 bp, H. sapiens
acctggaagctgccaa

SEQ ID NO: 28468 - DNA, 16 bp, H. sapiens
acctggaagtcccctc

SEQ ID NO: 28469 - DNA, 16 bp, H. sapiens
acctggaagttaccac

SEQ ID NO: 28470 - DNA, 16 bp, H. sapiens
acctggacacagggca

SEQ ID NO: 28471 - DNA, 16 bp, H. sapiens
acctggactgaccctg

SEQ ID NO: 28472 - DNA, 16 bp, H. sapiens
acctggaggcagagct

SEQ ID NO: 28473 - DNA, 16 bp, H. sapiens
acctggaggcggagct

SEQ ID NO: 28474 - DNA, 16 bp, H. sapiens
acctggaggtgtcacc

SEQ ID NO: 28475 - DNA, 16 bp, H. sapiens
acctggagttagcaca

SEQ ID NO: 28476 - DNA, 16 bp, H. sapiens
acctggatatccacat

SEQ ID NO: 28477 - DNA, 16 bp, H. sapiens
acctggatccagccat

SEQ ID NO: 28478 - DNA, 16 bp, H. sapiens
acctggatgacaggtt

SEQ ID NO: 28479 - DNA, 16 bp, H. sapiens
acctggatttgaatct

SEQ ID NO: 28480 - DNA, 16 bp, H. sapiens
acctggcaatcccatt

SEQ ID NO: 28481 - DNA, 16 bp, H. sapiens
acctggcacacagcag

SEQ ID NO: 28482 - DNA, 16 bp, H. sapiens
acctggcacagagcag

SEQ ID NO: 28483 - DNA, 16 bp, H. sapiens
acctggcacagtggct

SEQ ID NO: 28484 - DNA, 16 bp, H. sapiens
acctggcacttagtag

SEQ ID NO: 28485 - DNA, 16 bp, H. sapiens
acctggcagaggcaca

SEQ ID NO: 28486 - DNA, 16 bp, H. sapiens
acctggcatatagtag

SEQ ID NO: 28487 - DNA, 16 bp, H. sapiens
acctggccaacatagc

SEQ ID NO: 28488 - DNA, 16 bp, H. sapiens
acctggccaacatggg

SEQ ID NO: 28489 - DNA, 24 bp, H. sapiens
acctggccaacatggtgaaacccc

SEQ ID NO: 28490 - DNA, 16 bp, H. sapiens
acctggccaacatgtt

SEQ ID NO: 28491 - DNA, 16 bp, H. sapiens
acctggccttccaggt

SEQ ID NO: 28492 - DNA, 16 bp, H. sapiens
acctggctacagccac

SEQ ID NO: 28493 - DNA, 16 bp, H. sapiens
acctggctcatctcac

SEQ ID NO: 28494 - DNA, 16 bp, H. sapiens
acctggctccaggctg

SEQ ID NO: 28495 - DNA, 16 bp, H. sapiens
acctggctgggcatgg

SEQ ID NO: 28496 - DNA, 16 bp, H. sapiens
acctggcttatttcac

SEQ ID NO: 28497 - DNA, 16 bp, H. sapiens
acctgggaagcaaagg

SEQ ID NO: 28498 - DNA, 16 bp, H. sapiens
acctgggacacggagg

SEQ ID NO: 28499 - DNA, 16 bp, H. sapiens
acctgggagacagaag

SEQ ID NO: 28500 - DNA, 16 bp, H. sapiens
acctgggagacagagc

SEQ ID NO: 28501 - DNA, 16 bp, H. sapiens
acctgggaggaagagg

SEQ ID NO: 28502 - DNA, 16 bp, H. sapiens
acctgggaggcaaaga

SEQ ID NO: 28503 - DNA, 16 bp, H. sapiens
acctgggaggcacagc

SEQ ID NO: 28504 - DNA, 16 bp, H. sapiens
acctgggaggcagaaa

SEQ ID NO: 28505 - DNA, 16 bp, H. sapiens
acctgggaggcagaga

SEQ ID NO: 28506 - DNA, 16 bp, H. sapiens
acctgggaggcaggag

SEQ ID NO: 28507 - DNA, 16 bp, H. sapiens
acctgggaggccgaga

SEQ ID NO: 28508 - DNA, 16 bp, H. sapiens
acctgggaggccgagg

SEQ ID NO: 28509 - DNA, 16 bp, H. sapiens
acctgggaggcgaggg

SEQ ID NO: 28510 - DNA, 16 bp, H. sapiens
acctgggaggctgagg

SEQ ID NO: 28511 - DNA, 16 bp, H. sapiens
acctgggaggtgaaga

SEQ ID NO: 28512 - DNA, 16 bp, H. sapiens
acctgggaggtggaag

SEQ ID NO: 28513 - DNA, 16 bp, H. sapiens
acctgggaggtggacg

SEQ ID NO: 28514 - DNA, 16 bp, H. sapiens
acctgggaggtggggc

SEQ ID NO: 28515 - DNA, 16 bp, H. sapiens
acctgggagttggagg

SEQ ID NO: 28516 - DNA, 16 bp, H. sapiens
acctgggcaacaagaa

SEQ ID NO: 28517 - DNA, 16 bp, H. sapiens
acctgggcaacagaac

SEQ ID NO: 28518 - DNA, 23 bp, H. sapiens
acctgggcaacatagtgagacct

SEQ ID NO: 28519 - DNA, 23 bp, H. sapiens
acctgggcaacatggcaaaaccc

SEQ ID NO: 28520 - DNA, 16 bp, H. sapiens
acctgggcaacatggt

SEQ ID NO: 28521 - DNA, 16 bp, H. sapiens
acctgggcaagttact

SEQ ID NO: 28522 - DNA, 16 bp, H. sapiens
acctgggcagtggagg

SEQ ID NO: 28523 - DNA, 16 bp, H. sapiens
acctgggcatccaggc

SEQ ID NO: 28524 - DNA, 16 bp, H. sapiens
acctgggcatggtggt

SEQ ID NO: 28525 - DNA, 17 bp, H. sapiens
acctgggccagcagctg

SEQ ID NO: 28526 - DNA, 16 bp, H. sapiens
acctgggcctggtggc

SEQ ID NO: 28527 - DNA, 18 bp, H. sapiens
acctgggctcaagtgatc

SEQ ID NO: 28528 - DNA, 16 bp, H. sapiens
acctgggctcactgca

SEQ ID NO: 28529 - DNA, 16 bp, H. sapiens
acctgggctgtgctgc

SEQ ID NO: 28530 - DNA, 16 bp, H. sapiens
acctggggcctgtgca

SEQ ID NO: 28531 - DNA, 16 bp, H. sapiens
acctgggggatggagg

SEQ ID NO: 28532 - DNA, 16 bp, H. sapiens
acctgggggtggaggt

SEQ ID NO: 28533 - DNA, 16 bp, H. sapiens
acctggggtcccagct

SEQ ID NO: 28534 - DNA, 16 bp, H. sapiens
acctgggtaacaggca

SEQ ID NO: 28535 - DNA, 16 bp, H. sapiens
acctgggtattaagcc

SEQ ID NO: 28536 - DNA, 16 bp, H. sapiens
acctgggtggtggtta

SEQ ID NO: 28537 - DNA, 17 bp, H. sapiens
acctgggttcaagtgat

SEQ ID NO: 28538 - DNA, 16 bp, H. sapiens
acctgggtttgagttc

SEQ ID NO: 28539 - DNA, 16 bp, H. sapiens
acctggtctctccttt

SEQ ID NO: 28540 - DNA, 16 bp, H. sapiens
acctggtctcttcctt

SEQ ID NO: 28541 - DNA, 16 bp, H. sapiens
acctggtgacagagtg

SEQ ID NO: 28542 - DNA, 17 bp, H. sapiens
acctggtgacagagtga

SEQ ID NO: 28543 - DNA, 16 bp, H. sapiens
acctggtgatccgccc

SEQ ID NO: 28544 - DNA, 16 bp, H. sapiens
acctggtggtctttct

SEQ ID NO: 28545 - DNA, 16 bp, H. sapiens
acctggtttcaccatg

SEQ ID NO: 28546 - DNA, 16 bp, H. sapiens
acctgtaaaatcaaaa

SEQ ID NO: 28547 - DNA, 16 bp, H. sapiens
acctgtaagcccagca

SEQ ID NO: 28548 - DNA, 16 bp, H. sapiens
acctgtaatcccaact

SEQ ID NO: 28549 - DNA, 19 bp, H. sapiens
acctgtaatcccagcactg

SEQ ID NO: 28550 - DNA, 16 bp, H. sapiens
acctgtaatgccagct

SEQ ID NO: 28551 - DNA, 16 bp, H. sapiens
acctgtacagcatgtc

SEQ ID NO: 28552 - DNA, 17 bp, H. sapiens
acctgtattttgtgctg

SEQ ID NO: 28553 - DNA, 16 bp, H. sapiens
acctgtcaaccaagaa

SEQ ID NO: 28554 - DNA, 16 bp, H. sapiens
acctgtcaggagttca

SEQ ID NO: 28555 - DNA, 16 bp, H. sapiens
acctgtcatcccagct

SEQ ID NO: 28556 - DNA, 16 bp, H. sapiens
acctgtcatctatatt

SEQ ID NO: 28557 - DNA, 16 bp, H. sapiens
acctgtcattccagca

SEQ ID NO: 28558 - DNA, 16 bp, H. sapiens
acctgtctgtgcctca

SEQ ID NO: 28559 - DNA, 16 bp, H. sapiens
acctgtctgtggcctg

SEQ ID NO: 28560 - DNA, 16 bp, H. sapiens
acctgtgaatatgtga

SEQ ID NO: 28561 - DNA, 16 bp, H. sapiens
acctgtgaatcctggc

SEQ ID NO: 28562 - DNA, 16 bp, H. sapiens
acctgtgagaaataaa

SEQ ID NO: 28563 - DNA, 16 bp, H. sapiens
acctgtgcacatcctc

SEQ ID NO: 28564 - DNA, 16 bp, H. sapiens
acctgtgcttctgact

SEQ ID NO: 28565 - DNA, 16 bp, H. sapiens
acctgtgcttttgagg

SEQ ID NO: 28566 - DNA, 16 bp, H. sapiens
acctgtggtctcagct

SEQ ID NO: 28567 - DNA, 16 bp, H. sapiens
acctgtggttccagct

SEQ ID NO: 28568 - DNA, 16 bp, H. sapiens
acctgttaactcatca

SEQ ID NO: 28569 - DNA, 16 bp, H. sapiens
acctgttattccagct

SEQ ID NO: 28570 - DNA, 16 bp, H. sapiens
acctgttgtttccaga

SEQ ID NO: 28571 - DNA, 16 bp, H. sapiens
acctgttttatttatt

SEQ ID NO: 28572 - DNA, 16 bp, H. sapiens
acctgttttcccagca

SEQ ID NO: 28573 - DNA, 16 bp, H. sapiens
acctgtttttctcttt

SEQ ID NO: 28574 - DNA, 16 bp, H. sapiens
accttaaaaatttttt

SEQ ID NO: 28575 - DNA, 16 bp, H. sapiens
accttaagaaattaga

SEQ ID NO: 28576 - DNA, 16 bp, H. sapiens
accttaatttatttaa

SEQ ID NO: 28577 - DNA, 16 bp, H. sapiens
accttaattttagccc

SEQ ID NO: 28578 - DNA, 16 bp, H. sapiens
accttacacaaaaatc

SEQ ID NO: 28579 - DNA, 16 bp, H. sapiens
accttactccttcaag

SEQ ID NO: 28580 - DNA, 16 bp, H. sapiens
accttagcctcctgag

SEQ ID NO: 28581 - DNA, 16 bp, H. sapiens
accttaggaggccaag

SEQ ID NO: 28582 - DNA, 16 bp, H. sapiens
accttatttctactaa

SEQ ID NO: 28583 - DNA, 16 bp, H. sapiens
accttatttttaaata

SEQ ID NO: 28584 - DNA, 16 bp, H. sapiens
accttcaaaatatatc

SEQ ID NO: 28585 - DNA, 16 bp, H. sapiens
accttcaagccaagga

SEQ ID NO: 28586 - DNA, 16 bp, H. sapiens
accttcaagccaggga

SEQ ID NO: 28587 - DNA, 16 bp, H. sapiens
accttcaatttgtgaa

SEQ ID NO: 28588 - DNA, 16 bp, H. sapiens
accttcacagcaaccc

SEQ ID NO: 28589 - DNA, 16 bp, H. sapiens
accttcacctcccgag

SEQ ID NO: 28590 - DNA, 16 bp, H. sapiens
accttcacctcccgga

SEQ ID NO: 28591 - DNA, 16 bp, H. sapiens
accttcacctcttggg

SEQ ID NO: 28592 - DNA, 16 bp, H. sapiens
accttcaccttccacc

SEQ ID NO: 28593 - DNA, 16 bp, H. sapiens
accttcagcttctcca

SEQ ID NO: 28594 - DNA, 16 bp, H. sapiens
accttcatactaaaga

SEQ ID NO: 28595 - DNA, 16 bp, H. sapiens
accttcatgagaacca

SEQ ID NO: 28596 - DNA, 16 bp, H. sapiens
accttcattttacaga

SEQ ID NO: 28597 - DNA, 16 bp, H. sapiens
accttccaaaggcccc

SEQ ID NO: 28598 - DNA, 16 bp, H. sapiens
accttccaacaggccc

SEQ ID NO: 28599 - DNA, 16 bp, H. sapiens
accttccacactgtgg

SEQ ID NO: 28600 - DNA, 16 bp, H. sapiens
accttccaccagcaaa

SEQ ID NO: 28601 - DNA, 16 bp, H. sapiens
accttccacctcccag

SEQ ID NO: 28602 - DNA, 16 bp, H. sapiens
accttcccaccaacag

SEQ ID NO: 28603 - DNA, 16 bp, H. sapiens
accttcccaccagcaa

SEQ ID NO: 28604 - DNA, 16 bp, H. sapiens
accttcccagccatgt

SEQ ID NO: 28605 - DNA, 16 bp, H. sapiens
accttccgggttcaag

SEQ ID NO: 28606 - DNA, 16 bp, H. sapiens
accttcctctgccttt

SEQ ID NO: 28607 - DNA, 16 bp, H. sapiens
accttcctgctgtgtc

SEQ ID NO: 28608 - DNA, 16 bp, H. sapiens
accttcctggccaaca

SEQ ID NO: 28609 - DNA, 16 bp, H. sapiens
accttcctgtacctgg

SEQ ID NO: 28610 - DNA, 16 bp, H. sapiens
accttcctgtgcctca

SEQ ID NO: 28611 - DNA, 16 bp, H. sapiens
accttcgcctcctgag

SEQ ID NO: 28612 - DNA, 16 bp, H. sapiens
accttctcagggaggc

SEQ ID NO: 28613 - DNA, 16 bp, H. sapiens
accttctccttattat

SEQ ID NO: 28614 - DNA, 16 bp, H. sapiens
accttctgacatgatt

SEQ ID NO: 28615 - DNA, 16 bp, H. sapiens
accttctgagtagctg

SEQ ID NO: 28616 - DNA, 16 bp, H. sapiens
accttctgcacagcaa

SEQ ID NO: 28617 - DNA, 16 bp, H. sapiens
accttctgcctcccag

SEQ ID NO: 28618 - DNA, 16 bp, H. sapiens
accttctgctcaattt

SEQ ID NO: 28619 - DNA, 16 bp, H. sapiens
accttctgctgggaca

SEQ ID NO: 28620 - DNA, 16 bp, H. sapiens
accttctggactcaag

SEQ ID NO: 28621 - DNA, 16 bp, H. sapiens
accttctggattcaag

SEQ ID NO: 28622 - DNA, 16 bp, H. sapiens
accttctgggctgaag

SEQ ID NO: 28623 - DNA, 16 bp, H. sapiens
accttctgggttcaag

SEQ ID NO: 28624 - DNA, 16 bp, H. sapiens
accttcttggttaaat

SEQ ID NO: 28625 - DNA, 16 bp, H. sapiens
accttgaaaaaaatta

SEQ ID NO: 28626 - DNA, 16 bp, H. sapiens
accttgaaaacatcat

SEQ ID NO: 28627 - DNA, 16 bp, H. sapiens
accttgaaaacatttt

SEQ ID NO: 28628 - DNA, 16 bp, H. sapiens
accttgaaaatattat

SEQ ID NO: 28629 - DNA, 16 bp, H. sapiens
accttgaagtcctggg

SEQ ID NO: 28630 - DNA, 16 bp, H. sapiens
accttgacacttttga

SEQ ID NO: 28631 - DNA, 16 bp, H. sapiens
accttgacatttttga

SEQ ID NO: 28632 - DNA, 16 bp, H. sapiens
accttgactaatacag

SEQ ID NO: 28633 - DNA, 16 bp, H. sapiens
accttgacttcagact

SEQ ID NO: 28634 - DNA, 16 bp, H. sapiens
accttgagagagatga

SEQ ID NO: 28635 - DNA, 16 bp, H. sapiens
accttgagctcacaga

SEQ ID NO: 28636 - DNA, 16 bp, H. sapiens
accttgagctcctggg

SEQ ID NO: 28637 - DNA, 16 bp, H. sapiens
accttgatattggact

SEQ ID NO: 28638 - DNA, 16 bp, H. sapiens
accttgatgacattat

SEQ ID NO: 28639 - DNA, 16 bp, H. sapiens
accttgcaacccccac

SEQ ID NO: 28640 - DNA, 16 bp, H. sapiens
accttgcattgtaata

SEQ ID NO: 28641 - DNA, 16 bp, H. sapiens
accttgctgaagttgc

SEQ ID NO: 28642 - DNA, 16 bp, H. sapiens
accttggactctcaaa

SEQ ID NO: 28643 - DNA, 22 bp, H. sapiens
accttggcctcccaaagtgtta

SEQ ID NO: 28644 - DNA, 16 bp, H. sapiens
accttggcctctcaaa

SEQ ID NO: 28645 - DNA, 16 bp, H. sapiens
accttgggcaagctgc

SEQ ID NO: 28646 - DNA, 16 bp, H. sapiens
accttgggccagaagg

SEQ ID NO: 28647 - DNA, 16 bp, H. sapiens
accttgtctcaaaaat

SEQ ID NO: 28648 - DNA, 16 bp, H. sapiens
accttgtctcaaacaa

SEQ ID NO: 28649 - DNA, 16 bp, H. sapiens
accttgtctcaagaaa

SEQ ID NO: 28650 - DNA, 16 bp, H. sapiens
accttgtctcaataaa

SEQ ID NO: 28651 - DNA, 16 bp, H. sapiens
accttgtctctacaaa

SEQ ID NO: 28652 - DNA, 17 bp, H. sapiens
accttgtctctactaaa

SEQ ID NO: 28653 - DNA, 16 bp, H. sapiens
accttgtcttcaaaaa

SEQ ID NO: 28654 - DNA, 16 bp, H. sapiens
accttgtcttctcact

SEQ ID NO: 28655 - DNA, 16 bp, H. sapiens
accttgtgaaagtcct

SEQ ID NO: 28656 - DNA, 16 bp, H. sapiens
accttgtgaagaagga

SEQ ID NO: 28657 - DNA, 16 bp, H. sapiens
accttgtgaagcacgt

SEQ ID NO: 28658 - DNA, 16 bp, H. sapiens
accttgttagtcattt

SEQ ID NO: 28659 - DNA, 16 bp, H. sapiens
accttgttgtgctttt

SEQ ID NO: 28660 - DNA, 16 bp, H. sapiens
accttgtttctaccaa

SEQ ID NO: 28661 - DNA, 16 bp, H. sapiens
acctttaaaaaagaaa

SEQ ID NO: 28662 - DNA, 16 bp, H. sapiens
acctttaaaatgggaa

SEQ ID NO: 28663 - DNA, 16 bp, H. sapiens
acctttaatttaaaaa

SEQ ID NO: 28664 - DNA, 16 bp, H. sapiens
acctttacacaaataa

SEQ ID NO: 28665 - DNA, 16 bp, H. sapiens
acctttactctttgat

SEQ ID NO: 28666 - DNA, 16 bp, H. sapiens
acctttagaaaatgct

SEQ ID NO: 28667 - DNA, 16 bp, H. sapiens
acctttattttaagtt

SEQ ID NO: 28668 - DNA, 16 bp, H. sapiens
acctttcaaaaaatca

SEQ ID NO: 28669 - DNA, 16 bp, H. sapiens
acctttccaatttgct

SEQ ID NO: 28670 - DNA, 16 bp, H. sapiens
acctttccagactgaa

SEQ ID NO: 28671 - DNA, 16 bp, H. sapiens
acctttctctttggct

SEQ ID NO: 28672 - DNA, 16 bp, H. sapiens
acctttcttttgatta

SEQ ID NO: 28673 - DNA, 16 bp, H. sapiens
acctttcttttgattt

SEQ ID NO: 28674 - DNA, 16 bp, H. sapiens
acctttcttttgtaaa

SEQ ID NO: 28675 - DNA, 16 bp, H. sapiens
acctttgaaaaaaatt

SEQ ID NO: 28676 - DNA, 16 bp, H. sapiens
acctttgcacttgctg

SEQ ID NO: 28677 - DNA, 16 bp, H. sapiens
acctttgcctccaggg

SEQ ID NO: 28678 - DNA, 16 bp, H. sapiens
acctttgcctcctgag

SEQ ID NO: 28679 - DNA, 16 bp, H. sapiens
acctttgcctctttta

SEQ ID NO: 28680 - DNA, 16 bp, H. sapiens
acctttgccttccagg

SEQ ID NO: 28681 - DNA, 16 bp, H. sapiens
acctttggatggggtt

SEQ ID NO: 28682 - DNA, 16 bp, H. sapiens
acctttgtggttttat

SEQ ID NO: 28683 - DNA, 16 bp, H. sapiens
acctttgttaaaaatg

SEQ ID NO: 28684 - DNA, 16 bp, H. sapiens
accttttaatactgtt

SEQ ID NO: 28685 - DNA, 16 bp, H. sapiens
accttttcaaggagaa

SEQ ID NO: 28686 - DNA, 16 bp, H. sapiens
accttttcttaatcca

SEQ ID NO: 28687 - DNA, 16 bp, H. sapiens
accttttcttccagtt

SEQ ID NO: 28688 - DNA, 16 bp, H. sapiens
accttttggctatttt

SEQ ID NO: 28689 - DNA, 16 bp, H. sapiens
accttttttaaaaaaa

SEQ ID NO: 28690 - DNA, 16 bp, H. sapiens
acgaaaagagtcaaac

SEQ ID NO: 28691 - DNA, 16 bp, H. sapiens
acgaaggcctcaaagc

SEQ ID NO: 28692 - DNA, 16 bp, H. sapiens
acgaccagctgcagag

SEQ ID NO: 28693 - DNA, 16 bp, H. sapiens
acgacctgctgaggtg

SEQ ID NO: 28694 - DNA, 16 bp, H. sapiens
acgacgacgacgacga

SEQ ID NO: 28695 - DNA, 16 bp, H. sapiens
acgactggctaatttt

SEQ ID NO: 28696 - DNA, 16 bp, H. sapiens
acgagagcaaaactcc

SEQ ID NO: 28697 - DNA, 21 bp, H. sapiens
acgagcaaaactccgtctcaa

SEQ ID NO: 28698 - DNA, 16 bp, H. sapiens
acgagcaggagacaga

SEQ ID NO: 28699 - DNA, 16 bp, H. sapiens
acgaggacaggagttc

SEQ ID NO: 28700 - DNA, 17 bp, H. sapiens
acgaggcgggtggatca

SEQ ID NO: 28701 - DNA, 16 bp, H. sapiens
acgaggctgtggagaa

SEQ ID NO: 28702 - DNA, 16 bp, H. sapiens
acgaggtttcaccata

SEQ ID NO: 28703 - DNA, 16 bp, H. sapiens
acgagttcaagatcag

SEQ ID NO: 28704 - DNA, 23 bp, H. sapiens
acgatcttggctcactgcaaccc

SEQ ID NO: 28705 - DNA, 16 bp, H. sapiens
acgatcttggttcact

SEQ ID NO: 28706 - DNA, 26 bp, H. sapiens
acgatgaaaccctgtctctactaaaa

SEQ ID NO: 28707 - DNA, 16 bp, H. sapiens
acgatgaggatgaaga

SEQ ID NO: 28708 - DNA, 16 bp, H. sapiens
acgatgatgatgatga

SEQ ID NO: 28709 - DNA, 16 bp, H. sapiens
acgatgatggtgatga

SEQ ID NO: 28710 - DNA, 16 bp, H. sapiens
acgatggcttccagct

SEQ ID NO: 28711 - DNA, 16 bp, H. sapiens
acgcacacacacacct

SEQ ID NO: 28712 - DNA, 16 bp, H. sapiens
acgcagagccagctgt

SEQ ID NO: 28713 - DNA, 16 bp, H. sapiens
acgccaagctaatttt

SEQ ID NO: 28714 - DNA, 16 bp, H. sapiens
acgccaccatgcccag

SEQ ID NO: 28715 - DNA, 18 bp, H. sapiens
acgccaccatgcccggct

SEQ ID NO: 28716 - DNA, 16 bp, H. sapiens
acgccaggcacagtgg

SEQ ID NO: 28717 - DNA, 16 bp, H. sapiens
acgccaggctaatttt

SEQ ID NO: 28718 - DNA, 16 bp, H. sapiens
acgccatcaaaaagtg

SEQ ID NO: 28719 - DNA, 16 bp, H. sapiens
acgccattctcttgcc

SEQ ID NO: 28720 - DNA, 16 bp, H. sapiens
acgccattgcagtcca

SEQ ID NO: 28721 - DNA, 16 bp, H. sapiens
acgcccaactaatttt

SEQ ID NO: 28722 - DNA, 16 bp, H. sapiens
acgcccaggtaatttt

SEQ ID NO: 28723 - DNA, 16 bp, H. sapiens
acgcccggctaacttt

SEQ ID NO: 28724 - DNA, 16 bp, H. sapiens
acgccgggctaatttt

SEQ ID NO: 28725 - DNA, 16 bp, H. sapiens
acgcctagctaatttt

SEQ ID NO: 28726 - DNA, 16 bp, H. sapiens
acgcctgccaccacgc

SEQ ID NO: 28727 - DNA, 16 bp, H. sapiens
acgcctggccattttt

SEQ ID NO: 28728 - DNA, 16 bp, H. sapiens
acgcctggctaatttt

SEQ ID NO: 28729 - DNA, 16 bp, H. sapiens
acgcgcacacacacac

SEQ ID NO: 28730 - DNA, 16 bp, H. sapiens
acgcgcgcgcacacac

SEQ ID NO: 28731 - DNA, 18 bp, H. sapiens
acgcggtggctcacgcct

SEQ ID NO: 28732 - DNA, 16 bp, H. sapiens
acgctcagctaatttt

SEQ ID NO: 28733 - DNA, 16 bp, H. sapiens
acgctccagcctgggc

SEQ ID NO: 28734 - DNA, 16 bp, H. sapiens
acgctcgactaatttt

SEQ ID NO: 28735 - DNA, 16 bp, H. sapiens
acgctcggctaatttt

SEQ ID NO: 28736 - DNA, 16 bp, H. sapiens
acgctggctcatgcct

SEQ ID NO: 28737 - DNA, 16 bp, H. sapiens
acgctggtctcaaact

SEQ ID NO: 28738 - DNA, 16 bp, H. sapiens
acgctgtctcagaaaa

SEQ ID NO: 28739 - DNA, 16 bp, H. sapiens
acgcttggctaatttt

SEQ ID NO: 28740 - DNA, 16 bp, H. sapiens
acggagcccagcaagc

SEQ ID NO: 28741 - DNA, 16 bp, H. sapiens
acggaggtttcagtga

SEQ ID NO: 28742 - DNA, 16 bp, H. sapiens
acggagtctcactctt

SEQ ID NO: 28743 - DNA, 17 bp, H. sapiens
acggagtcttgcactgt

SEQ ID NO: 28744 - DNA, 16 bp, H. sapiens
acggagtgagactctg

SEQ ID NO: 28745 - DNA, 16 bp, H. sapiens
acggagtttcgctctt

SEQ ID NO: 28746 - DNA, 17 bp, H. sapiens
acggagttttgctcttt

SEQ ID NO: 28747 - DNA, 16 bp, H. sapiens
acggatgaatggatgg

SEQ ID NO: 28748 - DNA, 16 bp, H. sapiens
acggatggcacctgga

SEQ ID NO: 28749 - DNA, 17 bp, H. sapiens
acggattctcactctgt

SEQ ID NO: 28750 - DNA, 16 bp, H. sapiens
acggcaaaacctcatc

SEQ ID NO: 28751 - DNA, 16 bp, H. sapiens
acggcaagctctgcct

SEQ ID NO: 28752 - DNA, 16 bp, H. sapiens
acggcagaaggcaagg

SEQ ID NO: 28753 - DNA, 16 bp, H. sapiens
acggccagctaatttt

SEQ ID NO: 28754 - DNA, 16 bp, H. sapiens
acggccaggcgcggtg

SEQ ID NO: 28755 - DNA, 16 bp, H. sapiens
acggctaatttttgta

SEQ ID NO: 28756 - DNA, 16 bp, H. sapiens
acggctggccaggcgg

SEQ ID NO: 28757 - DNA, 16 bp, H. sapiens
acggctggctaatttt

SEQ ID NO: 28758 - DNA, 16 bp, H. sapiens
acgggcacacaccacc

SEQ ID NO: 28759 - DNA, 16 bp, H. sapiens
acgggcaggctgtggg

SEQ ID NO: 28760 - DNA, 17 bp, H. sapiens
acgggcgtcttcccaga

SEQ ID NO: 28761 - DNA, 16 bp, H. sapiens
acggggcagggctcag

SEQ ID NO: 28762 - DNA, 16 bp, H. sapiens
acggggtgtgtgtgtg

SEQ ID NO: 28763 - DNA, 16 bp, H. sapiens
acggtaaaaccctgtc

SEQ ID NO: 28764 - DNA, 16 bp, H. sapiens
acggtctcattctgtc

SEQ ID NO: 28765 - DNA, 16 bp, H. sapiens
acggtcttgctctgtc

SEQ ID NO: 28766 - DNA, 26 bp, H. sapiens
acggtgaaaccccgtctctactaaac

SEQ ID NO: 28767 - DNA, 16 bp, H. sapiens
acggtgcaccaggaga

SEQ ID NO: 28768 - DNA, 16 bp, H. sapiens
acggtggcatgatctc

SEQ ID NO: 28769 - DNA, 16 bp, H. sapiens
acgtacctgtggtccc

SEQ ID NO: 28770 - DNA, 16 bp, H. sapiens
acgtatataaatatat

SEQ ID NO: 28771 - DNA, 16 bp, H. sapiens
acgtatatatgtgtgt

SEQ ID NO: 28772 - DNA, 16 bp, H. sapiens
acgtccagctaatttt

SEQ ID NO: 28773 - DNA, 16 bp, H. sapiens
acgtccggctaatttt

SEQ ID NO: 28774 - DNA, 16 bp, H. sapiens
acgtctacaaccatct

SEQ ID NO: 28775 - DNA, 16 bp, H. sapiens
acgtctggctaatttt

SEQ ID NO: 28776 - DNA, 16 bp, H. sapiens
acgtctgtaatctcag

SEQ ID NO: 28777 - DNA, 16 bp, H. sapiens
acgtgaacccaggagg

SEQ ID NO: 28778 - DNA, 17 bp, H. sapiens
acgtgaaggaactcttc

SEQ ID NO: 28779 - DNA, 16 bp, H. sapiens
acgtgacaaatgcaca

SEQ ID NO: 28780 - DNA, 16 bp, H. sapiens
acgtgagggacaaaca

SEQ ID NO: 28781 - DNA, 16 bp, H. sapiens
acgtgccaggcactgt

SEQ ID NO: 28782 - DNA, 16 bp, H. sapiens
acgtgcctttcacctt

SEQ ID NO: 28783 - DNA, 16 bp, H. sapiens
acgtgctgggattgca

SEQ ID NO: 28784 - DNA, 16 bp, H. sapiens
acgtggacacagggag

SEQ ID NO: 28785 - DNA, 16 bp, H. sapiens
acgtggagctgtgagt

SEQ ID NO: 28786 - DNA, 16 bp, H. sapiens
acgtggcaaaactcca

SEQ ID NO: 28787 - DNA, 16 bp, H. sapiens
acgtggcccctgctgc

SEQ ID NO: 28788 - DNA, 16 bp, H. sapiens
acgtggctgtgctgga

SEQ ID NO: 28789 - DNA, 16 bp, H. sapiens
acgtggtggtgggcac

SEQ ID NO: 28790 - DNA, 16 bp, H. sapiens
acgtgtaatcccagca

SEQ ID NO: 28791 - DNA, 16 bp, H. sapiens
acgtgtatacctgtgt

SEQ ID NO: 28792 - DNA, 16 bp, H. sapiens
acgtgtatatgtatat

SEQ ID NO: 28793 - DNA, 17 bp, H. sapiens
acgtgtatgttcattgc

SEQ ID NO: 28794 - DNA, 16 bp, H. sapiens
acgtgtctggggaggc

SEQ ID NO: 28795 - DNA, 16 bp, H. sapiens
acgtgtgcacacacac

SEQ ID NO: 28796 - DNA, 16 bp, H. sapiens
acgtgtgtaatcccag

SEQ ID NO: 28797 - DNA, 16 bp, H. sapiens
acgtgtgtatatatat

SEQ ID NO: 28798 - DNA, 16 bp, H. sapiens
acgtgtgtgtacacac

SEQ ID NO: 28799 - DNA, 17 bp, H. sapiens
acgttggccaggctagt

SEQ ID NO: 28800 - DNA, 16 bp, H. sapiens
acgttggccaggttgg

SEQ ID NO: 28801 - DNA, 19 bp, H. sapiens
acgtttacctatgtaacaa

SEQ ID NO: 28802 - DNA, 16 bp, H. sapiens
acgtttgtaatcccag

SEQ ID NO: 28803 - DNA, 16 bp, H. sapiens
acgtttgtatttttag

SEQ ID NO: 28804 - DNA, 16 bp, H. sapiens
acgttttctttatcca

SEQ ID NO: 28805 - DNA, 16 bp, H. sapiens
actaaaaagtttaaaa

SEQ ID NO: 28806 - DNA, 16 bp, H. sapiens
actaaaaatacatgaa

SEQ ID NO: 28807 - DNA, 16 bp, H. sapiens
actaaaaataccattt

SEQ ID NO: 28808 - DNA, 16 bp, H. sapiens
actaaaaatgcagaaa

SEQ ID NO: 28809 - DNA, 16 bp, H. sapiens
actaaaaatgtaaaat

SEQ ID NO: 28810 - DNA, 16 bp, H. sapiens
actaaaaattgagcta

SEQ ID NO: 28811 - DNA, 16 bp, H. sapiens
actaaaacagtaaatt

SEQ ID NO: 28812 - DNA, 16 bp, H. sapiens
actaaaaggaaatgag

SEQ ID NO: 28813 - DNA, 16 bp, H. sapiens
actaaaatcagaaatg

SEQ ID NO: 28814 - DNA, 16 bp, H. sapiens
actaaaatttcagaat

SEQ ID NO: 28815 - DNA, 16 bp, H. sapiens
actaaacacaatgaaa

SEQ ID NO: 28816 - DNA, 16 bp, H. sapiens
actaaacccaaaatta

SEQ ID NO: 28817 - DNA, 16 bp, H. sapiens
actaaagagcccttgg

SEQ ID NO: 28818 - DNA, 16 bp, H. sapiens
actaaagagcttctat

SEQ ID NO: 28819 - DNA, 16 bp, H. sapiens
actaaagataaagaga

SEQ ID NO: 28820 - DNA, 16 bp, H. sapiens
actaaagcccagagag

SEQ ID NO: 28821 - DNA, 17 bp, H. sapiens
actaaaggagatagaga

SEQ ID NO: 28822 - DNA, 16 bp, H. sapiens
actaaatttatttcat

SEQ ID NO: 28823 - DNA, 16 bp, H. sapiens
actaaattttttgtat

SEQ ID NO: 28824 - DNA, 16 bp, H. sapiens
actaacaaattagtca

SEQ ID NO: 28825 - DNA, 16 bp, H. sapiens
actaacacagaaacag

SEQ ID NO: 28826 - DNA, 16 bp, H. sapiens
actaacacagtgaaac

SEQ ID NO: 28827 - DNA, 16 bp, H. sapiens
actaacactaacaata

SEQ ID NO: 28828 - DNA, 16 bp, H. sapiens
actaacagcattttgg

SEQ ID NO: 28829 - DNA, 16 bp, H. sapiens
actaacaggagaatgc

SEQ ID NO: 28830 - DNA, 16 bp, H. sapiens
actaactatcatgaga

SEQ ID NO: 28831 - DNA, 16 bp, H. sapiens
actaagaaaccaacat

SEQ ID NO: 28832 - DNA, 16 bp, H. sapiens
actaagatcaggaaca

SEQ ID NO: 28833 - DNA, 17 bp, H. sapiens
actaagcaaaaagaaca

SEQ ID NO: 28834 - DNA, 17 bp, H. sapiens
actaagctctgattttt

SEQ ID NO: 28835 - DNA, 16 bp, H. sapiens
actaaggaaatgcaaa

SEQ ID NO: 28836 - DNA, 16 bp, H. sapiens
actaaggaagctgagg

SEQ ID NO: 28837 - DNA, 16 bp, H. sapiens
actaaggcaagaaccc

SEQ ID NO: 28838 - DNA, 16 bp, H. sapiens
actaaggctcagagag

SEQ ID NO: 28839 - DNA, 16 bp, H. sapiens
actaaggggatggtgc

SEQ ID NO: 28840 - DNA, 16 bp, H. sapiens
actaagtaacttgccc

SEQ ID NO: 28841 - DNA, 16 bp, H. sapiens
actaagtatgatgtta

SEQ ID NO: 28842 - DNA, 16 bp, H. sapiens
actaagtctcactctg

SEQ ID NO: 28843 - DNA, 17 bp, H. sapiens
actaatacagtaaactg

SEQ ID NO: 28844 - DNA, 16 bp, H. sapiens
actaatacagtaaatt

SEQ ID NO: 28845 - DNA, 16 bp, H. sapiens
actaatagtaataata

SEQ ID NO: 28846 - DNA, 17 bp, H. sapiens
actaatatccagaatct

SEQ ID NO: 28847 - DNA, 16 bp, H. sapiens
actaatcataagagaa

SEQ ID NO: 28848 - DNA, 16 bp, H. sapiens
actaatcatcaaagaa

SEQ ID NO: 28849 - DNA, 16 bp, H. sapiens
actaatcatcagaaaa

SEQ ID NO: 28850 - DNA, 16 bp, H. sapiens
actaatcatcagagaa

SEQ ID NO: 28851 - DNA, 17 bp, H. sapiens
actaatccactccacca

SEQ ID NO: 28852 - DNA, 16 bp, H. sapiens
actaatcccatcatga

SEQ ID NO: 28853 - DNA, 16 bp, H. sapiens
actaatcccattgatg

SEQ ID NO: 28854 - DNA, 16 bp, H. sapiens
actaatctgttttcca

SEQ ID NO: 28855 - DNA, 16 bp, H. sapiens
actaatgaagcagaaa

SEQ ID NO: 28856 - DNA, 16 bp, H. sapiens
actaatgaggaaactg

SEQ ID NO: 28857 - DNA, 16 bp, H. sapiens
actaatgcaggaacag

SEQ ID NO: 28858 - DNA, 16 bp, H. sapiens
actaatgggcaaaaca

SEQ ID NO: 28859 - DNA, 16 bp, H. sapiens
actaatttaaatgtta

SEQ ID NO: 28860 - DNA, 16 bp, H. sapiens
actaatttacactcct

SEQ ID NO: 28861 - DNA, 20 bp, H. sapiens
actaatttaccagggccttt

SEQ ID NO: 28862 - DNA, 16 bp, H. sapiens
actacaaaaaattagc

SEQ ID NO: 28863 - DNA, 16 bp, H. sapiens
actacaaaaacatact

SEQ ID NO: 28864 - DNA, 16 bp, H. sapiens
actacaaaaatcagct

SEQ ID NO: 28865 - DNA, 16 bp, H. sapiens
actacaaaatattact

SEQ ID NO: 28866 - DNA, 16 bp, H. sapiens
actacaaagcaacagt

SEQ ID NO: 28867 - DNA, 16 bp, H. sapiens
actacaacaccaaaag

SEQ ID NO: 28868 - DNA, 16 bp, H. sapiens
actacaactcccagca

SEQ ID NO: 28869 - DNA, 16 bp, H. sapiens
actacaagcagccaga

SEQ ID NO: 28870 - DNA, 16 bp, H. sapiens
actacaagcgcacacc

SEQ ID NO: 28871 - DNA, 16 bp, H. sapiens
actacaataaagcaaa

SEQ ID NO: 28872 - DNA, 16 bp, H. sapiens
actacacacttttaaa

SEQ ID NO: 28873 - DNA, 16 bp, H. sapiens
actacacctggccaaa

SEQ ID NO: 28874 - DNA, 16 bp, H. sapiens
actacagagagagaga

SEQ ID NO: 28875 - DNA, 16 bp, H. sapiens
actacagatcaatatc

SEQ ID NO: 28876 - DNA, 16 bp, H. sapiens
actacagcctcagcct

SEQ ID NO: 28877 - DNA, 16 bp, H. sapiens
actacagcctccactt

SEQ ID NO: 28878 - DNA, 16 bp, H. sapiens
actacagcctctgcct

SEQ ID NO: 28879 - DNA, 16 bp, H. sapiens
actacagcctgggcga

SEQ ID NO: 28880 - DNA, 16 bp, H. sapiens
actacagccttaacct

SEQ ID NO: 28881 - DNA, 16 bp, H. sapiens
actacaggcacacaca

SEQ ID NO: 28882 - DNA, 21 bp, H. sapiens
actacaggcacatgccaccac

SEQ ID NO: 28883 - DNA, 17 bp, H. sapiens
actacaggcacgtgcca

SEQ ID NO: 28884 - DNA, 16 bp, H. sapiens
actacaggcatgaacc

SEQ ID NO: 28885 - DNA, 28 bp, H. sapiens
actacaggcgcctgccaccacgcctggc

SEQ ID NO: 28886 - DNA, 16 bp, H. sapiens
actacaggtgcatact

SEQ ID NO: 28887 - DNA, 17 bp, H. sapiens
actacaggtgtgtacca

SEQ ID NO: 28888 - DNA, 17 bp, H. sapiens
actacaggtgtgtgcca

SEQ ID NO: 28889 - DNA, 16 bp, H. sapiens
actacagtaaccaaaa

SEQ ID NO: 28890 - DNA, 16 bp, H. sapiens
actacagtggtgtgat

SEQ ID NO: 28891 - DNA, 17 bp, H. sapiens
actacagttgtgtgcca

SEQ ID NO: 28892 - DNA, 16 bp, H. sapiens
actacatcaactaatg

SEQ ID NO: 28893 - DNA, 16 bp, H. sapiens
actacatgacattctg

SEQ ID NO: 28894 - DNA, 16 bp, H. sapiens
actacatgtaaactga

SEQ ID NO: 28895 - DNA, 16 bp, H. sapiens
actacattttccaaaa

SEQ ID NO: 28896 - DNA, 16 bp, H. sapiens
actaccacacctggct

SEQ ID NO: 28897 - DNA, 16 bp, H. sapiens
actaccaccatcacca

SEQ ID NO: 28898 - DNA, 16 bp, H. sapiens
actaccacgcccagct

SEQ ID NO: 28899 - DNA, 22 bp, H. sapiens
actaccacgcccggctaatttt

SEQ ID NO: 28900 - DNA, 16 bp, H. sapiens
actaccagacttcaaa

SEQ ID NO: 28901 - DNA, 16 bp, H. sapiens
actaccaggcccagct

SEQ ID NO: 28902 - DNA, 16 bp, H. sapiens
actaccatgcccagct

SEQ ID NO: 28903 - DNA, 16 bp, H. sapiens
actaccatgcccagtt

SEQ ID NO: 28904 - DNA, 16 bp, H. sapiens
actaccatgcctggct

SEQ ID NO: 28905 - DNA, 16 bp, H. sapiens
actaccccttccctag

SEQ ID NO: 28906 - DNA, 16 bp, H. sapiens
actacctcatagggtt

SEQ ID NO: 28907 - DNA, 16 bp, H. sapiens
actacctggaaactga

SEQ ID NO: 28908 - DNA, 16 bp, H. sapiens
actacctgtgtgacct

SEQ ID NO: 28909 - DNA, 16 bp, H. sapiens
actacgcccagctaat

SEQ ID NO: 28910 - DNA, 16 bp, H. sapiens
actactaaaaggagct

SEQ ID NO: 28911 - DNA, 16 bp, H. sapiens
actactacacacctat

SEQ ID NO: 28912 - DNA, 16 bp, H. sapiens
actactactaccacca

SEQ ID NO: 28913 - DNA, 16 bp, H. sapiens
actactactactactg

SEQ ID NO: 28914 - DNA, 16 bp, H. sapiens
actactataagaaaac

SEQ ID NO: 28915 - DNA, 16 bp, H. sapiens
actactatgaacacct

SEQ ID NO: 28916 - DNA, 16 bp, H. sapiens
actactcagcaagaaa

SEQ ID NO: 28917 - DNA, 16 bp, H. sapiens
actactcagcaatata

SEQ ID NO: 28918 - DNA, 16 bp, H. sapiens
actactgaaagaaaac

SEQ ID NO: 28919 - DNA, 16 bp, H. sapiens
actactgcactcctgc

SEQ ID NO: 28920 - DNA, 16 bp, H. sapiens
actactgctgctgctg

SEQ ID NO: 28921 - DNA, 16 bp, H. sapiens
actactggaagaaaat

SEQ ID NO: 28922 - DNA, 16 bp, H. sapiens
actactggtgtgtgcc

SEQ ID NO: 28923 - DNA, 16 bp, H. sapiens
actactgtagacttta

SEQ ID NO: 28924 - DNA, 16 bp, H. sapiens
actactgtgcccagct

SEQ ID NO: 28925 - DNA, 16 bp, H. sapiens
actacttattagctgt

SEQ ID NO: 28926 - DNA, 16 bp, H. sapiens
actacttgagaccatc

SEQ ID NO: 28927 - DNA, 16 bp, H. sapiens
actactttcttcaaag

SEQ ID NO: 28928 - DNA, 16 bp, H. sapiens
actagaaaaaactgtt

SEQ ID NO: 28929 - DNA, 16 bp, H. sapiens
actagaaaacctagaa

SEQ ID NO: 28930 - DNA, 16 bp, H. sapiens
actagaaaagcaaaag

SEQ ID NO: 28931 - DNA, 16 bp, H. sapiens
actagaaaaggaagaa

SEQ ID NO: 28932 - DNA, 16 bp, H. sapiens
actagaaaaggagcaa

SEQ ID NO: 28933 - DNA, 16 bp, H. sapiens
actagaaaatttaaaa

SEQ ID NO: 28934 - DNA, 16 bp, H. sapiens
actagaaaggctaaaa

SEQ ID NO: 28935 - DNA, 16 bp, H. sapiens
actagaaagtctagaa

SEQ ID NO: 28936 - DNA, 16 bp, H. sapiens
actagaaataaataac

SEQ ID NO: 28937 - DNA, 16 bp, H. sapiens
actagaacttattcct

SEQ ID NO: 28938 - DNA, 16 bp, H. sapiens
actagaagcagcagca

SEQ ID NO: 28939 - DNA, 16 bp, H. sapiens
actagaatatttaaaa

SEQ ID NO: 28940 - DNA, 16 bp, H. sapiens
actagaatgactaaaa

SEQ ID NO: 28941 - DNA, 16 bp, H. sapiens
actagaccaagcagaa

SEQ ID NO: 28942 - DNA, 16 bp, H. sapiens
actagacccccacctc

SEQ ID NO: 28943 - DNA, 16 bp, H. sapiens
actagagaagcaggag

SEQ ID NO: 28944 - DNA, 16 bp, H. sapiens
actagagacagggttt

SEQ ID NO: 28945 - DNA, 16 bp, H. sapiens
actagagaggaaaaag

SEQ ID NO: 28946 - DNA, 16 bp, H. sapiens
actagagatgggattt

SEQ ID NO: 28947 - DNA, 16 bp, H. sapiens
actagattgcctttgt

SEQ ID NO: 28948 - DNA, 16 bp, H. sapiens
actagcaaagacatgg

SEQ ID NO: 28949 - DNA, 16 bp, H. sapiens
actagcatttgttatt

SEQ ID NO: 28950 - DNA, 17 bp, H. sapiens
actagccaggcgtggtg

SEQ ID NO: 28951 - DNA, 16 bp, H. sapiens
actagcctagacaaca

SEQ ID NO: 28952 - DNA, 16 bp, H. sapiens
actagctgtgtgacat

SEQ ID NO: 28953 - DNA, 16 bp, H. sapiens
actagctgtgtggcct

SEQ ID NO: 28954 - DNA, 16 bp, H. sapiens
actagcttgcagctcc

SEQ ID NO: 28955 - DNA, 16 bp, H. sapiens
actaggaagtggcaga

SEQ ID NO: 28956 - DNA, 16 bp, H. sapiens
actaggctgggtgtgg

SEQ ID NO: 28957 - DNA, 16 bp, H. sapiens
actaggtaatttttaa

SEQ ID NO: 28958 - DNA, 16 bp, H. sapiens
actaggtcttattcat

SEQ ID NO: 28959 - DNA, 16 bp, H. sapiens
actaggtgacagagca

SEQ ID NO: 28960 - DNA, 16 bp, H. sapiens
actagtaaaaatacaa

SEQ ID NO: 28961 - DNA, 16 bp, H. sapiens
actagtagtagtagta

SEQ ID NO: 28962 - DNA, 16 bp, H. sapiens
actagtggttctcaaa

SEQ ID NO: 28963 - DNA, 16 bp, H. sapiens
actagtttcagaagga

SEQ ID NO: 28964 - DNA, 16 bp, H. sapiens
actataaaaagagaca

SEQ ID NO: 28965 - DNA, 16 bp, H. sapiens
actataaaatatgaaa

SEQ ID NO: 28966 - DNA, 16 bp, H. sapiens
actataaaatccctag

SEQ ID NO: 28967 - DNA, 16 bp, H. sapiens
actataagtttcctga

SEQ ID NO: 28968 - DNA, 18 bp, H. sapiens
actataatcccagcactt

SEQ ID NO: 28969 - DNA, 16 bp, H. sapiens
actatacacacataca

SEQ ID NO: 28970 - DNA, 16 bp, H. sapiens
actatacattgtatgt

SEQ ID NO: 28971 - DNA, 16 bp, H. sapiens
actataccactgcact

SEQ ID NO: 28972 - DNA, 16 bp, H. sapiens
actataggcaagcacc

SEQ ID NO: 28973 - DNA, 16 bp, H. sapiens
actatagtcaccttgt

SEQ ID NO: 28974 - DNA, 16 bp, H. sapiens
actatagttagtaaca

SEQ ID NO: 28975 - DNA, 16 bp, H. sapiens
actatagttagtaata

SEQ ID NO: 28976 - DNA, 16 bp, H. sapiens
actatagttttgcaag

SEQ ID NO: 28977 - DNA, 16 bp, H. sapiens
actatataatgataaa

SEQ ID NO: 28978 - DNA, 16 bp, H. sapiens
actatatagcctaggt

SEQ ID NO: 28979 - DNA, 16 bp, H. sapiens
actatatattatagta

SEQ ID NO: 28980 - DNA, 16 bp, H. sapiens
actatatctcaataaa

SEQ ID NO: 28981 - DNA, 16 bp, H. sapiens
actatatgccagacat

SEQ ID NO: 28982 - DNA, 16 bp, H. sapiens
actatattatccaaca

SEQ ID NO: 28983 - DNA, 16 bp, H. sapiens
actatcaaaagaataa

SEQ ID NO: 28984 - DNA, 16 bp, H. sapiens
actatcacaggaacag

SEQ ID NO: 28985 - DNA, 16 bp, H. sapiens
actatcatttcaacat

SEQ ID NO: 28986 - DNA, 16 bp, H. sapiens
actatcccaagaacag

SEQ ID NO: 28987 - DNA, 16 bp, H. sapiens
actatccccattttac

SEQ ID NO: 28988 - DNA, 17 bp, H. sapiens
actatcctgcagcttga

SEQ ID NO: 28989 - DNA, 16 bp, H. sapiens
actatcctttctccac

SEQ ID NO: 28990 - DNA, 16 bp, H. sapiens
actatctacacagaaa

SEQ ID NO: 28991 - DNA, 16 bp, H. sapiens
actatctcatgccagt

SEQ ID NO: 28992 - DNA, 16 bp, H. sapiens
actatctgaaaagaaa

SEQ ID NO: 28993 - DNA, 16 bp, H. sapiens
actatgaagaaactac

SEQ ID NO: 28994 - DNA, 16 bp, H. sapiens
actatgaagaaactgc

SEQ ID NO: 28995 - DNA, 16 bp, H. sapiens
actatgcagaagcttt

SEQ ID NO: 28996 - DNA, 17 bp, H. sapiens
actatgcagccatgaaa

SEQ ID NO: 28997 - DNA, 16 bp, H. sapiens
actatgcccagcccca

SEQ ID NO: 28998 - DNA, 16 bp, H. sapiens
actatgcctctgacaa

SEQ ID NO: 28999 - DNA, 16 bp, H. sapiens
actatgcctggcccac

SEQ ID NO: 29000 - DNA, 16 bp, H. sapiens
actatggaaaacagcg

SEQ ID NO: 29001 - DNA, 16 bp, H. sapiens
actatggaggattcac

SEQ ID NO: 29002 - DNA, 16 bp, H. sapiens
actatggaggctgaga

SEQ ID NO: 29003 - DNA, 16 bp, H. sapiens
actatgggaacctacc

SEQ ID NO: 29004 - DNA, 16 bp, H. sapiens
actatgtacaaaaatt

SEQ ID NO: 29005 - DNA, 16 bp, H. sapiens
actatgtacacacaaa

SEQ ID NO: 29006 - DNA, 16 bp, H. sapiens
actatgtatttttaaa

SEQ ID NO: 29007 - DNA, 16 bp, H. sapiens
actatgtcaaaaaaaa

SEQ ID NO: 29008 - DNA, 16 bp, H. sapiens
actatgtcttatttat

SEQ ID NO: 29009 - DNA, 16 bp, H. sapiens
actatgtctttaaaaa

SEQ ID NO: 29010 - DNA, 16 bp, H. sapiens
actatgtgccagacac

SEQ ID NO: 29011 - DNA, 16 bp, H. sapiens
actatgttgcccaggg

SEQ ID NO: 29012 - DNA, 20 bp, H. sapiens
actatgttgctcaggctggt

SEQ ID NO: 29013 - DNA, 16 bp, H. sapiens
actattaaaaagtcag

SEQ ID NO: 29014 - DNA, 16 bp, H. sapiens
actattaaaaatgtga

SEQ ID NO: 29015 - DNA, 16 bp, H. sapiens
actattaaaatattca

SEQ ID NO: 29016 - DNA, 16 bp, H. sapiens
actattacaatggcaa

SEQ ID NO: 29017 - DNA, 16 bp, H. sapiens
actattactattacta

SEQ ID NO: 29018 - DNA, 19 bp, H. sapiens
actattaggttggtgcaaa

SEQ ID NO: 29019 - DNA, 16 bp, H. sapiens
actattatccccattt

SEQ ID NO: 29020 - DNA, 16 bp, H. sapiens
actattcatgagtatt

SEQ ID NO: 29021 - DNA, 16 bp, H. sapiens
actattccatcaccac

SEQ ID NO: 29022 - DNA, 16 bp, H. sapiens
actattctaggcactt

SEQ ID NO: 29023 - DNA, 16 bp, H. sapiens
actattctgtgtgata

SEQ ID NO: 29024 - DNA, 16 bp, H. sapiens
actattctttccccca

SEQ ID NO: 29025 - DNA, 16 bp, H. sapiens
actattctttctccat

SEQ ID NO: 29026 - DNA, 16 bp, H. sapiens
actattgaagaaacag

SEQ ID NO: 29027 - DNA, 16 bp, H. sapiens
actattgcaaggacag

SEQ ID NO: 29028 - DNA, 16 bp, H. sapiens
actattgctttgtagt

SEQ ID NO: 29029 - DNA, 16 bp, H. sapiens
actattgtgaatagtg

SEQ ID NO: 29030 - DNA, 16 bp, H. sapiens
actatttcttctgaaa

SEQ ID NO: 29031 - DNA, 16 bp, H. sapiens
actatttggggtcttt

SEQ ID NO: 29032 - DNA, 16 bp, H. sapiens
actattttaaaatgtt

SEQ ID NO: 29033 - DNA, 16 bp, H. sapiens
actattttcattaaaa

SEQ ID NO: 29034 - DNA, 16 bp, H. sapiens
actattttgattactg

SEQ ID NO: 29035 - DNA, 16 bp, H. sapiens
actattttgcccaggc

SEQ ID NO: 29036 - DNA, 16 bp, H. sapiens
actattttggagcttt

SEQ ID NO: 29037 - DNA, 16 bp, H. sapiens
actcaaaaatgtggaa

SEQ ID NO: 29038 - DNA, 16 bp, H. sapiens
actcaaaataattgaa

SEQ ID NO: 29039 - DNA, 16 bp, H. sapiens
actcaaaccaaaggca

SEQ ID NO: 29040 - DNA, 16 bp, H. sapiens
actcaaagaccccatc

SEQ ID NO: 29041 - DNA, 16 bp, H. sapiens
actcaaagcaaaggca

SEQ ID NO: 29042 - DNA, 16 bp, H. sapiens
actcaaaggaaaagaa

SEQ ID NO: 29043 - DNA, 16 bp, H. sapiens
actcaaataatatttt

SEQ ID NO: 29044 - DNA, 16 bp, H. sapiens
actcaaatatttattg

SEQ ID NO: 29045 - DNA, 16 bp, H. sapiens
actcaacaaagaaaca

SEQ ID NO: 29046 - DNA, 16 bp, H. sapiens
actcaacagtaaaaac

SEQ ID NO: 29047 - DNA, 16 bp, H. sapiens
actcaacattatgttt

SEQ ID NO: 29048 - DNA, 16 bp, H. sapiens
actcaagaagaaataa

SEQ ID NO: 29049 - DNA, 16 bp, H. sapiens
actcaagaggcagagg

SEQ ID NO: 29050 - DNA, 16 bp, H. sapiens
actcaagaggcaggag

SEQ ID NO: 29051 - DNA, 16 bp, H. sapiens
actcaagaggctgacg

SEQ ID NO: 29052 - DNA, 16 bp, H. sapiens
actcaagccctcactc

SEQ ID NO: 29053 - DNA, 16 bp, H. sapiens
actcaaggcctgctgt

SEQ ID NO: 29054 - DNA, 16 bp, H. sapiens
actcaagtcccacagt

SEQ ID NO: 29055 - DNA, 16 bp, H. sapiens
actcaagtcctgcagt

SEQ ID NO: 29056 - DNA, 16 bp, H. sapiens
actcaagtgatccacc

SEQ ID NO: 29057 - DNA, 16 bp, H. sapiens
actcaagtgatctgcc

SEQ ID NO: 29058 - DNA, 16 bp, H. sapiens
actcaataaaaaatga

SEQ ID NO: 29059 - DNA, 16 bp, H. sapiens
actcaataatgaaaag

SEQ ID NO: 29060 - DNA, 18 bp, H. sapiens
actcaatagatgcagaaa

SEQ ID NO: 29061 - DNA, 16 bp, H. sapiens
actcaatggtgaaaag

SEQ ID NO: 29062 - DNA, 16 bp, H. sapiens
actcaattttttaaaa

SEQ ID NO: 29063 - DNA, 16 bp, H. sapiens
actcacaatagccaaa

SEQ ID NO: 29064 - DNA, 16 bp, H. sapiens
actcacaccatcacaa

SEQ ID NO: 29065 - DNA, 16 bp, H. sapiens
actcacacctgtaatc

SEQ ID NO: 29066 - DNA, 16 bp, H. sapiens
actcacagaagcagag

SEQ ID NO: 29067 - DNA, 16 bp, H. sapiens
actcacagacaccact

SEQ ID NO: 29068 - DNA, 16 bp, H. sapiens
actcacagagacagaa

SEQ ID NO: 29069 - DNA, 16 bp, H. sapiens
actcacagcaacctct

SEQ ID NO: 29070 - DNA, 16 bp, H. sapiens
actcacagctctgcag

SEQ ID NO: 29071 - DNA, 16 bp, H. sapiens
actcacaggtcctaga

SEQ ID NO: 29072 - DNA, 16 bp, H. sapiens
actcacagtatttgag

SEQ ID NO: 29073 - DNA, 16 bp, H. sapiens
actcacagttccacaa

SEQ ID NO: 29074 - DNA, 16 bp, H. sapiens
actcacataaacttaa

SEQ ID NO: 29075 - DNA, 16 bp, H. sapiens
actcaccacaacctct

SEQ ID NO: 29076 - DNA, 16 bp, H. sapiens
actcaccgcaacctcc

SEQ ID NO: 29077 - DNA, 16 bp, H. sapiens
actcaccttggccttc

SEQ ID NO: 29078 - DNA, 21 bp, H. sapiens
actcacgcctgtaatcccaga

SEQ ID NO: 29079 - DNA, 16 bp, H. sapiens
actcacgcctgtcatc

SEQ ID NO: 29080 - DNA, 16 bp, H. sapiens
actcacgtgtttgtgg

SEQ ID NO: 29081 - DNA, 16 bp, H. sapiens
actcactacaacctcc

SEQ ID NO: 29082 - DNA, 16 bp, H. sapiens
actcactcactactgc

SEQ ID NO: 29083 - DNA, 16 bp, H. sapiens
actcactcactcattc

SEQ ID NO: 29084 - DNA, 16 bp, H. sapiens
actcactccagcctgg

SEQ ID NO: 29085 - DNA, 16 bp, H. sapiens
actcactcttattctc

SEQ ID NO: 29086 - DNA, 16 bp, H. sapiens
actcactgcaacctcc

SEQ ID NO: 29087 - DNA, 16 bp, H. sapiens
actcactgcaacctct

SEQ ID NO: 29088 - DNA, 16 bp, H. sapiens
actcactgcaagctcc

SEQ ID NO: 29089 - DNA, 16 bp, H. sapiens
actcactgcagccctg

SEQ ID NO: 29090 - DNA, 16 bp, H. sapiens
actcactgcagcctca

SEQ ID NO: 29091 - DNA, 16 bp, H. sapiens
actcactgcagcctcc

SEQ ID NO: 29092 - DNA, 16 bp, H. sapiens
actcactgcagcctcg

SEQ ID NO: 29093 - DNA, 16 bp, H. sapiens
actcactgtaacctcc

SEQ ID NO: 29094 - DNA, 16 bp, H. sapiens
actcactgtagcctca

SEQ ID NO: 29095 - DNA, 16 bp, H. sapiens
actcactgtgtcaccc

SEQ ID NO: 29096 - DNA, 16 bp, H. sapiens
actcacttaattctca

SEQ ID NO: 29097 - DNA, 16 bp, H. sapiens
actcacttgctgtgtg

SEQ ID NO: 29098 - DNA, 16 bp, H. sapiens
actcacttttctcttc

SEQ ID NO: 29099 - DNA, 16 bp, H. sapiens
actcagaaaaacagtt

SEQ ID NO: 29100 - DNA, 16 bp, H. sapiens
actcagaacacagcag

SEQ ID NO: 29101 - DNA, 16 bp, H. sapiens
actcagaactcagcag

SEQ ID NO: 29102 - DNA, 16 bp, H. sapiens
actcagaagctgaggc

SEQ ID NO: 29103 - DNA, 16 bp, H. sapiens
actcagaaggctcagg

SEQ ID NO: 29104 - DNA, 16 bp, H. sapiens
actcagaaggtggagg

SEQ ID NO: 29105 - DNA, 16 bp, H. sapiens
actcagaatggattaa

SEQ ID NO: 29106 - DNA, 16 bp, H. sapiens
actcagagaagttaaa

SEQ ID NO: 29107 - DNA, 16 bp, H. sapiens
actcagagaggctgag

SEQ ID NO: 29108 - DNA, 16 bp, H. sapiens
actcagagataaccac

SEQ ID NO: 29109 - DNA, 23 bp, H. sapiens
actcagatcatggggactggagt

SEQ ID NO: 29110 - DNA, 16 bp, H. sapiens
actcagatttttaaaa

SEQ ID NO: 29111 - DNA, 16 bp, H. sapiens
actcagcacagtgcct

SEQ ID NO: 29112 - DNA, 16 bp, H. sapiens
actcagcaggcagagg

SEQ ID NO: 29113 - DNA, 16 bp, H. sapiens
actcagcatgccaaag

SEQ ID NO: 29114 - DNA, 16 bp, H. sapiens
actcagccatgaaaaa

SEQ ID NO: 29115 - DNA, 16 bp, H. sapiens
actcagcctccagcaa

SEQ ID NO: 29116 - DNA, 21 bp, H. sapiens
actcagcctcccgagtagctg

SEQ ID NO: 29117 - DNA, 16 bp, H. sapiens
actcagcctctcaaag

SEQ ID NO: 29118 - DNA, 16 bp, H. sapiens
actcagcctgcctgca

SEQ ID NO: 29119 - DNA, 16 bp, H. sapiens
actcagccttccaaag

SEQ ID NO: 29120 - DNA, 16 bp, H. sapiens
actcagctcactgcaa

SEQ ID NO: 29121 - DNA, 16 bp, H. sapiens
actcagctctccacca

SEQ ID NO: 29122 - DNA, 16 bp, H. sapiens
actcagctctgcaaca

SEQ ID NO: 29123 - DNA, 18 bp, H. sapiens
actcagctctgcaccaag

SEQ ID NO: 29124 - DNA, 16 bp, H. sapiens
actcagctgtggacca

SEQ ID NO: 29125 - DNA, 16 bp, H. sapiens
actcaggaaaataaaa

SEQ ID NO: 29126 - DNA, 16 bp, H. sapiens
actcaggaaatatttg

SEQ ID NO: 29127 - DNA, 16 bp, H. sapiens
actcaggaagcagagg

SEQ ID NO: 29128 - DNA, 16 bp, H. sapiens
actcaggaagctcagg

SEQ ID NO: 29129 - DNA, 16 bp, H. sapiens
actcaggaagctgagc

SEQ ID NO: 29130 - DNA, 16 bp, H. sapiens
actcaggaatggaaaa

SEQ ID NO: 29131 - DNA, 16 bp, H. sapiens
actcaggaatgggaaa

SEQ ID NO: 29132 - DNA, 16 bp, H. sapiens
actcaggagactaagg

SEQ ID NO: 29133 - DNA, 19 bp, H. sapiens
actcaggagcccagctggc

SEQ ID NO: 29134 - DNA, 21 bp, H. sapiens
actcaggagcccagctggctt

SEQ ID NO: 29135 - DNA, 16 bp, H. sapiens
actcaggaggaggctg

SEQ ID NO: 29136 - DNA, 16 bp, H. sapiens
actcaggaggatgaag

SEQ ID NO: 29137 - DNA, 16 bp, H. sapiens
actcaggaggcagaga

SEQ ID NO: 29138 - DNA, 16 bp, H. sapiens
actcaggaggctggag

SEQ ID NO: 29139 - DNA, 16 bp, H. sapiens
actcaggaggtgaggc

SEQ ID NO: 29140 - DNA, 16 bp, H. sapiens
actcaggatttaaaaa

SEQ ID NO: 29141 - DNA, 16 bp, H. sapiens
actcaggctgaggcag

SEQ ID NO: 29142 - DNA, 16 bp, H. sapiens
actcaggctggtctca

SEQ ID NO: 29143 - DNA, 16 bp, H. sapiens
actcagggattgtaaa

SEQ ID NO: 29144 - DNA, 16 bp, H. sapiens
actcagggggctgggg

SEQ ID NO: 29145 - DNA, 16 bp, H. sapiens
actcaggtgatccacc

SEQ ID NO: 29146 - DNA, 16 bp, H. sapiens
actcagtaaacatttg

SEQ ID NO: 29147 - DNA, 16 bp, H. sapiens
actcagtaaatggtag

SEQ ID NO: 29148 - DNA, 16 bp, H. sapiens
actcagtctactgatt

SEQ ID NO: 29149 - DNA, 16 bp, H. sapiens
actcagtctctaaaaa

SEQ ID NO: 29150 - DNA, 16 bp, H. sapiens
actcagtctctcattt

SEQ ID NO: 29151 - DNA, 16 bp, H. sapiens
actcagtgcaacctcc

SEQ ID NO: 29152 - DNA, 16 bp, H. sapiens
actcagtgcttccctg

SEQ ID NO: 29153 - DNA, 16 bp, H. sapiens
actcagttacctccca

SEQ ID NO: 29154 - DNA, 16 bp, H. sapiens
actcagttccaaagtc

SEQ ID NO: 29155 - DNA, 16 bp, H. sapiens
actcataaaatgagtt

SEQ ID NO: 29156 - DNA, 17 bp, H. sapiens
actcatcagtgtgctgt

SEQ ID NO: 29157 - DNA, 16 bp, H. sapiens
actcatcatttttgat

SEQ ID NO: 29158 - DNA, 16 bp, H. sapiens
actcatctcacgtgca

SEQ ID NO: 29159 - DNA, 16 bp, H. sapiens
actcatctgacctctc

SEQ ID NO: 29160 - DNA, 16 bp, H. sapiens
actcatgactgtaatc

SEQ ID NO: 29161 - DNA, 16 bp, H. sapiens
actcatgagggatctg

SEQ ID NO: 29162 - DNA, 16 bp, H. sapiens
actcatgcctataatc

SEQ ID NO: 29163 - DNA, 16 bp, H. sapiens
actcatggcctcaagc

SEQ ID NO: 29164 - DNA, 16 bp, H. sapiens
actcatggttctgcag

SEQ ID NO: 29165 - DNA, 16 bp, H. sapiens
actcattaggatggct

SEQ ID NO: 29166 - DNA, 16 bp, H. sapiens
actcattcaacaaata

SEQ ID NO: 29167 - DNA, 16 bp, H. sapiens
actcattcagcaaata

SEQ ID NO: 29168 - DNA, 16 bp, H. sapiens
actcattccagcacta

SEQ ID NO: 29169 - DNA, 16 bp, H. sapiens
actcattctcaaaaaa

SEQ ID NO: 29170 - DNA, 16 bp, H. sapiens
actcatttaaagtata

SEQ ID NO: 29171 - DNA, 16 bp, H. sapiens
actcatttatattcat

SEQ ID NO: 29172 - DNA, 16 bp, H. sapiens
actcatttgacaaata

SEQ ID NO: 29173 - DNA, 16 bp, H. sapiens
actcattttatcctca

SEQ ID NO: 29174 - DNA, 16 bp, H. sapiens
actcatttttcacaaa

SEQ ID NO: 29175 - DNA, 16 bp, H. sapiens
actccaaaaattggaa

SEQ ID NO: 29176 - DNA, 16 bp, H. sapiens
actccaaaagaaacct

SEQ ID NO: 29177 - DNA, 16 bp, H. sapiens
actccaaagggaggag

SEQ ID NO: 29178 - DNA, 16 bp, H. sapiens
actccaaatcaacaga

SEQ ID NO: 29179 - DNA, 16 bp, H. sapiens
actccaacatgggcaa

SEQ ID NO: 29180 - DNA, 16 bp, H. sapiens
actccaacctaggtga

SEQ ID NO: 29181 - DNA, 16 bp, H. sapiens
actccaagtccttcag

SEQ ID NO: 29182 - DNA, 16 bp, H. sapiens
actccaatctccacct

SEQ ID NO: 29183 - DNA, 16 bp, H. sapiens
actccaatctctgcct

SEQ ID NO: 29184 - DNA, 16 bp, H. sapiens
actccaccacacctgg

SEQ ID NO: 29185 - DNA, 16 bp, H. sapiens
actccaccctgggtgg

SEQ ID NO: 29186 - DNA, 16 bp, H. sapiens
actccaccttccaggt

SEQ ID NO: 29187 - DNA, 16 bp, H. sapiens
actccactgcattcca

SEQ ID NO: 29188 - DNA, 16 bp, H. sapiens
actccactgggagagg

SEQ ID NO: 29189 - DNA, 16 bp, H. sapiens
actccagaactgtgag

SEQ ID NO: 29190 - DNA, 16 bp, H. sapiens
actccagacgcgctgc

SEQ ID NO: 29191 - DNA, 16 bp, H. sapiens
actccagactgggaaa

SEQ ID NO: 29192 - DNA, 16 bp, H. sapiens
actccagagcctgggc

SEQ ID NO: 29193 - DNA, 16 bp, H. sapiens
actccagaggcagagg

SEQ ID NO: 29194 - DNA, 16 bp, H. sapiens
actccagaggtggagg

SEQ ID NO: 29195 - DNA, 16 bp, H. sapiens
actccagcacagccat

SEQ ID NO: 29196 - DNA, 16 bp, H. sapiens
actccagcagcccaga

SEQ ID NO: 29197 - DNA, 16 bp, H. sapiens
actccagccagcctgg

SEQ ID NO: 29198 - DNA, 16 bp, H. sapiens
actccagccatggctg

SEQ ID NO: 29199 - DNA, 16 bp, H. sapiens
actccagcccagcaac

SEQ ID NO: 29200 - DNA, 16 bp, H. sapiens
actccagccggggcga

SEQ ID NO: 29201 - DNA, 16 bp, H. sapiens
actccagcctgagcca

SEQ ID NO: 29202 - DNA, 16 bp, H. sapiens
actccagcctgcctgg

SEQ ID NO: 29203 - DNA, 16 bp, H. sapiens
actccagcctgcgcaa

SEQ ID NO: 29204 - DNA, 16 bp, H. sapiens
actccagcctgcgcca

SEQ ID NO: 29205 - DNA, 16 bp, H. sapiens
actccagcctggagca

SEQ ID NO: 29206 - DNA, 16 bp, H. sapiens
actccagcctggagga

SEQ ID NO: 29207 - DNA, 16 bp, H. sapiens
actccagcctggatga

SEQ ID NO: 29208 - DNA, 16 bp, H. sapiens
actccagcctggcaac

SEQ ID NO: 29209 - DNA, 16 bp, H. sapiens
actccagcctggctgg

SEQ ID NO: 29210 - DNA, 17 bp, H. sapiens
actccagcctgggcaag

SEQ ID NO: 29211 - DNA, 19 bp, H. sapiens
actccagcctgggtgaagg

SEQ ID NO: 29212 - DNA, 16 bp, H. sapiens
actccagcctgggtgc

SEQ ID NO: 29213 - DNA, 16 bp, H. sapiens
actccagcctgggtgg

SEQ ID NO: 29214 - DNA, 16 bp, H. sapiens
actccagcctggtggc

SEQ ID NO: 29215 - DNA, 16 bp, H. sapiens
actccagcctgtgcag

SEQ ID NO: 29216 - DNA, 16 bp, H. sapiens
actccagccttgtgac

SEQ ID NO: 29217 - DNA, 16 bp, H. sapiens
actccagcgtgggtga

SEQ ID NO: 29218 - DNA, 16 bp, H. sapiens
actccagctccagcct

SEQ ID NO: 29219 - DNA, 16 bp, H. sapiens
actccagctctgggca

SEQ ID NO: 29220 - DNA, 16 bp, H. sapiens
actccaggcctcaagc

SEQ ID NO: 29221 - DNA, 16 bp, H. sapiens
actccagggtgacaga

SEQ ID NO: 29222 - DNA, 16 bp, H. sapiens
actccaggttcttcag

SEQ ID NO: 29223 - DNA, 16 bp, H. sapiens
actccagtgtgacctc

SEQ ID NO: 29224 - DNA, 16 bp, H. sapiens
actccataaatatttg

SEQ ID NO: 29225 - DNA, 16 bp, H. sapiens
actccataaatgtttg

SEQ ID NO: 29226 - DNA, 16 bp, H. sapiens
actccatatatatata

SEQ ID NO: 29227 - DNA, 16 bp, H. sapiens
actccatcacccaggc

SEQ ID NO: 29228 - DNA, 16 bp, H. sapiens
actccatccagcctga

SEQ ID NO: 29229 - DNA, 16 bp, H. sapiens
actccatcccaaaaaa

SEQ ID NO: 29230 - DNA, 16 bp, H. sapiens
actccatcctggctga

SEQ ID NO: 29231 - DNA, 16 bp, H. sapiens
actccatcctgggcca

SEQ ID NO: 29232 - DNA, 20 bp, H. sapiens
actccatcctgggcgacaga

SEQ ID NO: 29233 - DNA, 16 bp, H. sapiens
actccatcctggggga

SEQ ID NO: 29234 - DNA, 16 bp, H. sapiens
actccatctaaaaaaa

SEQ ID NO: 29235 - DNA, 16 bp, H. sapiens
actccatctaaaataa

SEQ ID NO: 29236 - DNA, 16 bp, H. sapiens
actccatctcaaaaaa

SEQ ID NO: 29237 - DNA, 16 bp, H. sapiens
actccatctcaaaata

SEQ ID NO: 29238 - DNA, 16 bp, H. sapiens
actccatctcaggaaa

SEQ ID NO: 29239 - DNA, 16 bp, H. sapiens
actccatctctataaa

SEQ ID NO: 29240 - DNA, 16 bp, H. sapiens
actccatctctccaaa

SEQ ID NO: 29241 - DNA, 16 bp, H. sapiens
actccatgccaggagc

SEQ ID NO: 29242 - DNA, 16 bp, H. sapiens
actccattgtctggat

SEQ ID NO: 29243 - DNA, 16 bp, H. sapiens
actccatttaaaaaat

SEQ ID NO: 29244 - DNA, 16 bp, H. sapiens
actccatttaccctga

SEQ ID NO: 29245 - DNA, 16 bp, H. sapiens
actccatttgtttgga

SEQ ID NO: 29246 - DNA, 16 bp, H. sapiens
actcccaaggtgatgg

SEQ ID NO: 29247 - DNA, 16 bp, H. sapiens
actcccaatatggcag

SEQ ID NO: 29248 - DNA, 17 bp, H. sapiens
actcccacagaataata

SEQ ID NO: 29249 - DNA, 16 bp, H. sapiens
actcccaccaagagtg

SEQ ID NO: 29250 - DNA, 16 bp, H. sapiens
actcccaccagcgcca

SEQ ID NO: 29251 - DNA, 16 bp, H. sapiens
actcccactgacagtg

SEQ ID NO: 29252 - DNA, 16 bp, H. sapiens
actcccactgctgcct

SEQ ID NO: 29253 - DNA, 16 bp, H. sapiens
actcccagctaatttt

SEQ ID NO: 29254 - DNA, 16 bp, H. sapiens
actcccaggctcaagc

SEQ ID NO: 29255 - DNA, 16 bp, H. sapiens
actcccaggctcaggc

SEQ ID NO: 29256 - DNA, 16 bp, H. sapiens
actcccaggttcaagc

SEQ ID NO: 29257 - DNA, 16 bp, H. sapiens
actcccatcctaatac

SEQ ID NO: 29258 - DNA, 16 bp, H. sapiens
actcccatctctaaaa

SEQ ID NO: 29259 - DNA, 16 bp, H. sapiens
actcccctcagcctcc

SEQ ID NO: 29260 - DNA, 16 bp, H. sapiens
actcccctcggacctc

SEQ ID NO: 29261 - DNA, 16 bp, H. sapiens
actcccctggaaagag

SEQ ID NO: 29262 - DNA, 16 bp, H. sapiens
actccccttcccagcc

SEQ ID NO: 29263 - DNA, 16 bp, H. sapiens
actccccttggcctcc

SEQ ID NO: 29264 - DNA, 16 bp, H. sapiens
actcccctttcttgag

SEQ ID NO: 29265 - DNA, 24 bp, H. sapiens
actcccgacctcaggtgatccgcc

SEQ ID NO: 29266 - DNA, 16 bp, H. sapiens
actcccggactcaagc

SEQ ID NO: 29267 - DNA, 16 bp, H. sapiens
actcccgggtctgagg

SEQ ID NO: 29268 - DNA, 16 bp, H. sapiens
actccctcacccaggc

SEQ ID NO: 29269 - DNA, 16 bp, H. sapiens
actccctctcaaaaaa

SEQ ID NO: 29270 - DNA, 16 bp, H. sapiens
actccctctccagccc

SEQ ID NO: 29271 - DNA, 16 bp, H. sapiens
actccctcttagagtg

SEQ ID NO: 29272 - DNA, 16 bp, H. sapiens
actccctgacctcagg

SEQ ID NO: 29273 - DNA, 16 bp, H. sapiens
actccctgagccaggg

SEQ ID NO: 29274 - DNA, 16 bp, H. sapiens
actccctggttcaagc

SEQ ID NO: 29275 - DNA, 16 bp, H. sapiens
actcccttggctgccc

SEQ ID NO: 29276 - DNA, 16 bp, H. sapiens
actccctttggcattt

SEQ ID NO: 29277 - DNA, 16 bp, H. sapiens
actccggaggccgagg

SEQ ID NO: 29278 - DNA, 16 bp, H. sapiens
actccggaggctgagt

SEQ ID NO: 29279 - DNA, 16 bp, H. sapiens
actccggcttgggtga

SEQ ID NO: 29280 - DNA, 19 bp, H. sapiens
actccgtctcaaaaaaaag

SEQ ID NO: 29281 - DNA, 18 bp, H. sapiens
actccgtctcaaaaaaac

SEQ ID NO: 29282 - DNA, 16 bp, H. sapiens
actccgtctcaaaaat

SEQ ID NO: 29283 - DNA, 16 bp, H. sapiens
actcctaagctcaggc

SEQ ID NO: 29284 - DNA, 16 bp, H. sapiens
actcctacaaatcaat

SEQ ID NO: 29285 - DNA, 16 bp, H. sapiens
actcctacaagaatgg

SEQ ID NO: 29286 - DNA, 16 bp, H. sapiens
actcctacagctagct

SEQ ID NO: 29287 - DNA, 16 bp, H. sapiens
actcctacctcagcct

SEQ ID NO: 29288 - DNA, 16 bp, H. sapiens
actcctactcaacata

SEQ ID NO: 29289 - DNA, 16 bp, H. sapiens
actcctaggtatttac

SEQ ID NO: 29290 - DNA, 16 bp, H. sapiens
actcctattcaacatg

SEQ ID NO: 29291 - DNA, 16 bp, H. sapiens
actcctcagtaaatgc

SEQ ID NO: 29292 - DNA, 16 bp, H. sapiens
actcctcctgggctca

SEQ ID NO: 29293 - DNA, 17 bp, H. sapiens
actcctcgagaggagca

SEQ ID NO: 29294 - DNA, 16 bp, H. sapiens
actcctctccagcaag

SEQ ID NO: 29295 - DNA, 16 bp, H. sapiens
actcctgaacttaaaa

SEQ ID NO: 29296 - DNA, 16 bp, H. sapiens
actcctgaccgcaggt

SEQ ID NO: 29297 - DNA, 17 bp, H. sapiens
actcctgacctcaggtc

SEQ ID NO: 29298 - DNA, 16 bp, H. sapiens
actcctgacctcatgc

SEQ ID NO: 29299 - DNA, 16 bp, H. sapiens
actcctgactgcaagt

SEQ ID NO: 29300 - DNA, 16 bp, H. sapiens
actcctgacttcagat

SEQ ID NO: 29301 - DNA, 18 bp, H. sapiens
actcctgagccagcgaga

SEQ ID NO: 29302 - DNA, 16 bp, H. sapiens
actcctgagctcagac

SEQ ID NO: 29303 - DNA, 16 bp, H. sapiens
actcctgatgaagatg

SEQ ID NO: 29304 - DNA, 16 bp, H. sapiens
actcctgcagtcccag

SEQ ID NO: 29305 - DNA, 16 bp, H. sapiens
actcctgcctcagcct

SEQ ID NO: 29306 - DNA, 16 bp, H. sapiens
actcctgcctccacca

SEQ ID NO: 29307 - DNA, 16 bp, H. sapiens
actcctgcctgggcga

SEQ ID NO: 29308 - DNA, 16 bp, H. sapiens
actcctgcctggtgac

SEQ ID NO: 29309 - DNA, 16 bp, H. sapiens
actcctgcctgtctct

SEQ ID NO: 29310 - DNA, 16 bp, H. sapiens
actcctgctctggcca

SEQ ID NO: 29311 - DNA, 16 bp, H. sapiens
actcctggactgaagt

SEQ ID NO: 29312 - DNA, 16 bp, H. sapiens
actcctggcctcaaga

SEQ ID NO: 29313 - DNA, 16 bp, H. sapiens
actcctggctaatttt

SEQ ID NO: 29314 - DNA, 16 bp, H. sapiens
actcctggctcaaaca

SEQ ID NO: 29315 - DNA, 16 bp, H. sapiens
actcctggctcaagcc

SEQ ID NO: 29316 - DNA, 16 bp, H. sapiens
actcctggcttcatgt

SEQ ID NO: 29317 - DNA, 18 bp, H. sapiens
actcctgggctcaagtgg

SEQ ID NO: 29318 - DNA, 16 bp, H. sapiens
actcctgggctcagac

SEQ ID NO: 29319 - DNA, 16 bp, H. sapiens
actcctgggctcaggg

SEQ ID NO: 29320 - DNA, 16 bp, H. sapiens
actcctgggttcaagt

SEQ ID NO: 29321 - DNA, 16 bp, H. sapiens
actcctggtgaagata

SEQ ID NO: 29322 - DNA, 16 bp, H. sapiens
actcctggttgacact

SEQ ID NO: 29323 - DNA, 16 bp, H. sapiens
actcctgtaaccccag

SEQ ID NO: 29324 - DNA, 16 bp, H. sapiens
actcctgtaatctcag

SEQ ID NO: 29325 - DNA, 16 bp, H. sapiens
actcctgtgattatgt

SEQ ID NO: 29326 - DNA, 16 bp, H. sapiens
actcctgtgcaaacat

SEQ ID NO: 29327 - DNA, 16 bp, H. sapiens
actcctgttaatgctg

SEQ ID NO: 29328 - DNA, 16 bp, H. sapiens
actcctgttctaaaac

SEQ ID NO: 29329 - DNA, 16 bp, H. sapiens
actcctgtttttaaaa

SEQ ID NO: 29330 - DNA, 16 bp, H. sapiens
actcctttatatatat

SEQ ID NO: 29331 - DNA, 16 bp, H. sapiens
actcctttccactcca

SEQ ID NO: 29332 - DNA, 16 bp, H. sapiens
actccttttaaattta

SEQ ID NO: 29333 - DNA, 16 bp, H. sapiens
actccttttttaaaaa

SEQ ID NO: 29334 - DNA, 16 bp, H. sapiens
actcgagaggctcagg

SEQ ID NO: 29335 - DNA, 17 bp, H. sapiens
actcgccagcagttttg

SEQ ID NO: 29336 - DNA, 18 bp, H. sapiens
actcggaaggctgaggca

SEQ ID NO: 29337 - DNA, 16 bp, H. sapiens
actcggactggctctc

SEQ ID NO: 29338 - DNA, 16 bp, H. sapiens
actcgggaggctgagc

SEQ ID NO: 29339 - DNA, 16 bp, H. sapiens
actcgggaggtggagg

SEQ ID NO: 29340 - DNA, 16 bp, H. sapiens
actcggtctcaaaaaa

SEQ ID NO: 29341 - DNA, 17 bp, H. sapiens
actcggtgtctgaggag

SEQ ID NO: 29342 - DNA, 19 bp, H. sapiens
actcgtgatccacccgcct

SEQ ID NO: 29343 - DNA, 16 bp, H. sapiens
actcgtgatctgccca

SEQ ID NO: 29344 - DNA, 16 bp, H. sapiens
actctaagaaataaat

SEQ ID NO: 29345 - DNA, 16 bp, H. sapiens
actctacaaaaatttt

SEQ ID NO: 29346 - DNA, 16 bp, H. sapiens
actctactaaaaatat

SEQ ID NO: 29347 - DNA, 16 bp, H. sapiens
actctactaaaactac

SEQ ID NO: 29348 - DNA, 19 bp, H. sapiens
actctactccccccatatt

SEQ ID NO: 29349 - DNA, 16 bp, H. sapiens
actctagcagacctga

SEQ ID NO: 29350 - DNA, 16 bp, H. sapiens
actctagcctggacag

SEQ ID NO: 29351 - DNA, 16 bp, H. sapiens
actctatctcaaaaaa

SEQ ID NO: 29352 - DNA, 16 bp, H. sapiens
actctatctcaaaaca

SEQ ID NO: 29353 - DNA, 16 bp, H. sapiens
actctatctcaggaaa

SEQ ID NO: 29354 - DNA, 16 bp, H. sapiens
actctatctctaccaa

SEQ ID NO: 29355 - DNA, 16 bp, H. sapiens
actctattaaaaatac

SEQ ID NO: 29356 - DNA, 16 bp, H. sapiens
actctatttttagttt

SEQ ID NO: 29357 - DNA, 16 bp, H. sapiens
actctcaaatgattca

SEQ ID NO: 29358 - DNA, 16 bp, H. sapiens
actctcaataaaccag

SEQ ID NO: 29359 - DNA, 16 bp, H. sapiens
actctcaccagcagtg

SEQ ID NO: 29360 - DNA, 27 bp, H. sapiens
actctcagaggatccagaactgcagcc

SEQ ID NO: 29361 - DNA, 16 bp, H. sapiens
actctcaggctgcagc

SEQ ID NO: 29362 - DNA, 16 bp, H. sapiens
actctcatacaactct

SEQ ID NO: 29363 - DNA, 16 bp, H. sapiens
actctcatctcaaaaa

SEQ ID NO: 29364 - DNA, 16 bp, H. sapiens
actctccaggacactg

SEQ ID NO: 29365 - DNA, 16 bp, H. sapiens
actctcccaccctgaa

SEQ ID NO: 29366 - DNA, 16 bp, H. sapiens
actctcctcccaggcc

SEQ ID NO: 29367 - DNA, 16 bp, H. sapiens
actctccttccctgga

SEQ ID NO: 29368 - DNA, 16 bp, H. sapiens
actctctcagaccata

SEQ ID NO: 29369 - DNA, 16 bp, H. sapiens
actctctcagactaca

SEQ ID NO: 29370 - DNA, 16 bp, H. sapiens
actctctctctctgtc

SEQ ID NO: 29371 - DNA, 16 bp, H. sapiens
actctctgcctcagcc

SEQ ID NO: 29372 - DNA, 16 bp, H. sapiens
actctctgtaaaatgg

SEQ ID NO: 29373 - DNA, 16 bp, H. sapiens
actctctgtcttcatg

SEQ ID NO: 29374 - DNA, 16 bp, H. sapiens
actctcttgctcctgc

SEQ ID NO: 29375 - DNA, 16 bp, H. sapiens
actctgaaaaaacaaa

SEQ ID NO: 29376 - DNA, 16 bp, H. sapiens
actctgaaacaaaatt

SEQ ID NO: 29377 - DNA, 16 bp, H. sapiens
actctgaaggctgaag

SEQ ID NO: 29378 - DNA, 16 bp, H. sapiens
actctgaaggctgagg

SEQ ID NO: 29379 - DNA, 16 bp, H. sapiens
actctgacctgggtga

SEQ ID NO: 29380 - DNA, 16 bp, H. sapiens
actctgaggctgaggc

SEQ ID NO: 29381 - DNA, 16 bp, H. sapiens
actctgcaccaagcag

SEQ ID NO: 29382 - DNA, 16 bp, H. sapiens
actctgcaccccaaat

SEQ ID NO: 29383 - DNA, 16 bp, H. sapiens
actctgcaggctgagg

SEQ ID NO: 29384 - DNA, 16 bp, H. sapiens
actctgcctcagaaaa

SEQ ID NO: 29385 - DNA, 16 bp, H. sapiens
actctgcctcctgggt

SEQ ID NO: 29386 - DNA, 16 bp, H. sapiens
actctgcgtgtgtgtg

SEQ ID NO: 29387 - DNA, 16 bp, H. sapiens
actctgctcactgcaa

SEQ ID NO: 29388 - DNA, 16 bp, H. sapiens
actctgctctgtaact

SEQ ID NO: 29389 - DNA, 16 bp, H. sapiens
actctgctgtccaggc

SEQ ID NO: 29390 - DNA, 16 bp, H. sapiens
actctggaaaaggcaa

SEQ ID NO: 29391 - DNA, 16 bp, H. sapiens
actctggaaggccaag

SEQ ID NO: 29392 - DNA, 16 bp, H. sapiens
actctggagactgaag

SEQ ID NO: 29393 - DNA, 16 bp, H. sapiens
actctggaggatgagg

SEQ ID NO: 29394 - DNA, 16 bp, H. sapiens
actctggaggccaagg

SEQ ID NO: 29395 - DNA, 16 bp, H. sapiens
actctggaggctgaca

SEQ ID NO: 29396 - DNA, 16 bp, H. sapiens
actctggaggctgaga

SEQ ID NO: 29397 - DNA, 16 bp, H. sapiens
actctggcacccaggc

SEQ ID NO: 29398 - DNA, 16 bp, H. sapiens
actctggccacgcttg

SEQ ID NO: 29399 - DNA, 16 bp, H. sapiens
actctggcggctgagg

SEQ ID NO: 29400 - DNA, 16 bp, H. sapiens
actctggctgcctgtg

SEQ ID NO: 29401 - DNA, 16 bp, H. sapiens
actctgggccaggcac

SEQ ID NO: 29402 - DNA, 16 bp, H. sapiens
actctggggtctgttg

SEQ ID NO: 29403 - DNA, 16 bp, H. sapiens
actctggtgatagttt

SEQ ID NO: 29404 - DNA, 16 bp, H. sapiens
actctggtgcccaggc

SEQ ID NO: 29405 - DNA, 16 bp, H. sapiens
actctggtgggggatg

SEQ ID NO: 29406 - DNA, 21 bp, H. sapiens
actctgtatctaactaatctg

SEQ ID NO: 29407 - DNA, 16 bp, H. sapiens
actctgtcaaccaggt

SEQ ID NO: 29408 - DNA, 19 bp, H. sapiens
actctgtcacccaggctga

SEQ ID NO: 29409 - DNA, 16 bp, H. sapiens
actctgtcacccaggg

SEQ ID NO: 29410 - DNA, 16 bp, H. sapiens
actctgtcactcaagc

SEQ ID NO: 29411 - DNA, 18 bp, H. sapiens
actctgtcatccaggcta

SEQ ID NO: 29412 - DNA, 16 bp, H. sapiens
actctgtcccacaggc

SEQ ID NO: 29413 - DNA, 16 bp, H. sapiens
actctgtcctccaggc

SEQ ID NO: 29414 - DNA, 16 bp, H. sapiens
actctgtccttttatt

SEQ ID NO: 29415 - DNA, 16 bp, H. sapiens
actctgtctagaaaaa

SEQ ID NO: 29416 - DNA, 20 bp, H. sapiens
actctgtctcaaaaaaaaac

SEQ ID NO: 29417 - DNA, 16 bp, H. sapiens
actctgtctcaaatat

SEQ ID NO: 29418 - DNA, 16 bp, H. sapiens
actctgtctccaggct

SEQ ID NO: 29419 - DNA, 16 bp, H. sapiens
actctgtctcgaaaaa

SEQ ID NO: 29420 - DNA, 16 bp, H. sapiens
actctgtctctattaa

SEQ ID NO: 29421 - DNA, 16 bp, H. sapiens
actctgtcttaaaaaa

SEQ ID NO: 29422 - DNA, 16 bp, H. sapiens
actctgtctttaaaac

SEQ ID NO: 29423 - DNA, 16 bp, H. sapiens
actctgtgcaacctcc

SEQ ID NO: 29424 - DNA, 16 bp, H. sapiens
actctgtgccaggcac

SEQ ID NO: 29425 - DNA, 16 bp, H. sapiens
actctgtgcctggcac

SEQ ID NO: 29426 - DNA, 16 bp, H. sapiens
actctgtgctaggcac

SEQ ID NO: 29427 - DNA, 16 bp, H. sapiens
actctgtgtcttttga

SEQ ID NO: 29428 - DNA, 16 bp, H. sapiens
actctgttcatagttt

SEQ ID NO: 29429 - DNA, 16 bp, H. sapiens
actctgttcattgttt

SEQ ID NO: 29430 - DNA, 16 bp, H. sapiens
actctgttcccttttc

SEQ ID NO: 29431 - DNA, 16 bp, H. sapiens
actctgttctgcctgg

SEQ ID NO: 29432 - DNA, 16 bp, H. sapiens
actctgttctttttca

SEQ ID NO: 29433 - DNA, 17 bp, H. sapiens
actctgttgcccaggct

SEQ ID NO: 29434 - DNA, 16 bp, H. sapiens
actctgttgcccaggt

SEQ ID NO: 29435 - DNA, 17 bp, H. sapiens
actctgttgcccatgct

SEQ ID NO: 29436 - DNA, 16 bp, H. sapiens
actctgttgtgctttt

SEQ ID NO: 29437 - DNA, 16 bp, H. sapiens
actctgtttgtagaat

SEQ ID NO: 29438 - DNA, 16 bp, H. sapiens
actctgttttaaaaat

SEQ ID NO: 29439 - DNA, 16 bp, H. sapiens
actctgttttccaggc

SEQ ID NO: 29440 - DNA, 16 bp, H. sapiens
actcttacaactcaat

SEQ ID NO: 29441 - DNA, 16 bp, H. sapiens
actcttactcaacata

SEQ ID NO: 29442 - DNA, 16 bp, H. sapiens
actcttatcttaaaaa

SEQ ID NO: 29443 - DNA, 16 bp, H. sapiens
actcttccaaaaagtt

SEQ ID NO: 29444 - DNA, 16 bp, H. sapiens
actcttccaatccatg

SEQ ID NO: 29445 - DNA, 16 bp, H. sapiens
actcttcccacctcag

SEQ ID NO: 29446 - DNA, 16 bp, H. sapiens
actcttcctttcagga

SEQ ID NO: 29447 - DNA, 16 bp, H. sapiens
actcttgcccaagctg

SEQ ID NO: 29448 - DNA, 16 bp, H. sapiens
actcttgcccaggctg

SEQ ID NO: 29449 - DNA, 16 bp, H. sapiens
actcttgcctgctgcc

SEQ ID NO: 29450 - DNA, 16 bp, H. sapiens
actcttgtccaggctg

SEQ ID NO: 29451 - DNA, 16 bp, H. sapiens
actctttattcaattt

SEQ ID NO: 29452 - DNA, 16 bp, H. sapiens
actctttcacccaggt

SEQ ID NO: 29453 - DNA, 16 bp, H. sapiens
actctttcagttattt

SEQ ID NO: 29454 - DNA, 16 bp, H. sapiens
actctttcctggcctg

SEQ ID NO: 29455 - DNA, 16 bp, H. sapiens
actctttctttcatga

SEQ ID NO: 29456 - DNA, 16 bp, H. sapiens
actctttgggtctgca

SEQ ID NO: 29457 - DNA, 16 bp, H. sapiens
actcttttcacatgct

SEQ ID NO: 29458 - DNA, 16 bp, H. sapiens
actcttttctctctaa

SEQ ID NO: 29459 - DNA, 16 bp, H. sapiens
actcttttctgcacag

SEQ ID NO: 29460 - DNA, 16 bp, H. sapiens
actcttttgtaataat

SEQ ID NO: 29461 - DNA, 16 bp, H. sapiens
actctttttgtcaaca

SEQ ID NO: 29462 - DNA, 16 bp, H. sapiens
actgaaaaaaaaattt

SEQ ID NO: 29463 - DNA, 16 bp, H. sapiens
actgaaaaaaatgcaa

SEQ ID NO: 29464 - DNA, 16 bp, H. sapiens
actgaaaaagaaaact

SEQ ID NO: 29465 - DNA, 16 bp, H. sapiens
actgaaaaagagcctg

SEQ ID NO: 29466 - DNA, 16 bp, H. sapiens
actgaaaaataatagt

SEQ ID NO: 29467 - DNA, 16 bp, H. sapiens
actgaaaaatcacaaa

SEQ ID NO: 29468 - DNA, 16 bp, H. sapiens
actgaaaaattattta

SEQ ID NO: 29469 - DNA, 16 bp, H. sapiens
actgaaaacagtaaaa

SEQ ID NO: 29470 - DNA, 16 bp, H. sapiens
actgaaaactacaaaa

SEQ ID NO: 29471 - DNA, 16 bp, H. sapiens
actgaaaactcaaaaa

SEQ ID NO: 29472 - DNA, 16 bp, H. sapiens
actgaaaactccacct

SEQ ID NO: 29473 - DNA, 16 bp, H. sapiens
actgaaaaggaagaag

SEQ ID NO: 29474 - DNA, 16 bp, H. sapiens
actgaaaataaaatca

SEQ ID NO: 29475 - DNA, 16 bp, H. sapiens
actgaaaataaaggga

SEQ ID NO: 29476 - DNA, 16 bp, H. sapiens
actgaaaataattttg

SEQ ID NO: 29477 - DNA, 16 bp, H. sapiens
actgaaaatacaataa

SEQ ID NO: 29478 - DNA, 16 bp, H. sapiens
actgaaaatatgaaaa

SEQ ID NO: 29479 - DNA, 16 bp, H. sapiens
actgaaaatgagaaaa

SEQ ID NO: 29480 - DNA, 16 bp, H. sapiens
actgaaaatgatattt

SEQ ID NO: 29481 - DNA, 16 bp, H. sapiens
actgaaaatggattaa

SEQ ID NO: 29482 - DNA, 16 bp, H. sapiens
actgaaaatgttttaa

SEQ ID NO: 29483 - DNA, 16 bp, H. sapiens
actgaaacaagacaaa

SEQ ID NO: 29484 - DNA, 16 bp, H. sapiens
actgaaaccacagaaa

SEQ ID NO: 29485 - DNA, 16 bp, H. sapiens
actgaaagaaaacatt

SEQ ID NO: 29486 - DNA, 16 bp, H. sapiens
actgaaagagcttcca

SEQ ID NO: 29487 - DNA, 16 bp, H. sapiens
actgaaagctctgcct

SEQ ID NO: 29488 - DNA, 16 bp, H. sapiens
actgaaagtgaaaaat

SEQ ID NO: 29489 - DNA, 16 bp, H. sapiens
actgaaagtgaaagaa

SEQ ID NO: 29490 - DNA, 16 bp, H. sapiens
actgaaagttctagct

SEQ ID NO: 29491 - DNA, 16 bp, H. sapiens
actgaaataaaaatga

SEQ ID NO: 29492 - DNA, 16 bp, H. sapiens
actgaaatataaaata

SEQ ID NO: 29493 - DNA, 16 bp, H. sapiens
actgaaatataaataa

SEQ ID NO: 29494 - DNA, 16 bp, H. sapiens
actgaaatataattta

SEQ ID NO: 29495 - DNA, 16 bp, H. sapiens
actgaaatatgccctg

SEQ ID NO: 29496 - DNA, 16 bp, H. sapiens
actgaaatatttatga

SEQ ID NO: 29497 - DNA, 16 bp, H. sapiens
actgaaatcagagcag

SEQ ID NO: 29498 - DNA, 16 bp, H. sapiens
actgaaatttattatt

SEQ ID NO: 29499 - DNA, 16 bp, H. sapiens
actgaacaaggaagaa

SEQ ID NO: 29500 - DNA, 16 bp, H. sapiens
actgaacaggaaaaaa

SEQ ID NO: 29501 - DNA, 16 bp, H. sapiens
actgaacatttaaaaa

SEQ ID NO: 29502 - DNA, 16 bp, H. sapiens
actgaacccacagaaa

SEQ ID NO: 29503 - DNA, 16 bp, H. sapiens
actgaactctacactt

SEQ ID NO: 29504 - DNA, 16 bp, H. sapiens
actgaactctgaccac

SEQ ID NO: 29505 - DNA, 16 bp, H. sapiens
actgaactgtacactt

SEQ ID NO: 29506 - DNA, 16 bp, H. sapiens
actgaagaaaaatgaa

SEQ ID NO: 29507 - DNA, 16 bp, H. sapiens
actgaagaaagcagaa

SEQ ID NO: 29508 - DNA, 16 bp, H. sapiens
actgaagaaataaaat

SEQ ID NO: 29509 - DNA, 16 bp, H. sapiens
actgaagaaattgtga

SEQ ID NO: 29510 - DNA, 16 bp, H. sapiens
actgaagaagaaaaga

SEQ ID NO: 29511 - DNA, 16 bp, H. sapiens
actgaagaagcaagcc

SEQ ID NO: 29512 - DNA, 16 bp, H. sapiens
actgaagacaaacttt

SEQ ID NO: 29513 - DNA, 16 bp, H. sapiens
actgaagagctcttgg

SEQ ID NO: 29514 - DNA, 16 bp, H. sapiens
actgaagatgaattaa

SEQ ID NO: 29515 - DNA, 16 bp, H. sapiens
actgaagcacagcacc

SEQ ID NO: 29516 - DNA, 16 bp, H. sapiens
actgaagcattctgag

SEQ ID NO: 29517 - DNA, 16 bp, H. sapiens
actgaagctcagaaaa

SEQ ID NO: 29518 - DNA, 16 bp, H. sapiens
actgaaggaaaatgaa

SEQ ID NO: 29519 - DNA, 16 bp, H. sapiens
actgaaggagaaaaat

SEQ ID NO: 29520 - DNA, 16 bp, H. sapiens
actgaagtcttgacct

SEQ ID NO: 29521 - DNA, 16 bp, H. sapiens
actgaagttcagagaa

SEQ ID NO: 29522 - DNA, 16 bp, H. sapiens
actgaataaataaatg

SEQ ID NO: 29523 - DNA, 16 bp, H. sapiens
actgaataatttataa

SEQ ID NO: 29524 - DNA, 16 bp, H. sapiens
actgaatatacaaaaa

SEQ ID NO: 29525 - DNA, 16 bp, H. sapiens
actgaatatggaaagg

SEQ ID NO: 29526 - DNA, 16 bp, H. sapiens
actgaatccaacaaca

SEQ ID NO: 29527 - DNA, 16 bp, H. sapiens
actgaatctgctggtg

SEQ ID NO: 29528 - DNA, 16 bp, H. sapiens
actgaatgctttctcc

SEQ ID NO: 29529 - DNA, 16 bp, H. sapiens
actgaatggaagaaaa

SEQ ID NO: 29530 - DNA, 16 bp, H. sapiens
actgaatggagaaaaa

SEQ ID NO: 29531 - DNA, 16 bp, H. sapiens
actgaatgggcagaag

SEQ ID NO: 29532 - DNA, 16 bp, H. sapiens
actgaattatgaagaa

SEQ ID NO: 29533 - DNA, 16 bp, H. sapiens
actgaattcccagcca

SEQ ID NO: 29534 - DNA, 16 bp, H. sapiens
actgaattggcaaaag

SEQ ID NO: 29535 - DNA, 16 bp, H. sapiens
actgaattgtacactt

SEQ ID NO: 29536 - DNA, 16 bp, H. sapiens
actgaatttttaaaat

SEQ ID NO: 29537 - DNA, 16 bp, H. sapiens
actgacaaagaattca

SEQ ID NO: 29538 - DNA, 16 bp, H. sapiens
actgacacagaaacag

SEQ ID NO: 29539 - DNA, 18 bp, H. sapiens
actgacacctcacacggc

SEQ ID NO: 29540 - DNA, 16 bp, H. sapiens
actgacagagcaggag

SEQ ID NO: 29541 - DNA, 16 bp, H. sapiens
actgacatggaaagat

SEQ ID NO: 29542 - DNA, 16 bp, H. sapiens
actgacatgtgggagc

SEQ ID NO: 29543 - DNA, 16 bp, H. sapiens
actgacatttactgag

SEQ ID NO: 29544 - DNA, 24 bp, H. sapiens
actgaccaacatggagaaaccccg

SEQ ID NO: 29545 - DNA, 16 bp, H. sapiens
actgacctcaagtgat

SEQ ID NO: 29546 - DNA, 16 bp, H. sapiens
actgacctcaggtgat

SEQ ID NO: 29547 - DNA, 16 bp, H. sapiens
actgacctgatgccag

SEQ ID NO: 29548 - DNA, 16 bp, H. sapiens
actgaccttgacctct

SEQ ID NO: 29549 - DNA, 16 bp, H. sapiens
actgactcacagttct

SEQ ID NO: 29550 - DNA, 16 bp, H. sapiens
actgacttatttcact

SEQ ID NO: 29551 - DNA, 16 bp, H. sapiens
actgactttattttat

SEQ ID NO: 29552 - DNA, 16 bp, H. sapiens
actgagaaaaaaagga

SEQ ID NO: 29553 - DNA, 16 bp, H. sapiens
actgagaaaaaatatt

SEQ ID NO: 29554 - DNA, 16 bp, H. sapiens
actgagaaataaaaat

SEQ ID NO: 29555 - DNA, 16 bp, H. sapiens
actgagaaatatttaa

SEQ ID NO: 29556 - DNA, 16 bp, H. sapiens
actgagaaattatttt

SEQ ID NO: 29557 - DNA, 16 bp, H. sapiens
actgagaagaaaaaga

SEQ ID NO: 29558 - DNA, 16 bp, H. sapiens
actgagacacagagaa

SEQ ID NO: 29559 - DNA, 16 bp, H. sapiens
actgagacaccagctg

SEQ ID NO: 29560 - DNA, 16 bp, H. sapiens
actgagactttttttt

SEQ ID NO: 29561 - DNA, 16 bp, H. sapiens
actgagagaaaaaaat

SEQ ID NO: 29562 - DNA, 16 bp, H. sapiens
actgagagagagagag

SEQ ID NO: 29563 - DNA, 16 bp, H. sapiens
actgagagaggaagac

SEQ ID NO: 29564 - DNA, 16 bp, H. sapiens
actgagagataagact

SEQ ID NO: 29565 - DNA, 16 bp, H. sapiens
actgagatccagagag

SEQ ID NO: 29566 - DNA, 16 bp, H. sapiens
actgagatcctgtctc

SEQ ID NO: 29567 - DNA, 16 bp, H. sapiens
actgagatgagaaaga

SEQ ID NO: 29568 - DNA, 16 bp, H. sapiens
actgagatgatggggt

SEQ ID NO: 29569 - DNA, 16 bp, H. sapiens
actgagatgggaggat

SEQ ID NO: 29570 - DNA, 16 bp, H. sapiens
actgagatggggaaga

SEQ ID NO: 29571 - DNA, 16 bp, H. sapiens
actgagcaagactgtc

SEQ ID NO: 29572 - DNA, 16 bp, H. sapiens
actgagcacttaaaat

SEQ ID NO: 29573 - DNA, 17 bp, H. sapiens
actgagcaggagttaga

SEQ ID NO: 29574 - DNA, 16 bp, H. sapiens
actgagcccagccagg

SEQ ID NO: 29575 - DNA, 16 bp, H. sapiens
actgagccccaggtat

SEQ ID NO: 29576 - DNA, 16 bp, H. sapiens
actgagcccttaacct

SEQ ID NO: 29577 - DNA, 16 bp, H. sapiens
actgagcctcactctg

SEQ ID NO: 29578 - DNA, 16 bp, H. sapiens
actgaggaagctgagg

SEQ ID NO: 29579 - DNA, 16 bp, H. sapiens
actgaggacctcagtt

SEQ ID NO: 29580 - DNA, 16 bp, H. sapiens
actgaggactccaaaa

SEQ ID NO: 29581 - DNA, 16 bp, H. sapiens
actgaggaggcagagg

SEQ ID NO: 29582 - DNA, 16 bp, H. sapiens
actgaggaggctgaga

SEQ ID NO: 29583 - DNA, 16 bp, H. sapiens
actgaggaggctgagg

SEQ ID NO: 29584 - DNA, 18 bp, H. sapiens
actgaggcaagagaatcg

SEQ ID NO: 29585 - DNA, 16 bp, H. sapiens
actgaggcacaaagag

SEQ ID NO: 29586 - DNA, 16 bp, H. sapiens
actgaggcacacagaa

SEQ ID NO: 29587 - DNA, 16 bp, H. sapiens
actgaggcacagaaag

SEQ ID NO: 29588 - DNA, 16 bp, H. sapiens
actgaggcacagagga

SEQ ID NO: 29589 - DNA, 16 bp, H. sapiens
actgaggcacagagtg

SEQ ID NO: 29590 - DNA, 16 bp, H. sapiens
actgaggcacgagaat

SEQ ID NO: 29591 - DNA, 16 bp, H. sapiens
actgaggcagagaggg

SEQ ID NO: 29592 - DNA, 16 bp, H. sapiens
actgaggcaggaaaat

SEQ ID NO: 29593 - DNA, 16 bp, H. sapiens
actgaggcaggagaat

SEQ ID NO: 29594 - DNA, 16 bp, H. sapiens
actgaggcaggaggat

SEQ ID NO: 29595 - DNA, 16 bp, H. sapiens
actgaggcatagggag

SEQ ID NO: 29596 - DNA, 16 bp, H. sapiens
actgaggcatgagaat

SEQ ID NO: 29597 - DNA, 16 bp, H. sapiens
actgaggccaagagaa

SEQ ID NO: 29598 - DNA, 16 bp, H. sapiens
actgaggccaggcatg

SEQ ID NO: 29599 - DNA, 16 bp, H. sapiens
actgaggcccagaaga

SEQ ID NO: 29600 - DNA, 16 bp, H. sapiens
actgaggcccagacag

SEQ ID NO: 29601 - DNA, 16 bp, H. sapiens
actgaggcccagagag

SEQ ID NO: 29602 - DNA, 16 bp, H. sapiens
actgaggcccagaggg

SEQ ID NO: 29603 - DNA, 16 bp, H. sapiens
actgaggcccaggaaa

SEQ ID NO: 29604 - DNA, 16 bp, H. sapiens
actgaggcccaggagg

SEQ ID NO: 29605 - DNA, 16 bp, H. sapiens
actgaggcccaggcag

SEQ ID NO: 29606 - DNA, 16 bp, H. sapiens
actgaggcctggagaa

SEQ ID NO: 29607 - DNA, 16 bp, H. sapiens
actgaggcctggggag

SEQ ID NO: 29608 - DNA, 16 bp, H. sapiens
actgaggcgggaggat

SEQ ID NO: 29609 - DNA, 16 bp, H. sapiens
actgaggctcaaagaa

SEQ ID NO: 29610 - DNA, 16 bp, H. sapiens
actgaggctcaaggag

SEQ ID NO: 29611 - DNA, 16 bp, H. sapiens
actgaggctcagagaa

SEQ ID NO: 29612 - DNA, 16 bp, H. sapiens
actgaggctcagggag

SEQ ID NO: 29613 - DNA, 16 bp, H. sapiens
actgaggctggaggat

SEQ ID NO: 29614 - DNA, 16 bp, H. sapiens
actgaggcttagagag

SEQ ID NO: 29615 - DNA, 16 bp, H. sapiens
actgaggcttggagaa

SEQ ID NO: 29616 - DNA, 16 bp, H. sapiens
actgagggacagagag

SEQ ID NO: 29617 - DNA, 16 bp, H. sapiens
actgagggtcagagag

SEQ ID NO: 29618 - DNA, 16 bp, H. sapiens
actgaggtccagagag

SEQ ID NO: 29619 - DNA, 16 bp, H. sapiens
actgaggtgggaggat

SEQ ID NO: 29620 - DNA, 16 bp, H. sapiens
actgaggttcaaagaa

SEQ ID NO: 29621 - DNA, 16 bp, H. sapiens
actgaggttcagagag

SEQ ID NO: 29622 - DNA, 16 bp, H. sapiens
actgagtaatttataa

SEQ ID NO: 29623 - DNA, 16 bp, H. sapiens
actgagtcaggaggat

SEQ ID NO: 29624 - DNA, 16 bp, H. sapiens
actgagttaaataaaa

SEQ ID NO: 29625 - DNA, 16 bp, H. sapiens
actgagtttcagagaa

SEQ ID NO: 29626 - DNA, 16 bp, H. sapiens
actgagtttgtggtaa

SEQ ID NO: 29627 - DNA, 16 bp, H. sapiens
actgataaaaatgaaa

SEQ ID NO: 29628 - DNA, 16 bp, H. sapiens
actgataaacaacttc

SEQ ID NO: 29629 - DNA, 16 bp, H. sapiens
actgataatacaaaaa

SEQ ID NO: 29630 - DNA, 16 bp, H. sapiens
actgatacatacaaca

SEQ ID NO: 29631 - DNA, 16 bp, H. sapiens
actgataccaaaacag

SEQ ID NO: 29632 - DNA, 16 bp, H. sapiens
actgatatcctttttt

SEQ ID NO: 29633 - DNA, 16 bp, H. sapiens
actgatattttttctt

SEQ ID NO: 29634 - DNA, 16 bp, H. sapiens
actgatcatcaaagaa

SEQ ID NO: 29635 - DNA, 16 bp, H. sapiens
actgatcatcagagaa

SEQ ID NO: 29636 - DNA, 16 bp, H. sapiens
actgatctcacagaaa

SEQ ID NO: 29637 - DNA, 16 bp, H. sapiens
actgatcttttcttct

SEQ ID NO: 29638 - DNA, 16 bp, H. sapiens
actgatgaaggtggct

SEQ ID NO: 29639 - DNA, 16 bp, H. sapiens
actgatgcttcagaaa

SEQ ID NO: 29640 - DNA, 16 bp, H. sapiens
actgatggagaagctg

SEQ ID NO: 29641 - DNA, 16 bp, H. sapiens
actgatgttcacttaa

SEQ ID NO: 29642 - DNA, 16 bp, H. sapiens
actgatgtttttcttt

SEQ ID NO: 29643 - DNA, 16 bp, H. sapiens
actgattattttttct

SEQ ID NO: 29644 - DNA, 16 bp, H. sapiens
actgattcattttttt

SEQ ID NO: 29645 - DNA, 16 bp, H. sapiens
actgatttatttttct

SEQ ID NO: 29646 - DNA, 16 bp, H. sapiens
actgatttcaaatatt

SEQ ID NO: 29647 - DNA, 16 bp, H. sapiens
actgattttattaaat

SEQ ID NO: 29648 - DNA, 16 bp, H. sapiens
actgatttttaaaaat

SEQ ID NO: 29649 - DNA, 16 bp, H. sapiens
actgatttttgaattt

SEQ ID NO: 29650 - DNA, 16 bp, H. sapiens
actgatttttgtataa

SEQ ID NO: 29651 - DNA, 16 bp, H. sapiens
actgattttttaaagt

SEQ ID NO: 29652 - DNA, 16 bp, H. sapiens
actgatttttttgaag

SEQ ID NO: 29653 - DNA, 19 bp, H. sapiens
actgcaaaaacataccaaa

SEQ ID NO: 29654 - DNA, 16 bp, H. sapiens
actgcaaaaggtgaca

SEQ ID NO: 29655 - DNA, 16 bp, H. sapiens
actgcaaactgtttta

SEQ ID NO: 29656 - DNA, 16 bp, H. sapiens
actgcaaagagacaaa

SEQ ID NO: 29657 - DNA, 16 bp, H. sapiens
actgcaacaaacatgg

SEQ ID NO: 29658 - DNA, 16 bp, H. sapiens
actgcaacaagacaag

SEQ ID NO: 29659 - DNA, 16 bp, H. sapiens
actgcaacccccacct

SEQ ID NO: 29660 - DNA, 16 bp, H. sapiens
actgcaacccctgcct

SEQ ID NO: 29661 - DNA, 16 bp, H. sapiens
actgcaacctcaacct

SEQ ID NO: 29662 - DNA, 16 bp, H. sapiens
actgcaacctcacctc

SEQ ID NO: 29663 - DNA, 16 bp, H. sapiens
actgcaacctcccagg

SEQ ID NO: 29664 - DNA, 16 bp, H. sapiens
actgcaacctccgccc

SEQ ID NO: 29665 - DNA, 19 bp, H. sapiens
actgcaacctctgtctcct

SEQ ID NO: 29666 - DNA, 16 bp, H. sapiens
actgcaacctggacct

SEQ ID NO: 29667 - DNA, 16 bp, H. sapiens
actgcaacctgggcct

SEQ ID NO: 29668 - DNA, 16 bp, H. sapiens
actgcaactccagcct

SEQ ID NO: 29669 - DNA, 16 bp, H. sapiens
actgcaacttgtttta

SEQ ID NO: 29670 - DNA, 16 bp, H. sapiens
actgcaactttgacct

SEQ ID NO: 29671 - DNA, 16 bp, H. sapiens
actgcaagctcttcct

SEQ ID NO: 29672 - DNA, 16 bp, H. sapiens
actgcaaggaggcagc

SEQ ID NO: 29673 - DNA, 16 bp, H. sapiens
actgcaatgaacattc

SEQ ID NO: 29674 - DNA, 16 bp, H. sapiens
actgcacatgtgagga

SEQ ID NO: 29675 - DNA, 23 bp, H. sapiens
actgcacattctccaacaggcat

SEQ ID NO: 29676 - DNA, 16 bp, H. sapiens
actgcacccagacttt

SEQ ID NO: 29677 - DNA, 16 bp, H. sapiens
actgcacccagctcca

SEQ ID NO: 29678 - DNA, 16 bp, H. sapiens
actgcacccagctgac

SEQ ID NO: 29679 - DNA, 16 bp, H. sapiens
actgcacccagctggc

SEQ ID NO: 29680 - DNA, 16 bp, H. sapiens
actgcacccagctggg

SEQ ID NO: 29681 - DNA, 16 bp, H. sapiens
actgcaccccagccag

SEQ ID NO: 29682 - DNA, 16 bp, H. sapiens
actgcaccccaggctg

SEQ ID NO: 29683 - DNA, 16 bp, H. sapiens
actgcaccctctgcct

SEQ ID NO: 29684 - DNA, 16 bp, H. sapiens
actgcaccgcagcctg

SEQ ID NO: 29685 - DNA, 16 bp, H. sapiens
actgcacctggcctgg

SEQ ID NO: 29686 - DNA, 16 bp, H. sapiens
actgcacctggctcat

SEQ ID NO: 29687 - DNA, 16 bp, H. sapiens
actgcactccaaccta

SEQ ID NO: 29688 - DNA, 17 bp, H. sapiens
actgcactccagcctgc

SEQ ID NO: 29689 - DNA, 18 bp, H. sapiens
actgcactccagcctgga

SEQ ID NO: 29690 - DNA, 16 bp, H. sapiens
actgcactcccagcct

SEQ ID NO: 29691 - DNA, 16 bp, H. sapiens
actgcactgcagcctc

SEQ ID NO: 29692 - DNA, 16 bp, H. sapiens
actgcacttcagcctc

SEQ ID NO: 29693 - DNA, 16 bp, H. sapiens
actgcagaaagcaaaa

SEQ ID NO: 29694 - DNA, 16 bp, H. sapiens
actgcagaaatttgca

SEQ ID NO: 29695 - DNA, 16 bp, H. sapiens
actgcagaagaaaagt

SEQ ID NO: 29696 - DNA, 16 bp, H. sapiens
actgcagacacagctg

SEQ ID NO: 29697 - DNA, 50 bp, H. sapiens
actgcagaccctcacggccttcccacactttgtcctcacttgcaacaggg

SEQ ID NO: 29698 - DNA, 16 bp, H. sapiens
actgcagatgtgatgg

SEQ ID NO: 29699 - DNA, 16 bp, H. sapiens
actgcagccccaacct

SEQ ID NO: 29700 - DNA, 16 bp, H. sapiens
actgcagccccagctg

SEQ ID NO: 29701 - DNA, 16 bp, H. sapiens
actgcagcccccacct

SEQ ID NO: 29702 - DNA, 16 bp, H. sapiens
actgcagcctaggcaa

SEQ ID NO: 29703 - DNA, 16 bp, H. sapiens
actgcagcctaggtga

SEQ ID NO: 29704 - DNA, 16 bp, H. sapiens
actgcagcctcaaaca

SEQ ID NO: 29705 - DNA, 16 bp, H. sapiens
actgcagcctcaaccc

SEQ ID NO: 29706 - DNA, 16 bp, H. sapiens
actgcagcctcagccc

SEQ ID NO: 29707 - DNA, 16 bp, H. sapiens
actgcagcctcagctt

SEQ ID NO: 29708 - DNA, 20 bp, H. sapiens
actgcagcctccacctccca

SEQ ID NO: 29709 - DNA, 16 bp, H. sapiens
actgcagcctccatcc

SEQ ID NO: 29710 - DNA, 16 bp, H. sapiens
actgcagcctccatct

SEQ ID NO: 29711 - DNA, 16 bp, H. sapiens
actgcagcctcccaag

SEQ ID NO: 29712 - DNA, 16 bp, H. sapiens
actgcagcctcccagg

SEQ ID NO: 29713 - DNA, 16 bp, H. sapiens
actgcagcctcccggg

SEQ ID NO: 29714 - DNA, 16 bp, H. sapiens
actgcagcctcctgag

SEQ ID NO: 29715 - DNA, 16 bp, H. sapiens
actgcagcctctacct

SEQ ID NO: 29716 - DNA, 16 bp, H. sapiens
actgcagcctctgccc

SEQ ID NO: 29717 - DNA, 16 bp, H. sapiens
actgcagcctgaaact

SEQ ID NO: 29718 - DNA, 16 bp, H. sapiens
actgcagcctggaact

SEQ ID NO: 29719 - DNA, 16 bp, H. sapiens
actgcagcctggacga

SEQ ID NO: 29720 - DNA, 16 bp, H. sapiens
actgcagcctggagct

SEQ ID NO: 29721 - DNA, 16 bp, H. sapiens
actgcagcctgggctc

SEQ ID NO: 29722 - DNA, 16 bp, H. sapiens
actgcagcctgggtgg

SEQ ID NO: 29723 - DNA, 16 bp, H. sapiens
actgcagccttcatct

SEQ ID NO: 29724 - DNA, 18 bp, H. sapiens
actgcagccttgaactct

SEQ ID NO: 29725 - DNA, 16 bp, H. sapiens
actgcagccttggcct

SEQ ID NO: 29726 - DNA, 16 bp, H. sapiens
actgcagcctttgcct

SEQ ID NO: 29727 - DNA, 16 bp, H. sapiens
actgcagcttcaaact

SEQ ID NO: 29728 - DNA, 16 bp, H. sapiens
actgcagcttctccat

SEQ ID NO: 29729 - DNA, 16 bp, H. sapiens
actgcaggaagcagct

SEQ ID NO: 29730 - DNA, 16 bp, H. sapiens
actgcaggacttgagt

SEQ ID NO: 29731 - DNA, 16 bp, H. sapiens
actgcaggcaggcacc

SEQ ID NO: 29732 - DNA, 16 bp, H. sapiens
actgcagggctggagg

SEQ ID NO: 29733 - DNA, 16 bp, H. sapiens
actgcaggtgcccacc

SEQ ID NO: 29734 - DNA, 16 bp, H. sapiens
actgcaggtgcccgcc

SEQ ID NO: 29735 - DNA, 16 bp, H. sapiens
actgcagtctggctct

SEQ ID NO: 29736 - DNA, 16 bp, H. sapiens
actgcagtctgggcaa

SEQ ID NO: 29737 - DNA, 16 bp, H. sapiens
actgcagtgagccatg

SEQ ID NO: 29738 - DNA, 16 bp, H. sapiens
actgcagtgagctatg

SEQ ID NO: 29739 - DNA, 16 bp, H. sapiens
actgcagtgattgtta

SEQ ID NO: 29740 - DNA, 16 bp, H. sapiens
actgcagttacttttg

SEQ ID NO: 29741 - DNA, 16 bp, H. sapiens
actgcataaatgtctt

SEQ ID NO: 29742 - DNA, 16 bp, H. sapiens
actgcatcactgcact

SEQ ID NO: 29743 - DNA, 16 bp, H. sapiens
actgcatccagccagg

SEQ ID NO: 29744 - DNA, 16 bp, H. sapiens
actgcatccagcctgg

SEQ ID NO: 29745 - DNA, 16 bp, H. sapiens
actgcatcctctgctt

SEQ ID NO: 29746 - DNA, 16 bp, H. sapiens
actgcatgttgtcact

SEQ ID NO: 29747 - DNA, 16 bp, H. sapiens
actgcatgtttttact

SEQ ID NO: 29748 - DNA, 16 bp, H. sapiens
actgcatttgcttttg

SEQ ID NO: 29749 - DNA, 16 bp, H. sapiens
actgcattttattttt

SEQ ID NO: 29750 - DNA, 16 bp, H. sapiens
actgccaaactctttt

SEQ ID NO: 29751 - DNA, 16 bp, H. sapiens
actgccaaactttttc

SEQ ID NO: 29752 - DNA, 16 bp, H. sapiens
actgccacaatttcag

SEQ ID NO: 29753 - DNA, 16 bp, H. sapiens
actgccacacctggct

SEQ ID NO: 29754 - DNA, 16 bp, H. sapiens
actgccagtactatgt

SEQ ID NO: 29755 - DNA, 16 bp, H. sapiens
actgccatcatcatca

SEQ ID NO: 29756 - DNA, 16 bp, H. sapiens
actgccatccagcctg

SEQ ID NO: 29757 - DNA, 16 bp, H. sapiens
actgccatgcctggct

SEQ ID NO: 29758 - DNA, 16 bp, H. sapiens
actgcccaaagaaatt

SEQ ID NO: 29759 - DNA, 16 bp, H. sapiens
actgcccaaagcaact

SEQ ID NO: 29760 - DNA, 16 bp, H. sapiens
actgcccaaagtgatc

SEQ ID NO: 29761 - DNA, 18 bp, H. sapiens
actgcccaaggcaattta

SEQ ID NO: 29762 - DNA, 16 bp, H. sapiens
actgcccaggcctgca

SEQ ID NO: 29763 - DNA, 16 bp, H. sapiens
actgcccaggctagag

SEQ ID NO: 29764 - DNA, 16 bp, H. sapiens
actgccccctgctcca

SEQ ID NO: 29765 - DNA, 16 bp, H. sapiens
actgccctggaaaggg

SEQ ID NO: 29766 - DNA, 16 bp, H. sapiens
actgcccttgctgccc

SEQ ID NO: 29767 - DNA, 16 bp, H. sapiens
actgcctagtggagct

SEQ ID NO: 29768 - DNA, 16 bp, H. sapiens
actgcctcaacttcag

SEQ ID NO: 29769 - DNA, 16 bp, H. sapiens
actgcctcagcctcct

SEQ ID NO: 29770 - DNA, 16 bp, H. sapiens
actgcctcctcaagta

SEQ ID NO: 29771 - DNA, 16 bp, H. sapiens
actgcctctctagatt

SEQ ID NO: 29772 - DNA, 16 bp, H. sapiens
actgcctctgccccag

SEQ ID NO: 29773 - DNA, 16 bp, H. sapiens
actgcctcttcaagtg

SEQ ID NO: 29774 - DNA, 16 bp, H. sapiens
actgcctgcctgactg

SEQ ID NO: 29775 - DNA, 16 bp, H. sapiens
actgcctggagttggg

SEQ ID NO: 29776 - DNA, 16 bp, H. sapiens
actgcctgtttttctg

SEQ ID NO: 29777 - DNA, 16 bp, H. sapiens
actgcctgtttttgta

SEQ ID NO: 29778 - DNA, 16 bp, H. sapiens
actgcgacctccactt

SEQ ID NO: 29779 - DNA, 16 bp, H. sapiens
actgcgcccagcccac

SEQ ID NO: 29780 - DNA, 16 bp, H. sapiens
actgcgcccagcctga

SEQ ID NO: 29781 - DNA, 16 bp, H. sapiens
actgcgcccagtccca

SEQ ID NO: 29782 - DNA, 16 bp, H. sapiens
actgcgcccggccccc

SEQ ID NO: 29783 - DNA, 16 bp, H. sapiens
actgcgcccggctgcc

SEQ ID NO: 29784 - DNA, 16 bp, H. sapiens
actgcgcctggccacc

SEQ ID NO: 29785 - DNA, 16 bp, H. sapiens
actgcgcctggcctac

SEQ ID NO: 29786 - DNA, 16 bp, H. sapiens
actgcgctgcagcctg

SEQ ID NO: 29787 - DNA, 19 bp, H. sapiens
actgcggaaggccgcaggg

SEQ ID NO: 29788 - DNA, 16 bp, H. sapiens
actgctaaaaaccaaa

SEQ ID NO: 29789 - DNA, 16 bp, H. sapiens
actgctacctctgtct

SEQ ID NO: 29790 - DNA, 16 bp, H. sapiens
actgctactgggttct

SEQ ID NO: 29791 - DNA, 16 bp, H. sapiens
actgctataaagaact

SEQ ID NO: 29792 - DNA, 16 bp, H. sapiens
actgctattattatta

SEQ ID NO: 29793 - DNA, 16 bp, H. sapiens
actgctcaataaaata

SEQ ID NO: 29794 - DNA, 16 bp, H. sapiens
actgctcaatgaaaaa

SEQ ID NO: 29795 - DNA, 17 bp, H. sapiens
actgctcactgcagcct

SEQ ID NO: 29796 - DNA, 16 bp, H. sapiens
actgctcagggaaata

SEQ ID NO: 29797 - DNA, 16 bp, H. sapiens
actgctcattgaaaat

SEQ ID NO: 29798 - DNA, 16 bp, H. sapiens
actgctccagctccag

SEQ ID NO: 29799 - DNA, 16 bp, H. sapiens
actgctccaggaaata

SEQ ID NO: 29800 - DNA, 16 bp, H. sapiens
actgctcctggcccag

SEQ ID NO: 29801 - DNA, 16 bp, H. sapiens
actgctctaaaaaagt

SEQ ID NO: 29802 - DNA, 16 bp, H. sapiens
actgctctggctagga

SEQ ID NO: 29803 - DNA, 16 bp, H. sapiens
actgctcttaaaaaaa

SEQ ID NO: 29804 - DNA, 16 bp, H. sapiens
actgctgaaagaaacc

SEQ ID NO: 29805 - DNA, 16 bp, H. sapiens
actgctgaaagcaatc

SEQ ID NO: 29806 - DNA, 16 bp, H. sapiens
actgctgataaagaca

SEQ ID NO: 29807 - DNA, 16 bp, H. sapiens
actgctgatgggcatc

SEQ ID NO: 29808 - DNA, 16 bp, H. sapiens
actgctgccaccacca

SEQ ID NO: 29809 - DNA, 16 bp, H. sapiens
actgctgccactgcca

SEQ ID NO: 29810 - DNA, 16 bp, H. sapiens
actgctgccactgctg

SEQ ID NO: 29811 - DNA, 16 bp, H. sapiens
actgctgctgcccctg

SEQ ID NO: 29812 - DNA, 16 bp, H. sapiens
actgctgctgcctgtc

SEQ ID NO: 29813 - DNA, 16 bp, H. sapiens
actgctgctgctgctt

SEQ ID NO: 29814 - DNA, 16 bp, H. sapiens
actgctgctgggaatg

SEQ ID NO: 29815 - DNA, 16 bp, H. sapiens
actgctggatttggtt

SEQ ID NO: 29816 - DNA, 16 bp, H. sapiens
actgctgggggatggg

SEQ ID NO: 29817 - DNA, 16 bp, H. sapiens
actgctggtctcaagt

SEQ ID NO: 29818 - DNA, 16 bp, H. sapiens
actgctggtggcaatg

SEQ ID NO: 29819 - DNA, 16 bp, H. sapiens
actgctgtaaagaact

SEQ ID NO: 29820 - DNA, 16 bp, H. sapiens
actgctgtagctgtgt

SEQ ID NO: 29821 - DNA, 16 bp, H. sapiens
actgctgtgccagcaa

SEQ ID NO: 29822 - DNA, 16 bp, H. sapiens
actgcttcctgctgac

SEQ ID NO: 29823 - DNA, 18 bp, H. sapiens
actgcttgagtccaggag

SEQ ID NO: 29824 - DNA, 16 bp, H. sapiens
actgcttggatgatgg

SEQ ID NO: 29825 - DNA, 16 bp, H. sapiens
actgctttccacagtg

SEQ ID NO: 29826 - DNA, 16 bp, H. sapiens
actgctttgaatgagt

SEQ ID NO: 29827 - DNA, 16 bp, H. sapiens
actgctttgtgacatg

SEQ ID NO: 29828 - DNA, 16 bp, H. sapiens
actgcttttggtgttt

SEQ ID NO: 29829 - DNA, 16 bp, H. sapiens
actggaaaaagaagaa

SEQ ID NO: 29830 - DNA, 16 bp, H. sapiens
actggaaacagcaaca

SEQ ID NO: 29831 - DNA, 16 bp, H. sapiens
actggaaagagaaaaa

SEQ ID NO: 29832 - DNA, 16 bp, H. sapiens
actggaaaggaatgga

SEQ ID NO: 29833 - DNA, 16 bp, H. sapiens
actggaacaagacaat

SEQ ID NO: 29834 - DNA, 16 bp, H. sapiens
actggaacaggtgctg

SEQ ID NO: 29835 - DNA, 16 bp, H. sapiens
actggaacctccacct

SEQ ID NO: 29836 - DNA, 16 bp, H. sapiens
actggaagaaaaagaa

SEQ ID NO: 29837 - DNA, 16 bp, H. sapiens
actggaagaaaacatt

SEQ ID NO: 29838 - DNA, 16 bp, H. sapiens
actggaagaagaattg

SEQ ID NO: 29839 - DNA, 16 bp, H. sapiens
actggaagaagacaag

SEQ ID NO: 29840 - DNA, 16 bp, H. sapiens
actggaagagaagcag

SEQ ID NO: 29841 - DNA, 16 bp, H. sapiens
actggaagcaagccct

SEQ ID NO: 29842 - DNA, 16 bp, H. sapiens
actggaagcattccat

SEQ ID NO: 29843 - DNA, 16 bp, H. sapiens
actggaataaaaacag

SEQ ID NO: 29844 - DNA, 17 bp, H. sapiens
actggaatagcaggcat

SEQ ID NO: 29845 - DNA, 16 bp, H. sapiens
actggaatttgaattt

SEQ ID NO: 29846 - DNA, 16 bp, H. sapiens
actggaattttttaaa

SEQ ID NO: 29847 - DNA, 16 bp, H. sapiens
actggacagagaatga

SEQ ID NO: 29848 - DNA, 16 bp, H. sapiens
actggacatcagagaa

SEQ ID NO: 29849 - DNA, 16 bp, H. sapiens
actggacattttaaat

SEQ ID NO: 29850 - DNA, 16 bp, H. sapiens
actggactccagccag

SEQ ID NO: 29851 - DNA, 16 bp, H. sapiens
actggagaaacaagaa

SEQ ID NO: 29852 - DNA, 16 bp, H. sapiens
actggagaaagagaaa

SEQ ID NO: 29853 - DNA, 16 bp, H. sapiens
actggagaagctgaag

SEQ ID NO: 29854 - DNA, 16 bp, H. sapiens
actggagactgggaag

SEQ ID NO: 29855 - DNA, 16 bp, H. sapiens
actggagagactgtgg

SEQ ID NO: 29856 - DNA, 16 bp, H. sapiens
actggagagagaaatt

SEQ ID NO: 29857 - DNA, 16 bp, H. sapiens
actggagagcagtggc

SEQ ID NO: 29858 - DNA, 16 bp, H. sapiens
actggagaggctgaga

SEQ ID NO: 29859 - DNA, 16 bp, H. sapiens
actggagagtttagtc

SEQ ID NO: 29860 - DNA, 16 bp, H. sapiens
actggagattccaaaa

SEQ ID NO: 29861 - DNA, 16 bp, H. sapiens
actggagcagctggga

SEQ ID NO: 29862 - DNA, 16 bp, H. sapiens
actggagcccaggaga

SEQ ID NO: 29863 - DNA, 16 bp, H. sapiens
actggaggaaaaaaaa

SEQ ID NO: 29864 - DNA, 16 bp, H. sapiens
actggagtacagtggc

SEQ ID NO: 29865 - DNA, 17 bp, H. sapiens
actggagtgcaatggcg

SEQ ID NO: 29866 - DNA, 16 bp, H. sapiens
actggagtgcaatggt

SEQ ID NO: 29867 - DNA, 16 bp, H. sapiens
actggagtgcagtggc

SEQ ID NO: 29868 - DNA, 18 bp, H. sapiens
actggagtgcagtggcgc

SEQ ID NO: 29869 - DNA, 18 bp, H. sapiens
actggagtgcagtggtgc

SEQ ID NO: 29870 - DNA, 16 bp, H. sapiens
actggagtgtgtgtgt

SEQ ID NO: 29871 - DNA, 16 bp, H. sapiens
actggagttcagtggc

SEQ ID NO: 29872 - DNA, 16 bp, H. sapiens
actggataaagaaaac

SEQ ID NO: 29873 - DNA, 16 bp, H. sapiens
actggataaataaaat

SEQ ID NO: 29874 - DNA, 16 bp, H. sapiens
actggatattcatata

SEQ ID NO: 29875 - DNA, 16 bp, H. sapiens
actggatcactcatac

SEQ ID NO: 29876 - DNA, 16 bp, H. sapiens
actggatctctgagct

SEQ ID NO: 29877 - DNA, 16 bp, H. sapiens
actggatgaagaaaat

SEQ ID NO: 29878 - DNA, 16 bp, H. sapiens
actggatgatgcccac

SEQ ID NO: 29879 - DNA, 16 bp, H. sapiens
actggatggagaatga

SEQ ID NO: 29880 - DNA, 16 bp, H. sapiens
actggattaagaaaac

SEQ ID NO: 29881 - DNA, 16 bp, H. sapiens
actggattaaggaata

SEQ ID NO: 29882 - DNA, 16 bp, H. sapiens
actggattagggtggg

SEQ ID NO: 29883 - DNA, 16 bp, H. sapiens
actggattccagcctg

SEQ ID NO: 29884 - DNA, 16 bp, H. sapiens
actggattctttcact

SEQ ID NO: 29885 - DNA, 16 bp, H. sapiens
actggattttttaaaa

SEQ ID NO: 29886 - DNA, 16 bp, H. sapiens
actggcaaagcagaat

SEQ ID NO: 29887 - DNA, 16 bp, H. sapiens
actggcaacctcttta

SEQ ID NO: 29888 - DNA, 16 bp, H. sapiens
actggcaaggatgcag

SEQ ID NO: 29889 - DNA, 16 bp, H. sapiens
actggcagaagacaag

SEQ ID NO: 29890 - DNA, 16 bp, H. sapiens
actggcagcctggccc

SEQ ID NO: 29891 - DNA, 23 bp, H. sapiens
actggcaggcagctccacctgcg

SEQ ID NO: 29892 - DNA, 16 bp, H. sapiens
actggcataagaacag

SEQ ID NO: 29893 - DNA, 16 bp, H. sapiens
actggcatctgcttgg

SEQ ID NO: 29894 - DNA, 16 bp, H. sapiens
actggcatctggtggg

SEQ ID NO: 29895 - DNA, 16 bp, H. sapiens
actggccaacatggag

SEQ ID NO: 29896 - DNA, 16 bp, H. sapiens
actggccaggcatggt

SEQ ID NO: 29897 - DNA, 16 bp, H. sapiens
actggccaggtgtggt

SEQ ID NO: 29898 - DNA, 16 bp, H. sapiens
actggccattttcact

SEQ ID NO: 29899 - DNA, 16 bp, H. sapiens
actggcccaaccagaa

SEQ ID NO: 29900 - DNA, 16 bp, H. sapiens
actggccctctgccct

SEQ ID NO: 29901 - DNA, 16 bp, H. sapiens
actggcctcaaatgat

SEQ ID NO: 29902 - DNA, 16 bp, H. sapiens
actggctaaccacatg

SEQ ID NO: 29903 - DNA, 16 bp, H. sapiens
actggctcaggagtga

SEQ ID NO: 29904 - DNA, 16 bp, H. sapiens
actggctctttttttt

SEQ ID NO: 29905 - DNA, 16 bp, H. sapiens
actggctgcacctgct

SEQ ID NO: 29906 - DNA, 16 bp, H. sapiens
actggctgggactaca

SEQ ID NO: 29907 - DNA, 16 bp, H. sapiens
actggctgtgggtctg

SEQ ID NO: 29908 - DNA, 16 bp, H. sapiens
actggctgtgtgatct

SEQ ID NO: 29909 - DNA, 16 bp, H. sapiens
actggctgtgtgattt

SEQ ID NO: 29910 - DNA, 16 bp, H. sapiens
actggcttcctttctc

SEQ ID NO: 29911 - DNA, 16 bp, H. sapiens
actggctttgtctggg

SEQ ID NO: 29912 - DNA, 16 bp, H. sapiens
actgggaaaactggat

SEQ ID NO: 29913 - DNA, 16 bp, H. sapiens
actgggaaaccaaaaa

SEQ ID NO: 29914 - DNA, 16 bp, H. sapiens
actgggaaaccaaaat

SEQ ID NO: 29915 - DNA, 16 bp, H. sapiens
actgggaagaaaaata

SEQ ID NO: 29916 - DNA, 16 bp, H. sapiens
actgggaagtctaaga

SEQ ID NO: 29917 - DNA, 16 bp, H. sapiens
actgggactacaggca

SEQ ID NO: 29918 - DNA, 16 bp, H. sapiens
actgggactacaggtg

SEQ ID NO: 29919 - DNA, 16 bp, H. sapiens
actgggagaaaacatt

SEQ ID NO: 29920 - DNA, 16 bp, H. sapiens
actgggagaaattatt

SEQ ID NO: 29921 - DNA, 16 bp, H. sapiens
actgggatcacaggtg

SEQ ID NO: 29922 - DNA, 16 bp, H. sapiens
actgggattacaggca

SEQ ID NO: 29923 - DNA, 17 bp, H. sapiens
actgggattacaggcgc

SEQ ID NO: 29924 - DNA, 16 bp, H. sapiens
actgggcatcagagaa

SEQ ID NO: 29925 - DNA, 16 bp, H. sapiens
actgggcatggtggca

SEQ ID NO: 29926 - DNA, 16 bp, H. sapiens
actgggccaaaatcaa

SEQ ID NO: 29927 - DNA, 16 bp, H. sapiens
actgggccactgccta

SEQ ID NO: 29928 - DNA, 16 bp, H. sapiens
actgggcccaggagcc

SEQ ID NO: 29929 - DNA, 16 bp, H. sapiens
actgggcccagtggct

SEQ ID NO: 29930 - DNA, 18 bp, H. sapiens
actgggcgcagtggctca

SEQ ID NO: 29931 - DNA, 16 bp, H. sapiens
actgggctcaagtgat

SEQ ID NO: 29932 - DNA, 16 bp, H. sapiens
actgggctccaggctg

SEQ ID NO: 29933 - DNA, 16 bp, H. sapiens
actgggctgggtgcgg

SEQ ID NO: 29934 - DNA, 16 bp, H. sapiens
actggggaaaaaaaaa

SEQ ID NO: 29935 - DNA, 16 bp, H. sapiens
actggggaaaatattt

SEQ ID NO: 29936 - DNA, 16 bp, H. sapiens
actggggaagaatctg

SEQ ID NO: 29937 - DNA, 16 bp, H. sapiens
actggggaagctgagg

SEQ ID NO: 29938 - DNA, 16 bp, H. sapiens
actggggagacctcag

SEQ ID NO: 29939 - DNA, 16 bp, H. sapiens
actggggaggctgggg

SEQ ID NO: 29940 - DNA, 16 bp, H. sapiens
actggggaggtagagg

SEQ ID NO: 29941 - DNA, 16 bp, H. sapiens
actggggcactcccta

SEQ ID NO: 29942 - DNA, 16 bp, H. sapiens
actggggcactgccta

SEQ ID NO: 29943 - DNA, 16 bp, H. sapiens
actggggcccagagag

SEQ ID NO: 29944 - DNA, 16 bp, H. sapiens
actggggcctatttga

SEQ ID NO: 29945 - DNA, 16 bp, H. sapiens
actggggctgctgcct

SEQ ID NO: 29946 - DNA, 16 bp, H. sapiens
actggggctgttgcct

SEQ ID NO: 29947 - DNA, 16 bp, H. sapiens
actgggggagggagag

SEQ ID NO: 29948 - DNA, 16 bp, H. sapiens
actggggtcagggacc

SEQ ID NO: 29949 - DNA, 16 bp, H. sapiens
actgggtaatttctaa

SEQ ID NO: 29950 - DNA, 16 bp, H. sapiens
actgggtaatttttaa

SEQ ID NO: 29951 - DNA, 16 bp, H. sapiens
actgggtctcaccatg

SEQ ID NO: 29952 - DNA, 16 bp, H. sapiens
actgggtctggctctg

SEQ ID NO: 29953 - DNA, 17 bp, H. sapiens
actgggtgccgtggagc

SEQ ID NO: 29954 - DNA, 16 bp, H. sapiens
actgggtgtggtggca

SEQ ID NO: 29955 - DNA, 16 bp, H. sapiens
actgggttcaagcgat

SEQ ID NO: 29956 - DNA, 16 bp, H. sapiens
actggtaccagtttac

SEQ ID NO: 29957 - DNA, 16 bp, H. sapiens
actggtctcagcccag

SEQ ID NO: 29958 - DNA, 16 bp, H. sapiens
actggtctgtggcctg

SEQ ID NO: 29959 - DNA, 16 bp, H. sapiens
actggtcttgaactcc

SEQ ID NO: 29960 - DNA, 16 bp, H. sapiens
actggtgaattttacc

SEQ ID NO: 29961 - DNA, 16 bp, H. sapiens
actggtgaggaaactg

SEQ ID NO: 29962 - DNA, 16 bp, H. sapiens
actggtgctttatttt

SEQ ID NO: 29963 - DNA, 16 bp, H. sapiens
actggtggaagaaatt

SEQ ID NO: 29964 - DNA, 16 bp, H. sapiens
actggtggtgacaaaa

SEQ ID NO: 29965 - DNA, 20 bp, H. sapiens
actggtgtacctgaaagtga

SEQ ID NO: 29966 - DNA, 16 bp, H. sapiens
actggtgtccctataa

SEQ ID NO: 29967 - DNA, 16 bp, H. sapiens
actggtgtccttataa

SEQ ID NO: 29968 - DNA, 16 bp, H. sapiens
actggtgtccttatag

SEQ ID NO: 29969 - DNA, 18 bp, H. sapiens
actggtgtgagatggtat

SEQ ID NO: 29970 - DNA, 16 bp, H. sapiens
actggtgtgggaaggg

SEQ ID NO: 29971 - DNA, 16 bp, H. sapiens
actggttaaataaatg

SEQ ID NO: 29972 - DNA, 16 bp, H. sapiens
actggttgtcctgctt

SEQ ID NO: 29973 - DNA, 16 bp, H. sapiens
actggtttaagaaaat

SEQ ID NO: 29974 - DNA, 16 bp, H. sapiens
actggtttcatagaat

SEQ ID NO: 29975 - DNA, 16 bp, H. sapiens
actgtaaaaagaaaca

SEQ ID NO: 29976 - DNA, 16 bp, H. sapiens
actgtaaaacactgat

SEQ ID NO: 29977 - DNA, 16 bp, H. sapiens
actgtaaacagtgctg

SEQ ID NO: 29978 - DNA, 16 bp, H. sapiens
actgtaacctctgccc

SEQ ID NO: 29979 - DNA, 16 bp, H. sapiens
actgtaagataaattt

SEQ ID NO: 29980 - DNA, 16 bp, H. sapiens
actgtaagctctgtga

SEQ ID NO: 29981 - DNA, 16 bp, H. sapiens
actgtaaggtaataaa

SEQ ID NO: 29982 - DNA, 16 bp, H. sapiens
actgtaagtttcctga

SEQ ID NO: 29983 - DNA, 16 bp, H. sapiens
actgtaatttttaaaa

SEQ ID NO: 29984 - DNA, 16 bp, H. sapiens
actgtacacataaaaa

SEQ ID NO: 29985 - DNA, 16 bp, H. sapiens
actgtacatttttaaa

SEQ ID NO: 29986 - DNA, 16 bp, H. sapiens
actgtaccattttata

SEQ ID NO: 29987 - DNA, 16 bp, H. sapiens
actgtactatcaaata

SEQ ID NO: 29988 - DNA, 16 bp, H. sapiens
actgtactccagccta

SEQ ID NO: 29989 - DNA, 16 bp, H. sapiens
actgtactctggccta

SEQ ID NO: 29990 - DNA, 18 bp, H. sapiens
actgtactgccgccatct

SEQ ID NO: 29991 - DNA, 16 bp, H. sapiens
actgtactggatactg

SEQ ID NO: 29992 - DNA, 16 bp, H. sapiens
actgtactgtatttat

SEQ ID NO: 29993 - DNA, 16 bp, H. sapiens
actgtagaaaaataaa

SEQ ID NO: 29994 - DNA, 16 bp, H. sapiens
actgtagagccccagg

SEQ ID NO: 29995 - DNA, 16 bp, H. sapiens
actgtagcctgggaga

SEQ ID NO: 29996 - DNA, 16 bp, H. sapiens
actgtagcctgggcaa

SEQ ID NO: 29997 - DNA, 16 bp, H. sapiens
actgtagcctgggtga

SEQ ID NO: 29998 - DNA, 16 bp, H. sapiens
actgtagccttcacct

SEQ ID NO: 29999 - DNA, 16 bp, H. sapiens
actgtaggactaatct

SEQ ID NO: 30000 - DNA, 16 bp, H. sapiens
actgtagttttgtaat

SEQ ID NO: 30001 - DNA, 16 bp, H. sapiens
actgtataggaaaaaa

SEQ ID NO: 30002 - DNA, 16 bp, H. sapiens
actgtatataattgta

SEQ ID NO: 30003 - DNA, 16 bp, H. sapiens
actgtatccaatgtgt

SEQ ID NO: 30004 - DNA, 22 bp, H. sapiens
actgtatctagctgctctggtg

SEQ ID NO: 30005 - DNA, 16 bp, H. sapiens
actgtatgattcaatt

SEQ ID NO: 30006 - DNA, 16 bp, H. sapiens
actgtatggcctgcaa

SEQ ID NO: 30007 - DNA, 16 bp, H. sapiens
actgtatgtaaatttt

SEQ ID NO: 30008 - DNA, 16 bp, H. sapiens
actgtattaaaattaa

SEQ ID NO: 30009 - DNA, 16 bp, H. sapiens
actgtattagtttgct

SEQ ID NO: 30010 - DNA, 16 bp, H. sapiens
actgtattattattat

SEQ ID NO: 30011 - DNA, 16 bp, H. sapiens
actgtattattttgtt

SEQ ID NO: 30012 - DNA, 16 bp, H. sapiens
actgtattcccagcac

SEQ ID NO: 30013 - DNA, 16 bp, H. sapiens
actgtattcctaggta

SEQ ID NO: 30014 - DNA, 16 bp, H. sapiens
actgtattcttacagt

SEQ ID NO: 30015 - DNA, 16 bp, H. sapiens
actgtatttaaaaaaa

SEQ ID NO: 30016 - DNA, 16 bp, H. sapiens
actgtatttaaaatat

SEQ ID NO: 30017 - DNA, 16 bp, H. sapiens
actgtatttggacata

SEQ ID NO: 30018 - DNA, 16 bp, H. sapiens
actgtatttggagaaa

SEQ ID NO: 30019 - DNA, 16 bp, H. sapiens
actgtattttgtttat

SEQ ID NO: 30020 - DNA, 16 bp, H. sapiens
actgtatttttacaat

SEQ ID NO: 30021 - DNA, 16 bp, H. sapiens
actgtatttttatatt

SEQ ID NO: 30022 - DNA, 16 bp, H. sapiens
actgtatttttatttc

SEQ ID NO: 30023 - DNA, 16 bp, H. sapiens
actgtatttttcagtt

SEQ ID NO: 30024 - DNA, 16 bp, H. sapiens
actgtatttttctctt

SEQ ID NO: 30025 - DNA, 16 bp, H. sapiens
actgtcaacagagtga

SEQ ID NO: 30026 - DNA, 16 bp, H. sapiens
actgtcaccaccacca

SEQ ID NO: 30027 - DNA, 16 bp, H. sapiens
actgtcactgtttgcc

SEQ ID NO: 30028 - DNA, 16 bp, H. sapiens
actgtcagagaatact

SEQ ID NO: 30029 - DNA, 16 bp, H. sapiens
actgtcattcagaaat

SEQ ID NO: 30030 - DNA, 16 bp, H. sapiens
actgtcattctgacca

SEQ ID NO: 30031 - DNA, 16 bp, H. sapiens
actgtccccatgatcc

SEQ ID NO: 30032 - DNA, 16 bp, H. sapiens
actgtcctttctccag

SEQ ID NO: 30033 - DNA, 16 bp, H. sapiens
actgtctcaaaaaaaa

SEQ ID NO: 30034 - DNA, 16 bp, H. sapiens
actgtctcaaaaaata

SEQ ID NO: 30035 - DNA, 16 bp, H. sapiens
actgtctcctggcctg

SEQ ID NO: 30036 - DNA, 16 bp, H. sapiens
actgtcttccaaagtg

SEQ ID NO: 30037 - DNA, 16 bp, H. sapiens
actgtcttccacaaaa

SEQ ID NO: 30038 - DNA, 16 bp, H. sapiens
actgtcttccacctct

SEQ ID NO: 30039 - DNA, 16 bp, H. sapiens
actgtcttcctcaatg

SEQ ID NO: 30040 - DNA, 16 bp, H. sapiens
actgtcttctgcaatg

SEQ ID NO: 30041 - DNA, 16 bp, H. sapiens
actgtctttcctgccc

SEQ ID NO: 30042 - DNA, 16 bp, H. sapiens
actgtctttctgaaat

SEQ ID NO: 30043 - DNA, 16 bp, H. sapiens
actgtctttggtttga

SEQ ID NO: 30044 - DNA, 16 bp, H. sapiens
actgtcttttaaaatt

SEQ ID NO: 30045 - DNA, 16 bp, H. sapiens
actgtgaaaaacaaaa

SEQ ID NO: 30046 - DNA, 16 bp, H. sapiens
actgtgaaaatggact

SEQ ID NO: 30047 - DNA, 16 bp, H. sapiens
actgtgaaataataaa

SEQ ID NO: 30048 - DNA, 16 bp, H. sapiens
actgtgaacaactcta

SEQ ID NO: 30049 - DNA, 16 bp, H. sapiens
actgtgaacaattata

SEQ ID NO: 30050 - DNA, 16 bp, H. sapiens
actgtgaagaaaaaga

SEQ ID NO: 30051 - DNA, 16 bp, H. sapiens
actgtgaagaaagtca

SEQ ID NO: 30052 - DNA, 16 bp, H. sapiens
actgtgaagatgaaat

SEQ ID NO: 30053 - DNA, 16 bp, H. sapiens
actgtgaatattgctg

SEQ ID NO: 30054 - DNA, 16 bp, H. sapiens
actgtgaatccattaa

SEQ ID NO: 30055 - DNA, 16 bp, H. sapiens
actgtgacctctgtct

SEQ ID NO: 30056 - DNA, 16 bp, H. sapiens
actgtgacttctgcct

SEQ ID NO: 30057 - DNA, 16 bp, H. sapiens
actgtgagaaataaat

SEQ ID NO: 30058 - DNA, 16 bp, H. sapiens
actgtgagaaatgttt

SEQ ID NO: 30059 - DNA, 16 bp, H. sapiens
actgtgagagaaaaaa

SEQ ID NO: 30060 - DNA, 16 bp, H. sapiens
actgtgagcaagctgg

SEQ ID NO: 30061 - DNA, 16 bp, H. sapiens
actgtgagcaataaat

SEQ ID NO: 30062 - DNA, 16 bp, H. sapiens
actgtgagccaaaata

SEQ ID NO: 30063 - DNA, 16 bp, H. sapiens
actgtgagccaggcac

SEQ ID NO: 30064 - DNA, 16 bp, H. sapiens
actgtgagctccttga

SEQ ID NO: 30065 - DNA, 16 bp, H. sapiens
actgtgaggaaataaa

SEQ ID NO: 30066 - DNA, 16 bp, H. sapiens
actgtgaggaatacat

SEQ ID NO: 30067 - DNA, 16 bp, H. sapiens
actgtgagggtaaaac

SEQ ID NO: 30068 - DNA, 16 bp, H. sapiens
actgtgagtccagtaa

SEQ ID NO: 30069 - DNA, 16 bp, H. sapiens
actgtgataaaataaa

SEQ ID NO: 30070 - DNA, 16 bp, H. sapiens
actgtgatataataaa

SEQ ID NO: 30071 - DNA, 16 bp, H. sapiens
actgtgatgcctccag

SEQ ID NO: 30072 - DNA, 16 bp, H. sapiens
actgtgattgtgaggc

SEQ ID NO: 30073 - DNA, 16 bp, H. sapiens
actgtgcacacagaaa

SEQ ID NO: 30074 - DNA, 16 bp, H. sapiens
actgtgcactttattt

SEQ ID NO: 30075 - DNA, 16 bp, H. sapiens
actgtgcagaagctct

SEQ ID NO: 30076 - DNA, 16 bp, H. sapiens
actgtgccactgcact

SEQ ID NO: 30077 - DNA, 16 bp, H. sapiens
actgtgccactgtgct

SEQ ID NO: 30078 - DNA, 16 bp, H. sapiens
actgtgccaggcactg

SEQ ID NO: 30079 - DNA, 16 bp, H. sapiens
actgtgccattttaca

SEQ ID NO: 30080 - DNA, 16 bp, H. sapiens
actgtgcccagcattt

SEQ ID NO: 30081 - DNA, 16 bp, H. sapiens
actgtgcccagccaga

SEQ ID NO: 30082 - DNA, 16 bp, H. sapiens
actgtgcccagcccac

SEQ ID NO: 30083 - DNA, 16 bp, H. sapiens
actgtgcccagcccag

SEQ ID NO: 30084 - DNA, 16 bp, H. sapiens
actgtgcccagcccca

SEQ ID NO: 30085 - DNA, 17 bp, H. sapiens
actgtgcccagcctaaa

SEQ ID NO: 30086 - DNA, 16 bp, H. sapiens
actgtgcccagcctgc

SEQ ID NO: 30087 - DNA, 16 bp, H. sapiens
actgtgcccagccttg

SEQ ID NO: 30088 - DNA, 16 bp, H. sapiens
actgtgcccagctcaa

SEQ ID NO: 30089 - DNA, 16 bp, H. sapiens
actgtgcccagctgca

SEQ ID NO: 30090 - DNA, 16 bp, H. sapiens
actgtgcccggcccca

SEQ ID NO: 30091 - DNA, 16 bp, H. sapiens
actgtgcccggcctgg

SEQ ID NO: 30092 - DNA, 16 bp, H. sapiens
actgtgcccggctgct

SEQ ID NO: 30093 - DNA, 16 bp, H. sapiens
actgtgccctgcccag

SEQ ID NO: 30094 - DNA, 16 bp, H. sapiens
actgtgcctaattttt

SEQ ID NO: 30095 - DNA, 16 bp, H. sapiens
actgtgcctagcctgt

SEQ ID NO: 30096 - DNA, 16 bp, H. sapiens
actgtgcctggcctgg

SEQ ID NO: 30097 - DNA, 16 bp, H. sapiens
actgtgcctggctccc

SEQ ID NO: 30098 - DNA, 16 bp, H. sapiens
actgtgcctggcttcc

SEQ ID NO: 30099 - DNA, 16 bp, H. sapiens
actgtgctgctgcact

SEQ ID NO: 30100 - DNA, 16 bp, H. sapiens
actgtgctggcttcag

SEQ ID NO: 30101 - DNA, 16 bp, H. sapiens
actgtgcttggcctaa

SEQ ID NO: 30102 - DNA, 16 bp, H. sapiens
actgtgcttttcccac

SEQ ID NO: 30103 - DNA, 16 bp, H. sapiens
actgtgctttttaaaa

SEQ ID NO: 30104 - DNA, 16 bp, H. sapiens
actgtggaaagagagg

SEQ ID NO: 30105 - DNA, 16 bp, H. sapiens
actgtggagaaaaggg

SEQ ID NO: 30106 - DNA, 16 bp, H. sapiens
actgtggaggctgaga

SEQ ID NO: 30107 - DNA, 16 bp, H. sapiens
actgtggatgtggaaa

SEQ ID NO: 30108 - DNA, 16 bp, H. sapiens
actgtggcactgccta

SEQ ID NO: 30109 - DNA, 16 bp, H. sapiens
actgtggccaggcaca

SEQ ID NO: 30110 - DNA, 16 bp, H. sapiens
actgtggcctccaact

SEQ ID NO: 30111 - DNA, 16 bp, H. sapiens
actgtggctaagctgg

SEQ ID NO: 30112 - DNA, 16 bp, H. sapiens
actgtggctcatgcct

SEQ ID NO: 30113 - DNA, 16 bp, H. sapiens
actgtgggaaaagcat

SEQ ID NO: 30114 - DNA, 16 bp, H. sapiens
actgtgggagactgag

SEQ ID NO: 30115 - DNA, 16 bp, H. sapiens
actgtggggccctggc

SEQ ID NO: 30116 - DNA, 16 bp, H. sapiens
actgtgggtttttttt

SEQ ID NO: 30117 - DNA, 16 bp, H. sapiens
actgtggttcatgcct

SEQ ID NO: 30118 - DNA, 16 bp, H. sapiens
actgtggttttaactt

SEQ ID NO: 30119 - DNA, 16 bp, H. sapiens
actgtggttttgactt

SEQ ID NO: 30120 - DNA, 16 bp, H. sapiens
actgtggttttgtttt

SEQ ID NO: 30121 - DNA, 16 bp, H. sapiens
actgtgtaacaggcag

SEQ ID NO: 30122 - DNA, 16 bp, H. sapiens
actgtgtacccattaa

SEQ ID NO: 30123 - DNA, 16 bp, H. sapiens
actgtgtatttagaaa

SEQ ID NO: 30124 - DNA, 17 bp, H. sapiens
actgtgtctatgtagaa

SEQ ID NO: 30125 - DNA, 16 bp, H. sapiens
actgtgtctggcccag

SEQ ID NO: 30126 - DNA, 16 bp, H. sapiens
actgtgtctttgttct

SEQ ID NO: 30127 - DNA, 16 bp, H. sapiens
actgtgtgcaacctcc

SEQ ID NO: 30128 - DNA, 16 bp, H. sapiens
actgtgtgccaagcac

SEQ ID NO: 30129 - DNA, 16 bp, H. sapiens
actgtgtgccaagcat

SEQ ID NO: 30130 - DNA, 16 bp, H. sapiens
actgtgtggccttggg

SEQ ID NO: 30131 - DNA, 16 bp, H. sapiens
actgtgtgtgatcctg

SEQ ID NO: 30132 - DNA, 16 bp, H. sapiens
actgtgtgtgtatgtg

SEQ ID NO: 30133 - DNA, 16 bp, H. sapiens
actgtgtgtttgtgtg

SEQ ID NO: 30134 - DNA, 16 bp, H. sapiens
actgtgttccagtaaa

SEQ ID NO: 30135 - DNA, 17 bp, H. sapiens
actgtgttgctcaggct

SEQ ID NO: 30136 - DNA, 16 bp, H. sapiens
actgtgtttggagata

SEQ ID NO: 30137 - DNA, 16 bp, H. sapiens
actgttaaaaattatt

SEQ ID NO: 30138 - DNA, 16 bp, H. sapiens
actgttacatcactaa

SEQ ID NO: 30139 - DNA, 22 bp, H. sapiens
actgttagaaggaaaactaaca

SEQ ID NO: 30140 - DNA, 16 bp, H. sapiens
actgttatctccattt

SEQ ID NO: 30141 - DNA, 16 bp, H. sapiens
actgttcaaaaaggaa

SEQ ID NO: 30142 - DNA, 16 bp, H. sapiens
actgttcagctcccac

SEQ ID NO: 30143 - DNA, 17 bp, H. sapiens
actgttcagttcccacc

SEQ ID NO: 30144 - DNA, 16 bp, H. sapiens
actgttccaacctctt

SEQ ID NO: 30145 - DNA, 16 bp, H. sapiens
actgttctgtatcttg

SEQ ID NO: 30146 - DNA, 16 bp, H. sapiens
actgttgacatttggg

SEQ ID NO: 30147 - DNA, 16 bp, H. sapiens
actgttgatgggaatg

SEQ ID NO: 30148 - DNA, 16 bp, H. sapiens
actgttgcactgggga

SEQ ID NO: 30149 - DNA, 16 bp, H. sapiens
actgttgctgctgctg

SEQ ID NO: 30150 - DNA, 16 bp, H. sapiens
actgttgggaaggcat

SEQ ID NO: 30151 - DNA, 16 bp, H. sapiens
actgttgggattacag

SEQ ID NO: 30152 - DNA, 17 bp, H. sapiens
actgttggtggggctgt

SEQ ID NO: 30153 - DNA, 16 bp, H. sapiens
actgttgtgagatggt

SEQ ID NO: 30154 - DNA, 16 bp, H. sapiens
actgtttaaaaataaa

SEQ ID NO: 30155 - DNA, 16 bp, H. sapiens
actgtttaaaattttt

SEQ ID NO: 30156 - DNA, 16 bp, H. sapiens
actgtttcaacctctg

SEQ ID NO: 30157 - DNA, 16 bp, H. sapiens
actgtttctctaaaat

SEQ ID NO: 30158 - DNA, 16 bp, H. sapiens
actgtttctctctctc

SEQ ID NO: 30159 - DNA, 16 bp, H. sapiens
actgtttctgtgattc

SEQ ID NO: 30160 - DNA, 16 bp, H. sapiens
actgtttgtttcaatt

SEQ ID NO: 30161 - DNA, 16 bp, H. sapiens
actgttttaagaaagt

SEQ ID NO: 30162 - DNA, 16 bp, H. sapiens
actgttttaattactg

SEQ ID NO: 30163 - DNA, 16 bp, H. sapiens
actgttttacattcct

SEQ ID NO: 30164 - DNA, 16 bp, H. sapiens
actgttttccaaagtg

SEQ ID NO: 30165 - DNA, 16 bp, H. sapiens
actgttttccaacttg

SEQ ID NO: 30166 - DNA, 16 bp, H. sapiens
actgttttccatattg

SEQ ID NO: 30167 - DNA, 16 bp, H. sapiens
actgttttccttggta

SEQ ID NO: 30168 - DNA, 16 bp, H. sapiens
actgttttctatagtg

SEQ ID NO: 30169 - DNA, 16 bp, H. sapiens
actgttttctctttct

SEQ ID NO: 30170 - DNA, 16 bp, H. sapiens
actgttttcttctttg

SEQ ID NO: 30171 - DNA, 16 bp, H. sapiens
actgttttgaatgtgt

SEQ ID NO: 30172 - DNA, 16 bp, H. sapiens
actgtttttattacta

SEQ ID NO: 30173 - DNA, 16 bp, H. sapiens
actgtttttcttttaa

SEQ ID NO: 30174 - DNA, 16 bp, H. sapiens
actgtttttgcaaaat

SEQ ID NO: 30175 - DNA, 16 bp, H. sapiens
actgttttttctatct

SEQ ID NO: 30176 - DNA, 16 bp, H. sapiens
acttaaaaaaaatcag

SEQ ID NO: 30177 - DNA, 16 bp, H. sapiens
acttaaaaatgattaa

SEQ ID NO: 30178 - DNA, 16 bp, H. sapiens
acttaaaaatgggcaa

SEQ ID NO: 30179 - DNA, 16 bp, H. sapiens
acttaaaaatggttaa

SEQ ID NO: 30180 - DNA, 16 bp, H. sapiens
acttaaaaatgtattt

SEQ ID NO: 30181 - DNA, 16 bp, H. sapiens
acttaaaacaaaagtt

SEQ ID NO: 30182 - DNA, 16 bp, H. sapiens
acttaaaactttcttt

SEQ ID NO: 30183 - DNA, 16 bp, H. sapiens
acttaaaagtaaaacc

SEQ ID NO: 30184 - DNA, 16 bp, H. sapiens
acttaaaatacaagtt

SEQ ID NO: 30185 - DNA, 16 bp, H. sapiens
acttaaaatacatttt

SEQ ID NO: 30186 - DNA, 16 bp, H. sapiens
acttaaaattttaaga

SEQ ID NO: 30187 - DNA, 16 bp, H. sapiens
acttaaaatttttgaa

SEQ ID NO: 30188 - DNA, 16 bp, H. sapiens
acttaaacaccccact

SEQ ID NO: 30189 - DNA, 16 bp, H. sapiens
acttaaacttttcttt

SEQ ID NO: 30190 - DNA, 16 bp, H. sapiens
acttaaagtaaaattt

SEQ ID NO: 30191 - DNA, 16 bp, H. sapiens
acttaaagtacatata

SEQ ID NO: 30192 - DNA, 16 bp, H. sapiens
acttaaagttccacat

SEQ ID NO: 30193 - DNA, 16 bp, H. sapiens
acttaaatgaaatgga

SEQ ID NO: 30194 - DNA, 16 bp, H. sapiens
acttaaatgaacatat

SEQ ID NO: 30195 - DNA, 16 bp, H. sapiens
acttaacaataaaaag

SEQ ID NO: 30196 - DNA, 16 bp, H. sapiens
acttaaccaaggaggt

SEQ ID NO: 30197 - DNA, 16 bp, H. sapiens
acttaaccagtctcta

SEQ ID NO: 30198 - DNA, 16 bp, H. sapiens
acttaacctctctggg

SEQ ID NO: 30199 - DNA, 16 bp, H. sapiens
acttaacctttctggg

SEQ ID NO: 30200 - DNA, 16 bp, H. sapiens
acttaactcttgttta

SEQ ID NO: 30201 - DNA, 16 bp, H. sapiens
acttaagaaatttcaa

SEQ ID NO: 30202 - DNA, 16 bp, H. sapiens
acttaagagtagttta

SEQ ID NO: 30203 - DNA, 16 bp, H. sapiens
acttaataaatatttg

SEQ ID NO: 30204 - DNA, 16 bp, H. sapiens
acttaataaatgtgtg

SEQ ID NO: 30205 - DNA, 16 bp, H. sapiens
acttaataatcaacct

SEQ ID NO: 30206 - DNA, 16 bp, H. sapiens
acttaatagatattta

SEQ ID NO: 30207 - DNA, 16 bp, H. sapiens
acttaatccccagtgt

SEQ ID NO: 30208 - DNA, 16 bp, H. sapiens
acttaatctccaaata

SEQ ID NO: 30209 - DNA, 16 bp, H. sapiens
acttaatgccactaaa

SEQ ID NO: 30210 - DNA, 16 bp, H. sapiens
acttaatggggaaaaa

SEQ ID NO: 30211 - DNA, 16 bp, H. sapiens
acttaatgttttcaag

SEQ ID NO: 30212 - DNA, 16 bp, H. sapiens
acttaattctcataac

SEQ ID NO: 30213 - DNA, 16 bp, H. sapiens
acttaattttgtattt

SEQ ID NO: 30214 - DNA, 16 bp, H. sapiens
acttacaaaaacaggt

SEQ ID NO: 30215 - DNA, 16 bp, H. sapiens
acttacaagtgggagt

SEQ ID NO: 30216 - DNA, 16 bp, H. sapiens
acttacaatagcatca

SEQ ID NO: 30217 - DNA, 16 bp, H. sapiens
acttacaattatggcg

SEQ ID NO: 30218 - DNA, 16 bp, H. sapiens
acttacaattttttaa

SEQ ID NO: 30219 - DNA, 16 bp, H. sapiens
acttacagatgaagaa

SEQ ID NO: 30220 - DNA, 16 bp, H. sapiens
acttacagtaaaataa

SEQ ID NO: 30221 - DNA, 16 bp, H. sapiens
acttacagtcccagct

SEQ ID NO: 30222 - DNA, 16 bp, H. sapiens
acttaccatgtgccag

SEQ ID NO: 30223 - DNA, 16 bp, H. sapiens
acttacccagagcaac

SEQ ID NO: 30224 - DNA, 16 bp, H. sapiens
acttaccctctctgtg

SEQ ID NO: 30225 - DNA, 16 bp, H. sapiens
acttacgatggggtta

SEQ ID NO: 30226 - DNA, 16 bp, H. sapiens
acttactagttttgtg

SEQ ID NO: 30227 - DNA, 16 bp, H. sapiens
acttactcaaggtcac

SEQ ID NO: 30228 - DNA, 16 bp, H. sapiens
acttactgtaaagcta

SEQ ID NO: 30229 - DNA, 16 bp, H. sapiens
acttagaaaatattaa

SEQ ID NO: 30230 - DNA, 16 bp, H. sapiens
acttagaatagtgcct

SEQ ID NO: 30231 - DNA, 16 bp, H. sapiens
acttagagatgaatga

SEQ ID NO: 30232 - DNA, 16 bp, H. sapiens
acttagaggcttaaaa

SEQ ID NO: 30233 - DNA, 16 bp, H. sapiens
acttagcagtgggatt

SEQ ID NO: 30234 - DNA, 16 bp, H. sapiens
acttagcatagtgttc

SEQ ID NO: 30235 - DNA, 16 bp, H. sapiens
acttaggatattttca

SEQ ID NO: 30236 - DNA, 16 bp, H. sapiens
acttaggttggttcca

SEQ ID NO: 30237 - DNA, 16 bp, H. sapiens
acttagtgccttaaaa

SEQ ID NO: 30238 - DNA, 16 bp, H. sapiens
acttagttgcttaaaa

SEQ ID NO: 30239 - DNA, 16 bp, H. sapiens
acttataatcatggta

SEQ ID NO: 30240 - DNA, 16 bp, H. sapiens
acttatacattgctgg

SEQ ID NO: 30241 - DNA, 16 bp, H. sapiens
acttatatgaggttcc

SEQ ID NO: 30242 - DNA, 16 bp, H. sapiens
acttatatttaatgta

SEQ ID NO: 30243 - DNA, 16 bp, H. sapiens
acttatcaaaagaaga

SEQ ID NO: 30244 - DNA, 16 bp, H. sapiens
acttatcacatggtaa

SEQ ID NO: 30245 - DNA, 16 bp, H. sapiens
acttatgatggggtta

SEQ ID NO: 30246 - DNA, 16 bp, H. sapiens
acttatgatgggttta

SEQ ID NO: 30247 - DNA, 16 bp, H. sapiens
acttatgatttgtgca

SEQ ID NO: 30248 - DNA, 16 bp, H. sapiens
acttatggaaataaaa

SEQ ID NO: 30249 - DNA, 16 bp, H. sapiens
acttatgtttaaaaga

SEQ ID NO: 30250 - DNA, 16 bp, H. sapiens
acttattcactatcac

SEQ ID NO: 30251 - DNA, 16 bp, H. sapiens
acttattcattcattt

SEQ ID NO: 30252 - DNA, 16 bp, H. sapiens
acttattctacaaggc

SEQ ID NO: 30253 - DNA, 16 bp, H. sapiens
acttattgagcaccta

SEQ ID NO: 30254 - DNA, 16 bp, H. sapiens
acttatttaagaaaaa

SEQ ID NO: 30255 - DNA, 16 bp, H. sapiens
acttatttcatttcct

SEQ ID NO: 30256 - DNA, 16 bp, H. sapiens
acttatttctgctctg

SEQ ID NO: 30257 - DNA, 16 bp, H. sapiens
acttatttcttacagt

SEQ ID NO: 30258 - DNA, 16 bp, H. sapiens
acttatttgaaatttt

SEQ ID NO: 30259 - DNA, 16 bp, H. sapiens
acttatttgtgtcttt

SEQ ID NO: 30260 - DNA, 16 bp, H. sapiens
acttatttttgtcatt

SEQ ID NO: 30261 - DNA, 16 bp, H. sapiens
acttatttttttaaag

SEQ ID NO: 30262 - DNA, 16 bp, H. sapiens
acttcaaaaaatcaat

SEQ ID NO: 30263 - DNA, 16 bp, H. sapiens
acttcaaaagaagaca

SEQ ID NO: 30264 - DNA, 16 bp, H. sapiens
acttcaaaataatttt

SEQ ID NO: 30265 - DNA, 16 bp, H. sapiens
acttcaaaatatgtta

SEQ ID NO: 30266 - DNA, 26 bp, H. sapiens
acttcaaactatactacaaggctacc

SEQ ID NO: 30267 - DNA, 16 bp, H. sapiens
acttcaaactatactg

SEQ ID NO: 30268 - DNA, 16 bp, H. sapiens
acttcaaactgtacta

SEQ ID NO: 30269 - DNA, 16 bp, H. sapiens
acttcaaagaagaaaa

SEQ ID NO: 30270 - DNA, 16 bp, H. sapiens
acttcaaagctgtcag

SEQ ID NO: 30271 - DNA, 16 bp, H. sapiens
acttcaaatgggtgaa

SEQ ID NO: 30272 - DNA, 16 bp, H. sapiens
acttcaacaaatgtaa

SEQ ID NO: 30273 - DNA, 16 bp, H. sapiens
acttcaacactccatt

SEQ ID NO: 30274 - DNA, 16 bp, H. sapiens
acttcaacccaggaag

SEQ ID NO: 30275 - DNA, 16 bp, H. sapiens
acttcaacctccatct

SEQ ID NO: 30276 - DNA, 16 bp, H. sapiens
acttcaacctctgcct

SEQ ID NO: 30277 - DNA, 16 bp, H. sapiens
acttcaacctttgcct

SEQ ID NO: 30278 - DNA, 16 bp, H. sapiens
acttcaagaaaataca

SEQ ID NO: 30279 - DNA, 16 bp, H. sapiens
acttcaagaatgaagc

SEQ ID NO: 30280 - DNA, 16 bp, H. sapiens
acttcaagacaaaaac

SEQ ID NO: 30281 - DNA, 16 bp, H. sapiens
acttcaagacttactg

SEQ ID NO: 30282 - DNA, 16 bp, H. sapiens
acttcaaggaaaataa

SEQ ID NO: 30283 - DNA, 16 bp, H. sapiens
acttcaaggaactaga

SEQ ID NO: 30284 - DNA, 16 bp, H. sapiens
acttcaaggacagtta

SEQ ID NO: 30285 - DNA, 19 bp, H. sapiens
acttcaaggagaactacaa

SEQ ID NO: 30286 - DNA, 16 bp, H. sapiens
acttcaataatgaagc

SEQ ID NO: 30287 - DNA, 16 bp, H. sapiens
acttcaatgtatcttt

SEQ ID NO: 30288 - DNA, 16 bp, H. sapiens
acttcaatttcctcat

SEQ ID NO: 30289 - DNA, 16 bp, H. sapiens
acttcacaatgtatat

SEQ ID NO: 30290 - DNA, 16 bp, H. sapiens
acttcacagatattgt

SEQ ID NO: 30291 - DNA, 16 bp, H. sapiens
acttcaccaaagagga

SEQ ID NO: 30292 - DNA, 16 bp, H. sapiens
acttcaccagcatctg

SEQ ID NO: 30293 - DNA, 16 bp, H. sapiens
acttcacctctgtggt

SEQ ID NO: 30294 - DNA, 16 bp, H. sapiens
acttcactccatcctg

SEQ ID NO: 30295 - DNA, 16 bp, H. sapiens
acttcactgaagttgc

SEQ ID NO: 30296 - DNA, 16 bp, H. sapiens
acttcactgacagcac

SEQ ID NO: 30297 - DNA, 16 bp, H. sapiens
acttcacttaaaaaaa

SEQ ID NO: 30298 - DNA, 16 bp, H. sapiens
acttcagaaaaattaa

SEQ ID NO: 30299 - DNA, 16 bp, H. sapiens
acttcagaaaaatttt

SEQ ID NO: 30300 - DNA, 16 bp, H. sapiens
acttcagagagagcag

SEQ ID NO: 30301 - DNA, 16 bp, H. sapiens
acttcagcatcatgca

SEQ ID NO: 30302 - DNA, 16 bp, H. sapiens
acttcagcatgggcaa

SEQ ID NO: 30303 - DNA, 16 bp, H. sapiens
acttcagcctggacaa

SEQ ID NO: 30304 - DNA, 16 bp, H. sapiens
acttcagcttcctcat

SEQ ID NO: 30305 - DNA, 16 bp, H. sapiens
acttcaggaggccaag

SEQ ID NO: 30306 - DNA, 16 bp, H. sapiens
acttcaggtcaatatc

SEQ ID NO: 30307 - DNA, 16 bp, H. sapiens
acttcagtcaagccca

SEQ ID NO: 30308 - DNA, 16 bp, H. sapiens
acttcagtgaaggaag

SEQ ID NO: 30309 - DNA, 16 bp, H. sapiens
acttcagtggaagaag

SEQ ID NO: 30310 - DNA, 16 bp, H. sapiens
acttcagtggaggaaa

SEQ ID NO: 30311 - DNA, 16 bp, H. sapiens
acttcagtttcctcac

SEQ ID NO: 30312 - DNA, 16 bp, H. sapiens
acttcagtttcttcat

SEQ ID NO: 30313 - DNA, 16 bp, H. sapiens
acttcataaatatgta

SEQ ID NO: 30314 - DNA, 16 bp, H. sapiens
acttcatacaggagag

SEQ ID NO: 30315 - DNA, 16 bp, H. sapiens
acttcataggattgtt

SEQ ID NO: 30316 - DNA, 16 bp, H. sapiens
acttcatcaatattaa

SEQ ID NO: 30317 - DNA, 16 bp, H. sapiens
acttcatcctcttcat

SEQ ID NO: 30318 - DNA, 16 bp, H. sapiens
acttcatctcaaacaa

SEQ ID NO: 30319 - DNA, 16 bp, H. sapiens
acttcatctcttccta

SEQ ID NO: 30320 - DNA, 16 bp, H. sapiens
acttcatgccactgaa

SEQ ID NO: 30321 - DNA, 16 bp, H. sapiens
acttcattcctgttgt

SEQ ID NO: 30322 - DNA, 16 bp, H. sapiens
acttcattccttttca

SEQ ID NO: 30323 - DNA, 16 bp, H. sapiens
acttcattgctaaaaa

SEQ ID NO: 30324 - DNA, 16 bp, H. sapiens
acttcattgttgtttt

SEQ ID NO: 30325 - DNA, 16 bp, H. sapiens
acttcatttaaaataa

SEQ ID NO: 30326 - DNA, 16 bp, H. sapiens
acttcattttacctta

SEQ ID NO: 30327 - DNA, 16 bp, H. sapiens
acttccaaatttatat

SEQ ID NO: 30328 - DNA, 16 bp, H. sapiens
acttccaattttgtgg

SEQ ID NO: 30329 - DNA, 16 bp, H. sapiens
acttccacaaacctag

SEQ ID NO: 30330 - DNA, 16 bp, H. sapiens
acttccacagcacctc

SEQ ID NO: 30331 - DNA, 16 bp, H. sapiens
acttccacattttggg

SEQ ID NO: 30332 - DNA, 16 bp, H. sapiens
acttccaccccctggg

SEQ ID NO: 30333 - DNA, 16 bp, H. sapiens
acttccacctccacct

SEQ ID NO: 30334 - DNA, 16 bp, H. sapiens
acttccacctcccagt

SEQ ID NO: 30335 - DNA, 16 bp, H. sapiens
acttccacctcctgga

SEQ ID NO: 30336 - DNA, 16 bp, H. sapiens
acttccagaatgaagc

SEQ ID NO: 30337 - DNA, 16 bp, H. sapiens
acttccagactccaga

SEQ ID NO: 30338 - DNA, 16 bp, H. sapiens
acttccagcccccaga

SEQ ID NO: 30339 - DNA, 16 bp, H. sapiens
acttccagcctgggca

SEQ ID NO: 30340 - DNA, 16 bp, H. sapiens
acttccagtttccaga

SEQ ID NO: 30341 - DNA, 16 bp, H. sapiens
acttccagtttttgcc

SEQ ID NO: 30342 - DNA, 16 bp, H. sapiens
acttcccaaacccaga

SEQ ID NO: 30343 - DNA, 16 bp, H. sapiens
acttcccagactgggc

SEQ ID NO: 30344 - DNA, 16 bp, H. sapiens
acttcccaggctcaag

SEQ ID NO: 30345 - DNA, 16 bp, H. sapiens
acttcccaggctcagg

SEQ ID NO: 30346 - DNA, 16 bp, H. sapiens
acttcccagtctccaa

SEQ ID NO: 30347 - DNA, 16 bp, H. sapiens
acttcccagtttccag

SEQ ID NO: 30348 - DNA, 16 bp, H. sapiens
acttccccaacctggc

SEQ ID NO: 30349 - DNA, 16 bp, H. sapiens
acttcccctttgacct

SEQ ID NO: 30350 - DNA, 16 bp, H. sapiens
acttcccctttgcctt

SEQ ID NO: 30351 - DNA, 16 bp, H. sapiens
acttccctgggcctca

SEQ ID NO: 30352 - DNA, 16 bp, H. sapiens
acttccctgtgcctca

SEQ ID NO: 30353 - DNA, 16 bp, H. sapiens
acttcctaattatttt

SEQ ID NO: 30354 - DNA, 16 bp, H. sapiens
acttcctagagacttg

SEQ ID NO: 30355 - DNA, 16 bp, H. sapiens
acttcctcacctcctt

SEQ ID NO: 30356 - DNA, 16 bp, H. sapiens
acttcctcacttccta

SEQ ID NO: 30357 - DNA, 16 bp, H. sapiens
acttcctcataaagca

SEQ ID NO: 30358 - DNA, 16 bp, H. sapiens
acttcctcccctctga

SEQ ID NO: 30359 - DNA, 16 bp, H. sapiens
acttcctcccttctga

SEQ ID NO: 30360 - DNA, 16 bp, H. sapiens
acttcctcctcagcca

SEQ ID NO: 30361 - DNA, 16 bp, H. sapiens
acttcctcctcctggg

SEQ ID NO: 30362 - DNA, 16 bp, H. sapiens
acttcctcctctctga

SEQ ID NO: 30363 - DNA, 16 bp, H. sapiens
acttcctctctcccta

SEQ ID NO: 30364 - DNA, 16 bp, H. sapiens
acttcctctgggacat

SEQ ID NO: 30365 - DNA, 16 bp, H. sapiens
acttcctctgtgaagc

SEQ ID NO: 30366 - DNA, 16 bp, H. sapiens
acttcctctttgaccc

SEQ ID NO: 30367 - DNA, 16 bp, H. sapiens
acttcctcttttccaa

SEQ ID NO: 30368 - DNA, 16 bp, H. sapiens
acttcctcttttccag

SEQ ID NO: 30369 - DNA, 16 bp, H. sapiens
acttcctgatttctgc

SEQ ID NO: 30370 - DNA, 16 bp, H. sapiens
acttcctgatttgaaa

SEQ ID NO: 30371 - DNA, 16 bp, H. sapiens
acttcctgggtcaagt

SEQ ID NO: 30372 - DNA, 16 bp, H. sapiens
acttcctgggttcaag

SEQ ID NO: 30373 - DNA, 16 bp, H. sapiens
acttcctgggttcatg

SEQ ID NO: 30374 - DNA, 16 bp, H. sapiens
acttccttgtaaaatc

SEQ ID NO: 30375 - DNA, 16 bp, H. sapiens
acttcgggaggccagg

SEQ ID NO: 30376 - DNA, 16 bp, H. sapiens
acttcgggaggctgag

SEQ ID NO: 30377 - DNA, 16 bp, H. sapiens
acttctaaaaatatat

SEQ ID NO: 30378 - DNA, 16 bp, H. sapiens
acttctaaaattattt

SEQ ID NO: 30379 - DNA, 16 bp, H. sapiens
acttctaaataaagac

SEQ ID NO: 30380 - DNA, 16 bp, H. sapiens
acttctaatctacttt

SEQ ID NO: 30381 - DNA, 16 bp, H. sapiens
acttctacctgggcat

SEQ ID NO: 30382 - DNA, 16 bp, H. sapiens
acttctagcctccaga

SEQ ID NO: 30383 - DNA, 16 bp, H. sapiens
acttctatgagataaa

SEQ ID NO: 30384 - DNA, 16 bp, H. sapiens
acttctcagaagaaga

SEQ ID NO: 30385 - DNA, 16 bp, H. sapiens
acttctcagcctccca

SEQ ID NO: 30386 - DNA, 16 bp, H. sapiens
acttctcagggccttt

SEQ ID NO: 30387 - DNA, 16 bp, H. sapiens
acttctcagtctccag

SEQ ID NO: 30388 - DNA, 16 bp, H. sapiens
acttctcatttttaaa

SEQ ID NO: 30389 - DNA, 16 bp, H. sapiens
acttctcccttgctgt

SEQ ID NO: 30390 - DNA, 16 bp, H. sapiens
acttctccttcctgcc

SEQ ID NO: 30391 - DNA, 16 bp, H. sapiens
acttctctaaagaaga

SEQ ID NO: 30392 - DNA, 16 bp, H. sapiens
acttctctctagctgt

SEQ ID NO: 30393 - DNA, 16 bp, H. sapiens
acttctctctgagcct

SEQ ID NO: 30394 - DNA, 16 bp, H. sapiens
acttctctgacctcat

SEQ ID NO: 30395 - DNA, 16 bp, H. sapiens
acttctctgagcttca

SEQ ID NO: 30396 - DNA, 16 bp, H. sapiens
acttctctgtaccctt

SEQ ID NO: 30397 - DNA, 16 bp, H. sapiens
acttctcttctaacaa

SEQ ID NO: 30398 - DNA, 16 bp, H. sapiens
acttctcttctgactt

SEQ ID NO: 30399 - DNA, 16 bp, H. sapiens
acttctctttgcctca

SEQ ID NO: 30400 - DNA, 16 bp, H. sapiens
acttctgaggctagat

SEQ ID NO: 30401 - DNA, 16 bp, H. sapiens
acttctgcaagaatgg

SEQ ID NO: 30402 - DNA, 16 bp, H. sapiens
acttctgcaaggacat

SEQ ID NO: 30403 - DNA, 16 bp, H. sapiens
acttctgcacaacaaa

SEQ ID NO: 30404 - DNA, 16 bp, H. sapiens
acttctgcacagcaaa

SEQ ID NO: 30405 - DNA, 16 bp, H. sapiens
acttctgccccctggg

SEQ ID NO: 30406 - DNA, 16 bp, H. sapiens
acttctgctctttttt

SEQ ID NO: 30407 - DNA, 16 bp, H. sapiens
acttctgcttctggga

SEQ ID NO: 30408 - DNA, 16 bp, H. sapiens
acttctgcttttcttt

SEQ ID NO: 30409 - DNA, 16 bp, H. sapiens
acttctggaaatgaag

SEQ ID NO: 30410 - DNA, 16 bp, H. sapiens
acttctggagatggat

SEQ ID NO: 30411 - DNA, 16 bp, H. sapiens
acttctggcctccagc

SEQ ID NO: 30412 - DNA, 16 bp, H. sapiens
acttctggcctctgga

SEQ ID NO: 30413 - DNA, 16 bp, H. sapiens
acttctgggctgaagc

SEQ ID NO: 30414 - DNA, 16 bp, H. sapiens
acttcttaaaaatatt

SEQ ID NO: 30415 - DNA, 16 bp, H. sapiens
acttcttaaaagaaaa

SEQ ID NO: 30416 - DNA, 16 bp, H. sapiens
acttcttaaactcttc

SEQ ID NO: 30417 - DNA, 16 bp, H. sapiens
acttcttaaatattta

SEQ ID NO: 30418 - DNA, 16 bp, H. sapiens
acttcttcaagcatct

SEQ ID NO: 30419 - DNA, 16 bp, H. sapiens
acttcttcacagcaaa

SEQ ID NO: 30420 - DNA, 16 bp, H. sapiens
acttcttcctttttaa

SEQ ID NO: 30421 - DNA, 16 bp, H. sapiens
acttcttggaggcttt

SEQ ID NO: 30422 - DNA, 16 bp, H. sapiens
acttcttggaggtttt

SEQ ID NO: 30423 - DNA, 16 bp, H. sapiens
acttcttggagtcttt

SEQ ID NO: 30424 - DNA, 16 bp, H. sapiens
acttcttgtatctttt

SEQ ID NO: 30425 - DNA, 16 bp, H. sapiens
acttctttcacttagc

SEQ ID NO: 30426 - DNA, 16 bp, H. sapiens
acttctttctttctaa

SEQ ID NO: 30427 - DNA, 16 bp, H. sapiens
acttctttctttctga

SEQ ID NO: 30428 - DNA, 16 bp, H. sapiens
acttctttgaaaatat

SEQ ID NO: 30429 - DNA, 16 bp, H. sapiens
acttctttgggcctca

SEQ ID NO: 30430 - DNA, 16 bp, H. sapiens
acttgaaaaaaaaatc

SEQ ID NO: 30431 - DNA, 16 bp, H. sapiens
acttgaaaaaaataat

SEQ ID NO: 30432 - DNA, 16 bp, H. sapiens
acttgaaaaatgttgt

SEQ ID NO: 30433 - DNA, 16 bp, H. sapiens
acttgaaaacagaaaa

SEQ ID NO: 30434 - DNA, 16 bp, H. sapiens
acttgaaaataaattt

SEQ ID NO: 30435 - DNA, 16 bp, H. sapiens
acttgaaaatctagaa

SEQ ID NO: 30436 - DNA, 16 bp, H. sapiens
acttgaaagtaaaaat

SEQ ID NO: 30437 - DNA, 16 bp, H. sapiens
acttgaaagtcaaaat

SEQ ID NO: 30438 - DNA, 16 bp, H. sapiens
acttgaaatggatcat

SEQ ID NO: 30439 - DNA, 16 bp, H. sapiens
acttgaacattatgaa

SEQ ID NO: 30440 - DNA, 16 bp, H. sapiens
acttgaacatttagag

SEQ ID NO: 30441 - DNA, 17 bp, H. sapiens
acttgaaccagggaggt

SEQ ID NO: 30442 - DNA, 16 bp, H. sapiens
acttgaacccagctct

SEQ ID NO: 30443 - DNA, 18 bp, H. sapiens
acttgaacccaggagttc

SEQ ID NO: 30444 - DNA, 16 bp, H. sapiens
acttgaacccaggcag

SEQ ID NO: 30445 - DNA, 17 bp, H. sapiens
acttgaacctaggaggt

SEQ ID NO: 30446 - DNA, 16 bp, H. sapiens
acttgaacctgagaga

SEQ ID NO: 30447 - DNA, 16 bp, H. sapiens
acttgaactcaggtct

SEQ ID NO: 30448 - DNA, 17 bp, H. sapiens
acttgaactcctggcct

SEQ ID NO: 30449 - DNA, 16 bp, H. sapiens
acttgaagaacaagtg

SEQ ID NO: 30450 - DNA, 16 bp, H. sapiens
acttgaagaactccct

SEQ ID NO: 30451 - DNA, 16 bp, H. sapiens
acttgaagacaagtct

SEQ ID NO: 30452 - DNA, 16 bp, H. sapiens
acttgaaggaaaaaaa

SEQ ID NO: 30453 - DNA, 16 bp, H. sapiens
acttgaagtcaggcat

SEQ ID NO: 30454 - DNA, 16 bp, H. sapiens
acttgaattattttta

SEQ ID NO: 30455 - DNA, 16 bp, H. sapiens
acttgaattttttaaa

SEQ ID NO: 30456 - DNA, 16 bp, H. sapiens
acttgacaaatattta

SEQ ID NO: 30457 - DNA, 16 bp, H. sapiens
acttgacagaagcatt

SEQ ID NO: 30458 - DNA, 16 bp, H. sapiens
acttgaccaaggtcac

SEQ ID NO: 30459 - DNA, 16 bp, H. sapiens
acttgacctctctggg

SEQ ID NO: 30460 - DNA, 16 bp, H. sapiens
acttgacttctctgag

SEQ ID NO: 30461 - DNA, 16 bp, H. sapiens
acttgagaacaggagt

SEQ ID NO: 30462 - DNA, 16 bp, H. sapiens
acttgagccaagagtt

SEQ ID NO: 30463 - DNA, 16 bp, H. sapiens
acttgagcccaggagc

SEQ ID NO: 30464 - DNA, 16 bp, H. sapiens
acttgagccctgaagg

SEQ ID NO: 30465 - DNA, 16 bp, H. sapiens
acttgagctgggaggt

SEQ ID NO: 30466 - DNA, 17 bp, H. sapiens
acttgaggcaaggagtt

SEQ ID NO: 30467 - DNA, 16 bp, H. sapiens
acttgaggccaacagt

SEQ ID NO: 30468 - DNA, 16 bp, H. sapiens
acttgaggccaggaac

SEQ ID NO: 30469 - DNA, 16 bp, H. sapiens
acttgaggccaggagg

SEQ ID NO: 30470 - DNA, 16 bp, H. sapiens
acttgaggccaggtgc

SEQ ID NO: 30471 - DNA, 16 bp, H. sapiens
acttgataaagaatat

SEQ ID NO: 30472 - DNA, 16 bp, H. sapiens
acttgataaatatttg

SEQ ID NO: 30473 - DNA, 16 bp, H. sapiens
acttgataaatatttt

SEQ ID NO: 30474 - DNA, 16 bp, H. sapiens
acttgatattatttca

SEQ ID NO: 30475 - DNA, 16 bp, H. sapiens
acttgatattttttaa

SEQ ID NO: 30476 - DNA, 16 bp, H. sapiens
acttgatcccaggaat

SEQ ID NO: 30477 - DNA, 17 bp, H. sapiens
acttgatcttggtggat

SEQ ID NO: 30478 - DNA, 16 bp, H. sapiens
acttgattctgtactc

SEQ ID NO: 30479 - DNA, 16 bp, H. sapiens
acttgcaacctccacc

SEQ ID NO: 30480 - DNA, 16 bp, H. sapiens
acttgcagccaggagt

SEQ ID NO: 30481 - DNA, 16 bp, H. sapiens
acttgcaggtcacagg

SEQ ID NO: 30482 - DNA, 16 bp, H. sapiens
acttgcatggggcctg

SEQ ID NO: 30483 - DNA, 16 bp, H. sapiens
acttgccatcagagaa

SEQ ID NO: 30484 - DNA, 16 bp, H. sapiens
acttgcccaaagttac

SEQ ID NO: 30485 - DNA, 16 bp, H. sapiens
acttgcccaagatcac

SEQ ID NO: 30486 - DNA, 16 bp, H. sapiens
acttgcccaagctcac

SEQ ID NO: 30487 - DNA, 16 bp, H. sapiens
acttgcccaaggccac

SEQ ID NO: 30488 - DNA, 16 bp, H. sapiens
acttgcccacagccac

SEQ ID NO: 30489 - DNA, 16 bp, H. sapiens
acttgcccagggtcac

SEQ ID NO: 30490 - DNA, 16 bp, H. sapiens
acttgccccaagtcac

SEQ ID NO: 30491 - DNA, 16 bp, H. sapiens
acttgcccctccccca

SEQ ID NO: 30492 - DNA, 16 bp, H. sapiens
acttgcctaagatcat

SEQ ID NO: 30493 - DNA, 16 bp, H. sapiens
acttgcctgaggctgt

SEQ ID NO: 30494 - DNA, 16 bp, H. sapiens
acttgctcaaggtcac

SEQ ID NO: 30495 - DNA, 16 bp, H. sapiens
acttgctcaagttcac

SEQ ID NO: 30496 - DNA, 16 bp, H. sapiens
acttgctctgggggaa

SEQ ID NO: 30497 - DNA, 16 bp, H. sapiens
acttgctgcagcttct

SEQ ID NO: 30498 - DNA, 16 bp, H. sapiens
acttgctgctgctgct

SEQ ID NO: 30499 - DNA, 16 bp, H. sapiens
acttgctgtgtggcct

SEQ ID NO: 30500 - DNA, 32 bp, H. sapiens
acttgctttatgaatctgggtgctcctgtatt

SEQ ID NO: 30501 - DNA, 16 bp, H. sapiens
acttggaaaatggaaa

SEQ ID NO: 30502 - DNA, 16 bp, H. sapiens
acttggaaacaaccca

SEQ ID NO: 30503 - DNA, 16 bp, H. sapiens
acttggaaagctgaag

SEQ ID NO: 30504 - DNA, 16 bp, H. sapiens
acttggaaaggaacaa

SEQ ID NO: 30505 - DNA, 16 bp, H. sapiens
acttggaagaaaaaga

SEQ ID NO: 30506 - DNA, 16 bp, H. sapiens
acttggaagaaggcca

SEQ ID NO: 30507 - DNA, 16 bp, H. sapiens
acttggaagaggacca

SEQ ID NO: 30508 - DNA, 16 bp, H. sapiens
acttggaataatttta

SEQ ID NO: 30509 - DNA, 16 bp, H. sapiens
acttggacccaggagt

SEQ ID NO: 30510 - DNA, 16 bp, H. sapiens
acttggactggctctc

SEQ ID NO: 30511 - DNA, 16 bp, H. sapiens
acttggagaaaaaaaa

SEQ ID NO: 30512 - DNA, 16 bp, H. sapiens
acttggagccaggagt

SEQ ID NO: 30513 - DNA, 16 bp, H. sapiens
acttggaggtgtcctg

SEQ ID NO: 30514 - DNA, 16 bp, H. sapiens
acttggattgattcca

SEQ ID NO: 30515 - DNA, 16 bp, H. sapiens
acttggattttaaaat

SEQ ID NO: 30516 - DNA, 16 bp, H. sapiens
acttggccaaagtcac

SEQ ID NO: 30517 - DNA, 16 bp, H. sapiens
acttggccaaggtcac

SEQ ID NO: 30518 - DNA, 16 bp, H. sapiens
acttggcccctgccac

SEQ ID NO: 30519 - DNA, 16 bp, H. sapiens
acttggcctccaaaag

SEQ ID NO: 30520 - DNA, 16 bp, H. sapiens
acttggcctcccgaag

SEQ ID NO: 30521 - DNA, 16 bp, H. sapiens
acttggctctctggct

SEQ ID NO: 30522 - DNA, 16 bp, H. sapiens
acttgggaagcacaag

SEQ ID NO: 30523 - DNA, 16 bp, H. sapiens
acttgggaagctaagg

SEQ ID NO: 30524 - DNA, 16 bp, H. sapiens
acttgggaaggtgagg

SEQ ID NO: 30525 - DNA, 16 bp, H. sapiens
acttgggaggctggga

SEQ ID NO: 30526 - DNA, 16 bp, H. sapiens
acttgggaggtggaag

SEQ ID NO: 30527 - DNA, 16 bp, H. sapiens
acttggggaaaaaaaa

SEQ ID NO: 30528 - DNA, 16 bp, H. sapiens
acttggggaggccgag

SEQ ID NO: 30529 - DNA, 16 bp, H. sapiens
acttggtagcttaaaa

SEQ ID NO: 30530 - DNA, 16 bp, H. sapiens
acttggtcatggtgga

SEQ ID NO: 30531 - DNA, 16 bp, H. sapiens
acttggtggctcacac

SEQ ID NO: 30532 - DNA, 16 bp, H. sapiens
acttggtgtccttttt

SEQ ID NO: 30533 - DNA, 17 bp, H. sapiens
acttggtttatgaatct

SEQ ID NO: 30534 - DNA, 16 bp, H. sapiens
acttgtaattccagca

SEQ ID NO: 30535 - DNA, 16 bp, H. sapiens
acttgtacattgaaaa

SEQ ID NO: 30536 - DNA, 16 bp, H. sapiens
acttgtactccctaaa

SEQ ID NO: 30537 - DNA, 16 bp, H. sapiens
acttgtagctcccata

SEQ ID NO: 30538 - DNA, 16 bp, H. sapiens
acttgtagtcttttat

SEQ ID NO: 30539 - DNA, 16 bp, H. sapiens
acttgtatattgaaaa

SEQ ID NO: 30540 - DNA, 16 bp, H. sapiens
acttgtatgccttctt

SEQ ID NO: 30541 - DNA, 16 bp, H. sapiens
acttgtattattattt

SEQ ID NO: 30542 - DNA, 16 bp, H. sapiens
acttgtccaaggtcaa

SEQ ID NO: 30543 - DNA, 16 bp, H. sapiens
acttgtccaaggtcac

SEQ ID NO: 30544 - DNA, 16 bp, H. sapiens
acttgtccaaggtctc

SEQ ID NO: 30545 - DNA, 16 bp, H. sapiens
acttgtctaaagtcac

SEQ ID NO: 30546 - DNA, 16 bp, H. sapiens
acttgtctaaggtcac

SEQ ID NO: 30547 - DNA, 16 bp, H. sapiens
acttgtctcttaaaaa

SEQ ID NO: 30548 - DNA, 16 bp, H. sapiens
acttgtctttttgtga

SEQ ID NO: 30549 - DNA, 16 bp, H. sapiens
acttgtgaagttcaca

SEQ ID NO: 30550 - DNA, 16 bp, H. sapiens
acttgtgaatatatta

SEQ ID NO: 30551 - DNA, 16 bp, H. sapiens
acttgtgcttttggtg

SEQ ID NO: 30552 - DNA, 16 bp, H. sapiens
acttgtggaactttga

SEQ ID NO: 30553 - DNA, 16 bp, H. sapiens
acttgtgtatgttaaa

SEQ ID NO: 30554 - DNA, 16 bp, H. sapiens
acttgtgtccttataa

SEQ ID NO: 30555 - DNA, 16 bp, H. sapiens
acttgtgtcgtggggg

SEQ ID NO: 30556 - DNA, 16 bp, H. sapiens
acttgttaatgtagtt

SEQ ID NO: 30557 - DNA, 16 bp, H. sapiens
acttgttagaaatgca

SEQ ID NO: 30558 - DNA, 16 bp, H. sapiens
acttgttatctcttgt

SEQ ID NO: 30559 - DNA, 16 bp, H. sapiens
acttgttattggccta

SEQ ID NO: 30560 - DNA, 16 bp, H. sapiens
acttgttggtctgtgt

SEQ ID NO: 30561 - DNA, 16 bp, H. sapiens
acttgtttaataaata

SEQ ID NO: 30562 - DNA, 16 bp, H. sapiens
acttgtttgtataatg

SEQ ID NO: 30563 - DNA, 16 bp, H. sapiens
acttgtttgtgtgtgt

SEQ ID NO: 30564 - DNA, 16 bp, H. sapiens
acttgttttatgaatt

SEQ ID NO: 30565 - DNA, 16 bp, H. sapiens
acttgttttcacttta

SEQ ID NO: 30566 - DNA, 16 bp, H. sapiens
acttgttttgtgttct

SEQ ID NO: 30567 - DNA, 16 bp, H. sapiens
acttgtttttataaat

SEQ ID NO: 30568 - DNA, 16 bp, H. sapiens
acttgttttttaaaaa

SEQ ID NO: 30569 - DNA, 16 bp, H. sapiens
actttaaaaaaatgta

SEQ ID NO: 30570 - DNA, 16 bp, H. sapiens
actttaaaaaaattct

SEQ ID NO: 30571 - DNA, 16 bp, H. sapiens
actttaaaaaagaaga

SEQ ID NO: 30572 - DNA, 16 bp, H. sapiens
actttaaaaaagtata

SEQ ID NO: 30573 - DNA, 16 bp, H. sapiens
actttaaaaagaataa

SEQ ID NO: 30574 - DNA, 16 bp, H. sapiens
actttaaaaagattaa

SEQ ID NO: 30575 - DNA, 16 bp, H. sapiens
actttaaaaagtgaaa

SEQ ID NO: 30576 - DNA, 16 bp, H. sapiens
actttaaaaatacaga

SEQ ID NO: 30577 - DNA, 16 bp, H. sapiens
actttaaaaatcagtt

SEQ ID NO: 30578 - DNA, 16 bp, H. sapiens
actttaaaaatctgtt

SEQ ID NO: 30579 - DNA, 16 bp, H. sapiens
actttaaaaatctttg

SEQ ID NO: 30580 - DNA, 16 bp, H. sapiens
actttaaaaatctttt

SEQ ID NO: 30581 - DNA, 16 bp, H. sapiens
actttaaaacaatttt

SEQ ID NO: 30582 - DNA, 16 bp, H. sapiens
actttaaaacttttaa

SEQ ID NO: 30583 - DNA, 16 bp, H. sapiens
actttaaaagaaaata

SEQ ID NO: 30584 - DNA, 16 bp, H. sapiens
actttaaaagagtgaa

SEQ ID NO: 30585 - DNA, 16 bp, H. sapiens
actttaaaaggattaa

SEQ ID NO: 30586 - DNA, 16 bp, H. sapiens
actttaaaagttttaa

SEQ ID NO: 30587 - DNA, 16 bp, H. sapiens
actttaaaataacttt

SEQ ID NO: 30588 - DNA, 16 bp, H. sapiens
actttaaaatcatttt

SEQ ID NO: 30589 - DNA, 16 bp, H. sapiens
actttaaaatgtcaaa

SEQ ID NO: 30590 - DNA, 16 bp, H. sapiens
actttaaaattttgtt

SEQ ID NO: 30591 - DNA, 24 bp, H. sapiens
actttaaaccaacaaagatcagaa

SEQ ID NO: 30592 - DNA, 16 bp, H. sapiens
actttaaagtcgtttt

SEQ ID NO: 30593 - DNA, 16 bp, H. sapiens
actttaaagttaatat

SEQ ID NO: 30594 - DNA, 16 bp, H. sapiens
actttaaatacaaaga

SEQ ID NO: 30595 - DNA, 16 bp, H. sapiens
actttaaatatttatc

SEQ ID NO: 30596 - DNA, 16 bp, H. sapiens
actttaaattcttttg

SEQ ID NO: 30597 - DNA, 16 bp, H. sapiens
actttaaattgttttt

SEQ ID NO: 30598 - DNA, 16 bp, H. sapiens
actttaaattttttga

SEQ ID NO: 30599 - DNA, 16 bp, H. sapiens
actttaacactccact

SEQ ID NO: 30600 - DNA, 16 bp, H. sapiens
actttaagaaaaagaa

SEQ ID NO: 30601 - DNA, 16 bp, H. sapiens
actttaagcaaaatga

SEQ ID NO: 30602 - DNA, 16 bp, H. sapiens
actttaagctctgggg

SEQ ID NO: 30603 - DNA, 16 bp, H. sapiens
actttaagttctgtgg

SEQ ID NO: 30604 - DNA, 17 bp, H. sapiens
actttaagtttagggta

SEQ ID NO: 30605 - DNA, 16 bp, H. sapiens
actttacaaaaatatt

SEQ ID NO: 30606 - DNA, 16 bp, H. sapiens
actttacaaaagaaga

SEQ ID NO: 30607 - DNA, 16 bp, H. sapiens
actttacaaaatattt

SEQ ID NO: 30608 - DNA, 16 bp, H. sapiens
actttacacaataaaa

SEQ ID NO: 30609 - DNA, 16 bp, H. sapiens
actttacagatgaggg

SEQ ID NO: 30610 - DNA, 16 bp, H. sapiens
actttacagatgagta

SEQ ID NO: 30611 - DNA, 16 bp, H. sapiens
actttacagtggagaa

SEQ ID NO: 30612 - DNA, 16 bp, H. sapiens
actttacatgtatttt

SEQ ID NO: 30613 - DNA, 16 bp, H. sapiens
actttactgtccatat

SEQ ID NO: 30614 - DNA, 16 bp, H. sapiens
actttacttctgtaaa

SEQ ID NO: 30615 - DNA, 16 bp, H. sapiens
actttacttttaaaat

SEQ ID NO: 30616 - DNA, 16 bp, H. sapiens
actttagaaaacagtc

SEQ ID NO: 30617 - DNA, 16 bp, H. sapiens
actttagaacattttt

SEQ ID NO: 30618 - DNA, 16 bp, H. sapiens
actttagaattgtttt

SEQ ID NO: 30619 - DNA, 16 bp, H. sapiens
actttagattttattt

SEQ ID NO: 30620 - DNA, 16 bp, H. sapiens
actttagcctgcagtg

SEQ ID NO: 30621 - DNA, 16 bp, H. sapiens
actttagtttttaaaa

SEQ ID NO: 30622 - DNA, 16 bp, H. sapiens
actttataaatactgt

SEQ ID NO: 30623 - DNA, 16 bp, H. sapiens
actttataatttacaa

SEQ ID NO: 30624 - DNA, 16 bp, H. sapiens
actttatatacattat

SEQ ID NO: 30625 - DNA, 16 bp, H. sapiens
actttatatgcattat

SEQ ID NO: 30626 - DNA, 16 bp, H. sapiens
actttatgaatatttt

SEQ ID NO: 30627 - DNA, 16 bp, H. sapiens
actttatgttaaaaaa

SEQ ID NO: 30628 - DNA, 16 bp, H. sapiens
actttattaaggtata

SEQ ID NO: 30629 - DNA, 16 bp, H. sapiens
actttattcatatttc

SEQ ID NO: 30630 - DNA, 16 bp, H. sapiens
actttattgacaaaaa

SEQ ID NO: 30631 - DNA, 16 bp, H. sapiens
actttatttacaaaat

SEQ ID NO: 30632 - DNA, 16 bp, H. sapiens
actttatttagatttc

SEQ ID NO: 30633 - DNA, 16 bp, H. sapiens
actttatttccattat

SEQ ID NO: 30634 - DNA, 16 bp, H. sapiens
actttatttctgttat

SEQ ID NO: 30635 - DNA, 16 bp, H. sapiens
actttattttatgaaa

SEQ ID NO: 30636 - DNA, 16 bp, H. sapiens
actttatttttaacaa

SEQ ID NO: 30637 - DNA, 16 bp, H. sapiens
actttatttttactgt

SEQ ID NO: 30638 - DNA, 16 bp, H. sapiens
actttatttttttaga

SEQ ID NO: 30639 - DNA, 16 bp, H. sapiens
actttatttttttgag

SEQ ID NO: 30640 - DNA, 16 bp, H. sapiens
actttcaaaatattct

SEQ ID NO: 30641 - DNA, 16 bp, H. sapiens
actttcaaacagccag

SEQ ID NO: 30642 - DNA, 16 bp, H. sapiens
actttcaaccaacaaa

SEQ ID NO: 30643 - DNA, 16 bp, H. sapiens
actttcaagattttct

SEQ ID NO: 30644 - DNA, 16 bp, H. sapiens
actttcagacagagaa

SEQ ID NO: 30645 - DNA, 16 bp, H. sapiens
actttcagagaccaag

SEQ ID NO: 30646 - DNA, 16 bp, H. sapiens
actttcagagcactga

SEQ ID NO: 30647 - DNA, 16 bp, H. sapiens
actttcagatttctct

SEQ ID NO: 30648 - DNA, 16 bp, H. sapiens
actttcagcctcacct

SEQ ID NO: 30649 - DNA, 16 bp, H. sapiens
actttcagtacagtat

SEQ ID NO: 30650 - DNA, 16 bp, H. sapiens
actttcagtgctaaaa

SEQ ID NO: 30651 - DNA, 16 bp, H. sapiens
actttcatattttaaa

SEQ ID NO: 30652 - DNA, 16 bp, H. sapiens
actttcatgtattttt

SEQ ID NO: 30653 - DNA, 16 bp, H. sapiens
actttcatgtgagaaa

SEQ ID NO: 30654 - DNA, 16 bp, H. sapiens
actttcattttaaaag

SEQ ID NO: 30655 - DNA, 16 bp, H. sapiens
actttcatttttaaaa

SEQ ID NO: 30656 - DNA, 16 bp, H. sapiens
actttccaacactccc

SEQ ID NO: 30657 - DNA, 16 bp, H. sapiens
actttccaacctccag

SEQ ID NO: 30658 - DNA, 16 bp, H. sapiens
actttccaccttcctg

SEQ ID NO: 30659 - DNA, 16 bp, H. sapiens
actttccactgtgaga

SEQ ID NO: 30660 - DNA, 16 bp, H. sapiens
actttcctatatacca

SEQ ID NO: 30661 - DNA, 16 bp, H. sapiens
actttcctctcaattt

SEQ ID NO: 30662 - DNA, 16 bp, H. sapiens
actttcctgcctcagc

SEQ ID NO: 30663 - DNA, 16 bp, H. sapiens
actttcctttgattca

SEQ ID NO: 30664 - DNA, 17 bp, H. sapiens
actttcggaggccaagg

SEQ ID NO: 30665 - DNA, 16 bp, H. sapiens
actttctaatggggtt

SEQ ID NO: 30666 - DNA, 16 bp, H. sapiens
actttctcaaggtcac

SEQ ID NO: 30667 - DNA, 16 bp, H. sapiens
actttctcccaaagaa

SEQ ID NO: 30668 - DNA, 16 bp, H. sapiens
actttctcccactctg

SEQ ID NO: 30669 - DNA, 16 bp, H. sapiens
actttctcttctccag

SEQ ID NO: 30670 - DNA, 16 bp, H. sapiens
actttctcttggtttc

SEQ ID NO: 30671 - DNA, 16 bp, H. sapiens
actttctgagcctcag

SEQ ID NO: 30672 - DNA, 16 bp, H. sapiens
actttctgaggaactg

SEQ ID NO: 30673 - DNA, 16 bp, H. sapiens
actttctgatttcaaa

SEQ ID NO: 30674 - DNA, 16 bp, H. sapiens
actttctggactcaag

SEQ ID NO: 30675 - DNA, 16 bp, H. sapiens
actttctgtgtgccag

SEQ ID NO: 30676 - DNA, 16 bp, H. sapiens
actttctgtttccatg

SEQ ID NO: 30677 - DNA, 16 bp, H. sapiens
actttctgtttctaag

SEQ ID NO: 30678 - DNA, 16 bp, H. sapiens
actttctgttttcaaa

SEQ ID NO: 30679 - DNA, 16 bp, H. sapiens
actttcttaaaaataa

SEQ ID NO: 30680 - DNA, 16 bp, H. sapiens
actttcttaaagaaaa

SEQ ID NO: 30681 - DNA, 16 bp, H. sapiens
actttcttcaaagctg

SEQ ID NO: 30682 - DNA, 16 bp, H. sapiens
actttcttcacagaaa

SEQ ID NO: 30683 - DNA, 16 bp, H. sapiens
actttcttctcaattt

SEQ ID NO: 30684 - DNA, 16 bp, H. sapiens
actttctttaaaaaat

SEQ ID NO: 30685 - DNA, 16 bp, H. sapiens
actttctttatccttg

SEQ ID NO: 30686 - DNA, 16 bp, H. sapiens
actttctttggttggt

SEQ ID NO: 30687 - DNA, 16 bp, H. sapiens
actttcttttgtaaat

SEQ ID NO: 30688 - DNA, 16 bp, H. sapiens
actttgaaaaaatttt

SEQ ID NO: 30689 - DNA, 16 bp, H. sapiens
actttgaaaaacaatt

SEQ ID NO: 30690 - DNA, 16 bp, H. sapiens
actttgaaaacagttt

SEQ ID NO: 30691 - DNA, 16 bp, H. sapiens
actttgaaaaccactg

SEQ ID NO: 30692 - DNA, 16 bp, H. sapiens
actttgaaaatatata

SEQ ID NO: 30693 - DNA, 16 bp, H. sapiens
actttgaaaatgaaaa

SEQ ID NO: 30694 - DNA, 16 bp, H. sapiens
actttgaaaatttttt

SEQ ID NO: 30695 - DNA, 16 bp, H. sapiens
actttgaatgtattat

SEQ ID NO: 30696 - DNA, 16 bp, H. sapiens
actttgaccaaaatgc

SEQ ID NO: 30697 - DNA, 16 bp, H. sapiens
actttgacccaacctg

SEQ ID NO: 30698 - DNA, 16 bp, H. sapiens
actttgactatgcctt

SEQ ID NO: 30699 - DNA, 16 bp, H. sapiens
actttgagaagccaaa

SEQ ID NO: 30700 - DNA, 16 bp, H. sapiens
actttgagaatcacta

SEQ ID NO: 30701 - DNA, 16 bp, H. sapiens
actttgagaggacaag

SEQ ID NO: 30702 - DNA, 16 bp, H. sapiens
actttgagcctgtggg

SEQ ID NO: 30703 - DNA, 16 bp, H. sapiens
actttgagtagcaaga

SEQ ID NO: 30704 - DNA, 16 bp, H. sapiens
actttgataaaattca

SEQ ID NO: 30705 - DNA, 16 bp, H. sapiens
actttgattaaataaa

SEQ ID NO: 30706 - DNA, 16 bp, H. sapiens
actttgattttaaaaa

SEQ ID NO: 30707 - DNA, 16 bp, H. sapiens
actttgatttttaaaa

SEQ ID NO: 30708 - DNA, 16 bp, H. sapiens
actttgatttttttaa

SEQ ID NO: 30709 - DNA, 16 bp, H. sapiens
actttgcaaacattta

SEQ ID NO: 30710 - DNA, 16 bp, H. sapiens
actttgcagatgaaaa

SEQ ID NO: 30711 - DNA, 16 bp, H. sapiens
actttgcagatgtggt

SEQ ID NO: 30712 - DNA, 16 bp, H. sapiens
actttgcctgtaacct

SEQ ID NO: 30713 - DNA, 16 bp, H. sapiens
actttgcctttctttt

SEQ ID NO: 30714 - DNA, 16 bp, H. sapiens
actttgcttttaattt

SEQ ID NO: 30715 - DNA, 16 bp, H. sapiens
actttggaaaacagtc

SEQ ID NO: 30716 - DNA, 16 bp, H. sapiens
actttggaaaagaatg

SEQ ID NO: 30717 - DNA, 16 bp, H. sapiens
actttggaaaatactt

SEQ ID NO: 30718 - DNA, 16 bp, H. sapiens
actttggaaaatattt

SEQ ID NO: 30719 - DNA, 16 bp, H. sapiens
actttggaaacaaaag

SEQ ID NO: 30720 - DNA, 16 bp, H. sapiens
actttggaaagaaaaa

SEQ ID NO: 30721 - DNA, 16 bp, H. sapiens
actttggaaagccaag

SEQ ID NO: 30722 - DNA, 16 bp, H. sapiens
actttggaagacagag

SEQ ID NO: 30723 - DNA, 16 bp, H. sapiens
actttggagattctaa

SEQ ID NO: 30724 - DNA, 16 bp, H. sapiens
actttggagattgtgc

SEQ ID NO: 30725 - DNA, 16 bp, H. sapiens
actttggagggtgggt

SEQ ID NO: 30726 - DNA, 16 bp, H. sapiens
actttggcttttgttg

SEQ ID NO: 30727 - DNA, 16 bp, H. sapiens
actttgggaaatgctg

SEQ ID NO: 30728 - DNA, 16 bp, H. sapiens
actttgggaagctggg

SEQ ID NO: 30729 - DNA, 16 bp, H. sapiens
actttgggaagttgag

SEQ ID NO: 30730 - DNA, 16 bp, H. sapiens
actttgggagactgaa

SEQ ID NO: 30731 - DNA, 16 bp, H. sapiens
actttgggaggacgaa

SEQ ID NO: 30732 - DNA, 16 bp, H. sapiens
actttgggaggccgaa

SEQ ID NO: 30733 - DNA, 18 bp, H. sapiens
actttgggaggccgagga

SEQ ID NO: 30734 - DNA, 18 bp, H. sapiens
actttgggaggccgaggt

SEQ ID NO: 30735 - DNA, 19 bp, H. sapiens
actttgggaggctgaagcg

SEQ ID NO: 30736 - DNA, 16 bp, H. sapiens
actttgggcaagtcac

SEQ ID NO: 30737 - DNA, 16 bp, H. sapiens
actttgggcactgaca

SEQ ID NO: 30738 - DNA, 16 bp, H. sapiens
actttgggctcctcct

SEQ ID NO: 30739 - DNA, 16 bp, H. sapiens
actttggggactgggg

SEQ ID NO: 30740 - DNA, 16 bp, H. sapiens
actttggggacttgag

SEQ ID NO: 30741 - DNA, 16 bp, H. sapiens
actttgggggaaaaaa

SEQ ID NO: 30742 - DNA, 16 bp, H. sapiens
actttgggtaataatg

SEQ ID NO: 30743 - DNA, 16 bp, H. sapiens
actttggtctttgatg

SEQ ID NO: 30744 - DNA, 16 bp, H. sapiens
actttggtggaatggt

SEQ ID NO: 30745 - DNA, 16 bp, H. sapiens
actttggttttgattt

SEQ ID NO: 30746 - DNA, 16 bp, H. sapiens
actttgtaaaaataaa

SEQ ID NO: 30747 - DNA, 16 bp, H. sapiens
actttgtaattttgag

SEQ ID NO: 30748 - DNA, 16 bp, H. sapiens
actttgtataatttta

SEQ ID NO: 30749 - DNA, 16 bp, H. sapiens
actttgtatcaaaaaa

SEQ ID NO: 30750 - DNA, 16 bp, H. sapiens
actttgtatcttgcaa

SEQ ID NO: 30751 - DNA, 16 bp, H. sapiens
actttgtatctttcaa

SEQ ID NO: 30752 - DNA, 16 bp, H. sapiens
actttgtatttatata

SEQ ID NO: 30753 - DNA, 16 bp, H. sapiens
actttgtattttaaaa

SEQ ID NO: 30754 - DNA, 17 bp, H. sapiens
actttgtatttttagta

SEQ ID NO: 30755 - DNA, 16 bp, H. sapiens
actttgtcaaatatca

SEQ ID NO: 30756 - DNA, 16 bp, H. sapiens
actttgtcaccaccag

SEQ ID NO: 30757 - DNA, 16 bp, H. sapiens
actttgtctcaaaaaa

SEQ ID NO: 30758 - DNA, 16 bp, H. sapiens
actttgtgaagctgag

SEQ ID NO: 30759 - DNA, 16 bp, H. sapiens
actttgttaattgttt

SEQ ID NO: 30760 - DNA, 16 bp, H. sapiens
actttgttattgtgaa

SEQ ID NO: 30761 - DNA, 16 bp, H. sapiens
actttgttcttttcaa

SEQ ID NO: 30762 - DNA, 16 bp, H. sapiens
actttgtttatccatt

SEQ ID NO: 30763 - DNA, 16 bp, H. sapiens
actttgtttcatttaa

SEQ ID NO: 30764 - DNA, 16 bp, H. sapiens
actttgtttctcccaa

SEQ ID NO: 30765 - DNA, 16 bp, H. sapiens
actttgttttaaaata

SEQ ID NO: 30766 - DNA, 16 bp, H. sapiens
acttttaaaaaaccag

SEQ ID NO: 30767 - DNA, 16 bp, H. sapiens
acttttaaaaactata

SEQ ID NO: 30768 - DNA, 16 bp, H. sapiens
acttttaaaaagattt

SEQ ID NO: 30769 - DNA, 16 bp, H. sapiens
acttttaaaaatatgt

SEQ ID NO: 30770 - DNA, 16 bp, H. sapiens
acttttaaaaatgtaa

SEQ ID NO: 30771 - DNA, 16 bp, H. sapiens
acttttaaaacatgta

SEQ ID NO: 30772 - DNA, 16 bp, H. sapiens
acttttaaaagagaaa

SEQ ID NO: 30773 - DNA, 16 bp, H. sapiens
acttttaaaagatttt

SEQ ID NO: 30774 - DNA, 16 bp, H. sapiens
acttttaaaagctttt

SEQ ID NO: 30775 - DNA, 16 bp, H. sapiens
acttttaaaataaact

SEQ ID NO: 30776 - DNA, 16 bp, H. sapiens
acttttaaaataaatg

SEQ ID NO: 30777 - DNA, 16 bp, H. sapiens
acttttaaaatgtatt

SEQ ID NO: 30778 - DNA, 16 bp, H. sapiens
acttttaaaattaagt

SEQ ID NO: 30779 - DNA, 16 bp, H. sapiens
acttttaaaatttgta

SEQ ID NO: 30780 - DNA, 16 bp, H. sapiens
acttttaaacaactag

SEQ ID NO: 30781 - DNA, 16 bp, H. sapiens
acttttaaagaaaata

SEQ ID NO: 30782 - DNA, 16 bp, H. sapiens
acttttaaataaagaa

SEQ ID NO: 30783 - DNA, 16 bp, H. sapiens
acttttaaattataca

SEQ ID NO: 30784 - DNA, 16 bp, H. sapiens
acttttaacaccccac

SEQ ID NO: 30785 - DNA, 16 bp, H. sapiens
acttttaataatggat

SEQ ID NO: 30786 - DNA, 16 bp, H. sapiens
acttttaatagcaaaa

SEQ ID NO: 30787 - DNA, 16 bp, H. sapiens
acttttaatttaaatg

SEQ ID NO: 30788 - DNA, 16 bp, H. sapiens
acttttaattttggaa

SEQ ID NO: 30789 - DNA, 16 bp, H. sapiens
acttttacattgttgg

SEQ ID NO: 30790 - DNA, 16 bp, H. sapiens
acttttacccttttgc

SEQ ID NO: 30791 - DNA, 16 bp, H. sapiens
acttttagaaaatatt

SEQ ID NO: 30792 - DNA, 16 bp, H. sapiens
acttttataatgaaaa

SEQ ID NO: 30793 - DNA, 16 bp, H. sapiens
acttttatatttcact

SEQ ID NO: 30794 - DNA, 16 bp, H. sapiens
acttttatcctcattt

SEQ ID NO: 30795 - DNA, 16 bp, H. sapiens
acttttatctgaggaa

SEQ ID NO: 30796 - DNA, 16 bp, H. sapiens
acttttatgtaacaaa

SEQ ID NO: 30797 - DNA, 16 bp, H. sapiens
acttttatgttataaa

SEQ ID NO: 30798 - DNA, 16 bp, H. sapiens
acttttattatttcca

SEQ ID NO: 30799 - DNA, 16 bp, H. sapiens
acttttattcaaaata

SEQ ID NO: 30800 - DNA, 16 bp, H. sapiens
acttttatttgaaata

SEQ ID NO: 30801 - DNA, 16 bp, H. sapiens
acttttattttaaaag

SEQ ID NO: 30802 - DNA, 16 bp, H. sapiens
acttttattttaagtt

SEQ ID NO: 30803 - DNA, 16 bp, H. sapiens
acttttattttctgga

SEQ ID NO: 30804 - DNA, 16 bp, H. sapiens
acttttcaaaaataca

SEQ ID NO: 30805 - DNA, 16 bp, H. sapiens
acttttcaaagaaaat

SEQ ID NO: 30806 - DNA, 16 bp, H. sapiens
acttttcaaagggaat

SEQ ID NO: 30807 - DNA, 16 bp, H. sapiens
acttttcagatgagga

SEQ ID NO: 30808 - DNA, 16 bp, H. sapiens
acttttcatgtttctt

SEQ ID NO: 30809 - DNA, 16 bp, H. sapiens
acttttcccttaaaaa

SEQ ID NO: 30810 - DNA, 16 bp, H. sapiens
acttttctaaattaaa

SEQ ID NO: 30811 - DNA, 16 bp, H. sapiens
acttttctacttttag

SEQ ID NO: 30812 - DNA, 16 bp, H. sapiens
acttttctagattcca

SEQ ID NO: 30813 - DNA, 16 bp, H. sapiens
acttttctatttttag

SEQ ID NO: 30814 - DNA, 16 bp, H. sapiens
acttttctctctggct

SEQ ID NO: 30815 - DNA, 16 bp, H. sapiens
acttttctctgcttct

SEQ ID NO: 30816 - DNA, 16 bp, H. sapiens
acttttctcttttaaa

SEQ ID NO: 30817 - DNA, 16 bp, H. sapiens
acttttctgacaaaat

SEQ ID NO: 30818 - DNA, 16 bp, H. sapiens
acttttctgatttctt

SEQ ID NO: 30819 - DNA, 16 bp, H. sapiens
acttttctgggcctca

SEQ ID NO: 30820 - DNA, 16 bp, H. sapiens
acttttctgtaagttt

SEQ ID NO: 30821 - DNA, 16 bp, H. sapiens
acttttctttaataaa

SEQ ID NO: 30822 - DNA, 16 bp, H. sapiens
acttttgaaaacaaaa

SEQ ID NO: 30823 - DNA, 16 bp, H. sapiens
acttttgaaaattgtt

SEQ ID NO: 30824 - DNA, 16 bp, H. sapiens
acttttgaaataaaat

SEQ ID NO: 30825 - DNA, 16 bp, H. sapiens
acttttgaaatataaa

SEQ ID NO: 30826 - DNA, 16 bp, H. sapiens
acttttgaagaataat

SEQ ID NO: 30827 - DNA, 16 bp, H. sapiens
acttttgaagtttttt

SEQ ID NO: 30828 - DNA, 16 bp, H. sapiens
acttttgaataaataa

SEQ ID NO: 30829 - DNA, 16 bp, H. sapiens
acttttgaatggggtt

SEQ ID NO: 30830 - DNA, 16 bp, H. sapiens
acttttgataaaattc

SEQ ID NO: 30831 - DNA, 16 bp, H. sapiens
acttttgattcagcag

SEQ ID NO: 30832 - DNA, 16 bp, H. sapiens
acttttgcatgttttt

SEQ ID NO: 30833 - DNA, 16 bp, H. sapiens
acttttgctccaagaa

SEQ ID NO: 30834 - DNA, 16 bp, H. sapiens
acttttggaatttttt

SEQ ID NO: 30835 - DNA, 16 bp, H. sapiens
acttttggaggcccag

SEQ ID NO: 30836 - DNA, 16 bp, H. sapiens
acttttggctgggcat

SEQ ID NO: 30837 - DNA, 18 bp, H. sapiens
acttttggggagactcac

SEQ ID NO: 30838 - DNA, 16 bp, H. sapiens
acttttgggtaaataa

SEQ ID NO: 30839 - DNA, 16 bp, H. sapiens
acttttgtaaacagaa

SEQ ID NO: 30840 - DNA, 16 bp, H. sapiens
acttttgtaattttag

SEQ ID NO: 30841 - DNA, 16 bp, H. sapiens
acttttgtatttttga

SEQ ID NO: 30842 - DNA, 16 bp, H. sapiens
acttttgtcagatgca

SEQ ID NO: 30843 - DNA, 16 bp, H. sapiens
acttttgtgtatatat

SEQ ID NO: 30844 - DNA, 16 bp, H. sapiens
acttttgtgtatgttt

SEQ ID NO: 30845 - DNA, 16 bp, H. sapiens
acttttgttctgtgaa

SEQ ID NO: 30846 - DNA, 16 bp, H. sapiens
actttttaaaaaactt

SEQ ID NO: 30847 - DNA, 16 bp, H. sapiens
actttttaaaaaagta

SEQ ID NO: 30848 - DNA, 16 bp, H. sapiens
actttttaaaaaatgt

SEQ ID NO: 30849 - DNA, 16 bp, H. sapiens
actttttaaaaacttt

SEQ ID NO: 30850 - DNA, 16 bp, H. sapiens
actttttaaaaataag

SEQ ID NO: 30851 - DNA, 16 bp, H. sapiens
actttttaaaaataca

SEQ ID NO: 30852 - DNA, 16 bp, H. sapiens
actttttaaaaattca

SEQ ID NO: 30853 - DNA, 16 bp, H. sapiens
actttttaaaagaaat

SEQ ID NO: 30854 - DNA, 16 bp, H. sapiens
actttttaaaagtttg

SEQ ID NO: 30855 - DNA, 16 bp, H. sapiens
actttttaaaagtttt

SEQ ID NO: 30856 - DNA, 16 bp, H. sapiens
actttttaaaatgcta

SEQ ID NO: 30857 - DNA, 16 bp, H. sapiens
actttttaaaatgtat

SEQ ID NO: 30858 - DNA, 16 bp, H. sapiens
actttttaaaattgtt

SEQ ID NO: 30859 - DNA, 16 bp, H. sapiens
actttttaaagtaatt

SEQ ID NO: 30860 - DNA, 16 bp, H. sapiens
actttttaaatgtctt

SEQ ID NO: 30861 - DNA, 16 bp, H. sapiens
actttttaagaaactg

SEQ ID NO: 30862 - DNA, 16 bp, H. sapiens
actttttaataaaaac

SEQ ID NO: 30863 - DNA, 16 bp, H. sapiens
actttttaatgagatt

SEQ ID NO: 30864 - DNA, 16 bp, H. sapiens
actttttaatgcagtt

SEQ ID NO: 30865 - DNA, 16 bp, H. sapiens
actttttaatgtggtt

SEQ ID NO: 30866 - DNA, 16 bp, H. sapiens
actttttacttctgtg

SEQ ID NO: 30867 - DNA, 16 bp, H. sapiens
actttttagtaacagc

SEQ ID NO: 30868 - DNA, 16 bp, H. sapiens
actttttatccaattt

SEQ ID NO: 30869 - DNA, 16 bp, H. sapiens
actttttatcttaaaa

SEQ ID NO: 30870 - DNA, 16 bp, H. sapiens
actttttattatgaat

SEQ ID NO: 30871 - DNA, 16 bp, H. sapiens
actttttatttatgta

SEQ ID NO: 30872 - DNA, 16 bp, H. sapiens
actttttattttgaga

SEQ ID NO: 30873 - DNA, 16 bp, H. sapiens
actttttatttttgaa

SEQ ID NO: 30874 - DNA, 16 bp, H. sapiens
actttttcatcattcc

SEQ ID NO: 30875 - DNA, 16 bp, H. sapiens
actttttcatgtttct

SEQ ID NO: 30876 - DNA, 16 bp, H. sapiens
actttttcccaaacaa

SEQ ID NO: 30877 - DNA, 16 bp, H. sapiens
actttttcctttctaa

SEQ ID NO: 30878 - DNA, 16 bp, H. sapiens
actttttcttttgaga

SEQ ID NO: 30879 - DNA, 16 bp, H. sapiens
actttttgagcaccaa

SEQ ID NO: 30880 - DNA, 16 bp, H. sapiens
actttttgatggaatt

SEQ ID NO: 30881 - DNA, 16 bp, H. sapiens
actttttgcttaaaat

SEQ ID NO: 30882 - DNA, 16 bp, H. sapiens
actttttggaaaaaaa

SEQ ID NO: 30883 - DNA, 16 bp, H. sapiens
actttttggattttta

SEQ ID NO: 30884 - DNA, 16 bp, H. sapiens
actttttgtaaataaa

SEQ ID NO: 30885 - DNA, 16 bp, H. sapiens
actttttgtacccatt

SEQ ID NO: 30886 - DNA, 16 bp, H. sapiens
actttttgtactttta

SEQ ID NO: 30887 - DNA, 16 bp, H. sapiens
actttttgtagaaaca

SEQ ID NO: 30888 - DNA, 16 bp, H. sapiens
actttttgtagacatg

SEQ ID NO: 30889 - DNA, 16 bp, H. sapiens
acttttttagagacag

SEQ ID NO: 30890 - DNA, 16 bp, H. sapiens
acttttttcagatttt

SEQ ID NO: 30891 - DNA, 16 bp, H. sapiens
acttttttccaaagtg

SEQ ID NO: 30892 - DNA, 16 bp, H. sapiens
acttttttccttaaaa

SEQ ID NO: 30893 - DNA, 16 bp, H. sapiens
acttttttcttaaaaa

SEQ ID NO: 30894 - DNA, 16 bp, H. sapiens
acttttttggtggaga

SEQ ID NO: 30895 - DNA, 16 bp, H. sapiens
acttttttgttaaaag

SEQ ID NO: 30896 - DNA, 16 bp, H. sapiens
actttttttcccccca

SEQ ID NO: 30897 - DNA, 16 bp, H. sapiens
actttttttgtgtgtg

SEQ ID NO: 30898 - DNA, 16 bp, H. sapiens
actttttttttgagac

SEQ ID NO: 30899 - DNA, 16 bp, H. sapiens
agaaaaaaaaatcctg

SEQ ID NO: 30900 - DNA, 16 bp, H. sapiens
agaaaaaaaaattctt

SEQ ID NO: 30901 - DNA, 16 bp, H. sapiens
agaaaaaaaacccatc

SEQ ID NO: 30902 - DNA, 16 bp, H. sapiens
agaaaaaaaaccttca

SEQ ID NO: 30903 - DNA, 16 bp, H. sapiens
agaaaaaaaactcatt

SEQ ID NO: 30904 - DNA, 16 bp, H. sapiens
agaaaaaaaagattcc

SEQ ID NO: 30905 - DNA, 16 bp, H. sapiens
agaaaaaaaatctgtt

SEQ ID NO: 30906 - DNA, 16 bp, H. sapiens
agaaaaaaaatcttca

SEQ ID NO: 30907 - DNA, 16 bp, H. sapiens
agaaaaaaaattacct

SEQ ID NO: 30908 - DNA, 16 bp, H. sapiens
agaaaaaaaattactt

SEQ ID NO: 30909 - DNA, 16 bp, H. sapiens
agaaaaaaaattcctg

SEQ ID NO: 30910 - DNA, 16 bp, H. sapiens
agaaaaaaaattgctt

SEQ ID NO: 30911 - DNA, 16 bp, H. sapiens
agaaaaaaacaagttt

SEQ ID NO: 30912 - DNA, 16 bp, H. sapiens
agaaaaaaacaatttc

SEQ ID NO: 30913 - DNA, 16 bp, H. sapiens
agaaaaaaacacattt

SEQ ID NO: 30914 - DNA, 16 bp, H. sapiens
agaaaaaaacattttt

SEQ ID NO: 30915 - DNA, 16 bp, H. sapiens
agaaaaaaacctggaa

SEQ ID NO: 30916 - DNA, 16 bp, H. sapiens
agaaaaaaactgccag

SEQ ID NO: 30917 - DNA, 16 bp, H. sapiens
agaaaaaaactggtaa

SEQ ID NO: 30918 - DNA, 16 bp, H. sapiens
agaaaaaaagaattct

SEQ ID NO: 30919 - DNA, 16 bp, H. sapiens
agaaaaaaagacattc

SEQ ID NO: 30920 - DNA, 16 bp, H. sapiens
agaaaaaaagcagatt

SEQ ID NO: 30921 - DNA, 16 bp, H. sapiens
agaaaaaaagcatttt

SEQ ID NO: 30922 - DNA, 16 bp, H. sapiens
agaaaaaaataatcct

SEQ ID NO: 30923 - DNA, 16 bp, H. sapiens
agaaaaaaatacactt

SEQ ID NO: 30924 - DNA, 16 bp, H. sapiens
agaaaaaaataggtca

SEQ ID NO: 30925 - DNA, 16 bp, H. sapiens
agaaaaaaatatactt

SEQ ID NO: 30926 - DNA, 16 bp, H. sapiens
agaaaaaaatattcca

SEQ ID NO: 30927 - DNA, 16 bp, H. sapiens
agaaaaaaatatttct

SEQ ID NO: 30928 - DNA, 16 bp, H. sapiens
agaaaaaaatcagcat

SEQ ID NO: 30929 - DNA, 16 bp, H. sapiens
agaaaaaaatcagttg

SEQ ID NO: 30930 - DNA, 16 bp, H. sapiens
agaaaaaaatcctgaa

SEQ ID NO: 30931 - DNA, 16 bp, H. sapiens
agaaaaaaatgacatt

SEQ ID NO: 30932 - DNA, 16 bp, H. sapiens
agaaaaaaatgcaatt

SEQ ID NO: 30933 - DNA, 16 bp, H. sapiens
agaaaaaaatgcatta

SEQ ID NO: 30934 - DNA, 16 bp, H. sapiens
agaaaaaaatgcattt

SEQ ID NO: 30935 - DNA, 16 bp, H. sapiens
agaaaaaaatggattt

SEQ ID NO: 30936 - DNA, 16 bp, H. sapiens
agaaaaaaatgtgatt

SEQ ID NO: 30937 - DNA, 16 bp, H. sapiens
agaaaaaaatgtgttt

SEQ ID NO: 30938 - DNA, 16 bp, H. sapiens
agaaaaaaatgtttct

SEQ ID NO: 30939 - DNA, 16 bp, H. sapiens
agaaaaaaattggcaa

SEQ ID NO: 30940 - DNA, 16 bp, H. sapiens
agaaaaaaatttctct

SEQ ID NO: 30941 - DNA, 16 bp, H. sapiens
agaaaaaacaactcta

SEQ ID NO: 30942 - DNA, 16 bp, H. sapiens
agaaaaaactaattta

SEQ ID NO: 30943 - DNA, 16 bp, H. sapiens
agaaaaaactattcta

SEQ ID NO: 30944 - DNA, 16 bp, H. sapiens
agaaaaaacttcagag

SEQ ID NO: 30945 - DNA, 16 bp, H. sapiens
agaaaaaacttttaaa

SEQ ID NO: 30946 - DNA, 16 bp, H. sapiens
agaaaaaagaaacttg

SEQ ID NO: 30947 - DNA, 16 bp, H. sapiens
agaaaaaagaaatcct

SEQ ID NO: 30948 - DNA, 16 bp, H. sapiens
agaaaaaagaacttca

SEQ ID NO: 30949 - DNA, 16 bp, H. sapiens
agaaaaaagatttcaa

SEQ ID NO: 30950 - DNA, 16 bp, H. sapiens
agaaaaaagatttctt

SEQ ID NO: 30951 - DNA, 16 bp, H. sapiens
agaaaaaagcaatcct

SEQ ID NO: 30952 - DNA, 16 bp, H. sapiens
agaaaaaagcattcaa

SEQ ID NO: 30953 - DNA, 16 bp, H. sapiens
agaaaaaagctggagg

SEQ ID NO: 30954 - DNA, 16 bp, H. sapiens
agaaaaaagtaaactt

SEQ ID NO: 30955 - DNA, 16 bp, H. sapiens
agaaaaaataaattcc

SEQ ID NO: 30956 - DNA, 16 bp, H. sapiens
agaaaaaatacaattt

SEQ ID NO: 30957 - DNA, 16 bp, H. sapiens
agaaaaaatactttca

SEQ ID NO: 30958 - DNA, 16 bp, H. sapiens
agaaaaaatatctaag

SEQ ID NO: 30959 - DNA, 16 bp, H. sapiens
agaaaaaatatctgta

SEQ ID NO: 30960 - DNA, 16 bp, H. sapiens
agaaaaaatcttgaaa

SEQ ID NO: 30961 - DNA, 16 bp, H. sapiens
agaaaaaatcttggaa

SEQ ID NO: 30962 - DNA, 16 bp, H. sapiens
agaaaaaattcaaatg

SEQ ID NO: 30963 - DNA, 16 bp, H. sapiens
agaaaaaattcttgaa

SEQ ID NO: 30964 - DNA, 16 bp, H. sapiens
agaaaaaattgatttt

SEQ ID NO: 30965 - DNA, 16 bp, H. sapiens
agaaaaacaaacactg

SEQ ID NO: 30966 - DNA, 16 bp, H. sapiens
agaaaaacaaatgagg

SEQ ID NO: 30967 - DNA, 16 bp, H. sapiens
agaaaaacaaatgtta

SEQ ID NO: 30968 - DNA, 16 bp, H. sapiens
agaaaaacaaatgttt

SEQ ID NO: 30969 - DNA, 16 bp, H. sapiens
agaaaaacaagctcag

SEQ ID NO: 30970 - DNA, 16 bp, H. sapiens
agaaaaacaaggctgg

SEQ ID NO: 30971 - DNA, 16 bp, H. sapiens
agaaaaacaatatttt

SEQ ID NO: 30972 - DNA, 16 bp, H. sapiens
agaaaaacaattattt

SEQ ID NO: 30973 - DNA, 16 bp, H. sapiens
agaaaaacatgaaatt

SEQ ID NO: 30974 - DNA, 16 bp, H. sapiens
agaaaaacatttcaga

SEQ ID NO: 30975 - DNA, 16 bp, H. sapiens
agaaaaacatttcatg

SEQ ID NO: 30976 - DNA, 16 bp, H. sapiens
agaaaaacatttgtaa

SEQ ID NO: 30977 - DNA, 16 bp, H. sapiens
agaaaaacattttaga

SEQ ID NO: 30978 - DNA, 16 bp, H. sapiens
agaaaaacatttttaa

SEQ ID NO: 30979 - DNA, 16 bp, H. sapiens
agaaaaaccacatgat

SEQ ID NO: 30980 - DNA, 16 bp, H. sapiens
agaaaaaccagaaact

SEQ ID NO: 30981 - DNA, 16 bp, H. sapiens
agaaaaaccatataat

SEQ ID NO: 30982 - DNA, 16 bp, H. sapiens
agaaaaaccttttaaa

SEQ ID NO: 30983 - DNA, 16 bp, H. sapiens
agaaaaactatatgaa

SEQ ID NO: 30984 - DNA, 16 bp, H. sapiens
agaaaaactcagaaat

SEQ ID NO: 30985 - DNA, 16 bp, H. sapiens
agaaaaactctgtctc

SEQ ID NO: 30986 - DNA, 16 bp, H. sapiens
agaaaaactgagcaga

SEQ ID NO: 30987 - DNA, 16 bp, H. sapiens
agaaaaactgaggaaa

SEQ ID NO: 30988 - DNA, 16 bp, H. sapiens
agaaaaactggaagca

SEQ ID NO: 30989 - DNA, 16 bp, H. sapiens
agaaaaactggaagct

SEQ ID NO: 30990 - DNA, 16 bp, H. sapiens
agaaaaactgggaaaa

SEQ ID NO: 30991 - DNA, 16 bp, H. sapiens
agaaaaacttcagaca

SEQ ID NO: 30992 - DNA, 16 bp, H. sapiens
agaaaaagaaaactct

SEQ ID NO: 30993 - DNA, 16 bp, H. sapiens
agaaaaagaaaagttc

SEQ ID NO: 30994 - DNA, 16 bp, H. sapiens
agaaaaagaaaatcct

SEQ ID NO: 30995 - DNA, 16 bp, H. sapiens
agaaaaagaaaatctg

SEQ ID NO: 30996 - DNA, 16 bp, H. sapiens
agaaaaagaaaattcc

SEQ ID NO: 30997 - DNA, 16 bp, H. sapiens
agaaaaagaaactctt

SEQ ID NO: 30998 - DNA, 16 bp, H. sapiens
agaaaaagaaactgca

SEQ ID NO: 30999 - DNA, 16 bp, H. sapiens
agaaaaagaaatccag

SEQ ID NO: 31000 - DNA, 16 bp, H. sapiens
agaaaaagaaatgctt

SEQ ID NO: 31001 - DNA, 16 bp, H. sapiens
agaaaaagaaattccc

SEQ ID NO: 31002 - DNA, 16 bp, H. sapiens
agaaaaagaaattctt

SEQ ID NO: 31003 - DNA, 16 bp, H. sapiens
agaaaaagaaattgct

SEQ ID NO: 31004 - DNA, 16 bp, H. sapiens
agaaaaagaaatttca

SEQ ID NO: 31005 - DNA, 16 bp, H. sapiens
agaaaaagaacacttt

SEQ ID NO: 31006 - DNA, 16 bp, H. sapiens
agaaaaagaacatttt

SEQ ID NO: 31007 - DNA, 16 bp, H. sapiens
agaaaaagaactgtaa

SEQ ID NO: 31008 - DNA, 16 bp, H. sapiens
agaaaaagaagaagtc

SEQ ID NO: 31009 - DNA, 16 bp, H. sapiens
agaaaaagaagactca

SEQ ID NO: 31010 - DNA, 16 bp, H. sapiens
agaaaaagaagcaatg

SEQ ID NO: 31011 - DNA, 16 bp, H. sapiens
agaaaaagacacatta

SEQ ID NO: 31012 - DNA, 16 bp, H. sapiens
agaaaaagactggaaa

SEQ ID NO: 31013 - DNA, 16 bp, H. sapiens
agaaaaagactttaaa

SEQ ID NO: 31014 - DNA, 16 bp, H. sapiens
agaaaaagagaaagct

SEQ ID NO: 31015 - DNA, 16 bp, H. sapiens
agaaaaagagaagctg

SEQ ID NO: 31016 - DNA, 16 bp, H. sapiens
agaaaaagagaagtca

SEQ ID NO: 31017 - DNA, 16 bp, H. sapiens
agaaaaagagaatttg

SEQ ID NO: 31018 - DNA, 36 bp, H. sapiens
agaaaaagagagaatcctccctaactcattttatga

SEQ ID NO: 31019 - DNA, 16 bp, H. sapiens
agaaaaagaggaaatc

SEQ ID NO: 31020 - DNA, 16 bp, H. sapiens
agaaaaagagggagtc

SEQ ID NO: 31021 - DNA, 16 bp, H. sapiens
agaaaaagaggtttta

SEQ ID NO: 31022 - DNA, 16 bp, H. sapiens
agaaaaagatatccca

SEQ ID NO: 31023 - DNA, 16 bp, H. sapiens
agaaaaagatgatttt

SEQ ID NO: 31024 - DNA, 16 bp, H. sapiens
agaaaaagattccttt

SEQ ID NO: 31025 - DNA, 16 bp, H. sapiens
agaaaaagattttact

SEQ ID NO: 31026 - DNA, 16 bp, H. sapiens
agaaaaagcagcagca

SEQ ID NO: 31027 - DNA, 16 bp, H. sapiens
agaaaaagcattttct

SEQ ID NO: 31028 - DNA, 16 bp, H. sapiens
agaaaaaggaaacatt

SEQ ID NO: 31029 - DNA, 16 bp, H. sapiens
agaaaaaggaatgctt

SEQ ID NO: 31030 - DNA, 16 bp, H. sapiens
agaaaaaggatatttt

SEQ ID NO: 31031 - DNA, 16 bp, H. sapiens
agaaaaaggatttttt

SEQ ID NO: 31032 - DNA, 16 bp, H. sapiens
agaaaaaggctgaaaa

SEQ ID NO: 31033 - DNA, 16 bp, H. sapiens
agaaaaagtaaacttt

SEQ ID NO: 31034 - DNA, 16 bp, H. sapiens
agaaaaagtacaaatg

SEQ ID NO: 31035 - DNA, 16 bp, H. sapiens
agaaaaagtattttta

SEQ ID NO: 31036 - DNA, 16 bp, H. sapiens
agaaaaagtcaaacta

SEQ ID NO: 31037 - DNA, 16 bp, H. sapiens
agaaaaagtgtgtgtg

SEQ ID NO: 31038 - DNA, 16 bp, H. sapiens
agaaaaagtgtttaaa

SEQ ID NO: 31039 - DNA, 16 bp, H. sapiens
agaaaaagttatttat

SEQ ID NO: 31040 - DNA, 16 bp, H. sapiens
agaaaaagtttgccag

SEQ ID NO: 31041 - DNA, 16 bp, H. sapiens
agaaaaagtttgctga

SEQ ID NO: 31042 - DNA, 16 bp, H. sapiens
agaaaaagtttgttga

SEQ ID NO: 31043 - DNA, 16 bp, H. sapiens
agaaaaataaagcagt

SEQ ID NO: 31044 - DNA, 16 bp, H. sapiens
agaaaaataaagctgg

SEQ ID NO: 31045 - DNA, 16 bp, H. sapiens
agaaaaataaattcat

SEQ ID NO: 31046 - DNA, 16 bp, H. sapiens
agaaaaataacttcaa

SEQ ID NO: 31047 - DNA, 16 bp, H. sapiens
agaaaaataagcagag

SEQ ID NO: 31048 - DNA, 16 bp, H. sapiens
agaaaaataattacat

SEQ ID NO: 31049 - DNA, 16 bp, H. sapiens
agaaaaataattagca

SEQ ID NO: 31050 - DNA, 16 bp, H. sapiens
agaaaaataattccat

SEQ ID NO: 31051 - DNA, 16 bp, H. sapiens
agaaaaatacaaagtt

SEQ ID NO: 31052 - DNA, 16 bp, H. sapiens
agaaaaatacaggcca

SEQ ID NO: 31053 - DNA, 16 bp, H. sapiens
agaaaaatacagtgaa

SEQ ID NO: 31054 - DNA, 16 bp, H. sapiens
agaaaaatactttatt

SEQ ID NO: 31055 - DNA, 16 bp, H. sapiens
agaaaaatactttttt

SEQ ID NO: 31056 - DNA, 16 bp, H. sapiens
agaaaaatagaaagct

SEQ ID NO: 31057 - DNA, 16 bp, H. sapiens
agaaaaataggcaaat

SEQ ID NO: 31058 - DNA, 16 bp, H. sapiens
agaaaaatatatacat

SEQ ID NO: 31059 - DNA, 16 bp, H. sapiens
agaaaaatatattcat

SEQ ID NO: 31060 - DNA, 16 bp, H. sapiens
agaaaaatatcaacat

SEQ ID NO: 31061 - DNA, 16 bp, H. sapiens
agaaaaatatcagaga

SEQ ID NO: 31062 - DNA, 16 bp, H. sapiens
agaaaaatatctattt

SEQ ID NO: 31063 - DNA, 16 bp, H. sapiens
agaaaaatatctgaaa

SEQ ID NO: 31064 - DNA, 16 bp, H. sapiens
agaaaaatatctgtaa

SEQ ID NO: 31065 - DNA, 16 bp, H. sapiens
agaaaaatattacagc

SEQ ID NO: 31066 - DNA, 16 bp, H. sapiens
agaaaaatatttctaa

SEQ ID NO: 31067 - DNA, 16 bp, H. sapiens
agaaaaatatttgaca

SEQ ID NO: 31068 - DNA, 16 bp, H. sapiens
agaaaaatcacatttt

SEQ ID NO: 31069 - DNA, 16 bp, H. sapiens
agaaaaatcagagaag

SEQ ID NO: 31070 - DNA, 16 bp, H. sapiens
agaaaaatcagtgaaa

SEQ ID NO: 31071 - DNA, 16 bp, H. sapiens
agaaaaatccatttta

SEQ ID NO: 31072 - DNA, 16 bp, H. sapiens
agaaaaatctatttta

SEQ ID NO: 31073 - DNA, 16 bp, H. sapiens
agaaaaatctctgaaa

SEQ ID NO: 31074 - DNA, 16 bp, H. sapiens
agaaaaatctcttgaa

SEQ ID NO: 31075 - DNA, 16 bp, H. sapiens
agaaaaatctgaacag

SEQ ID NO: 31076 - DNA, 16 bp, H. sapiens
agaaaaatcttcaaat

SEQ ID NO: 31077 - DNA, 16 bp, H. sapiens
agaaaaatctttccaa

SEQ ID NO: 31078 - DNA, 16 bp, H. sapiens
agaaaaatctttgaat

SEQ ID NO: 31079 - DNA, 16 bp, H. sapiens
agaaaaatctttgtga

SEQ ID NO: 31080 - DNA, 16 bp, H. sapiens
agaaaaatgaaaactt

SEQ ID NO: 31081 - DNA, 16 bp, H. sapiens
agaaaaatgaaaatct

SEQ ID NO: 31082 - DNA, 16 bp, H. sapiens
agaaaaatgaaaccat

SEQ ID NO: 31083 - DNA, 16 bp, H. sapiens
agaaaaatgaaactga

SEQ ID NO: 31084 - DNA, 16 bp, H. sapiens
agaaaaatgaaatgtt

SEQ ID NO: 31085 - DNA, 16 bp, H. sapiens
agaaaaatgaaattca

SEQ ID NO: 31086 - DNA, 16 bp, H. sapiens
agaaaaatgagagcca

SEQ ID NO: 31087 - DNA, 16 bp, H. sapiens
agaaaaatgcagatca

SEQ ID NO: 31088 - DNA, 16 bp, H. sapiens
agaaaaatgccaaaat

SEQ ID NO: 31089 - DNA, 16 bp, H. sapiens
agaaaaatgcttataa

SEQ ID NO: 31090 - DNA, 16 bp, H. sapiens
agaaaaatgcttattt

SEQ ID NO: 31091 - DNA, 16 bp, H. sapiens
agaaaaatggttttaa

SEQ ID NO: 31092 - DNA, 16 bp, H. sapiens
agaaaaatgtaatttg

SEQ ID NO: 31093 - DNA, 16 bp, H. sapiens
agaaaaatgtatatgc

SEQ ID NO: 31094 - DNA, 16 bp, H. sapiens
agaaaaatgtatattc

SEQ ID NO: 31095 - DNA, 16 bp, H. sapiens
agaaaaatgtattttt

SEQ ID NO: 31096 - DNA, 16 bp, H. sapiens
agaaaaatgtggcaaa

SEQ ID NO: 31097 - DNA, 16 bp, H. sapiens
agaaaaatgtgtattt

SEQ ID NO: 31098 - DNA, 16 bp, H. sapiens
agaaaaatgttctttt

SEQ ID NO: 31099 - DNA, 16 bp, H. sapiens
agaaaaattacaaatt

SEQ ID NO: 31100 - DNA, 16 bp, H. sapiens
agaaaaattattctca

SEQ ID NO: 31101 - DNA, 16 bp, H. sapiens
agaaaaattctaattt

SEQ ID NO: 31102 - DNA, 16 bp, H. sapiens
agaaaaattggaaact

SEQ ID NO: 31103 - DNA, 16 bp, H. sapiens
agaaaaattggaagct

SEQ ID NO: 31104 - DNA, 16 bp, H. sapiens
agaaaaattggcaaaa

SEQ ID NO: 31105 - DNA, 16 bp, H. sapiens
agaaaaattggccagg

SEQ ID NO: 31106 - DNA, 16 bp, H. sapiens
agaaaaatttcaaata

SEQ ID NO: 31107 - DNA, 16 bp, H. sapiens
agaaaaatttccaaaa

SEQ ID NO: 31108 - DNA, 16 bp, H. sapiens
agaaaaattttgcaat

SEQ ID NO: 31109 - DNA, 16 bp, H. sapiens
agaaaacaaaaacttt

SEQ ID NO: 31110 - DNA, 16 bp, H. sapiens
agaaaacaaaaagtgg

SEQ ID NO: 31111 - DNA, 16 bp, H. sapiens
agaaaacaaaactatt

SEQ ID NO: 31112 - DNA, 16 bp, H. sapiens
agaaaacaaaactgca

SEQ ID NO: 31113 - DNA, 16 bp, H. sapiens
agaaaacaaagtatct

SEQ ID NO: 31114 - DNA, 16 bp, H. sapiens
agaaaacaaatggcaa

SEQ ID NO: 31115 - DNA, 16 bp, H. sapiens
agaaaacaaattcttt

SEQ ID NO: 31116 - DNA, 16 bp, H. sapiens
agaaaacaagattaga

SEQ ID NO: 31117 - DNA, 16 bp, H. sapiens
agaaaacaagttatct

SEQ ID NO: 31118 - DNA, 16 bp, H. sapiens
agaaaacaataaattt

SEQ ID NO: 31119 - DNA, 16 bp, H. sapiens
agaaaacaatcacatt

SEQ ID NO: 31120 - DNA, 16 bp, H. sapiens
agaaaacaatgtattt

SEQ ID NO: 31121 - DNA, 16 bp, H. sapiens
agaaaacaatgtttaa

SEQ ID NO: 31122 - DNA, 16 bp, H. sapiens
agaaaacaattacatt

SEQ ID NO: 31123 - DNA, 16 bp, H. sapiens
agaaaacaatttttaa

SEQ ID NO: 31124 - DNA, 16 bp, H. sapiens
agaaaacacaaatatg

SEQ ID NO: 31125 - DNA, 16 bp, H. sapiens
agaaaacacagatgaa

SEQ ID NO: 31126 - DNA, 16 bp, H. sapiens
agaaaacacatttctg

SEQ ID NO: 31127 - DNA, 16 bp, H. sapiens
agaaaacacattttct

SEQ ID NO: 31128 - DNA, 16 bp, H. sapiens
agaaaacaccattctg

SEQ ID NO: 31129 - DNA, 16 bp, H. sapiens
agaaaacactggaaaa

SEQ ID NO: 31130 - DNA, 16 bp, H. sapiens
agaaaacactggagaa

SEQ ID NO: 31131 - DNA, 16 bp, H. sapiens
agaaaacactgggaaa

SEQ ID NO: 31132 - DNA, 16 bp, H. sapiens
agaaaacacttttaaa

SEQ ID NO: 31133 - DNA, 16 bp, H. sapiens
agaaaacagaagtgaa

SEQ ID NO: 31134 - DNA, 16 bp, H. sapiens
agaaaacagaattcag

SEQ ID NO: 31135 - DNA, 16 bp, H. sapiens
agaaaacagaggcaca

SEQ ID NO: 31136 - DNA, 16 bp, H. sapiens
agaaaacagattcaga

SEQ ID NO: 31137 - DNA, 16 bp, H. sapiens
agaaaacagattttaa

SEQ ID NO: 31138 - DNA, 16 bp, H. sapiens
agaaaacagcaaaatg

SEQ ID NO: 31139 - DNA, 16 bp, H. sapiens
agaaaacagctgggcc

SEQ ID NO: 31140 - DNA, 16 bp, H. sapiens
agaaaacagcttttct

SEQ ID NO: 31141 - DNA, 16 bp, H. sapiens
agaaaacaggaattag

SEQ ID NO: 31142 - DNA, 16 bp, H. sapiens
agaaaacagtgtttcc

SEQ ID NO: 31143 - DNA, 16 bp, H. sapiens
agaaaacagttaacaa

SEQ ID NO: 31144 - DNA, 16 bp, H. sapiens
agaaaacagttttatt

SEQ ID NO: 31145 - DNA, 16 bp, H. sapiens
agaaaacataaatttt

SEQ ID NO: 31146 - DNA, 16 bp, H. sapiens
agaaaacataattata

SEQ ID NO: 31147 - DNA, 16 bp, H. sapiens
agaaaacataggcaaa

SEQ ID NO: 31148 - DNA, 16 bp, H. sapiens
agaaaacataggcatt

SEQ ID NO: 31149 - DNA, 16 bp, H. sapiens
agaaaacatatatttt

SEQ ID NO: 31150 - DNA, 16 bp, H. sapiens
agaaaacatattcttt

SEQ ID NO: 31151 - DNA, 16 bp, H. sapiens
agaaaacatatttgag

SEQ ID NO: 31152 - DNA, 16 bp, H. sapiens
agaaaacatcagagaa

SEQ ID NO: 31153 - DNA, 16 bp, H. sapiens
agaaaacatcagataa

SEQ ID NO: 31154 - DNA, 16 bp, H. sapiens
agaaaacatcaggcaa

SEQ ID NO: 31155 - DNA, 16 bp, H. sapiens
agaaaacatcaggcca

SEQ ID NO: 31156 - DNA, 16 bp, H. sapiens
agaaaacatgaaaatt

SEQ ID NO: 31157 - DNA, 16 bp, H. sapiens
agaaaacatgagagaa

SEQ ID NO: 31158 - DNA, 16 bp, H. sapiens
agaaaacatgcaaata

SEQ ID NO: 31159 - DNA, 16 bp, H. sapiens
agaaaacatgcatttt

SEQ ID NO: 31160 - DNA, 16 bp, H. sapiens
agaaaacatggacaca

SEQ ID NO: 31161 - DNA, 16 bp, H. sapiens
agaaaacatggcaaaa

SEQ ID NO: 31162 - DNA, 16 bp, H. sapiens
agaaaacatgttttat

SEQ ID NO: 31163 - DNA, 16 bp, H. sapiens
agaaaacattaaatta

SEQ ID NO: 31164 - DNA, 16 bp, H. sapiens
agaaaacattcacaaa

SEQ ID NO: 31165 - DNA, 16 bp, H. sapiens
agaaaacattccaaaa

SEQ ID NO: 31166 - DNA, 16 bp, H. sapiens
agaaaacattgaaaat

SEQ ID NO: 31167 - DNA, 16 bp, H. sapiens
agaaaacatttaatat

SEQ ID NO: 31168 - DNA, 16 bp, H. sapiens
agaaaacatttacaaa

SEQ ID NO: 31169 - DNA, 16 bp, H. sapiens
agaaaacatttcattt

SEQ ID NO: 31170 - DNA, 16 bp, H. sapiens
agaaaacatttccaaa

SEQ ID NO: 31171 - DNA, 16 bp, H. sapiens
agaaaacatttgccaa

SEQ ID NO: 31172 - DNA, 16 bp, H. sapiens
agaaaacattttaatt

SEQ ID NO: 31173 - DNA, 16 bp, H. sapiens
agaaaacattttgaaa

SEQ ID NO: 31174 - DNA, 16 bp, H. sapiens
agaaaacattttggaa

SEQ ID NO: 31175 - DNA, 16 bp, H. sapiens
agaaaacattttttaa

SEQ ID NO: 31176 - DNA, 16 bp, H. sapiens
agaaaaccaaacaatg

SEQ ID NO: 31177 - DNA, 19 bp, H. sapiens
agaaaaccaaacactgcat

SEQ ID NO: 31178 - DNA, 16 bp, H. sapiens
agaaaaccaaatgccg

SEQ ID NO: 31179 - DNA, 16 bp, H. sapiens
agaaaaccagctcctg

SEQ ID NO: 31180 - DNA, 16 bp, H. sapiens
agaaaaccatacacca

SEQ ID NO: 31181 - DNA, 16 bp, H. sapiens
agaaaaccattttaaa

SEQ ID NO: 31182 - DNA, 16 bp, H. sapiens
agaaaaccatttttaa

SEQ ID NO: 31183 - DNA, 16 bp, H. sapiens
agaaaacccaggcaat

SEQ ID NO: 31184 - DNA, 16 bp, H. sapiens
agaaaaccctaaagaa

SEQ ID NO: 31185 - DNA, 16 bp, H. sapiens
agaaaacccttcaaaa

SEQ ID NO: 31186 - DNA, 16 bp, H. sapiens
agaaaacctaagaaat

SEQ ID NO: 31187 - DNA, 16 bp, H. sapiens
agaaaacctgaaaata

SEQ ID NO: 31188 - DNA, 16 bp, H. sapiens
agaaaacctgaaaatt

SEQ ID NO: 31189 - DNA, 16 bp, H. sapiens
agaaaacctgaacaga

SEQ ID NO: 31190 - DNA, 16 bp, H. sapiens
agaaaacctgaagaaa

SEQ ID NO: 31191 - DNA, 16 bp, H. sapiens
agaaaacctgaataaa

SEQ ID NO: 31192 - DNA, 16 bp, H. sapiens
agaaaacctggaagaa

SEQ ID NO: 31193 - DNA, 16 bp, H. sapiens
agaaaactaattttat

SEQ ID NO: 31194 - DNA, 16 bp, H. sapiens
agaaaactacagaaca

SEQ ID NO: 31195 - DNA, 16 bp, H. sapiens
agaaaactatagacca

SEQ ID NO: 31196 - DNA, 16 bp, H. sapiens
agaaaactcaagcagt

SEQ ID NO: 31197 - DNA, 16 bp, H. sapiens
agaaaactcaaggctg

SEQ ID NO: 31198 - DNA, 16 bp, H. sapiens
agaaaactccagcaga

SEQ ID NO: 31199 - DNA, 16 bp, H. sapiens
agaaaactgaaaacat

SEQ ID NO: 31200 - DNA, 16 bp, H. sapiens
agaaaactgaaaagga

SEQ ID NO: 31201 - DNA, 16 bp, H. sapiens
agaaaactgaaacagg

SEQ ID NO: 31202 - DNA, 16 bp, H. sapiens
agaaaactgaagagaa

SEQ ID NO: 31203 - DNA, 16 bp, H. sapiens
agaaaactgaagagga

SEQ ID NO: 31204 - DNA, 16 bp, H. sapiens
agaaaactgacaaaat

SEQ ID NO: 31205 - DNA, 16 bp, H. sapiens
agaaaactgacaaaga

SEQ ID NO: 31206 - DNA, 16 bp, H. sapiens
agaaaactgacaaata

SEQ ID NO: 31207 - DNA, 16 bp, H. sapiens
agaaaactgagaaaat

SEQ ID NO: 31208 - DNA, 16 bp, H. sapiens
agaaaactgaggctca

SEQ ID NO: 31209 - DNA, 16 bp, H. sapiens
agaaaactgaggcttc

SEQ ID NO: 31210 - DNA, 16 bp, H. sapiens
agaaaactgcaaacca

SEQ ID NO: 31211 - DNA, 16 bp, H. sapiens
agaaaactgcccccat

SEQ ID NO: 31212 - DNA, 16 bp, H. sapiens
agaaaactggaagaaa

SEQ ID NO: 31213 - DNA, 16 bp, H. sapiens
agaaaactggaataaa

SEQ ID NO: 31214 - DNA, 16 bp, H. sapiens
agaaaactggaggaaa

SEQ ID NO: 31215 - DNA, 16 bp, H. sapiens
agaaaactggataaaa

SEQ ID NO: 31216 - DNA, 16 bp, H. sapiens
agaaaactggggctca

SEQ ID NO: 31217 - DNA, 16 bp, H. sapiens
agaaaacttaaaatga

SEQ ID NO: 31218 - DNA, 16 bp, H. sapiens
agaaaacttaatttta

SEQ ID NO: 31219 - DNA, 16 bp, H. sapiens
agaaaacttattcaaa

SEQ ID NO: 31220 - DNA, 16 bp, H. sapiens
agaaaacttatttaaa

SEQ ID NO: 31221 - DNA, 16 bp, H. sapiens
agaaaacttgaaaaat

SEQ ID NO: 31222 - DNA, 16 bp, H. sapiens
agaaaacttttaaata

SEQ ID NO: 31223 - DNA, 16 bp, H. sapiens
agaaaacttttatttt

SEQ ID NO: 31224 - DNA, 16 bp, H. sapiens
agaaaactttttaaaa

SEQ ID NO: 31225 - DNA, 16 bp, H. sapiens
agaaaacttttttttt

SEQ ID NO: 31226 - DNA, 16 bp, H. sapiens
agaaaagaaaacactg

SEQ ID NO: 31227 - DNA, 16 bp, H. sapiens
agaaaagaaaacactt

SEQ ID NO: 31228 - DNA, 16 bp, H. sapiens
agaaaagaaaacatct

SEQ ID NO: 31229 - DNA, 16 bp, H. sapiens
agaaaagaaaacattt

SEQ ID NO: 31230 - DNA, 16 bp, H. sapiens
agaaaagaaaacctca

SEQ ID NO: 31231 - DNA, 16 bp, H. sapiens
agaaaagaaaactgat

SEQ ID NO: 31232 - DNA, 16 bp, H. sapiens
agaaaagaaaactgtt

SEQ ID NO: 31233 - DNA, 16 bp, H. sapiens
agaaaagaaaagatgc

SEQ ID NO: 31234 - DNA, 16 bp, H. sapiens
agaaaagaaaagctca

SEQ ID NO: 31235 - DNA, 16 bp, H. sapiens
agaaaagaaaatccca

SEQ ID NO: 31236 - DNA, 16 bp, H. sapiens
agaaaagaaaatgcag

SEQ ID NO: 31237 - DNA, 16 bp, H. sapiens
agaaaagaaaatgctg

SEQ ID NO: 31238 - DNA, 16 bp, H. sapiens
agaaaagaaaatggac

SEQ ID NO: 31239 - DNA, 16 bp, H. sapiens
agaaaagaaaatgttg

SEQ ID NO: 31240 - DNA, 16 bp, H. sapiens
agaaaagaaaattcat

SEQ ID NO: 31241 - DNA, 16 bp, H. sapiens
agaaaagaaaattctg

SEQ ID NO: 31242 - DNA, 16 bp, H. sapiens
agaaaagaaacactga

SEQ ID NO: 31243 - DNA, 16 bp, H. sapiens
agaaaagaaacatgtt

SEQ ID NO: 31244 - DNA, 16 bp, H. sapiens
agaaaagaaacatttc

SEQ ID NO: 31245 - DNA, 16 bp, H. sapiens
agaaaagaaacatttt

SEQ ID NO: 31246 - DNA, 16 bp, H. sapiens
agaaaagaaaccattt

SEQ ID NO: 31247 - DNA, 16 bp, H. sapiens
agaaaagaaactacca

SEQ ID NO: 31248 - DNA, 16 bp, H. sapiens
agaaaagaaagcattt

SEQ ID NO: 31249 - DNA, 16 bp, H. sapiens
agaaaagaaaggctgg

SEQ ID NO: 31250 - DNA, 16 bp, H. sapiens
agaaaagaaaggcttt

SEQ ID NO: 31251 - DNA, 16 bp, H. sapiens
agaaaagaaagttatt

SEQ ID NO: 31252 - DNA, 16 bp, H. sapiens
agaaaagaaatggttt

SEQ ID NO: 31253 - DNA, 16 bp, H. sapiens
agaaaagaaatgtatg

SEQ ID NO: 31254 - DNA, 16 bp, H. sapiens
agaaaagaaatttcag

SEQ ID NO: 31255 - DNA, 16 bp, H. sapiens
agaaaagaaatttcat

SEQ ID NO: 31256 - DNA, 16 bp, H. sapiens
agaaaagaacatggaa

SEQ ID NO: 31257 - DNA, 16 bp, H. sapiens
agaaaagaatttctgt

SEQ ID NO: 31258 - DNA, 16 bp, H. sapiens
agaaaagaattttatt

SEQ ID NO: 31259 - DNA, 16 bp, H. sapiens
agaaaagacaattttg

SEQ ID NO: 31260 - DNA, 16 bp, H. sapiens
agaaaagacatgaaat

SEQ ID NO: 31261 - DNA, 16 bp, H. sapiens
agaaaagacctttgat

SEQ ID NO: 31262 - DNA, 16 bp, H. sapiens
agaaaagactgaagaa

SEQ ID NO: 31263 - DNA, 16 bp, H. sapiens
agaaaagacttggaac

SEQ ID NO: 31264 - DNA, 16 bp, H. sapiens
agaaaagagaagaatc

SEQ ID NO: 31265 - DNA, 16 bp, H. sapiens
agaaaagagacatttt

SEQ ID NO: 31266 - DNA, 16 bp, H. sapiens
agaaaagagacttaat

SEQ ID NO: 31267 - DNA, 16 bp, H. sapiens
agaaaagagatttatt

SEQ ID NO: 31268 - DNA, 16 bp, H. sapiens
agaaaagagatttgat

SEQ ID NO: 31269 - DNA, 16 bp, H. sapiens
agaaaagagattttaa

SEQ ID NO: 31270 - DNA, 16 bp, H. sapiens
agaaaagagcaggagt

SEQ ID NO: 31271 - DNA, 16 bp, H. sapiens
agaaaagaggcctcag

SEQ ID NO: 31272 - DNA, 16 bp, H. sapiens
agaaaagaggtttgtt

SEQ ID NO: 31273 - DNA, 16 bp, H. sapiens
agaaaagagttttatt

SEQ ID NO: 31274 - DNA, 16 bp, H. sapiens
agaaaagataactact

SEQ ID NO: 31275 - DNA, 16 bp, H. sapiens
agaaaagatatttatt

SEQ ID NO: 31276 - DNA, 16 bp, H. sapiens
agaaaagatcattttt

SEQ ID NO: 31277 - DNA, 16 bp, H. sapiens
agaaaagatggcagct

SEQ ID NO: 31278 - DNA, 16 bp, H. sapiens
agaaaagattagtgaa

SEQ ID NO: 31279 - DNA, 16 bp, H. sapiens
agaaaagcaaaggaat

SEQ ID NO: 31280 - DNA, 16 bp, H. sapiens
agaaaagcaaatatca

SEQ ID NO: 31281 - DNA, 16 bp, H. sapiens
agaaaagcaactgaaa

SEQ ID NO: 31282 - DNA, 16 bp, H. sapiens
agaaaagcaagctgga

SEQ ID NO: 31283 - DNA, 16 bp, H. sapiens
agaaaagcaattattt

SEQ ID NO: 31284 - DNA, 16 bp, H. sapiens
agaaaagcaatttaaa

SEQ ID NO: 31285 - DNA, 16 bp, H. sapiens
agaaaagcaccttcat

SEQ ID NO: 31286 - DNA, 16 bp, H. sapiens
agaaaagcatgaaaag

SEQ ID NO: 31287 - DNA, 16 bp, H. sapiens
agaaaagccttttgat

SEQ ID NO: 31288 - DNA, 16 bp, H. sapiens
agaaaagctaaaaatt

SEQ ID NO: 31289 - DNA, 16 bp, H. sapiens
agaaaagctgaaagaa

SEQ ID NO: 31290 - DNA, 16 bp, H. sapiens
agaaaagctgaacaaa

SEQ ID NO: 31291 - DNA, 16 bp, H. sapiens
agaaaagctgggaaat

SEQ ID NO: 31292 - DNA, 16 bp, H. sapiens
agaaaaggaaaaatct

SEQ ID NO: 31293 - DNA, 16 bp, H. sapiens
agaaaaggaaaaattc

SEQ ID NO: 31294 - DNA, 16 bp, H. sapiens
agaaaaggaaacactt

SEQ ID NO: 31295 - DNA, 16 bp, H. sapiens
agaaaaggaaactgag

SEQ ID NO: 31296 - DNA, 16 bp, H. sapiens
agaaaaggaaatgctt

SEQ ID NO: 31297 - DNA, 16 bp, H. sapiens
agaaaaggaaatgtta

SEQ ID NO: 31298 - DNA, 16 bp, H. sapiens
agaaaaggaaatgttt

SEQ ID NO: 31299 - DNA, 16 bp, H. sapiens
agaaaaggaaattaca

SEQ ID NO: 31300 - DNA, 16 bp, H. sapiens
agaaaaggaaatttat

SEQ ID NO: 31301 - DNA, 16 bp, H. sapiens
agaaaaggaaatttgt

SEQ ID NO: 31302 - DNA, 16 bp, H. sapiens
agaaaaggaatgtatt

SEQ ID NO: 31303 - DNA, 16 bp, H. sapiens
agaaaaggaatttgtt

SEQ ID NO: 31304 - DNA, 16 bp, H. sapiens
agaaaaggataaattc

SEQ ID NO: 31305 - DNA, 16 bp, H. sapiens
agaaaaggcagctggg

SEQ ID NO: 31306 - DNA, 16 bp, H. sapiens
agaaaaggcctctgac

SEQ ID NO: 31307 - DNA, 16 bp, H. sapiens
agaaaaggctgaagaa

SEQ ID NO: 31308 - DNA, 16 bp, H. sapiens
agaaaagggaagcctt

SEQ ID NO: 31309 - DNA, 16 bp, H. sapiens
agaaaagggaagtctt

SEQ ID NO: 31310 - DNA, 16 bp, H. sapiens
agaaaagggaatgttt

SEQ ID NO: 31311 - DNA, 16 bp, H. sapiens
agaaaagggatttaat

SEQ ID NO: 31312 - DNA, 16 bp, H. sapiens
agaaaagggccaggtg

SEQ ID NO: 31313 - DNA, 16 bp, H. sapiens
agaaaaggtacagcaa

SEQ ID NO: 31314 - DNA, 16 bp, H. sapiens
agaaaaggtcttcaat

SEQ ID NO: 31315 - DNA, 16 bp, H. sapiens
agaaaagtaaacagag

SEQ ID NO: 31316 - DNA, 16 bp, H. sapiens
agaaaagtatttcttt

SEQ ID NO: 31317 - DNA, 16 bp, H. sapiens
agaaaagtattttcaa

SEQ ID NO: 31318 - DNA, 16 bp, H. sapiens
agaaaagtccaaaata

SEQ ID NO: 31319 - DNA, 16 bp, H. sapiens
agaaaagtctccattc

SEQ ID NO: 31320 - DNA, 16 bp, H. sapiens
agaaaagtgagaacaa

SEQ ID NO: 31321 - DNA, 16 bp, H. sapiens
agaaaagtgcacaaat

SEQ ID NO: 31322 - DNA, 16 bp, H. sapiens
agaaaagtggccaggc

SEQ ID NO: 31323 - DNA, 16 bp, H. sapiens
agaaaagtgtttattt

SEQ ID NO: 31324 - DNA, 16 bp, H. sapiens
agaaaagttctccaag

SEQ ID NO: 31325 - DNA, 16 bp, H. sapiens
agaaaagttgcaagaa

SEQ ID NO: 31326 - DNA, 16 bp, H. sapiens
agaaaagttggagaag

SEQ ID NO: 31327 - DNA, 16 bp, H. sapiens
agaaaagtttcaaaaa

SEQ ID NO: 31328 - DNA, 16 bp, H. sapiens
agaaaagtttgaaaat

SEQ ID NO: 31329 - DNA, 16 bp, H. sapiens
agaaaagtttttatat

SEQ ID NO: 31330 - DNA, 16 bp, H. sapiens
agaaaataaaactgag

SEQ ID NO: 31331 - DNA, 16 bp, H. sapiens
agaaaataaaagcagg

SEQ ID NO: 31332 - DNA, 16 bp, H. sapiens
agaaaataaaagcatt

SEQ ID NO: 31333 - DNA, 16 bp, H. sapiens
agaaaataaaagttca

SEQ ID NO: 31334 - DNA, 16 bp, H. sapiens
agaaaataaaatcact

SEQ ID NO: 31335 - DNA, 16 bp, H. sapiens
agaaaataaaatctca

SEQ ID NO: 31336 - DNA, 16 bp, H. sapiens
agaaaataaaatgtca

SEQ ID NO: 31337 - DNA, 16 bp, H. sapiens
agaaaataaacattta

SEQ ID NO: 31338 - DNA, 16 bp, H. sapiens
agaaaataaacatttt

SEQ ID NO: 31339 - DNA, 16 bp, H. sapiens
agaaaataaactgttt

SEQ ID NO: 31340 - DNA, 16 bp, H. sapiens
agaaaataaacttctg

SEQ ID NO: 31341 - DNA, 16 bp, H. sapiens
agaaaataaacttgtt

SEQ ID NO: 31342 - DNA, 16 bp, H. sapiens
agaaaataaatatctg

SEQ ID NO: 31343 - DNA, 16 bp, H. sapiens
agaaaataaatatgtg

SEQ ID NO: 31344 - DNA, 16 bp, H. sapiens
agaaaataaatattca

SEQ ID NO: 31345 - DNA, 16 bp, H. sapiens
agaaaataaatgagtt

SEQ ID NO: 31346 - DNA, 16 bp, H. sapiens
agaaaataaatgcaat

SEQ ID NO: 31347 - DNA, 16 bp, H. sapiens
agaaaataaattccaa

SEQ ID NO: 31348 - DNA, 16 bp, H. sapiens
agaaaataacaagagt

SEQ ID NO: 31349 - DNA, 16 bp, H. sapiens
agaaaataacctcaaa

SEQ ID NO: 31350 - DNA, 16 bp, H. sapiens
agaaaataactttcat

SEQ ID NO: 31351 - DNA, 16 bp, H. sapiens
agaaaataagttttta

SEQ ID NO: 31352 - DNA, 16 bp, H. sapiens
agaaaataatgcattt

SEQ ID NO: 31353 - DNA, 16 bp, H. sapiens
agaaaataattcaatt

SEQ ID NO: 31354 - DNA, 16 bp, H. sapiens
agaaaataattgcaaa

SEQ ID NO: 31355 - DNA, 16 bp, H. sapiens
agaaaatacacattta

SEQ ID NO: 31356 - DNA, 16 bp, H. sapiens
agaaaatacagttaaa

SEQ ID NO: 31357 - DNA, 16 bp, H. sapiens
agaaaatacattattt

SEQ ID NO: 31358 - DNA, 16 bp, H. sapiens
agaaaatacatttact

SEQ ID NO: 31359 - DNA, 16 bp, H. sapiens
agaaaataccaaggaa

SEQ ID NO: 31360 - DNA, 16 bp, H. sapiens
agaaaatacggtacat

SEQ ID NO: 31361 - DNA, 16 bp, H. sapiens
agaaaatactagcaaa

SEQ ID NO: 31362 - DNA, 16 bp, H. sapiens
agaaaatacttccaaa

SEQ ID NO: 31363 - DNA, 16 bp, H. sapiens
agaaaatacttgaaaa

SEQ ID NO: 31364 - DNA, 16 bp, H. sapiens
agaaaatacttgcaaa

SEQ ID NO: 31365 - DNA, 16 bp, H. sapiens
agaaaatactttcaaa

SEQ ID NO: 31366 - DNA, 16 bp, H. sapiens
agaaaatagaagcaat

SEQ ID NO: 31367 - DNA, 16 bp, H. sapiens
agaaaatagagacaca

SEQ ID NO: 31368 - DNA, 16 bp, H. sapiens
agaaaatagatgtttt

SEQ ID NO: 31369 - DNA, 16 bp, H. sapiens
agaaaatagctttatt

SEQ ID NO: 31370 - DNA, 16 bp, H. sapiens
agaaaatagttcaaaa

SEQ ID NO: 31371 - DNA, 16 bp, H. sapiens
agaaaatataactgaa

SEQ ID NO: 31372 - DNA, 16 bp, H. sapiens
agaaaatatacagaat

SEQ ID NO: 31373 - DNA, 16 bp, H. sapiens
agaaaatatattaaca

SEQ ID NO: 31374 - DNA, 16 bp, H. sapiens
agaaaatatatttact

SEQ ID NO: 31375 - DNA, 16 bp, H. sapiens
agaaaatatatttcta

SEQ ID NO: 31376 - DNA, 16 bp, H. sapiens
agaaaatatcagaatt

SEQ ID NO: 31377 - DNA, 16 bp, H. sapiens
agaaaatatctgcaga

SEQ ID NO: 31378 - DNA, 16 bp, H. sapiens
agaaaatatggatgaa

SEQ ID NO: 31379 - DNA, 16 bp, H. sapiens
agaaaatatgtgaaat

SEQ ID NO: 31380 - DNA, 16 bp, H. sapiens
agaaaatatgttattt

SEQ ID NO: 31381 - DNA, 16 bp, H. sapiens
agaaaatattaataca

SEQ ID NO: 31382 - DNA, 16 bp, H. sapiens
agaaaatattatttga

SEQ ID NO: 31383 - DNA, 16 bp, H. sapiens
agaaaatattcacaat

SEQ ID NO: 31384 - DNA, 16 bp, H. sapiens
agaaaatattcatcaa

SEQ ID NO: 31385 - DNA, 16 bp, H. sapiens
agaaaatattctcaaa

SEQ ID NO: 31386 - DNA, 16 bp, H. sapiens
agaaaatattgcaaac

SEQ ID NO: 31387 - DNA, 16 bp, H. sapiens
agaaaatatttacaga

SEQ ID NO: 31388 - DNA, 16 bp, H. sapiens
agaaaatatttacagt

SEQ ID NO: 31389 - DNA, 16 bp, H. sapiens
agaaaatatttattga

SEQ ID NO: 31390 - DNA, 16 bp, H. sapiens
agaaaatatttcaaga

SEQ ID NO: 31391 - DNA, 16 bp, H. sapiens
agaaaatatttccaag

SEQ ID NO: 31392 - DNA, 16 bp, H. sapiens
agaaaatatttgaaga

SEQ ID NO: 31393 - DNA, 16 bp, H. sapiens
agaaaatatttgcaaa

SEQ ID NO: 31394 - DNA, 16 bp, H. sapiens
agaaaatatttgcaga

SEQ ID NO: 31395 - DNA, 16 bp, H. sapiens
agaaaatatttgtcaa

SEQ ID NO: 31396 - DNA, 16 bp, H. sapiens
agaaaatattttatct

SEQ ID NO: 31397 - DNA, 16 bp, H. sapiens
agaaaatattttcaga

SEQ ID NO: 31398 - DNA, 16 bp, H. sapiens
agaaaatattttccca

SEQ ID NO: 31399 - DNA, 16 bp, H. sapiens
agaaaatatttttatg

SEQ ID NO: 31400 - DNA, 16 bp, H. sapiens
agaaaatcaaaatgtt

SEQ ID NO: 31401 - DNA, 16 bp, H. sapiens
agaaaatcaaaattat

SEQ ID NO: 31402 - DNA, 16 bp, H. sapiens
agaaaatcaaatccaa

SEQ ID NO: 31403 - DNA, 16 bp, H. sapiens
agaaaatcaacaagga

SEQ ID NO: 31404 - DNA, 16 bp, H. sapiens
agaaaatcaataaatt

SEQ ID NO: 31405 - DNA, 16 bp, H. sapiens
agaaaatcacagagaa

SEQ ID NO: 31406 - DNA, 16 bp, H. sapiens
agaaaatcacattttc

SEQ ID NO: 31407 - DNA, 16 bp, H. sapiens
agaaaatcagaaggaa

SEQ ID NO: 31408 - DNA, 16 bp, H. sapiens
agaaaatcagcaaaac

SEQ ID NO: 31409 - DNA, 16 bp, H. sapiens
agaaaatcagcaaaga

SEQ ID NO: 31410 - DNA, 16 bp, H. sapiens
agaaaatcagcaagaa

SEQ ID NO: 31411 - DNA, 16 bp, H. sapiens
agaaaatcaggccagg

SEQ ID NO: 31412 - DNA, 16 bp, H. sapiens
agaaaatcatcaaaga

SEQ ID NO: 31413 - DNA, 16 bp, H. sapiens
agaaaatcattaagga

SEQ ID NO: 31414 - DNA, 16 bp, H. sapiens
agaaaatcatttttaa

SEQ ID NO: 31415 - DNA, 16 bp, H. sapiens
agaaaatccaattcaa

SEQ ID NO: 31416 - DNA, 16 bp, H. sapiens
agaaaatccagaaata

SEQ ID NO: 31417 - DNA, 16 bp, H. sapiens
agaaaatcctaaggaa

SEQ ID NO: 31418 - DNA, 31 bp, H. sapiens
agaaaatcctactgcctttctggagagacta

SEQ ID NO: 31419 - DNA, 17 bp, H. sapiens
agaaaatccttctgcct

SEQ ID NO: 31420 - DNA, 16 bp, H. sapiens
agaaaatctattttaa

SEQ ID NO: 31421 - DNA, 16 bp, H. sapiens
agaaaatctcaaagaa

SEQ ID NO: 31422 - DNA, 16 bp, H. sapiens
agaaaatctcaaggaa

SEQ ID NO: 31423 - DNA, 16 bp, H. sapiens
agaaaatctcaataaa

SEQ ID NO: 31424 - DNA, 16 bp, H. sapiens
agaaaatctgaaagaa

SEQ ID NO: 31425 - DNA, 16 bp, H. sapiens
agaaaatctgaacaaa

SEQ ID NO: 31426 - DNA, 16 bp, H. sapiens
agaaaatctgaagaaa

SEQ ID NO: 31427 - DNA, 16 bp, H. sapiens
agaaaatcttaagaaa

SEQ ID NO: 31428 - DNA, 16 bp, H. sapiens
agaaaatcttcaaaat

SEQ ID NO: 31429 - DNA, 16 bp, H. sapiens
agaaaatctttgcaaa

SEQ ID NO: 31430 - DNA, 16 bp, H. sapiens
agaaaatgaaaaccac

SEQ ID NO: 31431 - DNA, 16 bp, H. sapiens
agaaaatgaaaactga

SEQ ID NO: 31432 - DNA, 16 bp, H. sapiens
agaaaatgaaactata

SEQ ID NO: 31433 - DNA, 16 bp, H. sapiens
agaaaatgaaactgaa

SEQ ID NO: 31434 - DNA, 16 bp, H. sapiens
agaaaatgaaaggcaa

SEQ ID NO: 31435 - DNA, 16 bp, H. sapiens
agaaaatgaaagtgtt

SEQ ID NO: 31436 - DNA, 16 bp, H. sapiens
agaaaatgaaatacct

SEQ ID NO: 31437 - DNA, 16 bp, H. sapiens
agaaaatgaaatcatt

SEQ ID NO: 31438 - DNA, 16 bp, H. sapiens
agaaaatgaaattctg

SEQ ID NO: 31439 - DNA, 16 bp, H. sapiens
agaaaatgaacaatta

SEQ ID NO: 31440 - DNA, 16 bp, H. sapiens
agaaaatgaacattaa

SEQ ID NO: 31441 - DNA, 16 bp, H. sapiens
agaaaatgaagaccca

SEQ ID NO: 31442 - DNA, 16 bp, H. sapiens
agaaaatgaagatttt

SEQ ID NO: 31443 - DNA, 16 bp, H. sapiens
agaaaatgaagctcag

SEQ ID NO: 31444 - DNA, 16 bp, H. sapiens
agaaaatgaatatttt

SEQ ID NO: 31445 - DNA, 16 bp, H. sapiens
agaaaatgaatgtgaa

SEQ ID NO: 31446 - DNA, 16 bp, H. sapiens
agaaaatgaatttatt

SEQ ID NO: 31447 - DNA, 16 bp, H. sapiens
agaaaatgaatttctg

SEQ ID NO: 31448 - DNA, 16 bp, H. sapiens
agaaaatgaattttga

SEQ ID NO: 31449 - DNA, 16 bp, H. sapiens
agaaaatgactataaa

SEQ ID NO: 31450 - DNA, 16 bp, H. sapiens
agaaaatgactttatt

SEQ ID NO: 31451 - DNA, 16 bp, H. sapiens
agaaaatgagaagaca

SEQ ID NO: 31452 - DNA, 16 bp, H. sapiens
agaaaatgagaagcca

SEQ ID NO: 31453 - DNA, 16 bp, H. sapiens
agaaaatgaggaacaa

SEQ ID NO: 31454 - DNA, 16 bp, H. sapiens
agaaaatgaggaagac

SEQ ID NO: 31455 - DNA, 16 bp, H. sapiens
agaaaatgatattact

SEQ ID NO: 31456 - DNA, 16 bp, H. sapiens
agaaaatgatgaattc

SEQ ID NO: 31457 - DNA, 16 bp, H. sapiens
agaaaatgatgatgat

SEQ ID NO: 31458 - DNA, 16 bp, H. sapiens
agaaaatgatgtttat

SEQ ID NO: 31459 - DNA, 16 bp, H. sapiens
agaaaatgatttcatt

SEQ ID NO: 31460 - DNA, 16 bp, H. sapiens
agaaaatgcaaaatga

SEQ ID NO: 31461 - DNA, 16 bp, H. sapiens
agaaaatgcaaaattt

SEQ ID NO: 31462 - DNA, 16 bp, H. sapiens
agaaaatgcagaaaca

SEQ ID NO: 31463 - DNA, 16 bp, H. sapiens
agaaaatgcagtgttt

SEQ ID NO: 31464 - DNA, 16 bp, H. sapiens
agaaaatgcatgtgaa

SEQ ID NO: 31465 - DNA, 16 bp, H. sapiens
agaaaatgcattattt

SEQ ID NO: 31466 - DNA, 16 bp, H. sapiens
agaaaatgccttcaat

SEQ ID NO: 31467 - DNA, 16 bp, H. sapiens
agaaaatgctaaactg

SEQ ID NO: 31468 - DNA, 16 bp, H. sapiens
agaaaatgctattttt

SEQ ID NO: 31469 - DNA, 16 bp, H. sapiens
agaaaatgctgaaaaa

SEQ ID NO: 31470 - DNA, 16 bp, H. sapiens
agaaaatgcttttaaa

SEQ ID NO: 31471 - DNA, 16 bp, H. sapiens
agaaaatgctttttct

SEQ ID NO: 31472 - DNA, 16 bp, H. sapiens
agaaaatggaaacaga

SEQ ID NO: 31473 - DNA, 16 bp, H. sapiens
agaaaatggaaagcca

SEQ ID NO: 31474 - DNA, 16 bp, H. sapiens
agaaaatggaatgttt

SEQ ID NO: 31475 - DNA, 16 bp, H. sapiens
agaaaatggagatgga

SEQ ID NO: 31476 - DNA, 16 bp, H. sapiens
agaaaatggaggcaga

SEQ ID NO: 31477 - DNA, 16 bp, H. sapiens
agaaaatggatttgaa

SEQ ID NO: 31478 - DNA, 16 bp, H. sapiens
agaaaatggccatttc

SEQ ID NO: 31479 - DNA, 16 bp, H. sapiens
agaaaatgggctgggc

SEQ ID NO: 31480 - DNA, 16 bp, H. sapiens
agaaaatgggcttttc

SEQ ID NO: 31481 - DNA, 16 bp, H. sapiens
agaaaatggggttttc

SEQ ID NO: 31482 - DNA, 16 bp, H. sapiens
agaaaatgggttttct

SEQ ID NO: 31483 - DNA, 16 bp, H. sapiens
agaaaatgtaaagcaa

SEQ ID NO: 31484 - DNA, 16 bp, H. sapiens
agaaaatgtaacagaa

SEQ ID NO: 31485 - DNA, 16 bp, H. sapiens
agaaaatgtatggaaa

SEQ ID NO: 31486 - DNA, 16 bp, H. sapiens
agaaaatgtattttct

SEQ ID NO: 31487 - DNA, 16 bp, H. sapiens
agaaaatgtctttatt

SEQ ID NO: 31488 - DNA, 16 bp, H. sapiens
agaaaatgtcttttaa

SEQ ID NO: 31489 - DNA, 16 bp, H. sapiens
agaaaatgtgaacaaa

SEQ ID NO: 31490 - DNA, 16 bp, H. sapiens
agaaaatgtgatgtat

SEQ ID NO: 31491 - DNA, 16 bp, H. sapiens
agaaaatgtgatttat

SEQ ID NO: 31492 - DNA, 16 bp, H. sapiens
agaaaatgtgcagcct

SEQ ID NO: 31493 - DNA, 16 bp, H. sapiens
agaaaatgtgccatat

SEQ ID NO: 31494 - DNA, 16 bp, H. sapiens
agaaaatgtggaaaat

SEQ ID NO: 31495 - DNA, 16 bp, H. sapiens
agaaaatgtggcaaaa

SEQ ID NO: 31496 - DNA, 16 bp, H. sapiens
agaaaatgtggggaaa

SEQ ID NO: 31497 - DNA, 16 bp, H. sapiens
agaaaatgtggtttgt

SEQ ID NO: 31498 - DNA, 16 bp, H. sapiens
agaaaatgtgtacata

SEQ ID NO: 31499 - DNA, 16 bp, H. sapiens
agaaaatgtgtcatat

SEQ ID NO: 31500 - DNA, 16 bp, H. sapiens
agaaaatgttaaggaa

SEQ ID NO: 31501 - DNA, 16 bp, H. sapiens
agaaaatgttattttt

SEQ ID NO: 31502 - DNA, 16 bp, H. sapiens
agaaaatgttgtatat

SEQ ID NO: 31503 - DNA, 16 bp, H. sapiens
agaaaatgtttacaat

SEQ ID NO: 31504 - DNA, 16 bp, H. sapiens
agaaaatgtttacatt

SEQ ID NO: 31505 - DNA, 16 bp, H. sapiens
agaaaatgtttgttga

SEQ ID NO: 31506 - DNA, 16 bp, H. sapiens
agaaaatgttttcaga

SEQ ID NO: 31507 - DNA, 16 bp, H. sapiens
agaaaatgttttctct

SEQ ID NO: 31508 - DNA, 16 bp, H. sapiens
agaaaatgttttcttt

SEQ ID NO: 31509 - DNA, 16 bp, H. sapiens
agaaaatgttttggaa

SEQ ID NO: 31510 - DNA, 16 bp, H. sapiens
agaaaatgtttttaaa

SEQ ID NO: 31511 - DNA, 16 bp, H. sapiens
agaaaattaacaaggg

SEQ ID NO: 31512 - DNA, 16 bp, H. sapiens
agaaaattaaccattt

SEQ ID NO: 31513 - DNA, 16 bp, H. sapiens
agaaaattaatccttt

SEQ ID NO: 31514 - DNA, 16 bp, H. sapiens
agaaaattaggccagg

SEQ ID NO: 31515 - DNA, 16 bp, H. sapiens
agaaaattatcaagga

SEQ ID NO: 31516 - DNA, 16 bp, H. sapiens
agaaaattatctttct

SEQ ID NO: 31517 - DNA, 16 bp, H. sapiens
agaaaattatttcaga

SEQ ID NO: 31518 - DNA, 16 bp, H. sapiens
agaaaattcaaaagga

SEQ ID NO: 31519 - DNA, 16 bp, H. sapiens
agaaaattcaaataag

SEQ ID NO: 31520 - DNA, 16 bp, H. sapiens
agaaaattcaagagaa

SEQ ID NO: 31521 - DNA, 16 bp, H. sapiens
agaaaattcacaaaga

SEQ ID NO: 31522 - DNA, 16 bp, H. sapiens
agaaaattcagaaaga

SEQ ID NO: 31523 - DNA, 16 bp, H. sapiens
agaaaattcagaaatt

SEQ ID NO: 31524 - DNA, 16 bp, H. sapiens
agaaaattcagaagaa

SEQ ID NO: 31525 - DNA, 16 bp, H. sapiens
agaaaattcagataaa

SEQ ID NO: 31526 - DNA, 16 bp, H. sapiens
agaaaattccaaagaa

SEQ ID NO: 31527 - DNA, 16 bp, H. sapiens
agaaaattctcatttt

SEQ ID NO: 31528 - DNA, 16 bp, H. sapiens
agaaaattctgtttct

SEQ ID NO: 31529 - DNA, 16 bp, H. sapiens
agaaaattctttgcga

SEQ ID NO: 31530 - DNA, 16 bp, H. sapiens
agaaaattgaaaacat

SEQ ID NO: 31531 - DNA, 16 bp, H. sapiens
agaaaattgaaatcat

SEQ ID NO: 31532 - DNA, 16 bp, H. sapiens
agaaaattgaatcata

SEQ ID NO: 31533 - DNA, 16 bp, H. sapiens
agaaaattgccatttt

SEQ ID NO: 31534 - DNA, 16 bp, H. sapiens
agaaaatttcaactct

SEQ ID NO: 31535 - DNA, 16 bp, H. sapiens
agaaaatttggaaaat

SEQ ID NO: 31536 - DNA, 16 bp, H. sapiens
agaaaatttggcaaaa

SEQ ID NO: 31537 - DNA, 16 bp, H. sapiens
agaaaattttaaggaa

SEQ ID NO: 31538 - DNA, 16 bp, H. sapiens
agaaaattttcaaaga

SEQ ID NO: 31539 - DNA, 16 bp, H. sapiens
agaaaattttcctttt

SEQ ID NO: 31540 - DNA, 16 bp, H. sapiens
agaaaattttgaagaa

SEQ ID NO: 31541 - DNA, 16 bp, H. sapiens
agaaacaaaaatattt

SEQ ID NO: 31542 - DNA, 16 bp, H. sapiens
agaaacaaaaattagc

SEQ ID NO: 31543 - DNA, 16 bp, H. sapiens
agaaacaaaaattatg

SEQ ID NO: 31544 - DNA, 16 bp, H. sapiens
agaaacaaaagctgag

SEQ ID NO: 31545 - DNA, 16 bp, H. sapiens
agaaacaaaaggcatt

SEQ ID NO: 31546 - DNA, 16 bp, H. sapiens
agaaacaaaatcttaa

SEQ ID NO: 31547 - DNA, 16 bp, H. sapiens
agaaacaaaatgagat

SEQ ID NO: 31548 - DNA, 16 bp, H. sapiens
agaaacaaaatgtatt

SEQ ID NO: 31549 - DNA, 16 bp, H. sapiens
agaaacaaacattttt

SEQ ID NO: 31550 - DNA, 16 bp, H. sapiens
agaaacaaactctgga

SEQ ID NO: 31551 - DNA, 16 bp, H. sapiens
agaaacaaagaatgca

SEQ ID NO: 31552 - DNA, 16 bp, H. sapiens
agaaacaaagtcaaat

SEQ ID NO: 31553 - DNA, 16 bp, H. sapiens
agaaacaaatcaaatg

SEQ ID NO: 31554 - DNA, 16 bp, H. sapiens
agaaacaaatttctat

SEQ ID NO: 31555 - DNA, 16 bp, H. sapiens
agaaacaaatttttat

SEQ ID NO: 31556 - DNA, 16 bp, H. sapiens
agaaacaacagatgat

SEQ ID NO: 31557 - DNA, 16 bp, H. sapiens
agaaacaagcaaagcc

SEQ ID NO: 31558 - DNA, 16 bp, H. sapiens
agaaacaattttattt

SEQ ID NO: 31559 - DNA, 16 bp, H. sapiens
agaaacaattttgaaa

SEQ ID NO: 31560 - DNA, 16 bp, H. sapiens
agaaacacaaaaccta

SEQ ID NO: 31561 - DNA, 16 bp, H. sapiens
agaaacacacagagag

SEQ ID NO: 31562 - DNA, 19 bp, H. sapiens
agaaacacccacaggtgtg

SEQ ID NO: 31563 - DNA, 16 bp, H. sapiens
agaaacaccctcacag

SEQ ID NO: 31564 - DNA, 16 bp, H. sapiens
agaaacactgaaaaat

SEQ ID NO: 31565 - DNA, 16 bp, H. sapiens
agaaacagaaaagagt

SEQ ID NO: 31566 - DNA, 16 bp, H. sapiens
agaaacagaaaattat

SEQ ID NO: 31567 - DNA, 16 bp, H. sapiens
agaaacagaaacacat

SEQ ID NO: 31568 - DNA, 16 bp, H. sapiens
agaaacagaaagaatg

SEQ ID NO: 31569 - DNA, 16 bp, H. sapiens
agaaacagaaagtaca

SEQ ID NO: 31570 - DNA, 16 bp, H. sapiens
agaaacagaaagtcaa

SEQ ID NO: 31571 - DNA, 16 bp, H. sapiens
agaaacagaaagtgaa

SEQ ID NO: 31572 - DNA, 16 bp, H. sapiens
agaaacagaaagtgga

SEQ ID NO: 31573 - DNA, 16 bp, H. sapiens
agaaacagaaatatat

SEQ ID NO: 31574 - DNA, 16 bp, H. sapiens
agaaacagaaatctct

SEQ ID NO: 31575 - DNA, 16 bp, H. sapiens
agaaacagaaatgctt

SEQ ID NO: 31576 - DNA, 16 bp, H. sapiens
agaaacagaaattcta

SEQ ID NO: 31577 - DNA, 16 bp, H. sapiens
agaaacagaaattttg

SEQ ID NO: 31578 - DNA, 16 bp, H. sapiens
agaaacagaactaaag

SEQ ID NO: 31579 - DNA, 16 bp, H. sapiens
agaaacagaatatttt

SEQ ID NO: 31580 - DNA, 16 bp, H. sapiens
agaaacagactggcaa

SEQ ID NO: 31581 - DNA, 16 bp, H. sapiens
agaaacagagaaaatg

SEQ ID NO: 31582 - DNA, 16 bp, H. sapiens
agaaacagagagaatg

SEQ ID NO: 31583 - DNA, 16 bp, H. sapiens
agaaacagagtttcac

SEQ ID NO: 31584 - DNA, 16 bp, H. sapiens
agaaacagcagatgct

SEQ ID NO: 31585 - DNA, 16 bp, H. sapiens
agaaacaggaagtcaa

SEQ ID NO: 31586 - DNA, 16 bp, H. sapiens
agaaacaggcaaagat

SEQ ID NO: 31587 - DNA, 16 bp, H. sapiens
agaaacagggtttctc

SEQ ID NO: 31588 - DNA, 16 bp, H. sapiens
agaaacagtgaaaata

SEQ ID NO: 31589 - DNA, 16 bp, H. sapiens
agaaacagttttgttt

SEQ ID NO: 31590 - DNA, 16 bp, H. sapiens
agaaacatatttttca

SEQ ID NO: 31591 - DNA, 16 bp, H. sapiens
agaaacatcagaagca

SEQ ID NO: 31592 - DNA, 16 bp, H. sapiens
agaaacatccagaata

SEQ ID NO: 31593 - DNA, 16 bp, H. sapiens
agaaacatgcccctct

SEQ ID NO: 31594 - DNA, 16 bp, H. sapiens
agaaacattcagacca

SEQ ID NO: 31595 - DNA, 16 bp, H. sapiens
agaaacattctacaaa

SEQ ID NO: 31596 - DNA, 16 bp, H. sapiens
agaaacatttaaaaag

SEQ ID NO: 31597 - DNA, 16 bp, H. sapiens
agaaacatttatttct

SEQ ID NO: 31598 - DNA, 16 bp, H. sapiens
agaaacatttctcaaa

SEQ ID NO: 31599 - DNA, 16 bp, H. sapiens
agaaacattttaaaaa

SEQ ID NO: 31600 - DNA, 16 bp, H. sapiens
agaaacattttatata

SEQ ID NO: 31601 - DNA, 16 bp, H. sapiens
agaaacatttttaaag

SEQ ID NO: 31602 - DNA, 16 bp, H. sapiens
agaaacatttttcaaa

SEQ ID NO: 31603 - DNA, 16 bp, H. sapiens
agaaacatttttggtt

SEQ ID NO: 31604 - DNA, 16 bp, H. sapiens
agaaacattttttaaa

SEQ ID NO: 31605 - DNA, 16 bp, H. sapiens
agaaacattttttttt

SEQ ID NO: 31606 - DNA, 16 bp, H. sapiens
agaaaccaaatggaaa

SEQ ID NO: 31607 - DNA, 16 bp, H. sapiens
agaaaccaaggctcag

SEQ ID NO: 31608 - DNA, 16 bp, H. sapiens
agaaaccacaattact

SEQ ID NO: 31609 - DNA, 16 bp, H. sapiens
agaaaccagccctttt

SEQ ID NO: 31610 - DNA, 16 bp, H. sapiens
agaaaccagcctgggc

SEQ ID NO: 31611 - DNA, 16 bp, H. sapiens
agaaaccaggtcattt

SEQ ID NO: 31612 - DNA, 16 bp, H. sapiens
agaaaccagtgcaaaa

SEQ ID NO: 31613 - DNA, 16 bp, H. sapiens
agaaaccattgcctaa

SEQ ID NO: 31614 - DNA, 16 bp, H. sapiens
agaaacccacagctaa

SEQ ID NO: 31615 - DNA, 25 bp, H. sapiens
agaaaccccatctctactaaaaaca

SEQ ID NO: 31616 - DNA, 17 bp, H. sapiens
agaaaccccatctctat

SEQ ID NO: 31617 - DNA, 18 bp, H. sapiens
agaaaccccatttctact

SEQ ID NO: 31618 - DNA, 18 bp, H. sapiens
agaaaccccgtctctacc

SEQ ID NO: 31619 - DNA, 22 bp, H. sapiens
agaaaccccgtctctactaaaa

SEQ ID NO: 31620 - DNA, 22 bp, H. sapiens
agaaaccccgtgtctactaaaa

SEQ ID NO: 31621 - DNA, 17 bp, H. sapiens
agaaaccctacaaatgt

SEQ ID NO: 31622 - DNA, 16 bp, H. sapiens
agaaaccgaggctcag

SEQ ID NO: 31623 - DNA, 16 bp, H. sapiens
agaaacctccaaaact

SEQ ID NO: 31624 - DNA, 16 bp, H. sapiens
agaaacctggatggaa

SEQ ID NO: 31625 - DNA, 16 bp, H. sapiens
agaaaccttacaggtc

SEQ ID NO: 31626 - DNA, 16 bp, H. sapiens
agaaactaaagaagac

SEQ ID NO: 31627 - DNA, 16 bp, H. sapiens
agaaactaacaaagcc

SEQ ID NO: 31628 - DNA, 17 bp, H. sapiens
agaaactaccatcaggg

SEQ ID NO: 31629 - DNA, 16 bp, H. sapiens
agaaactactttctga

SEQ ID NO: 31630 - DNA, 16 bp, H. sapiens
agaaactagaaccctt

SEQ ID NO: 31631 - DNA, 16 bp, H. sapiens
agaaactattgcttct

SEQ ID NO: 31632 - DNA, 16 bp, H. sapiens
agaaactatttgcaaa

SEQ ID NO: 31633 - DNA, 16 bp, H. sapiens
agaaactatttttatt

SEQ ID NO: 31634 - DNA, 16 bp, H. sapiens
agaaactatttttttt

SEQ ID NO: 31635 - DNA, 16 bp, H. sapiens
agaaactcaaagcttt

SEQ ID NO: 31636 - DNA, 16 bp, H. sapiens
agaaactcaagaaaat

SEQ ID NO: 31637 - DNA, 16 bp, H. sapiens
agaaactcactttaga

SEQ ID NO: 31638 - DNA, 16 bp, H. sapiens
agaaactcagagagct

SEQ ID NO: 31639 - DNA, 16 bp, H. sapiens
agaaactccagaaagt

SEQ ID NO: 31640 - DNA, 16 bp, H. sapiens
agaaactccatctcca

SEQ ID NO: 31641 - DNA, 16 bp, H. sapiens
agaaactctacaaacc

SEQ ID NO: 31642 - DNA, 16 bp, H. sapiens
agaaactctctcaaaa

SEQ ID NO: 31643 - DNA, 16 bp, H. sapiens
agaaactctgaggatg

SEQ ID NO: 31644 - DNA, 16 bp, H. sapiens
agaaactctggaaaca

SEQ ID NO: 31645 - DNA, 16 bp, H. sapiens
agaaactctggacaca

SEQ ID NO: 31646 - DNA, 16 bp, H. sapiens
agaaactgaaaatcaa

SEQ ID NO: 31647 - DNA, 16 bp, H. sapiens
agaaactgaaactgga

SEQ ID NO: 31648 - DNA, 16 bp, H. sapiens
agaaactgaaagaaag

SEQ ID NO: 31649 - DNA, 16 bp, H. sapiens
agaaactgaaatttaa

SEQ ID NO: 31650 - DNA, 16 bp, H. sapiens
agaaactgaagaaaat

SEQ ID NO: 31651 - DNA, 16 bp, H. sapiens
agaaactgaaggaaaa

SEQ ID NO: 31652 - DNA, 16 bp, H. sapiens
agaaactgaattttaa

SEQ ID NO: 31653 - DNA, 16 bp, H. sapiens
agaaactgacatttaa

SEQ ID NO: 31654 - DNA, 16 bp, H. sapiens
agaaactgagacagag

SEQ ID NO: 31655 - DNA, 16 bp, H. sapiens
agaaactgaggaaaag

SEQ ID NO: 31656 - DNA, 16 bp, H. sapiens
agaaactgaggcacaa

SEQ ID NO: 31657 - DNA, 16 bp, H. sapiens
agaaactgaggcccag

SEQ ID NO: 31658 - DNA, 17 bp, H. sapiens
agaaactgaggcccaga

SEQ ID NO: 31659 - DNA, 16 bp, H. sapiens
agaaactgaggctcag

SEQ ID NO: 31660 - DNA, 16 bp, H. sapiens
agaaactgaggctggg

SEQ ID NO: 31661 - DNA, 16 bp, H. sapiens
agaaactgcaaaagga

SEQ ID NO: 31662 - DNA, 16 bp, H. sapiens
agaaactgcagaagaa

SEQ ID NO: 31663 - DNA, 16 bp, H. sapiens
agaaactgcagcaact

SEQ ID NO: 31664 - DNA, 16 bp, H. sapiens
agaaactgcatcaaca

SEQ ID NO: 31665 - DNA, 16 bp, H. sapiens
agaaactgcattttaa

SEQ ID NO: 31666 - DNA, 16 bp, H. sapiens
agaaactgccaaattt

SEQ ID NO: 31667 - DNA, 16 bp, H. sapiens
agaaactgccttgtga

SEQ ID NO: 31668 - DNA, 16 bp, H. sapiens
agaaactgcttgggtg

SEQ ID NO: 31669 - DNA, 16 bp, H. sapiens
agaaactggaaccctt

SEQ ID NO: 31670 - DNA, 16 bp, H. sapiens
agaaactggaagaaaa

SEQ ID NO: 31671 - DNA, 16 bp, H. sapiens
agaaactggaaggaaa

SEQ ID NO: 31672 - DNA, 16 bp, H. sapiens
agaaactggaattctc

SEQ ID NO: 31673 - DNA, 16 bp, H. sapiens
agaaactggagagaga

SEQ ID NO: 31674 - DNA, 16 bp, H. sapiens
agaaactggccaaaac

SEQ ID NO: 31675 - DNA, 16 bp, H. sapiens
agaaactggttgtttt

SEQ ID NO: 31676 - DNA, 16 bp, H. sapiens
agaaactgtctctact

SEQ ID NO: 31677 - DNA, 16 bp, H. sapiens
agaaacttaaaataat

SEQ ID NO: 31678 - DNA, 16 bp, H. sapiens
agaaacttaaacaatt

SEQ ID NO: 31679 - DNA, 16 bp, H. sapiens
agaaacttaacaagga

SEQ ID NO: 31680 - DNA, 16 bp, H. sapiens
agaaacttatttctca

SEQ ID NO: 31681 - DNA, 16 bp, H. sapiens
agaaacttcaaataaa

SEQ ID NO: 31682 - DNA, 16 bp, H. sapiens
agaaacttctcctgca

SEQ ID NO: 31683 - DNA, 16 bp, H. sapiens
agaaacttgaagaaaa

SEQ ID NO: 31684 - DNA, 16 bp, H. sapiens
agaaactttacaaata

SEQ ID NO: 31685 - DNA, 16 bp, H. sapiens
agaaactttatgtcta

SEQ ID NO: 31686 - DNA, 16 bp, H. sapiens
agaaactttcaactct

SEQ ID NO: 31687 - DNA, 16 bp, H. sapiens
agaaactttgttttct

SEQ ID NO: 31688 - DNA, 16 bp, H. sapiens
agaaacttttcagttt

SEQ ID NO: 31689 - DNA, 16 bp, H. sapiens
agaaacttttcttaaa

SEQ ID NO: 31690 - DNA, 16 bp, H. sapiens
agaaacttttcttttt

SEQ ID NO: 31691 - DNA, 16 bp, H. sapiens
agaaactttttaaaaa

SEQ ID NO: 31692 - DNA, 16 bp, H. sapiens
agaaagaaaaacagtt

SEQ ID NO: 31693 - DNA, 16 bp, H. sapiens
agaaagaaaaactgag

SEQ ID NO: 31694 - DNA, 16 bp, H. sapiens
agaaagaaaaatcagt

SEQ ID NO: 31695 - DNA, 16 bp, H. sapiens
agaaagaaaaatctct

SEQ ID NO: 31696 - DNA, 16 bp, H. sapiens
agaaagaaaaatcttt

SEQ ID NO: 31697 - DNA, 16 bp, H. sapiens
agaaagaaaaatgttt

SEQ ID NO: 31698 - DNA, 16 bp, H. sapiens
agaaagaaaaattagc

SEQ ID NO: 31699 - DNA, 16 bp, H. sapiens
agaaagaaaaattttg

SEQ ID NO: 31700 - DNA, 16 bp, H. sapiens
agaaagaaaactgttt

SEQ ID NO: 31701 - DNA, 16 bp, H. sapiens
agaaagaaaagagtca

SEQ ID NO: 31702 - DNA, 16 bp, H. sapiens
agaaagaaaaggcatc

SEQ ID NO: 31703 - DNA, 16 bp, H. sapiens
agaaagaaaatctcca

SEQ ID NO: 31704 - DNA, 16 bp, H. sapiens
agaaagaaaatctgaa

SEQ ID NO: 31705 - DNA, 16 bp, H. sapiens
agaaagaaaatgactt

SEQ ID NO: 31706 - DNA, 16 bp, H. sapiens
agaaagaaaatgtctg

SEQ ID NO: 31707 - DNA, 16 bp, H. sapiens
agaaagaaaatgtggc

SEQ ID NO: 31708 - DNA, 16 bp, H. sapiens
agaaagaaaatttctt

SEQ ID NO: 31709 - DNA, 16 bp, H. sapiens
agaaagaaagaaatct

SEQ ID NO: 31710 - DNA, 16 bp, H. sapiens
agaaagaaagaacact

SEQ ID NO: 31711 - DNA, 16 bp, H. sapiens
agaaagaaagcattta

SEQ ID NO: 31712 - DNA, 16 bp, H. sapiens
agaaagaaaggagtca

SEQ ID NO: 31713 - DNA, 16 bp, H. sapiens
agaaagaaaggctggg

SEQ ID NO: 31714 - DNA, 16 bp, H. sapiens
agaaagaaaggtcagg

SEQ ID NO: 31715 - DNA, 16 bp, H. sapiens
agaaagaaagtatttt

SEQ ID NO: 31716 - DNA, 16 bp, H. sapiens
agaaagaaagtcaaca

SEQ ID NO: 31717 - DNA, 16 bp, H. sapiens
agaaagaaataaacct

SEQ ID NO: 31718 - DNA, 16 bp, H. sapiens
agaaagaaataacagg

SEQ ID NO: 31719 - DNA, 16 bp, H. sapiens
agaaagaaatgaaggc

SEQ ID NO: 31720 - DNA, 16 bp, H. sapiens
agaaagaaatgcagcc

SEQ ID NO: 31721 - DNA, 16 bp, H. sapiens
agaaagaaatggtatt

SEQ ID NO: 31722 - DNA, 16 bp, H. sapiens
agaaagaaatgtttaa

SEQ ID NO: 31723 - DNA, 16 bp, H. sapiens
agaaagaaattcagaa

SEQ ID NO: 31724 - DNA, 16 bp, H. sapiens
agaaagaaatttcttc

SEQ ID NO: 31725 - DNA, 16 bp, H. sapiens
agaaagaaatttgaag

SEQ ID NO: 31726 - DNA, 16 bp, H. sapiens
agaaagaacagtgggc

SEQ ID NO: 31727 - DNA, 16 bp, H. sapiens
agaaagaacatttgaa

SEQ ID NO: 31728 - DNA, 16 bp, H. sapiens
agaaagaacattttat

SEQ ID NO: 31729 - DNA, 16 bp, H. sapiens
agaaagaacttcagaa

SEQ ID NO: 31730 - DNA, 16 bp, H. sapiens
agaaagaagaaattca

SEQ ID NO: 31731 - DNA, 16 bp, H. sapiens
agaaagaagaaattct

SEQ ID NO: 31732 - DNA, 16 bp, H. sapiens
agaaagaagctctctg

SEQ ID NO: 31733 - DNA, 16 bp, H. sapiens
agaaagaaggaaatca

SEQ ID NO: 31734 - DNA, 16 bp, H. sapiens
agaaagaaggaattct

SEQ ID NO: 31735 - DNA, 16 bp, H. sapiens
agaaagaaggccctgg

SEQ ID NO: 31736 - DNA, 16 bp, H. sapiens
agaaagaagttaaatt

SEQ ID NO: 31737 - DNA, 16 bp, H. sapiens
agaaagaagttgaatc

SEQ ID NO: 31738 - DNA, 16 bp, H. sapiens
agaaagaataaagcat

SEQ ID NO: 31739 - DNA, 16 bp, H. sapiens
agaaagaatagtcttt

SEQ ID NO: 31740 - DNA, 16 bp, H. sapiens
agaaagaatcttaaga

SEQ ID NO: 31741 - DNA, 16 bp, H. sapiens
agaaagaatgaatcaa

SEQ ID NO: 31742 - DNA, 16 bp, H. sapiens
agaaagaattcaaggc

SEQ ID NO: 31743 - DNA, 16 bp, H. sapiens
agaaagaattcagaat

SEQ ID NO: 31744 - DNA, 16 bp, H. sapiens
agaaagaattcagagt

SEQ ID NO: 31745 - DNA, 16 bp, H. sapiens
agaaagaatttcaaag

SEQ ID NO: 31746 - DNA, 16 bp, H. sapiens
agaaagacaaacatcg

SEQ ID NO: 31747 - DNA, 16 bp, H. sapiens
agaaagacaaacttca

SEQ ID NO: 31748 - DNA, 16 bp, H. sapiens
agaaagacaaacttct

SEQ ID NO: 31749 - DNA, 16 bp, H. sapiens
agaaagacaaatgctg

SEQ ID NO: 31750 - DNA, 16 bp, H. sapiens
agaaagacaaggaaat

SEQ ID NO: 31751 - DNA, 16 bp, H. sapiens
agaaagacagaaatag

SEQ ID NO: 31752 - DNA, 16 bp, H. sapiens
agaaagacaggcagag

SEQ ID NO: 31753 - DNA, 16 bp, H. sapiens
agaaagaccagaaata

SEQ ID NO: 31754 - DNA, 16 bp, H. sapiens
agaaagaccctatctc

SEQ ID NO: 31755 - DNA, 16 bp, H. sapiens
agaaagacctgggttc

SEQ ID NO: 31756 - DNA, 16 bp, H. sapiens
agaaagaccttgtctc

SEQ ID NO: 31757 - DNA, 16 bp, H. sapiens
agaaagactcagtgac

SEQ ID NO: 31758 - DNA, 16 bp, H. sapiens
agaaagactgagagag

SEQ ID NO: 31759 - DNA, 16 bp, H. sapiens
agaaagagaaaagctc

SEQ ID NO: 31760 - DNA, 16 bp, H. sapiens
agaaagagaaatcaga

SEQ ID NO: 31761 - DNA, 16 bp, H. sapiens
agaaagagaactgaaa

SEQ ID NO: 31762 - DNA, 16 bp, H. sapiens
agaaagagatcctgtc

SEQ ID NO: 31763 - DNA, 16 bp, H. sapiens
agaaagagcatcagga

SEQ ID NO: 31764 - DNA, 16 bp, H. sapiens
agaaagagtacaaaga

SEQ ID NO: 31765 - DNA, 16 bp, H. sapiens
agaaagagtttgctga

SEQ ID NO: 31766 - DNA, 16 bp, H. sapiens
agaaagatatctggaa

SEQ ID NO: 31767 - DNA, 16 bp, H. sapiens
agaaagatcacaaatt

SEQ ID NO: 31768 - DNA, 16 bp, H. sapiens
agaaagatcattcatt

SEQ ID NO: 31769 - DNA, 16 bp, H. sapiens
agaaagatgatttcca

SEQ ID NO: 31770 - DNA, 16 bp, H. sapiens
agaaagatgtaggctt

SEQ ID NO: 31771 - DNA, 16 bp, H. sapiens
agaaagatgttgaaat

SEQ ID NO: 31772 - DNA, 16 bp, H. sapiens
agaaagatgtttttaa

SEQ ID NO: 31773 - DNA, 16 bp, H. sapiens
agaaagatttaaaatg

SEQ ID NO: 31774 - DNA, 16 bp, H. sapiens
agaaagcaaaatatct

SEQ ID NO: 31775 - DNA, 16 bp, H. sapiens
agaaagcaaaatattt

SEQ ID NO: 31776 - DNA, 16 bp, H. sapiens
agaaagcaaacaactt

SEQ ID NO: 31777 - DNA, 16 bp, H. sapiens
agaaagcaagcaagca

SEQ ID NO: 31778 - DNA, 16 bp, H. sapiens
agaaagcaagcagact

SEQ ID NO: 31779 - DNA, 16 bp, H. sapiens
agaaagcaatgaaatt

SEQ ID NO: 31780 - DNA, 16 bp, H. sapiens
agaaagcagaaaacat

SEQ ID NO: 31781 - DNA, 16 bp, H. sapiens
agaaagcagaagaaat

SEQ ID NO: 31782 - DNA, 16 bp, H. sapiens
agaaagcagccaggat

SEQ ID NO: 31783 - DNA, 16 bp, H. sapiens
agaaagcagcctgaaa

SEQ ID NO: 31784 - DNA, 16 bp, H. sapiens
agaaagcaggaaacat

SEQ ID NO: 31785 - DNA, 16 bp, H. sapiens
agaaagcaggaaagct

SEQ ID NO: 31786 - DNA, 16 bp, H. sapiens
agaaagcaggagagat

SEQ ID NO: 31787 - DNA, 16 bp, H. sapiens
agaaagcattcattct

SEQ ID NO: 31788 - DNA, 16 bp, H. sapiens
agaaagcatttgacaa

SEQ ID NO: 31789 - DNA, 16 bp, H. sapiens
agaaagcatttttaaa

SEQ ID NO: 31790 - DNA, 16 bp, H. sapiens
agaaagccaaatacca

SEQ ID NO: 31791 - DNA, 16 bp, H. sapiens
agaaagccaataccca

SEQ ID NO: 31792 - DNA, 16 bp, H. sapiens
agaaagccaggcatgg

SEQ ID NO: 31793 - DNA, 16 bp, H. sapiens
agaaagccctttccca

SEQ ID NO: 31794 - DNA, 16 bp, H. sapiens
agaaagctcagaaaaa

SEQ ID NO: 31795 - DNA, 16 bp, H. sapiens
agaaagctcagaaata

SEQ ID NO: 31796 - DNA, 17 bp, H. sapiens
agaaagctcgtgaagta

SEQ ID NO: 31797 - DNA, 16 bp, H. sapiens
agaaagctctattgga

SEQ ID NO: 31798 - DNA, 16 bp, H. sapiens
agaaagctgaaagtgg

SEQ ID NO: 31799 - DNA, 16 bp, H. sapiens
agaaagctgaacctgg

SEQ ID NO: 31800 - DNA, 16 bp, H. sapiens
agaaagctgctttcta

SEQ ID NO: 31801 - DNA, 16 bp, H. sapiens
agaaagcttctgtgta

SEQ ID NO: 31802 - DNA, 16 bp, H. sapiens
agaaagcttgcaatta

SEQ ID NO: 31803 - DNA, 16 bp, H. sapiens
agaaagcttttaatgt

SEQ ID NO: 31804 - DNA, 16 bp, H. sapiens
agaaaggaaaatccaa

SEQ ID NO: 31805 - DNA, 16 bp, H. sapiens
agaaaggaaagtcaca

SEQ ID NO: 31806 - DNA, 16 bp, H. sapiens
agaaaggaagaaactg

SEQ ID NO: 31807 - DNA, 16 bp, H. sapiens
agaaaggaagtcagta

SEQ ID NO: 31808 - DNA, 16 bp, H. sapiens
agaaaggaatggaatg

SEQ ID NO: 31809 - DNA, 16 bp, H. sapiens
agaaaggactcattcc

SEQ ID NO: 31810 - DNA, 16 bp, H. sapiens
agaaaggagaacagct

SEQ ID NO: 31811 - DNA, 16 bp, H. sapiens
agaaaggagctttctg

SEQ ID NO: 31812 - DNA, 16 bp, H. sapiens
agaaaggattccagaa

SEQ ID NO: 31813 - DNA, 16 bp, H. sapiens
agaaaggcagcagcct

SEQ ID NO: 31814 - DNA, 16 bp, H. sapiens
agaaaggcctggaaca

SEQ ID NO: 31815 - DNA, 16 bp, H. sapiens
agaaaggctgggaaat

SEQ ID NO: 31816 - DNA, 16 bp, H. sapiens
agaaagggaaactgaa

SEQ ID NO: 31817 - DNA, 16 bp, H. sapiens
agaaagggcaaccaca

SEQ ID NO: 31818 - DNA, 16 bp, H. sapiens
agaaaggggtccagct

SEQ ID NO: 31819 - DNA, 16 bp, H. sapiens
agaaaggttcaattct

SEQ ID NO: 31820 - DNA, 16 bp, H. sapiens
agaaaggttcatctct

SEQ ID NO: 31821 - DNA, 16 bp, H. sapiens
agaaaggttttttaaa

SEQ ID NO: 31822 - DNA, 16 bp, H. sapiens
agaaagtaaatttcaa

SEQ ID NO: 31823 - DNA, 16 bp, H. sapiens
agaaagtactcaaaaa

SEQ ID NO: 31824 - DNA, 17 bp, H. sapiens
agaaagtacttcccatg

SEQ ID NO: 31825 - DNA, 16 bp, H. sapiens
agaaagtagaatgctg

SEQ ID NO: 31826 - DNA, 16 bp, H. sapiens
agaaagtataaggagg

SEQ ID NO: 31827 - DNA, 16 bp, H. sapiens
agaaagtatttcaaaa

SEQ ID NO: 31828 - DNA, 16 bp, H. sapiens
agaaagtatttcaaga

SEQ ID NO: 31829 - DNA, 16 bp, H. sapiens
agaaagtattttttta

SEQ ID NO: 31830 - DNA, 16 bp, H. sapiens
agaaagtcaacaagca

SEQ ID NO: 31831 - DNA, 16 bp, H. sapiens
agaaagtcagagaaag

SEQ ID NO: 31832 - DNA, 16 bp, H. sapiens
agaaagtcagtatgga

SEQ ID NO: 31833 - DNA, 18 bp, H. sapiens
agaaagtccttggtagct

SEQ ID NO: 31834 - DNA, 16 bp, H. sapiens
agaaagtgaaaaagca

SEQ ID NO: 31835 - DNA, 16 bp, H. sapiens
agaaagtgatttcttg

SEQ ID NO: 31836 - DNA, 16 bp, H. sapiens
agaaagtggcagagct

SEQ ID NO: 31837 - DNA, 16 bp, H. sapiens
agaaagtggctcaaat

SEQ ID NO: 31838 - DNA, 16 bp, H. sapiens
agaaagtgtattcaaa

SEQ ID NO: 31839 - DNA, 16 bp, H. sapiens
agaaagtgtttttata

SEQ ID NO: 31840 - DNA, 16 bp, H. sapiens
agaaagttctattaga

SEQ ID NO: 31841 - DNA, 16 bp, H. sapiens
agaaagttctattgga

SEQ ID NO: 31842 - DNA, 16 bp, H. sapiens
agaaagttgaatggtg

SEQ ID NO: 31843 - DNA, 16 bp, H. sapiens
agaaagtttatttaaa

SEQ ID NO: 31844 - DNA, 16 bp, H. sapiens
agaaagtttccttcta

SEQ ID NO: 31845 - DNA, 16 bp, H. sapiens
agaaagtttctttcta

SEQ ID NO: 31846 - DNA, 16 bp, H. sapiens
agaaagtttgaatggt

SEQ ID NO: 31847 - DNA, 16 bp, H. sapiens
agaaagttttaaaatt

SEQ ID NO: 31848 - DNA, 16 bp, H. sapiens
agaaagttttagaaaa

SEQ ID NO: 31849 - DNA, 16 bp, H. sapiens
agaaataaaaacttac

SEQ ID NO: 31850 - DNA, 16 bp, H. sapiens
agaaataaaacaggag

SEQ ID NO: 31851 - DNA, 16 bp, H. sapiens
agaaataaaacattct

SEQ ID NO: 31852 - DNA, 16 bp, H. sapiens
agaaataaaaccatct

SEQ ID NO: 31853 - DNA, 16 bp, H. sapiens
agaaataaaactaatt

SEQ ID NO: 31854 - DNA, 16 bp, H. sapiens
agaaataaaactgatt

SEQ ID NO: 31855 - DNA, 16 bp, H. sapiens
agaaataaaagacatt

SEQ ID NO: 31856 - DNA, 16 bp, H. sapiens
agaaataaaagcagca

SEQ ID NO: 31857 - DNA, 16 bp, H. sapiens
agaaataaaagcatca

SEQ ID NO: 31858 - DNA, 16 bp, H. sapiens
agaaataaaatacttc

SEQ ID NO: 31859 - DNA, 16 bp, H. sapiens
agaaataaaatctctg

SEQ ID NO: 31860 - DNA, 16 bp, H. sapiens
agaaataaaatctttt

SEQ ID NO: 31861 - DNA, 16 bp, H. sapiens
agaaataaacaattcc

SEQ ID NO: 31862 - DNA, 16 bp, H. sapiens
agaaataaaccttcac

SEQ ID NO: 31863 - DNA, 16 bp, H. sapiens
agaaataaacttccat

SEQ ID NO: 31864 - DNA, 16 bp, H. sapiens
agaaataaagacattc

SEQ ID NO: 31865 - DNA, 16 bp, H. sapiens
agaaataaagagcacc

SEQ ID NO: 31866 - DNA, 16 bp, H. sapiens
agaaataaagatattc

SEQ ID NO: 31867 - DNA, 16 bp, H. sapiens
agaaataaagatcaga

SEQ ID NO: 31868 - DNA, 16 bp, H. sapiens
agaaataaagatctca

SEQ ID NO: 31869 - DNA, 16 bp, H. sapiens
agaaataaagatgtta

SEQ ID NO: 31870 - DNA, 16 bp, H. sapiens
agaaataaagctaaat

SEQ ID NO: 31871 - DNA, 16 bp, H. sapiens
agaaataaagctgttc

SEQ ID NO: 31872 - DNA, 16 bp, H. sapiens
agaaataaaggatatt

SEQ ID NO: 31873 - DNA, 16 bp, H. sapiens
agaaataaagtcattt

SEQ ID NO: 31874 - DNA, 16 bp, H. sapiens
agaaataaatactttt

SEQ ID NO: 31875 - DNA, 16 bp, H. sapiens
agaaataaatatttca

SEQ ID NO: 31876 - DNA, 16 bp, H. sapiens
agaaataaatccaaat

SEQ ID NO: 31877 - DNA, 16 bp, H. sapiens
agaaataaatgcttgt

SEQ ID NO: 31878 - DNA, 16 bp, H. sapiens
agaaataaatgtgtat

SEQ ID NO: 31879 - DNA, 16 bp, H. sapiens
agaaataaatttcttt

SEQ ID NO: 31880 - DNA, 16 bp, H. sapiens
agaaataacaaaatct

SEQ ID NO: 31881 - DNA, 16 bp, H. sapiens
agaaataacatttaaa

SEQ ID NO: 31882 - DNA, 16 bp, H. sapiens
agaaataactaaaatt

SEQ ID NO: 31883 - DNA, 16 bp, H. sapiens
agaaataactaatatc

SEQ ID NO: 31884 - DNA, 16 bp, H. sapiens
agaaataactttttat

SEQ ID NO: 31885 - DNA, 16 bp, H. sapiens
agaaataacttttttt

SEQ ID NO: 31886 - DNA, 17 bp, H. sapiens
agaaataagaacgcttt

SEQ ID NO: 31887 - DNA, 16 bp, H. sapiens
agaaataagatatttt

SEQ ID NO: 31888 - DNA, 16 bp, H. sapiens
agaaataagatctttt

SEQ ID NO: 31889 - DNA, 16 bp, H. sapiens
agaaataagatgattt

SEQ ID NO: 31890 - DNA, 16 bp, H. sapiens
agaaataaggctgcat

SEQ ID NO: 31891 - DNA, 16 bp, H. sapiens
agaaataaggggaccc

SEQ ID NO: 31892 - DNA, 16 bp, H. sapiens
agaaataataaactat

SEQ ID NO: 31893 - DNA, 16 bp, H. sapiens
agaaataataaagatc

SEQ ID NO: 31894 - DNA, 16 bp, H. sapiens
agaaataatcagcaaa

SEQ ID NO: 31895 - DNA, 16 bp, H. sapiens
agaaataatctttaaa

SEQ ID NO: 31896 - DNA, 16 bp, H. sapiens
agaaataatgaaaatc

SEQ ID NO: 31897 - DNA, 16 bp, H. sapiens
agaaataatgccgcat

SEQ ID NO: 31898 - DNA, 16 bp, H. sapiens
agaaataatgttattt

SEQ ID NO: 31899 - DNA, 16 bp, H. sapiens
agaaataattatatca

SEQ ID NO: 31900 - DNA, 16 bp, H. sapiens
agaaataatttctgaa

SEQ ID NO: 31901 - DNA, 16 bp, H. sapiens
agaaataattttaatg

SEQ ID NO: 31902 - DNA, 16 bp, H. sapiens
agaaataattttatgt

SEQ ID NO: 31903 - DNA, 16 bp, H. sapiens
agaaataatttttctt

SEQ ID NO: 31904 - DNA, 16 bp, H. sapiens
agaaatacaaaaattg

SEQ ID NO: 31905 - DNA, 16 bp, H. sapiens
agaaatacaaaatatt

SEQ ID NO: 31906 - DNA, 16 bp, H. sapiens
agaaatacaaacatca

SEQ ID NO: 31907 - DNA, 16 bp, H. sapiens
agaaatacaaactact

SEQ ID NO: 31908 - DNA, 16 bp, H. sapiens
agaaatacaaaggatt

SEQ ID NO: 31909 - DNA, 16 bp, H. sapiens
agaaatacaagttaaa

SEQ ID NO: 31910 - DNA, 16 bp, H. sapiens
agaaatacaattcaaa

SEQ ID NO: 31911 - DNA, 16 bp, H. sapiens
agaaatacaatttata

SEQ ID NO: 31912 - DNA, 16 bp, H. sapiens
agaaatacaggaaaat

SEQ ID NO: 31913 - DNA, 16 bp, H. sapiens
agaaatacatgaaaat

SEQ ID NO: 31914 - DNA, 16 bp, H. sapiens
agaaatacattctttt

SEQ ID NO: 31915 - DNA, 16 bp, H. sapiens
agaaatacattggttt

SEQ ID NO: 31916 - DNA, 16 bp, H. sapiens
agaaatacatttcata

SEQ ID NO: 31917 - DNA, 16 bp, H. sapiens
agaaatacattttaat

SEQ ID NO: 31918 - DNA, 16 bp, H. sapiens
agaaatacatttttgt

SEQ ID NO: 31919 - DNA, 19 bp, H. sapiens
agaaataccatttgaccct

SEQ ID NO: 31920 - DNA, 16 bp, H. sapiens
agaaatactttatttt

SEQ ID NO: 31921 - DNA, 16 bp, H. sapiens
agaaatactttgaaat

SEQ ID NO: 31922 - DNA, 16 bp, H. sapiens
agaaatactttttatt

SEQ ID NO: 31923 - DNA, 16 bp, H. sapiens
agaaatagaaaaattc

SEQ ID NO: 31924 - DNA, 16 bp, H. sapiens
agaaatagaaaacctc

SEQ ID NO: 31925 - DNA, 16 bp, H. sapiens
agaaatagaaacattt

SEQ ID NO: 31926 - DNA, 16 bp, H. sapiens
agaaatagaagatatt

SEQ ID NO: 31927 - DNA, 16 bp, H. sapiens
agaaatagagaacaga

SEQ ID NO: 31928 - DNA, 16 bp, H. sapiens
agaaatagatgaatcc

SEQ ID NO: 31929 - DNA, 16 bp, H. sapiens
agaaatagcactgaat

SEQ ID NO: 31930 - DNA, 16 bp, H. sapiens
agaaataggaatgctt

SEQ ID NO: 31931 - DNA, 16 bp, H. sapiens
agaaataggacagtgg

SEQ ID NO: 31932 - DNA, 16 bp, H. sapiens
agaaataggcaagaaa

SEQ ID NO: 31933 - DNA, 16 bp, H. sapiens
agaaatatatacatgt

SEQ ID NO: 31934 - DNA, 16 bp, H. sapiens
agaaatatatattcaa

SEQ ID NO: 31935 - DNA, 16 bp, H. sapiens
agaaatatatatttct

SEQ ID NO: 31936 - DNA, 16 bp, H. sapiens
agaaatatatatttgt

SEQ ID NO: 31937 - DNA, 16 bp, H. sapiens
agaaatatatttaaca

SEQ ID NO: 31938 - DNA, 16 bp, H. sapiens
agaaatatattttcat

SEQ ID NO: 31939 - DNA, 16 bp, H. sapiens
agaaatatcttcagag

SEQ ID NO: 31940 - DNA, 16 bp, H. sapiens
agaaatatgattgatt

SEQ ID NO: 31941 - DNA, 16 bp, H. sapiens
agaaatatgatttgac

SEQ ID NO: 31942 - DNA, 16 bp, H. sapiens
agaaatatgattttaa

SEQ ID NO: 31943 - DNA, 16 bp, H. sapiens
agaaatatgcattttt

SEQ ID NO: 31944 - DNA, 16 bp, H. sapiens
agaaatatggagaaca

SEQ ID NO: 31945 - DNA, 16 bp, H. sapiens
agaaatatgggattat

SEQ ID NO: 31946 - DNA, 16 bp, H. sapiens
agaaatatgtattttt

SEQ ID NO: 31947 - DNA, 16 bp, H. sapiens
agaaatatgtgtgtat

SEQ ID NO: 31948 - DNA, 16 bp, H. sapiens
agaaatattaactttt

SEQ ID NO: 31949 - DNA, 16 bp, H. sapiens
agaaatattcatggaa

SEQ ID NO: 31950 - DNA, 16 bp, H. sapiens
agaaatattctaattt

SEQ ID NO: 31951 - DNA, 16 bp, H. sapiens
agaaatattgaaaagg

SEQ ID NO: 31952 - DNA, 16 bp, H. sapiens
agaaatatttcaaata

SEQ ID NO: 31953 - DNA, 16 bp, H. sapiens
agaaatatttcagatt

SEQ ID NO: 31954 - DNA, 16 bp, H. sapiens
agaaatattttactta

SEQ ID NO: 31955 - DNA, 16 bp, H. sapiens
agaaatattttatgca

SEQ ID NO: 31956 - DNA, 16 bp, H. sapiens
agaaatattttgttgt

SEQ ID NO: 31957 - DNA, 16 bp, H. sapiens
agaaatatttttaaca

SEQ ID NO: 31958 - DNA, 16 bp, H. sapiens
agaaatatttttcaaa

SEQ ID NO: 31959 - DNA, 16 bp, H. sapiens
agaaatatttttgtaa

SEQ ID NO: 31960 - DNA, 16 bp, H. sapiens
agaaatcaaaatggaa

SEQ ID NO: 31961 - DNA, 16 bp, H. sapiens
agaaatcaacaccaag

SEQ ID NO: 31962 - DNA, 16 bp, H. sapiens
agaaatcaagaaagca

SEQ ID NO: 31963 - DNA, 16 bp, H. sapiens
agaaatcaagaaagga

SEQ ID NO: 31964 - DNA, 16 bp, H. sapiens
agaaatcaaggaaata

SEQ ID NO: 31965 - DNA, 16 bp, H. sapiens
agaaatcaaggctcag

SEQ ID NO: 31966 - DNA, 16 bp, H. sapiens
agaaatcaagttcttt

SEQ ID NO: 31967 - DNA, 16 bp, H. sapiens
agaaatcaataaaatt

SEQ ID NO: 31968 - DNA, 16 bp, H. sapiens
agaaatcaataaatgt

SEQ ID NO: 31969 - DNA, 16 bp, H. sapiens
agaaatcaataacaga

SEQ ID NO: 31970 - DNA, 16 bp, H. sapiens
agaaatcaataaccaa

SEQ ID NO: 31971 - DNA, 16 bp, H. sapiens
agaaatcaatgagaaa

SEQ ID NO: 31972 - DNA, 16 bp, H. sapiens
agaaatcaatttaaaa

SEQ ID NO: 31973 - DNA, 17 bp, H. sapiens
agaaatcacaacaaact

SEQ ID NO: 31974 - DNA, 16 bp, H. sapiens
agaaatcagaaagaag

SEQ ID NO: 31975 - DNA, 16 bp, H. sapiens
agaaatcagccaggca

SEQ ID NO: 31976 - DNA, 16 bp, H. sapiens
agaaatcagccatctt

SEQ ID NO: 31977 - DNA, 16 bp, H. sapiens
agaaatcatattacaa

SEQ ID NO: 31978 - DNA, 16 bp, H. sapiens
agaaatcattgaaaaa

SEQ ID NO: 31979 - DNA, 16 bp, H. sapiens
agaaatcattgtgatt

SEQ ID NO: 31980 - DNA, 16 bp, H. sapiens
agaaatcccatttcca

SEQ ID NO: 31981 - DNA, 16 bp, H. sapiens
agaaatccctgattta

SEQ ID NO: 31982 - DNA, 16 bp, H. sapiens
agaaatcctaagcaaa

SEQ ID NO: 31983 - DNA, 16 bp, H. sapiens
agaaatcctgaactat

SEQ ID NO: 31984 - DNA, 16 bp, H. sapiens
agaaatcctggaactg

SEQ ID NO: 31985 - DNA, 16 bp, H. sapiens
agaaatccttaacaaa

SEQ ID NO: 31986 - DNA, 16 bp, H. sapiens
agaaatctacaaattc

SEQ ID NO: 31987 - DNA, 16 bp, H. sapiens
agaaatctccaaattg

SEQ ID NO: 31988 - DNA, 16 bp, H. sapiens
agaaatctgttctaca

SEQ ID NO: 31989 - DNA, 16 bp, H. sapiens
agaaatctttgcttat

SEQ ID NO: 31990 - DNA, 16 bp, H. sapiens
agaaatgaaacaattt

SEQ ID NO: 31991 - DNA, 16 bp, H. sapiens
agaaatgaaacaggaa

SEQ ID NO: 31992 - DNA, 16 bp, H. sapiens
agaaatgaaactggag

SEQ ID NO: 31993 - DNA, 16 bp, H. sapiens
agaaatgaaagagcaa

SEQ ID NO: 31994 - DNA, 16 bp, H. sapiens
agaaatgaaagcagag

SEQ ID NO: 31995 - DNA, 16 bp, H. sapiens
agaaatgaaatgggag

SEQ ID NO: 31996 - DNA, 16 bp, H. sapiens
agaaatgaaattttat

SEQ ID NO: 31997 - DNA, 16 bp, H. sapiens
agaaatgaacaaagca

SEQ ID NO: 31998 - DNA, 16 bp, H. sapiens
agaaatgaagaatgct

SEQ ID NO: 31999 - DNA, 16 bp, H. sapiens
agaaatgaaggcagaa

SEQ ID NO: 32000 - DNA, 16 bp, H. sapiens
agaaatgaatggaaat

SEQ ID NO: 32001 - DNA, 16 bp, H. sapiens
agaaatgaatttgaaa

SEQ ID NO: 32002 - DNA, 16 bp, H. sapiens
agaaatgaattttctt

SEQ ID NO: 32003 - DNA, 16 bp, H. sapiens
agaaatgacacaaata

SEQ ID NO: 32004 - DNA, 16 bp, H. sapiens
agaaatgacattttta

SEQ ID NO: 32005 - DNA, 16 bp, H. sapiens
agaaatgactgcagtg

SEQ ID NO: 32006 - DNA, 16 bp, H. sapiens
agaaatgactgtggtg

SEQ ID NO: 32007 - DNA, 16 bp, H. sapiens
agaaatgagagaagac

SEQ ID NO: 32008 - DNA, 16 bp, H. sapiens
agaaatgaggaactta

SEQ ID NO: 32009 - DNA, 16 bp, H. sapiens
agaaatgataaatgtt

SEQ ID NO: 32010 - DNA, 16 bp, H. sapiens
agaaatgatggaatta

SEQ ID NO: 32011 - DNA, 16 bp, H. sapiens
agaaatgattaaactt

SEQ ID NO: 32012 - DNA, 16 bp, H. sapiens
agaaatgattatttta

SEQ ID NO: 32013 - DNA, 16 bp, H. sapiens
agaaatgatttttaaa

SEQ ID NO: 32014 - DNA, 16 bp, H. sapiens
agaaatgcaaaaatct

SEQ ID NO: 32015 - DNA, 16 bp, H. sapiens
agaaatgcaaaatgtt

SEQ ID NO: 32016 - DNA, 16 bp, H. sapiens
agaaatgcaaatgcaa

SEQ ID NO: 32017 - DNA, 16 bp, H. sapiens
agaaatgcaaattctt

SEQ ID NO: 32018 - DNA, 16 bp, H. sapiens
agaaatgcaactaatt

SEQ ID NO: 32019 - DNA, 16 bp, H. sapiens
agaaatgcaagccaaa

SEQ ID NO: 32020 - DNA, 16 bp, H. sapiens
agaaatgcacatcaaa

SEQ ID NO: 32021 - DNA, 16 bp, H. sapiens
agaaatgcagaatttc

SEQ ID NO: 32022 - DNA, 16 bp, H. sapiens
agaaatgcagagcaaa

SEQ ID NO: 32023 - DNA, 16 bp, H. sapiens
agaaatgcatccttag

SEQ ID NO: 32024 - DNA, 16 bp, H. sapiens
agaaatgctactggtt

SEQ ID NO: 32025 - DNA, 16 bp, H. sapiens
agaaatgctgaaaatt

SEQ ID NO: 32026 - DNA, 16 bp, H. sapiens
agaaatgctttatttt

SEQ ID NO: 32027 - DNA, 16 bp, H. sapiens
agaaatgctttttatt

SEQ ID NO: 32028 - DNA, 16 bp, H. sapiens
agaaatggaaaagctg

SEQ ID NO: 32029 - DNA, 16 bp, H. sapiens
agaaatggaaaatatt

SEQ ID NO: 32030 - DNA, 16 bp, H. sapiens
agaaatggaaaatgtg

SEQ ID NO: 32031 - DNA, 16 bp, H. sapiens
agaaatggaaacatat

SEQ ID NO: 32032 - DNA, 16 bp, H. sapiens
agaaatggaaattcta

SEQ ID NO: 32033 - DNA, 16 bp, H. sapiens
agaaatggaagaaaca

SEQ ID NO: 32034 - DNA, 16 bp, H. sapiens
agaaatggaagaacaa

SEQ ID NO: 32035 - DNA, 16 bp, H. sapiens
agaaatggaagaagac

SEQ ID NO: 32036 - DNA, 16 bp, H. sapiens
agaaatggaagtcaaa

SEQ ID NO: 32037 - DNA, 16 bp, H. sapiens
agaaatggaatcacac

SEQ ID NO: 32038 - DNA, 16 bp, H. sapiens
agaaatggaggctcag

SEQ ID NO: 32039 - DNA, 16 bp, H. sapiens
agaaatggcatcagat

SEQ ID NO: 32040 - DNA, 16 bp, H. sapiens
agaaatggcattttaa

SEQ ID NO: 32041 - DNA, 16 bp, H. sapiens
agaaatggctaattct

SEQ ID NO: 32042 - DNA, 16 bp, H. sapiens
agaaatggcttccctg

SEQ ID NO: 32043 - DNA, 16 bp, H. sapiens
agaaatgggagagctg

SEQ ID NO: 32044 - DNA, 16 bp, H. sapiens
agaaatggggcttcac

SEQ ID NO: 32045 - DNA, 16 bp, H. sapiens
agaaatggtgaaagga

SEQ ID NO: 32046 - DNA, 16 bp, H. sapiens
agaaatgtaattttat

SEQ ID NO: 32047 - DNA, 16 bp, H. sapiens
agaaatgtatatattt

SEQ ID NO: 32048 - DNA, 16 bp, H. sapiens
agaaatgtatattttt

SEQ ID NO: 32049 - DNA, 16 bp, H. sapiens
agaaatgtatcaattt

SEQ ID NO: 32050 - DNA, 16 bp, H. sapiens
agaaatgtattatttc

SEQ ID NO: 32051 - DNA, 16 bp, H. sapiens
agaaatgtattcctca

SEQ ID NO: 32052 - DNA, 16 bp, H. sapiens
agaaatgtattctctt

SEQ ID NO: 32053 - DNA, 16 bp, H. sapiens
agaaatgtatttggct

SEQ ID NO: 32054 - DNA, 16 bp, H. sapiens
agaaatgtattttaaa

SEQ ID NO: 32055 - DNA, 16 bp, H. sapiens
agaaatgtatttttat

SEQ ID NO: 32056 - DNA, 16 bp, H. sapiens
agaaatgtccattcaa

SEQ ID NO: 32057 - DNA, 16 bp, H. sapiens
agaaatgtctattaag

SEQ ID NO: 32058 - DNA, 16 bp, H. sapiens
agaaatgtctatttat

SEQ ID NO: 32059 - DNA, 16 bp, H. sapiens
agaaatgtctgagact

SEQ ID NO: 32060 - DNA, 16 bp, H. sapiens
agaaatgtctgttcag

SEQ ID NO: 32061 - DNA, 16 bp, H. sapiens
agaaatgtcttatttt

SEQ ID NO: 32062 - DNA, 16 bp, H. sapiens
agaaatgtgaaaaatg

SEQ ID NO: 32063 - DNA, 16 bp, H. sapiens
agaaatgtgaagaatg

SEQ ID NO: 32064 - DNA, 16 bp, H. sapiens
agaaatgtggcagaaa

SEQ ID NO: 32065 - DNA, 16 bp, H. sapiens
agaaatgttaaaagtt

SEQ ID NO: 32066 - DNA, 16 bp, H. sapiens
agaaatgttaaaatgt

SEQ ID NO: 32067 - DNA, 16 bp, H. sapiens
agaaatgttaaatttt

SEQ ID NO: 32068 - DNA, 16 bp, H. sapiens
agaaatgttagtgatt

SEQ ID NO: 32069 - DNA, 16 bp, H. sapiens
agaaatgttcaactgt

SEQ ID NO: 32070 - DNA, 16 bp, H. sapiens
agaaatgttcatttct

SEQ ID NO: 32071 - DNA, 16 bp, H. sapiens
agaaatgttgaaagta

SEQ ID NO: 32072 - DNA, 16 bp, H. sapiens
agaaatgtttaaatct

SEQ ID NO: 32073 - DNA, 16 bp, H. sapiens
agaaatgtttatgttt

SEQ ID NO: 32074 - DNA, 16 bp, H. sapiens
agaaatgtttcctttt

SEQ ID NO: 32075 - DNA, 16 bp, H. sapiens
agaaatgttttaaaag

SEQ ID NO: 32076 - DNA, 16 bp, H. sapiens
agaaatgttttaaata

SEQ ID NO: 32077 - DNA, 16 bp, H. sapiens
agaaatgttttctatt

SEQ ID NO: 32078 - DNA, 16 bp, H. sapiens
agaaattaaaacatac

SEQ ID NO: 32079 - DNA, 16 bp, H. sapiens
agaaattaaaacattt

SEQ ID NO: 32080 - DNA, 16 bp, H. sapiens
agaaattaaaaggatt

SEQ ID NO: 32081 - DNA, 16 bp, H. sapiens
agaaattaaaatatca

SEQ ID NO: 32082 - DNA, 16 bp, H. sapiens
agaaattaaagaaggc

SEQ ID NO: 32083 - DNA, 16 bp, H. sapiens
agaaattaaagaatgt

SEQ ID NO: 32084 - DNA, 16 bp, H. sapiens
agaaattaacaaaatt

SEQ ID NO: 32085 - DNA, 16 bp, H. sapiens
agaaattaagatattc

SEQ ID NO: 32086 - DNA, 16 bp, H. sapiens
agaaattaattcaaga

SEQ ID NO: 32087 - DNA, 16 bp, H. sapiens
agaaattacaagagaa

SEQ ID NO: 32088 - DNA, 16 bp, H. sapiens
agaaattacagagaaa

SEQ ID NO: 32089 - DNA, 16 bp, H. sapiens
agaaattaccacaaat

SEQ ID NO: 32090 - DNA, 16 bp, H. sapiens
agaaattagccaaaag

SEQ ID NO: 32091 - DNA, 16 bp, H. sapiens
agaaattatcttcaga

SEQ ID NO: 32092 - DNA, 16 bp, H. sapiens
agaaattattattctt

SEQ ID NO: 32093 - DNA, 16 bp, H. sapiens
agaaattattgccaaa

SEQ ID NO: 32094 - DNA, 16 bp, H. sapiens
agaaattatttaacaa

SEQ ID NO: 32095 - DNA, 16 bp, H. sapiens
agaaattatttatctt

SEQ ID NO: 32096 - DNA, 16 bp, H. sapiens
agaaattattttcctt

SEQ ID NO: 32097 - DNA, 16 bp, H. sapiens
agaaattatttttcta

SEQ ID NO: 32098 - DNA, 16 bp, H. sapiens
agaaattcaaagaaga

SEQ ID NO: 32099 - DNA, 16 bp, H. sapiens
agaaattcaaagaatt

SEQ ID NO: 32100 - DNA, 16 bp, H. sapiens
agaaattcaaaggatt

SEQ ID NO: 32101 - DNA, 16 bp, H. sapiens
agaaattcaaataatt

SEQ ID NO: 32102 - DNA, 16 bp, H. sapiens
agaaattcaaatgaaa

SEQ ID NO: 32103 - DNA, 16 bp, H. sapiens
agaaattcaacagaga

SEQ ID NO: 32104 - DNA, 16 bp, H. sapiens
agaaattcaagaaaat

SEQ ID NO: 32105 - DNA, 16 bp, H. sapiens
agaaattcaagaaatt

SEQ ID NO: 32106 - DNA, 16 bp, H. sapiens
agaaattcaagacagc

SEQ ID NO: 32107 - DNA, 16 bp, H. sapiens
agaaattcaagcctgc

SEQ ID NO: 32108 - DNA, 16 bp, H. sapiens
agaaattcagagctca

SEQ ID NO: 32109 - DNA, 16 bp, H. sapiens
agaaattcagagttca

SEQ ID NO: 32110 - DNA, 16 bp, H. sapiens
agaaattcagtataaa

SEQ ID NO: 32111 - DNA, 16 bp, H. sapiens
agaaattcatcacaaa

SEQ ID NO: 32112 - DNA, 16 bp, H. sapiens
agaaattcattcaaaa

SEQ ID NO: 32113 - DNA, 16 bp, H. sapiens
agaaattcatttctta

SEQ ID NO: 32114 - DNA, 16 bp, H. sapiens
agaaattctaaaaaga

SEQ ID NO: 32115 - DNA, 16 bp, H. sapiens
agaaattctagaaatg

SEQ ID NO: 32116 - DNA, 16 bp, H. sapiens
agaaattctagaagaa

SEQ ID NO: 32117 - DNA, 16 bp, H. sapiens
agaaattctgaaaaat

SEQ ID NO: 32118 - DNA, 16 bp, H. sapiens
agaaattctgttttct

SEQ ID NO: 32119 - DNA, 16 bp, H. sapiens
agaaattcttaatttt

SEQ ID NO: 32120 - DNA, 16 bp, H. sapiens
agaaattcttgagttt

SEQ ID NO: 32121 - DNA, 16 bp, H. sapiens
agaaattctttcaaaa

SEQ ID NO: 32122 - DNA, 16 bp, H. sapiens
agaaattctttgaaac

SEQ ID NO: 32123 - DNA, 16 bp, H. sapiens
agaaattgaaatcata

SEQ ID NO: 32124 - DNA, 16 bp, H. sapiens
agaaattgaagcacag

SEQ ID NO: 32125 - DNA, 16 bp, H. sapiens
agaaattgaattgctg

SEQ ID NO: 32126 - DNA, 16 bp, H. sapiens
agaaattgacaaattg

SEQ ID NO: 32127 - DNA, 16 bp, H. sapiens
agaaattgacaagctg

SEQ ID NO: 32128 - DNA, 16 bp, H. sapiens
agaaattgaccttttg

SEQ ID NO: 32129 - DNA, 16 bp, H. sapiens
agaaattgagaaattg

SEQ ID NO: 32130 - DNA, 16 bp, H. sapiens
agaaattgcattttta

SEQ ID NO: 32131 - DNA, 16 bp, H. sapiens
agaaattgccaaacta

SEQ ID NO: 32132 - DNA, 16 bp, H. sapiens
agaaattggaaaacaa

SEQ ID NO: 32133 - DNA, 16 bp, H. sapiens
agaaattggagaccag

SEQ ID NO: 32134 - DNA, 16 bp, H. sapiens
agaaattggcaagctg

SEQ ID NO: 32135 - DNA, 16 bp, H. sapiens
agaaattggccaaaaa

SEQ ID NO: 32136 - DNA, 16 bp, H. sapiens
agaaattgtccaaaac

SEQ ID NO: 32137 - DNA, 16 bp, H. sapiens
agaaattgtccatttt

SEQ ID NO: 32138 - DNA, 16 bp, H. sapiens
agaaattgtggcacat

SEQ ID NO: 32139 - DNA, 16 bp, H. sapiens
agaaattgtggcatat

SEQ ID NO: 32140 - DNA, 16 bp, H. sapiens
agaaattgttaatttt

SEQ ID NO: 32141 - DNA, 16 bp, H. sapiens
agaaattgttttaaaa

SEQ ID NO: 32142 - DNA, 16 bp, H. sapiens
agaaatttaaaacaat

SEQ ID NO: 32143 - DNA, 16 bp, H. sapiens
agaaatttaaaatact

SEQ ID NO: 32144 - DNA, 16 bp, H. sapiens
agaaatttaatttctt

SEQ ID NO: 32145 - DNA, 16 bp, H. sapiens
agaaatttactttttt

SEQ ID NO: 32146 - DNA, 16 bp, H. sapiens
agaaatttatagcatt

SEQ ID NO: 32147 - DNA, 16 bp, H. sapiens
agaaatttatctgttt

SEQ ID NO: 32148 - DNA, 16 bp, H. sapiens
agaaatttattctgcc

SEQ ID NO: 32149 - DNA, 16 bp, H. sapiens
agaaatttatttccta

SEQ ID NO: 32150 - DNA, 16 bp, H. sapiens
agaaatttatttctta

SEQ ID NO: 32151 - DNA, 16 bp, H. sapiens
agaaatttattttgtc

SEQ ID NO: 32152 - DNA, 16 bp, H. sapiens
agaaatttcaaaatct

SEQ ID NO: 32153 - DNA, 16 bp, H. sapiens
agaaatttccattttt

SEQ ID NO: 32154 - DNA, 16 bp, H. sapiens
agaaatttctagaaat

SEQ ID NO: 32155 - DNA, 16 bp, H. sapiens
agaaatttcttccagc

SEQ ID NO: 32156 - DNA, 16 bp, H. sapiens
agaaatttctttcaaa

SEQ ID NO: 32157 - DNA, 16 bp, H. sapiens
agaaatttcttttctc

SEQ ID NO: 32158 - DNA, 16 bp, H. sapiens
agaaatttgaaaacat

SEQ ID NO: 32159 - DNA, 16 bp, H. sapiens
agaaatttgagaaaat

SEQ ID NO: 32160 - DNA, 16 bp, H. sapiens
agaaatttgagaaatt

SEQ ID NO: 32161 - DNA, 17 bp, H. sapiens
agaaatttgcataagta

SEQ ID NO: 32162 - DNA, 16 bp, H. sapiens
agaaatttgcccaaga

SEQ ID NO: 32163 - DNA, 16 bp, H. sapiens
agaaatttgctgttaa

SEQ ID NO: 32164 - DNA, 16 bp, H. sapiens
agaaatttggccaggc

SEQ ID NO: 32165 - DNA, 16 bp, H. sapiens
agaaattttaaatatc

SEQ ID NO: 32166 - DNA, 16 bp, H. sapiens
agaaattttagaaatt

SEQ ID NO: 32167 - DNA, 16 bp, H. sapiens
agaaattttatttcta

SEQ ID NO: 32168 - DNA, 16 bp, H. sapiens
agaaattttcagattt

SEQ ID NO: 32169 - DNA, 16 bp, H. sapiens
agaaattttgaaattt

SEQ ID NO: 32170 - DNA, 16 bp, H. sapiens
agaaattttgaagaaa

SEQ ID NO: 32171 - DNA, 16 bp, H. sapiens
agaaattttggaaatt

SEQ ID NO: 32172 - DNA, 16 bp, H. sapiens
agaaattttggagctg

SEQ ID NO: 32173 - DNA, 16 bp, H. sapiens
agaaattttgttttaa

SEQ ID NO: 32174 - DNA, 16 bp, H. sapiens
agaaattttgttttct

SEQ ID NO: 32175 - DNA, 16 bp, H. sapiens
agaaatttttaaaaac

SEQ ID NO: 32176 - DNA, 16 bp, H. sapiens
agaacaaaactgaagg

SEQ ID NO: 32177 - DNA, 16 bp, H. sapiens
agaacaaagagaagat

SEQ ID NO: 32178 - DNA, 16 bp, H. sapiens
agaacaaagattatta

SEQ ID NO: 32179 - DNA, 16 bp, H. sapiens
agaacaaagctcaaaa

SEQ ID NO: 32180 - DNA, 16 bp, H. sapiens
agaacaaagctcaaga

SEQ ID NO: 32181 - DNA, 21 bp, H. sapiens
agaacaaagctggaggcatcg

SEQ ID NO: 32182 - DNA, 16 bp, H. sapiens
agaacaaagtcagaag

SEQ ID NO: 32183 - DNA, 16 bp, H. sapiens
agaacaaagttcaaga

SEQ ID NO: 32184 - DNA, 16 bp, H. sapiens
agaacaaatggacaca

SEQ ID NO: 32185 - DNA, 16 bp, H. sapiens
agaacaactccccttt

SEQ ID NO: 32186 - DNA, 16 bp, H. sapiens
agaacaactttttttt

SEQ ID NO: 32187 - DNA, 16 bp, H. sapiens
agaacaagaaatattt

SEQ ID NO: 32188 - DNA, 16 bp, H. sapiens
agaacaagattctgtc

SEQ ID NO: 32189 - DNA, 16 bp, H. sapiens
agaacaagcaaaacta

SEQ ID NO: 32190 - DNA, 16 bp, H. sapiens
agaacaaggcctggca

SEQ ID NO: 32191 - DNA, 16 bp, H. sapiens
agaacaatggccacta

SEQ ID NO: 32192 - DNA, 16 bp, H. sapiens
agaacaattaggcaag

SEQ ID NO: 32193 - DNA, 16 bp, H. sapiens
agaacaatttatgttc

SEQ ID NO: 32194 - DNA, 16 bp, H. sapiens
agaacacaaacaaatg

SEQ ID NO: 32195 - DNA, 16 bp, H. sapiens
agaacacagagccaaa

SEQ ID NO: 32196 - DNA, 22 bp, H. sapiens
agaacacaggctaagggagaag

SEQ ID NO: 32197 - DNA, 16 bp, H. sapiens
agaacacagtggctgg

SEQ ID NO: 32198 - DNA, 16 bp, H. sapiens
agaacacatgatgttt

SEQ ID NO: 32199 - DNA, 16 bp, H. sapiens
agaacacatggatgca

SEQ ID NO: 32200 - DNA, 16 bp, H. sapiens
agaacacattttaaaa

SEQ ID NO: 32201 - DNA, 16 bp, H. sapiens
agaacaccaaagattg

SEQ ID NO: 32202 - DNA, 16 bp, H. sapiens
agaacaccaagaagat

SEQ ID NO: 32203 - DNA, 16 bp, H. sapiens
agaacaccacagactg

SEQ ID NO: 32204 - DNA, 16 bp, H. sapiens
agaacacgtggacaca

SEQ ID NO: 32205 - DNA, 16 bp, H. sapiens
agaacacttaaaatct

SEQ ID NO: 32206 - DNA, 16 bp, H. sapiens
agaacacttatattag

SEQ ID NO: 32207 - DNA, 16 bp, H. sapiens
agaacacttcccaact

SEQ ID NO: 32208 - DNA, 16 bp, H. sapiens
agaacacttgaacaca

SEQ ID NO: 32209 - DNA, 16 bp, H. sapiens
agaacactttttaaaa

SEQ ID NO: 32210 - DNA, 16 bp, H. sapiens
agaacagaaagaaatg

SEQ ID NO: 32211 - DNA, 16 bp, H. sapiens
agaacagaaattagaa

SEQ ID NO: 32212 - DNA, 16 bp, H. sapiens
agaacagaaattttaa

SEQ ID NO: 32213 - DNA, 16 bp, H. sapiens
agaacagaaggaaata

SEQ ID NO: 32214 - DNA, 16 bp, H. sapiens
agaacagaatagagga

SEQ ID NO: 32215 - DNA, 16 bp, H. sapiens
agaacagagcagaaat

SEQ ID NO: 32216 - DNA, 16 bp, H. sapiens
agaacagagtcctcag

SEQ ID NO: 32217 - DNA, 16 bp, H. sapiens
agaacagcaaagattg

SEQ ID NO: 32218 - DNA, 16 bp, H. sapiens
agaacagcaagagcaa

SEQ ID NO: 32219 - DNA, 16 bp, H. sapiens
agaacagcaccaaagg

SEQ ID NO: 32220 - DNA, 16 bp, H. sapiens
agaacagcaccaagga

SEQ ID NO: 32221 - DNA, 16 bp, H. sapiens
agaacagcacggggaa

SEQ ID NO: 32222 - DNA, 16 bp, H. sapiens
agaacagcactggaaa

SEQ ID NO: 32223 - DNA, 16 bp, H. sapiens
agaacagcactgtcca

SEQ ID NO: 32224 - DNA, 16 bp, H. sapiens
agaacagcagcacaaa

SEQ ID NO: 32225 - DNA, 16 bp, H. sapiens
agaacagcagcagcag

SEQ ID NO: 32226 - DNA, 16 bp, H. sapiens
agaacagcagtggctg

SEQ ID NO: 32227 - DNA, 16 bp, H. sapiens
agaacagcatgggaaa

SEQ ID NO: 32228 - DNA, 16 bp, H. sapiens
agaacagccaggccaa

SEQ ID NO: 32229 - DNA, 16 bp, H. sapiens
agaacagcctaataca

SEQ ID NO: 32230 - DNA, 16 bp, H. sapiens
agaacagcctggccaa

SEQ ID NO: 32231 - DNA, 16 bp, H. sapiens
agaacagcctggccga

SEQ ID NO: 32232 - DNA, 16 bp, H. sapiens
agaacagcgtgaaccc

SEQ ID NO: 32233 - DNA, 16 bp, H. sapiens
agaacagctccatcac

SEQ ID NO: 32234 - DNA, 16 bp, H. sapiens
agaacagcttagagga

SEQ ID NO: 32235 - DNA, 16 bp, H. sapiens
agaacagcttttaaaa

SEQ ID NO: 32236 - DNA, 16 bp, H. sapiens
agaacaggagttaact

SEQ ID NO: 32237 - DNA, 16 bp, H. sapiens
agaacaggatggagga

SEQ ID NO: 32238 - DNA, 16 bp, H. sapiens
agaacaggcaaaacta

SEQ ID NO: 32239 - DNA, 17 bp, H. sapiens
agaacaggggcctcaga

SEQ ID NO: 32240 - DNA, 16 bp, H. sapiens
agaacaggggtcctgg

SEQ ID NO: 32241 - DNA, 16 bp, H. sapiens
agaacagtgagaaaat

SEQ ID NO: 32242 - DNA, 16 bp, H. sapiens
agaacagtgagaaata

SEQ ID NO: 32243 - DNA, 16 bp, H. sapiens
agaacagtgcttgaca

SEQ ID NO: 32244 - DNA, 16 bp, H. sapiens
agaacagtggcctcag

SEQ ID NO: 32245 - DNA, 16 bp, H. sapiens
agaacagtggttgcct

SEQ ID NO: 32246 - DNA, 16 bp, H. sapiens
agaacagttcctggca

SEQ ID NO: 32247 - DNA, 16 bp, H. sapiens
agaacagtttgaaggt

SEQ ID NO: 32248 - DNA, 16 bp, H. sapiens
agaacataaaatattt

SEQ ID NO: 32249 - DNA, 16 bp, H. sapiens
agaacataatttttaa

SEQ ID NO: 32250 - DNA, 16 bp, H. sapiens
agaacatatgacattt

SEQ ID NO: 32251 - DNA, 16 bp, H. sapiens
agaacatcagagaaag

SEQ ID NO: 32252 - DNA, 18 bp, H. sapiens
agaacatcctggctaaca

SEQ ID NO: 32253 - DNA, 16 bp, H. sapiens
agaacatctttttttt

SEQ ID NO: 32254 - DNA, 16 bp, H. sapiens
agaacatgaggtattt

SEQ ID NO: 32255 - DNA, 16 bp, H. sapiens
agaacatgcaaaattt

SEQ ID NO: 32256 - DNA, 16 bp, H. sapiens
agaacatgcaatgttt

SEQ ID NO: 32257 - DNA, 16 bp, H. sapiens
agaacatgcagcattt

SEQ ID NO: 32258 - DNA, 16 bp, H. sapiens
agaacatgtgatgttt

SEQ ID NO: 32259 - DNA, 16 bp, H. sapiens
agaacattaatttttt

SEQ ID NO: 32260 - DNA, 16 bp, H. sapiens
agaacattaggacaaa

SEQ ID NO: 32261 - DNA, 16 bp, H. sapiens
agaacattccaggcag

SEQ ID NO: 32262 - DNA, 16 bp, H. sapiens
agaacattctaccaaa

SEQ ID NO: 32263 - DNA, 16 bp, H. sapiens
agaacattgtgaaact

SEQ ID NO: 32264 - DNA, 16 bp, H. sapiens
agaacatttaaaagaa

SEQ ID NO: 32265 - DNA, 16 bp, H. sapiens
agaacatttccatcaa

SEQ ID NO: 32266 - DNA, 16 bp, H. sapiens
agaacatttctgtttt

SEQ ID NO: 32267 - DNA, 16 bp, H. sapiens
agaacatttggaaaat

SEQ ID NO: 32268 - DNA, 16 bp, H. sapiens
agaacattttaaaaaa

SEQ ID NO: 32269 - DNA, 16 bp, H. sapiens
agaacattttatcacc

SEQ ID NO: 32270 - DNA, 16 bp, H. sapiens
agaacattttcatctc

SEQ ID NO: 32271 - DNA, 16 bp, H. sapiens
agaacatttttgcaat

SEQ ID NO: 32272 - DNA, 16 bp, H. sapiens
agaacattttttttct

SEQ ID NO: 32273 - DNA, 16 bp, H. sapiens
agaaccaaatgaaaat

SEQ ID NO: 32274 - DNA, 16 bp, H. sapiens
agaaccaaggaatata

SEQ ID NO: 32275 - DNA, 19 bp, H. sapiens
agaaccaagttggaaaaca

SEQ ID NO: 32276 - DNA, 16 bp, H. sapiens
agaaccacattttaaa

SEQ ID NO: 32277 - DNA, 16 bp, H. sapiens
agaaccacccagccaa

SEQ ID NO: 32278 - DNA, 16 bp, H. sapiens
agaaccactgatttaa

SEQ ID NO: 32279 - DNA, 16 bp, H. sapiens
agaaccactggaaccc

SEQ ID NO: 32280 - DNA, 16 bp, H. sapiens
agaaccactggactag

SEQ ID NO: 32281 - DNA, 16 bp, H. sapiens
agaaccagaaaaatct

SEQ ID NO: 32282 - DNA, 16 bp, H. sapiens
agaaccagaaatacaa

SEQ ID NO: 32283 - DNA, 16 bp, H. sapiens
agaaccagagagatgg

SEQ ID NO: 32284 - DNA, 16 bp, H. sapiens
agaaccaggaaagctg

SEQ ID NO: 32285 - DNA, 16 bp, H. sapiens
agaaccaggagcacca

SEQ ID NO: 32286 - DNA, 16 bp, H. sapiens
agaaccaggagctctg

SEQ ID NO: 32287 - DNA, 16 bp, H. sapiens
agaaccaggatttgaa

SEQ ID NO: 32288 - DNA, 16 bp, H. sapiens
agaaccagggaagctg

SEQ ID NO: 32289 - DNA, 16 bp, H. sapiens
agaaccagttgttaaa

SEQ ID NO: 32290 - DNA, 16 bp, H. sapiens
agaaccataagccaaa

SEQ ID NO: 32291 - DNA, 16 bp, H. sapiens
agaaccatttaaaaat

SEQ ID NO: 32292 - DNA, 16 bp, H. sapiens
agaacccaaaaataag

SEQ ID NO: 32293 - DNA, 16 bp, H. sapiens
agaacccagaaattaa

SEQ ID NO: 32294 - DNA, 16 bp, H. sapiens
agaacccggaaataaa

SEQ ID NO: 32295 - DNA, 18 bp, H. sapiens
agaacccgggaggcggag

SEQ ID NO: 32296 - DNA, 16 bp, H. sapiens
agaaccctcagctgca

SEQ ID NO: 32297 - DNA, 16 bp, H. sapiens
agaaccctcctgggct

SEQ ID NO: 32298 - DNA, 16 bp, H. sapiens
agaaccctgactaata

SEQ ID NO: 32299 - DNA, 16 bp, H. sapiens
agaaccctgactaatg

SEQ ID NO: 32300 - DNA, 16 bp, H. sapiens
agaacctagaaataaa

SEQ ID NO: 32301 - DNA, 16 bp, H. sapiens
agaacctctactaagg

SEQ ID NO: 32302 - DNA, 16 bp, H. sapiens
agaacctctgggacac

SEQ ID NO: 32303 - DNA, 16 bp, H. sapiens
agaacctgaacagaca

SEQ ID NO: 32304 - DNA, 16 bp, H. sapiens
agaacctggagttctg

SEQ ID NO: 32305 - DNA, 16 bp, H. sapiens
agaacctggcacctcc

SEQ ID NO: 32306 - DNA, 16 bp, H. sapiens
agaacctgggaggcag

SEQ ID NO: 32307 - DNA, 16 bp, H. sapiens
agaacctgggtaccaa

SEQ ID NO: 32308 - DNA, 16 bp, H. sapiens
agaacctggtagagct

SEQ ID NO: 32309 - DNA, 16 bp, H. sapiens
agaacctgtctcttaa

SEQ ID NO: 32310 - DNA, 16 bp, H. sapiens
agaaccttcagtacaa

SEQ ID NO: 32311 - DNA, 17 bp, H. sapiens
agaacgagactctatct

SEQ ID NO: 32312 - DNA, 16 bp, H. sapiens
agaacgagactctgtc

SEQ ID NO: 32313 - DNA, 16 bp, H. sapiens
agaacgagattctgtc

SEQ ID NO: 32314 - DNA, 16 bp, H. sapiens
agaactaaaaatagat

SEQ ID NO: 32315 - DNA, 16 bp, H. sapiens
agaactaaagagaaag

SEQ ID NO: 32316 - DNA, 16 bp, H. sapiens
agaactaaatcaaaag

SEQ ID NO: 32317 - DNA, 16 bp, H. sapiens
agaactaaatgaattt

SEQ ID NO: 32318 - DNA, 16 bp, H. sapiens
agaactaatgacaaaa

SEQ ID NO: 32319 - DNA, 16 bp, H. sapiens
agaactacaaaatgct

SEQ ID NO: 32320 - DNA, 16 bp, H. sapiens
agaactacaaacaact

SEQ ID NO: 32321 - DNA, 19 bp, H. sapiens
agaactacaaaccactact

SEQ ID NO: 32322 - DNA, 21 bp, H. sapiens
agaactacaagccactgctca

SEQ ID NO: 32323 - DNA, 16 bp, H. sapiens
agaactacacagaagc

SEQ ID NO: 32324 - DNA, 16 bp, H. sapiens
agaactacaggtgtgc

SEQ ID NO: 32325 - DNA, 16 bp, H. sapiens
agaactactgcaggaa

SEQ ID NO: 32326 - DNA, 16 bp, H. sapiens
agaactagaaaaacca

SEQ ID NO: 32327 - DNA, 16 bp, H. sapiens
agaactagagaagcag

SEQ ID NO: 32328 - DNA, 16 bp, H. sapiens
agaactagagaaggaa

SEQ ID NO: 32329 - DNA, 16 bp, H. sapiens
agaactaggaatacca

SEQ ID NO: 32330 - DNA, 16 bp, H. sapiens
agaactagtcacatgg

SEQ ID NO: 32331 - DNA, 16 bp, H. sapiens
agaactatgagaagta

SEQ ID NO: 32332 - DNA, 16 bp, H. sapiens
agaactatgtgaagaa

SEQ ID NO: 32333 - DNA, 16 bp, H. sapiens
agaactcaaagaaatt

SEQ ID NO: 32334 - DNA, 16 bp, H. sapiens
agaactcactcattat

SEQ ID NO: 32335 - DNA, 16 bp, H. sapiens
agaactcagaaacaaa

SEQ ID NO: 32336 - DNA, 16 bp, H. sapiens
agaactcaggctcagg

SEQ ID NO: 32337 - DNA, 16 bp, H. sapiens
agaactcctgaaggaa

SEQ ID NO: 32338 - DNA, 17 bp, H. sapiens
agaactctccaccccag

SEQ ID NO: 32339 - DNA, 16 bp, H. sapiens
agaactcttaaaattc

SEQ ID NO: 32340 - DNA, 16 bp, H. sapiens
agaactgaaaatacaa

SEQ ID NO: 32341 - DNA, 16 bp, H. sapiens
agaactgaagaaaata

SEQ ID NO: 32342 - DNA, 16 bp, H. sapiens
agaactgaaggaaatg

SEQ ID NO: 32343 - DNA, 16 bp, H. sapiens
agaactgaaggagtta

SEQ ID NO: 32344 - DNA, 16 bp, H. sapiens
agaactgaattgaatt

SEQ ID NO: 32345 - DNA, 16 bp, H. sapiens
agaactgacatcttta

SEQ ID NO: 32346 - DNA, 16 bp, H. sapiens
agaactgacattttga

SEQ ID NO: 32347 - DNA, 16 bp, H. sapiens
agaactgacattttta

SEQ ID NO: 32348 - DNA, 16 bp, H. sapiens
agaactgagaaataca

SEQ ID NO: 32349 - DNA, 16 bp, H. sapiens
agaactgagagacaat

SEQ ID NO: 32350 - DNA, 16 bp, H. sapiens
agaactgagttcaagt

SEQ ID NO: 32351 - DNA, 16 bp, H. sapiens
agaactgattgcttgc

SEQ ID NO: 32352 - DNA, 16 bp, H. sapiens
agaactgcatggggga

SEQ ID NO: 32353 - DNA, 16 bp, H. sapiens
agaactgcctctgagc

SEQ ID NO: 32354 - DNA, 16 bp, H. sapiens
agaactgcttgagttt

SEQ ID NO: 32355 - DNA, 16 bp, H. sapiens
agaactggaaaaaaac

SEQ ID NO: 32356 - DNA, 16 bp, H. sapiens
agaactggaaaagcaa

SEQ ID NO: 32357 - DNA, 16 bp, H. sapiens
agaactggaacaaaac

SEQ ID NO: 32358 - DNA, 17 bp, H. sapiens
agaactggaacaagaca

SEQ ID NO: 32359 - DNA, 16 bp, H. sapiens
agaactggacagagga

SEQ ID NO: 32360 - DNA, 16 bp, H. sapiens
agaactgggactagaa

SEQ ID NO: 32361 - DNA, 16 bp, H. sapiens
agaactggttgtgtat

SEQ ID NO: 32362 - DNA, 16 bp, H. sapiens
agaactgtctattcaa

SEQ ID NO: 32363 - DNA, 16 bp, H. sapiens
agaactgtgagaaaca

SEQ ID NO: 32364 - DNA, 19 bp, H. sapiens
agaactgtgagaaataaac

SEQ ID NO: 32365 - DNA, 16 bp, H. sapiens
agaactgtgagataat

SEQ ID NO: 32366 - DNA, 16 bp, H. sapiens
agaactgtgaggaaaa

SEQ ID NO: 32367 - DNA, 16 bp, H. sapiens
agaactgtgcttggca

SEQ ID NO: 32368 - DNA, 16 bp, H. sapiens
agaactgtgtgaaaat

SEQ ID NO: 32369 - DNA, 16 bp, H. sapiens
agaactgttaaaaaaa

SEQ ID NO: 32370 - DNA, 16 bp, H. sapiens
agaacttaaaaataca

SEQ ID NO: 32371 - DNA, 16 bp, H. sapiens
agaacttaaagcaaaa

SEQ ID NO: 32372 - DNA, 16 bp, H. sapiens
agaacttaaagtaaaa

SEQ ID NO: 32373 - DNA, 16 bp, H. sapiens
agaacttaatttaaaa

SEQ ID NO: 32374 - DNA, 16 bp, H. sapiens
agaacttcaaaatgcc

SEQ ID NO: 32375 - DNA, 16 bp, H. sapiens
agaacttcaagtaaaa

SEQ ID NO: 32376 - DNA, 16 bp, H. sapiens
agaacttcacaatgca

SEQ ID NO: 32377 - DNA, 16 bp, H. sapiens
agaacttcagagctca

SEQ ID NO: 32378 - DNA, 16 bp, H. sapiens
agaacttcatctaaaa

SEQ ID NO: 32379 - DNA, 18 bp, H. sapiens
agaacttccccaacctag

SEQ ID NO: 32380 - DNA, 16 bp, H. sapiens
agaacttccccaattt

SEQ ID NO: 32381 - DNA, 16 bp, H. sapiens
agaacttcgtgaagca

SEQ ID NO: 32382 - DNA, 18 bp, H. sapiens
agaacttcgtgaagcata

SEQ ID NO: 32383 - DNA, 16 bp, H. sapiens
agaacttctcaaacct

SEQ ID NO: 32384 - DNA, 16 bp, H. sapiens
agaacttgaacagaca

SEQ ID NO: 32385 - DNA, 16 bp, H. sapiens
agaacttgaacccagg

SEQ ID NO: 32386 - DNA, 16 bp, H. sapiens
agaacttgatttctgc

SEQ ID NO: 32387 - DNA, 16 bp, H. sapiens
agaacttgtctctaaa

SEQ ID NO: 32388 - DNA, 16 bp, H. sapiens
agaactttaaaaaatt

SEQ ID NO: 32389 - DNA, 16 bp, H. sapiens
agaactttcctgcttt

SEQ ID NO: 32390 - DNA, 16 bp, H. sapiens
agaactttctatgatg

SEQ ID NO: 32391 - DNA, 16 bp, H. sapiens
agaactttctccaaga

SEQ ID NO: 32392 - DNA, 16 bp, H. sapiens
agaactttctgcagtg

SEQ ID NO: 32393 - DNA, 16 bp, H. sapiens
agaactttctgtgata

SEQ ID NO: 32394 - DNA, 16 bp, H. sapiens
agaactttctgtgatg

SEQ ID NO: 32395 - DNA, 16 bp, H. sapiens
agaactttctttcttt

SEQ ID NO: 32396 - DNA, 16 bp, H. sapiens
agaactttgagaaata

SEQ ID NO: 32397 - DNA, 16 bp, H. sapiens
agaactttggtctcca

SEQ ID NO: 32398 - DNA, 16 bp, H. sapiens
agaactttgtgaaaca

SEQ ID NO: 32399 - DNA, 16 bp, H. sapiens
agaactttgtgacaca

SEQ ID NO: 32400 - DNA, 16 bp, H. sapiens
agaacttttaaaaatt

SEQ ID NO: 32401 - DNA, 16 bp, H. sapiens
agaacttttaaaatga

SEQ ID NO: 32402 - DNA, 16 bp, H. sapiens
agaacttttaacattt

SEQ ID NO: 32403 - DNA, 16 bp, H. sapiens
agaacttttacatttt

SEQ ID NO: 32404 - DNA, 16 bp, H. sapiens
agaacttttctttttt

SEQ ID NO: 32405 - DNA, 16 bp, H. sapiens
agaactttttcctttt

SEQ ID NO: 32406 - DNA, 16 bp, H. sapiens
agaagaaaaaactgag

SEQ ID NO: 32407 - DNA, 16 bp, H. sapiens
agaagaaaaaatactt

SEQ ID NO: 32408 - DNA, 16 bp, H. sapiens
agaagaaaaacttcat

SEQ ID NO: 32409 - DNA, 16 bp, H. sapiens
agaagaaaaagtcaga

SEQ ID NO: 32410 - DNA, 16 bp, H. sapiens
agaagaaaaataactt

SEQ ID NO: 32411 - DNA, 16 bp, H. sapiens
agaagaaaaatagtca

SEQ ID NO: 32412 - DNA, 16 bp, H. sapiens
agaagaaaaatctcaa

SEQ ID NO: 32413 - DNA, 16 bp, H. sapiens
agaagaaaaatgttat

SEQ ID NO: 32414 - DNA, 16 bp, H. sapiens
agaagaaaaatgttgg

SEQ ID NO: 32415 - DNA, 16 bp, H. sapiens
agaagaaaaattatct

SEQ ID NO: 32416 - DNA, 16 bp, H. sapiens
agaagaaaaattattc

SEQ ID NO: 32417 - DNA, 16 bp, H. sapiens
agaagaaaaattcaga

SEQ ID NO: 32418 - DNA, 16 bp, H. sapiens
agaagaaaaatttcaa

SEQ ID NO: 32419 - DNA, 16 bp, H. sapiens
agaagaaaacataatt

SEQ ID NO: 32420 - DNA, 16 bp, H. sapiens
agaagaaaacattgga

SEQ ID NO: 32421 - DNA, 16 bp, H. sapiens
agaagaaaacattttc

SEQ ID NO: 32422 - DNA, 16 bp, H. sapiens
agaagaaaacattttt

SEQ ID NO: 32423 - DNA, 16 bp, H. sapiens
agaagaaaaccaaggc

SEQ ID NO: 32424 - DNA, 16 bp, H. sapiens
agaagaaaacccagga

SEQ ID NO: 32425 - DNA, 16 bp, H. sapiens
agaagaaaacctgagg

SEQ ID NO: 32426 - DNA, 16 bp, H. sapiens
agaagaaaagataact

SEQ ID NO: 32427 - DNA, 16 bp, H. sapiens
agaagaaaagatcaat

SEQ ID NO: 32428 - DNA, 16 bp, H. sapiens
agaagaaaagatcagt

SEQ ID NO: 32429 - DNA, 16 bp, H. sapiens
agaagaaaaggacttt

SEQ ID NO: 32430 - DNA, 16 bp, H. sapiens
agaagaaaagtttgaa

SEQ ID NO: 32431 - DNA, 16 bp, H. sapiens
agaagaaaataacttt

SEQ ID NO: 32432 - DNA, 16 bp, H. sapiens
agaagaaaatacagag

SEQ ID NO: 32433 - DNA, 16 bp, H. sapiens
agaagaaaatatcaga

SEQ ID NO: 32434 - DNA, 16 bp, H. sapiens
agaagaaaatcccatt

SEQ ID NO: 32435 - DNA, 16 bp, H. sapiens
agaagaaaatctggaa

SEQ ID NO: 32436 - DNA, 16 bp, H. sapiens
agaagaaaatcttcat

SEQ ID NO: 32437 - DNA, 16 bp, H. sapiens
agaagaaaatgacaga

SEQ ID NO: 32438 - DNA, 16 bp, H. sapiens
agaagaaaatgctgac

SEQ ID NO: 32439 - DNA, 16 bp, H. sapiens
agaagaaaatgctgag

SEQ ID NO: 32440 - DNA, 16 bp, H. sapiens
agaagaaaatgttatt

SEQ ID NO: 32441 - DNA, 16 bp, H. sapiens
agaagaaaatgtttat

SEQ ID NO: 32442 - DNA, 16 bp, H. sapiens
agaagaaaatgtttta

SEQ ID NO: 32443 - DNA, 16 bp, H. sapiens
agaagaaaatttcaaa

SEQ ID NO: 32444 - DNA, 16 bp, H. sapiens
agaagaaaattttctt

SEQ ID NO: 32445 - DNA, 16 bp, H. sapiens
agaagaaacaaaattt

SEQ ID NO: 32446 - DNA, 16 bp, H. sapiens
agaagaaacaaatgga

SEQ ID NO: 32447 - DNA, 16 bp, H. sapiens
agaagaaacagaaagt

SEQ ID NO: 32448 - DNA, 16 bp, H. sapiens
agaagaaacatcagaa

SEQ ID NO: 32449 - DNA, 16 bp, H. sapiens
agaagaaactgaaatg

SEQ ID NO: 32450 - DNA, 16 bp, H. sapiens
agaagaaactgaggct

SEQ ID NO: 32451 - DNA, 16 bp, H. sapiens
agaagaaagaaaacct

SEQ ID NO: 32452 - DNA, 16 bp, H. sapiens
agaagaaagaaacatg

SEQ ID NO: 32453 - DNA, 16 bp, H. sapiens
agaagaaagaatctgt

SEQ ID NO: 32454 - DNA, 16 bp, H. sapiens
agaagaaagaatttga

SEQ ID NO: 32455 - DNA, 16 bp, H. sapiens
agaagaaagactggaa

SEQ ID NO: 32456 - DNA, 16 bp, H. sapiens
agaagaaagagcaaat

SEQ ID NO: 32457 - DNA, 16 bp, H. sapiens
agaagaaagctggaag

SEQ ID NO: 32458 - DNA, 16 bp, H. sapiens
agaagaaagtgaaaca

SEQ ID NO: 32459 - DNA, 16 bp, H. sapiens
agaagaaagtggaatg

SEQ ID NO: 32460 - DNA, 16 bp, H. sapiens
agaagaaataaaatcc

SEQ ID NO: 32461 - DNA, 16 bp, H. sapiens
agaagaaatacaaatg

SEQ ID NO: 32462 - DNA, 16 bp, H. sapiens
agaagaaatagcaaat

SEQ ID NO: 32463 - DNA, 16 bp, H. sapiens
agaagaaatcaagaag

SEQ ID NO: 32464 - DNA, 16 bp, H. sapiens
agaagaaatcacaaga

SEQ ID NO: 32465 - DNA, 16 bp, H. sapiens
agaagaaatcatgaaa

SEQ ID NO: 32466 - DNA, 16 bp, H. sapiens
agaagaaatctgaaaa

SEQ ID NO: 32467 - DNA, 16 bp, H. sapiens
agaagaaatgacattt

SEQ ID NO: 32468 - DNA, 16 bp, H. sapiens
agaagaaatgcaaacc

SEQ ID NO: 32469 - DNA, 16 bp, H. sapiens
agaagaaatggaattt

SEQ ID NO: 32470 - DNA, 16 bp, H. sapiens
agaagaaatggtacca

SEQ ID NO: 32471 - DNA, 16 bp, H. sapiens
agaagaaatgttaaag

SEQ ID NO: 32472 - DNA, 16 bp, H. sapiens
agaagaaatgtttgaa

SEQ ID NO: 32473 - DNA, 16 bp, H. sapiens
agaagaaattatagga

SEQ ID NO: 32474 - DNA, 16 bp, H. sapiens
agaagaaattatttag

SEQ ID NO: 32475 - DNA, 16 bp, H. sapiens
agaagaaattatttct

SEQ ID NO: 32476 - DNA, 16 bp, H. sapiens
agaagaaattatttta

SEQ ID NO: 32477 - DNA, 16 bp, H. sapiens
agaagaaattcaaaat

SEQ ID NO: 32478 - DNA, 16 bp, H. sapiens
agaagaaattcaagaa

SEQ ID NO: 32479 - DNA, 16 bp, H. sapiens
agaagaaatttcaaaa

SEQ ID NO: 32480 - DNA, 16 bp, H. sapiens
agaagaaatttcaaag

SEQ ID NO: 32481 - DNA, 16 bp, H. sapiens
agaagaaatttttttt

SEQ ID NO: 32482 - DNA, 16 bp, H. sapiens
agaagaacaagatcat

SEQ ID NO: 32483 - DNA, 16 bp, H. sapiens
agaagaacagaaatca

SEQ ID NO: 32484 - DNA, 16 bp, H. sapiens
agaagaacagaatgct

SEQ ID NO: 32485 - DNA, 16 bp, H. sapiens
agaagaacagatgaaa

SEQ ID NO: 32486 - DNA, 16 bp, H. sapiens
agaagaacataaatta

SEQ ID NO: 32487 - DNA, 16 bp, H. sapiens
agaagaacattccaga

SEQ ID NO: 32488 - DNA, 16 bp, H. sapiens
agaagaaccaaatgaa

SEQ ID NO: 32489 - DNA, 16 bp, H. sapiens
agaagaactacaaaac

SEQ ID NO: 32490 - DNA, 16 bp, H. sapiens
agaagaactagaaaag

SEQ ID NO: 32491 - DNA, 16 bp, H. sapiens
agaagaactagagaag

SEQ ID NO: 32492 - DNA, 16 bp, H. sapiens
agaagaactgaaatca

SEQ ID NO: 32493 - DNA, 16 bp, H. sapiens
agaagaactggtacca

SEQ ID NO: 32494 - DNA, 16 bp, H. sapiens
agaagaactttttttt

SEQ ID NO: 32495 - DNA, 16 bp, H. sapiens
agaagaagaaaaactg

SEQ ID NO: 32496 - DNA, 16 bp, H. sapiens
agaagaagaaaacttt

SEQ ID NO: 32497 - DNA, 16 bp, H. sapiens
agaagaagaaatacat

SEQ ID NO: 32498 - DNA, 16 bp, H. sapiens
agaagaagaaattatt

SEQ ID NO: 32499 - DNA, 16 bp, H. sapiens
agaagaagaagaaatc

SEQ ID NO: 32500 - DNA, 16 bp, H. sapiens
agaagaagaagaagct

SEQ ID NO: 32501 - DNA, 16 bp, H. sapiens
agaagaagaagaatct

SEQ ID NO: 32502 - DNA, 16 bp, H. sapiens
agaagaagaaggctgg

SEQ ID NO: 32503 - DNA, 16 bp, H. sapiens
agaagaagagactgag

SEQ ID NO: 32504 - DNA, 16 bp, H. sapiens
agaagaagcagctgga

SEQ ID NO: 32505 - DNA, 16 bp, H. sapiens
agaagaagcttctctg

SEQ ID NO: 32506 - DNA, 16 bp, H. sapiens
agaagaaggaaattct

SEQ ID NO: 32507 - DNA, 16 bp, H. sapiens
agaagaaggcttcaaa

SEQ ID NO: 32508 - DNA, 16 bp, H. sapiens
agaagaagtaaaaact

SEQ ID NO: 32509 - DNA, 16 bp, H. sapiens
agaagaagtcagagag

SEQ ID NO: 32510 - DNA, 16 bp, H. sapiens
agaagaatattttgtg

SEQ ID NO: 32511 - DNA, 16 bp, H. sapiens
agaagaatcaaattga

SEQ ID NO: 32512 - DNA, 16 bp, H. sapiens
agaagaatcaattgaa

SEQ ID NO: 32513 - DNA, 16 bp, H. sapiens
agaagaatcacttgag

SEQ ID NO: 32514 - DNA, 16 bp, H. sapiens
agaagaatcacttgga

SEQ ID NO: 32515 - DNA, 16 bp, H. sapiens
agaagaatcactttaa

SEQ ID NO: 32516 - DNA, 16 bp, H. sapiens
agaagaatcagtattg

SEQ ID NO: 32517 - DNA, 16 bp, H. sapiens
agaagaatccacacat

SEQ ID NO: 32518 - DNA, 16 bp, H. sapiens
agaagaatgaaactag

SEQ ID NO: 32519 - DNA, 16 bp, H. sapiens
agaagaatgaggtcat

SEQ ID NO: 32520 - DNA, 16 bp, H. sapiens
agaagaatggtgtgaa

SEQ ID NO: 32521 - DNA, 16 bp, H. sapiens
agaagaatgtatattc

SEQ ID NO: 32522 - DNA, 16 bp, H. sapiens
agaagaatgtggaaag

SEQ ID NO: 32523 - DNA, 16 bp, H. sapiens
agaagaattatctgga

SEQ ID NO: 32524 - DNA, 16 bp, H. sapiens
agaagaattttggaaa

SEQ ID NO: 32525 - DNA, 16 bp, H. sapiens
agaagacaaaactgag

SEQ ID NO: 32526 - DNA, 16 bp, H. sapiens
agaagacaaaatatat

SEQ ID NO: 32527 - DNA, 16 bp, H. sapiens
agaagacaaatactgc

SEQ ID NO: 32528 - DNA, 16 bp, H. sapiens
agaagacaaatggaaa

SEQ ID NO: 32529 - DNA, 16 bp, H. sapiens
agaagacaataaaatg

SEQ ID NO: 32530 - DNA, 16 bp, H. sapiens
agaagacacagagaca

SEQ ID NO: 32531 - DNA, 16 bp, H. sapiens
agaagacacataaatg

SEQ ID NO: 32532 - DNA, 16 bp, H. sapiens
agaagacagaagggca

SEQ ID NO: 32533 - DNA, 16 bp, H. sapiens
agaagacagctttgac

SEQ ID NO: 32534 - DNA, 16 bp, H. sapiens
agaagacagtggagca

SEQ ID NO: 32535 - DNA, 16 bp, H. sapiens
agaagacatagaagaa

SEQ ID NO: 32536 - DNA, 16 bp, H. sapiens
agaagacatataaatt

SEQ ID NO: 32537 - DNA, 16 bp, H. sapiens
agaagacatctatgca

SEQ ID NO: 32538 - DNA, 16 bp, H. sapiens
agaagacatgagaaga

SEQ ID NO: 32539 - DNA, 16 bp, H. sapiens
agaagacattcatgta

SEQ ID NO: 32540 - DNA, 16 bp, H. sapiens
agaagacatttttaaa

SEQ ID NO: 32541 - DNA, 16 bp, H. sapiens
agaagacccaaataaa

SEQ ID NO: 32542 - DNA, 16 bp, H. sapiens
agaagaccctgtctca

SEQ ID NO: 32543 - DNA, 16 bp, H. sapiens
agaagacggccatctg

SEQ ID NO: 32544 - DNA, 16 bp, H. sapiens
agaagactgaggcaga

SEQ ID NO: 32545 - DNA, 16 bp, H. sapiens
agaagactggaataaa

SEQ ID NO: 32546 - DNA, 16 bp, H. sapiens
agaagactttatttct

SEQ ID NO: 32547 - DNA, 16 bp, H. sapiens
agaagacttttaaaaa

SEQ ID NO: 32548 - DNA, 16 bp, H. sapiens
agaagacttttcagtg

SEQ ID NO: 32549 - DNA, 16 bp, H. sapiens
agaagagaaaaatcca

SEQ ID NO: 32550 - DNA, 16 bp, H. sapiens
agaagagaaaactgaa

SEQ ID NO: 32551 - DNA, 16 bp, H. sapiens
agaagagaaactccaa

SEQ ID NO: 32552 - DNA, 16 bp, H. sapiens
agaagagaaagctgag

SEQ ID NO: 32553 - DNA, 16 bp, H. sapiens
agaagagaaagtcaga

SEQ ID NO: 32554 - DNA, 16 bp, H. sapiens
agaagagaaatgattt

SEQ ID NO: 32555 - DNA, 16 bp, H. sapiens
agaagagaacttgtgc

SEQ ID NO: 32556 - DNA, 16 bp, H. sapiens
agaagagaagaagtca

SEQ ID NO: 32557 - DNA, 22 bp, H. sapiens
agaagagaagtttagagaaaaa

SEQ ID NO: 32558 - DNA, 16 bp, H. sapiens
agaagagaatagacaa

SEQ ID NO: 32559 - DNA, 16 bp, H. sapiens
agaagagaatatttta

SEQ ID NO: 32560 - DNA, 16 bp, H. sapiens
agaagagaatgagatg

SEQ ID NO: 32561 - DNA, 16 bp, H. sapiens
agaagagacaaatctt

SEQ ID NO: 32562 - DNA, 16 bp, H. sapiens
agaagagacagcagag

SEQ ID NO: 32563 - DNA, 16 bp, H. sapiens
agaagagactttaaaa

SEQ ID NO: 32564 - DNA, 16 bp, H. sapiens
agaagagagaaattca

SEQ ID NO: 32565 - DNA, 16 bp, H. sapiens
agaagagagaagatct

SEQ ID NO: 32566 - DNA, 16 bp, H. sapiens
agaagagagaattttg

SEQ ID NO: 32567 - DNA, 16 bp, H. sapiens
agaagagagagcccag

SEQ ID NO: 32568 - DNA, 16 bp, H. sapiens
agaagagagctccctg

SEQ ID NO: 32569 - DNA, 16 bp, H. sapiens
agaagagagcttgtgc

SEQ ID NO: 32570 - DNA, 16 bp, H. sapiens
agaagagaggaagtca

SEQ ID NO: 32571 - DNA, 16 bp, H. sapiens
agaagagaggacttga

SEQ ID NO: 32572 - DNA, 16 bp, H. sapiens
agaagagaggccaggc

SEQ ID NO: 32573 - DNA, 16 bp, H. sapiens
agaagagaggcctgga

SEQ ID NO: 32574 - DNA, 16 bp, H. sapiens
agaagagatggggttt

SEQ ID NO: 32575 - DNA, 16 bp, H. sapiens
agaagagatttttatt

SEQ ID NO: 32576 - DNA, 16 bp, H. sapiens
agaagagcaaaactcc

SEQ ID NO: 32577 - DNA, 16 bp, H. sapiens
agaagagcaaagtaaa

SEQ ID NO: 32578 - DNA, 37 bp, H. sapiens
agaagagcaactccaagacacataattgtcagattca

SEQ ID NO: 32579 - DNA, 46 bp, H. sapiens
agaagagcaactccaagacacataattgtcagattcaccaaagttg

SEQ ID NO: 32580 - DNA, 16 bp, H. sapiens
agaagagcaactgcaa

SEQ ID NO: 32581 - DNA, 16 bp, H. sapiens
agaagagcagaagaat

SEQ ID NO: 32582 - DNA, 16 bp, H. sapiens
agaagagcagctccaa

SEQ ID NO: 32583 - DNA, 16 bp, H. sapiens
agaagagccacatcac

SEQ ID NO: 32584 - DNA, 16 bp, H. sapiens
agaagagcctggccaa

SEQ ID NO: 32585 - DNA, 16 bp, H. sapiens
agaagagcgaaactcc

SEQ ID NO: 32586 - DNA, 16 bp, H. sapiens
agaagagctaaaacaa

SEQ ID NO: 32587 - DNA, 16 bp, H. sapiens
agaagagctaaataaa

SEQ ID NO: 32588 - DNA, 16 bp, H. sapiens
agaagaggaaactgaa

SEQ ID NO: 32589 - DNA, 16 bp, H. sapiens
agaagaggaaattgag

SEQ ID NO: 32590 - DNA, 16 bp, H. sapiens
agaagaggaccaccat

SEQ ID NO: 32591 - DNA, 16 bp, H. sapiens
agaagaggagcacacc

SEQ ID NO: 32592 - DNA, 16 bp, H. sapiens
agaagaggaggaacca

SEQ ID NO: 32593 - DNA, 16 bp, H. sapiens
agaagaggtgctctga

SEQ ID NO: 32594 - DNA, 16 bp, H. sapiens
agaagaggtttcacca

SEQ ID NO: 32595 - DNA, 16 bp, H. sapiens
agaagagtcagtgtca

SEQ ID NO: 32596 - DNA, 16 bp, H. sapiens
agaagagtgcctggca

SEQ ID NO: 32597 - DNA, 16 bp, H. sapiens
agaagagttaactatt

SEQ ID NO: 32598 - DNA, 16 bp, H. sapiens
agaagagtttttatta

SEQ ID NO: 32599 - DNA, 16 bp, H. sapiens
agaagataacacagga

SEQ ID NO: 32600 - DNA, 16 bp, H. sapiens
agaagataactttgga

SEQ ID NO: 32601 - DNA, 16 bp, H. sapiens
agaagatacacagata

SEQ ID NO: 32602 - DNA, 16 bp, H. sapiens
agaagatacacagatg

SEQ ID NO: 32603 - DNA, 16 bp, H. sapiens
agaagatagagacaca

SEQ ID NO: 32604 - DNA, 16 bp, H. sapiens
agaagatatacagatg

SEQ ID NO: 32605 - DNA, 16 bp, H. sapiens
agaagatatttgcaat

SEQ ID NO: 32606 - DNA, 17 bp, H. sapiens
agaagatcaagaccatc

SEQ ID NO: 32607 - DNA, 16 bp, H. sapiens
agaagatcaatgaaac

SEQ ID NO: 32608 - DNA, 16 bp, H. sapiens
agaagatcgagatcat

SEQ ID NO: 32609 - DNA, 16 bp, H. sapiens
agaagatgaaaaggca

SEQ ID NO: 32610 - DNA, 16 bp, H. sapiens
agaagatgaatctctg

SEQ ID NO: 32611 - DNA, 16 bp, H. sapiens
agaagatgacagctcc

SEQ ID NO: 32612 - DNA, 16 bp, H. sapiens
agaagatgatattact

SEQ ID NO: 32613 - DNA, 16 bp, H. sapiens
agaagatgcatggaaa

SEQ ID NO: 32614 - DNA, 16 bp, H. sapiens
agaagatgccatctat

SEQ ID NO: 32615 - DNA, 16 bp, H. sapiens
agaagatgctcagtaa

SEQ ID NO: 32616 - DNA, 16 bp, H. sapiens
agaagatggaaaaggc

SEQ ID NO: 32617 - DNA, 16 bp, H. sapiens
agaagatggaggcaga

SEQ ID NO: 32618 - DNA, 16 bp, H. sapiens
agaagatggaggctgc

SEQ ID NO: 32619 - DNA, 16 bp, H. sapiens
agaagatggatggatg

SEQ ID NO: 32620 - DNA, 16 bp, H. sapiens
agaagatggatgtcct

SEQ ID NO: 32621 - DNA, 16 bp, H. sapiens
agaagatggcagagcc

SEQ ID NO: 32622 - DNA, 16 bp, H. sapiens
agaagatgggaaaatg

SEQ ID NO: 32623 - DNA, 16 bp, H. sapiens
agaagatgtatgaaaa

SEQ ID NO: 32624 - DNA, 16 bp, H. sapiens
agaagatgtggagaaa

SEQ ID NO: 32625 - DNA, 16 bp, H. sapiens
agaagatgtgggaaag

SEQ ID NO: 32626 - DNA, 16 bp, H. sapiens
agaagatgtggtacat

SEQ ID NO: 32627 - DNA, 17 bp, H. sapiens
agaagattagcagcctg

SEQ ID NO: 32628 - DNA, 16 bp, H. sapiens
agaagattattctcaa

SEQ ID NO: 32629 - DNA, 16 bp, H. sapiens
agaagattattttgga

SEQ ID NO: 32630 - DNA, 16 bp, H. sapiens
agaagattccagaaat

SEQ ID NO: 32631 - DNA, 17 bp, H. sapiens
agaagattgagaccatc

SEQ ID NO: 32632 - DNA, 16 bp, H. sapiens
agaagattttttaaat

SEQ ID NO: 32633 - DNA, 16 bp, H. sapiens
agaagcaaaagtagaa

SEQ ID NO: 32634 - DNA, 16 bp, H. sapiens
agaagcaaaatgtatt

SEQ ID NO: 32635 - DNA, 16 bp, H. sapiens
agaagcaaagagtaga

SEQ ID NO: 32636 - DNA, 26 bp, H. sapiens
agaagcaaataagctgactcttgggc

SEQ ID NO: 32637 - DNA, 16 bp, H. sapiens
agaagcaaatgctgag

SEQ ID NO: 32638 - DNA, 16 bp, H. sapiens
agaagcaacacaggaa

SEQ ID NO: 32639 - DNA, 16 bp, H. sapiens
agaagcaacatttgaa

SEQ ID NO: 32640 - DNA, 16 bp, H. sapiens
agaagcaacccaagtg

SEQ ID NO: 32641 - DNA, 16 bp, H. sapiens
agaagcaactcaaatg

SEQ ID NO: 32642 - DNA, 16 bp, H. sapiens
agaagcaagagcagac

SEQ ID NO: 32643 - DNA, 16 bp, H. sapiens
agaagcaagatggagc

SEQ ID NO: 32644 - DNA, 16 bp, H. sapiens
agaagcaaggaaggat

SEQ ID NO: 32645 - DNA, 16 bp, H. sapiens
agaagcaatcaaactc

SEQ ID NO: 32646 - DNA, 16 bp, H. sapiens
agaagcaatcagaaga

SEQ ID NO: 32647 - DNA, 16 bp, H. sapiens
agaagcaatggagaaa

SEQ ID NO: 32648 - DNA, 16 bp, H. sapiens
agaagcacattttaaa

SEQ ID NO: 32649 - DNA, 16 bp, H. sapiens
agaagcactctcagaa

SEQ ID NO: 32650 - DNA, 16 bp, H. sapiens
agaagcagaaaaatca

SEQ ID NO: 32651 - DNA, 16 bp, H. sapiens
agaagcagaaaaggcc

SEQ ID NO: 32652 - DNA, 16 bp, H. sapiens
agaagcagaaagtaaa

SEQ ID NO: 32653 - DNA, 16 bp, H. sapiens
agaagcagaaatattt

SEQ ID NO: 32654 - DNA, 16 bp, H. sapiens
agaagcagaacaactg

SEQ ID NO: 32655 - DNA, 16 bp, H. sapiens
agaagcagaacctgag

SEQ ID NO: 32656 - DNA, 16 bp, H. sapiens
agaagcagaagaaata

SEQ ID NO: 32657 - DNA, 16 bp, H. sapiens
agaagcagaagctgct

SEQ ID NO: 32658 - DNA, 16 bp, H. sapiens
agaagcagaaggaata

SEQ ID NO: 32659 - DNA, 16 bp, H. sapiens
agaagcagagaaaagt

SEQ ID NO: 32660 - DNA, 16 bp, H. sapiens
agaagcagagcagatg

SEQ ID NO: 32661 - DNA, 16 bp, H. sapiens
agaagcagagccagga

SEQ ID NO: 32662 - DNA, 16 bp, H. sapiens
agaagcagagcctgag

SEQ ID NO: 32663 - DNA, 16 bp, H. sapiens
agaagcagaggctgag

SEQ ID NO: 32664 - DNA, 16 bp, H. sapiens
agaagcagaggctgca

SEQ ID NO: 32665 - DNA, 16 bp, H. sapiens
agaagcagatcctgag

SEQ ID NO: 32666 - DNA, 16 bp, H. sapiens
agaagcagatgccaag

SEQ ID NO: 32667 - DNA, 16 bp, H. sapiens
agaagcagcagaagca

SEQ ID NO: 32668 - DNA, 16 bp, H. sapiens
agaagcagcagcaaca

SEQ ID NO: 32669 - DNA, 16 bp, H. sapiens
agaagcagcagcagaa

SEQ ID NO: 32670 - DNA, 16 bp, H. sapiens
agaagcagcagcagga

SEQ ID NO: 32671 - DNA, 16 bp, H. sapiens
agaagcagcagccagg

SEQ ID NO: 32672 - DNA, 16 bp, H. sapiens
agaagcagcagctgga

SEQ ID NO: 32673 - DNA, 16 bp, H. sapiens
agaagcagccaggcca

SEQ ID NO: 32674 - DNA, 16 bp, H. sapiens
agaagcagccaggcta

SEQ ID NO: 32675 - DNA, 16 bp, H. sapiens
agaagcagctcctcat

SEQ ID NO: 32676 - DNA, 16 bp, H. sapiens
agaagcagctgcagtc

SEQ ID NO: 32677 - DNA, 16 bp, H. sapiens
agaagcagctgtggtc

SEQ ID NO: 32678 - DNA, 16 bp, H. sapiens
agaagcaggagagctg

SEQ ID NO: 32679 - DNA, 16 bp, H. sapiens
agaagcagggagtaga

SEQ ID NO: 32680 - DNA, 16 bp, H. sapiens
agaagcatgatgctgg

SEQ ID NO: 32681 - DNA, 16 bp, H. sapiens
agaagcattctgaaaa

SEQ ID NO: 32682 - DNA, 16 bp, H. sapiens
agaagcattctgagga

SEQ ID NO: 32683 - DNA, 16 bp, H. sapiens
agaagcattgcatgca

SEQ ID NO: 32684 - DNA, 16 bp, H. sapiens
agaagcatttgacaaa

SEQ ID NO: 32685 - DNA, 16 bp, H. sapiens
agaagccaagaaataa

SEQ ID NO: 32686 - DNA, 16 bp, H. sapiens
agaagccaagaagaat

SEQ ID NO: 32687 - DNA, 16 bp, H. sapiens
agaagccaagaagatg

SEQ ID NO: 32688 - DNA, 16 bp, H. sapiens
agaagccaagggaaga

SEQ ID NO: 32689 - DNA, 16 bp, H. sapiens
agaagccaatttgaaa

SEQ ID NO: 32690 - DNA, 16 bp, H. sapiens
agaagccagaagacag

SEQ ID NO: 32691 - DNA, 16 bp, H. sapiens
agaagccagaggccag

SEQ ID NO: 32692 - DNA, 16 bp, H. sapiens
agaagccagatacaaa

SEQ ID NO: 32693 - DNA, 16 bp, H. sapiens
agaagccaggcaaaaa

SEQ ID NO: 32694 - DNA, 16 bp, H. sapiens
agaagccagggctcag

SEQ ID NO: 32695 - DNA, 16 bp, H. sapiens
agaagccagttacaaa

SEQ ID NO: 32696 - DNA, 16 bp, H. sapiens
agaagccataaaggaa

SEQ ID NO: 32697 - DNA, 16 bp, H. sapiens
agaagcccaaacctca

SEQ ID NO: 32698 - DNA, 16 bp, H. sapiens
agaagcccagcagatg

SEQ ID NO: 32699 - DNA, 16 bp, H. sapiens
agaagcccatcagact

SEQ ID NO: 32700 - DNA, 16 bp, H. sapiens
agaagcccctctcagg

SEQ ID NO: 32701 - DNA, 16 bp, H. sapiens
agaagcctcacaatca

SEQ ID NO: 32702 - DNA, 16 bp, H. sapiens
agaagcctggcagaca

SEQ ID NO: 32703 - DNA, 16 bp, H. sapiens
agaagccttatcaaat

SEQ ID NO: 32704 - DNA, 16 bp, H. sapiens
agaagccttcctggag

SEQ ID NO: 32705 - DNA, 16 bp, H. sapiens
agaagccttctctgac

SEQ ID NO: 32706 - DNA, 16 bp, H. sapiens
agaagctagaaagagg

SEQ ID NO: 32707 - DNA, 16 bp, H. sapiens
agaagctagaagaggc

SEQ ID NO: 32708 - DNA, 16 bp, H. sapiens
agaagctaggagagaa

SEQ ID NO: 32709 - DNA, 16 bp, H. sapiens
agaagctcaacatcac

SEQ ID NO: 32710 - DNA, 16 bp, H. sapiens
agaagctcttcctggc

SEQ ID NO: 32711 - DNA, 16 bp, H. sapiens
agaagctctttagttc

SEQ ID NO: 32712 - DNA, 16 bp, H. sapiens
agaagctgaaaaagac

SEQ ID NO: 32713 - DNA, 16 bp, H. sapiens
agaagctgaaaaggct

SEQ ID NO: 32714 - DNA, 16 bp, H. sapiens
agaagctgaaagaaaa

SEQ ID NO: 32715 - DNA, 16 bp, H. sapiens
agaagctgaaagaaca

SEQ ID NO: 32716 - DNA, 16 bp, H. sapiens
agaagctgaaagagga

SEQ ID NO: 32717 - DNA, 16 bp, H. sapiens
agaagctgaagaaaga

SEQ ID NO: 32718 - DNA, 16 bp, H. sapiens
agaagctgaagaagaa

SEQ ID NO: 32719 - DNA, 16 bp, H. sapiens
agaagctgaagcagga

SEQ ID NO: 32720 - DNA, 16 bp, H. sapiens
agaagctgagaagggt

SEQ ID NO: 32721 - DNA, 16 bp, H. sapiens
agaagctgagagaaga

SEQ ID NO: 32722 - DNA, 16 bp, H. sapiens
agaagctgagcagatg

SEQ ID NO: 32723 - DNA, 16 bp, H. sapiens
agaagctgagcaggtg

SEQ ID NO: 32724 - DNA, 16 bp, H. sapiens
agaagctgaggcaaga

SEQ ID NO: 32725 - DNA, 16 bp, H. sapiens
agaagctgcagcaaat

SEQ ID NO: 32726 - DNA, 16 bp, H. sapiens
agaagctgcagcaagt

SEQ ID NO: 32727 - DNA, 16 bp, H. sapiens
agaagctgcagcaggt

SEQ ID NO: 32728 - DNA, 16 bp, H. sapiens
agaagctgcttttcct

SEQ ID NO: 32729 - DNA, 16 bp, H. sapiens
agaagctggaaaaaaa

SEQ ID NO: 32730 - DNA, 16 bp, H. sapiens
agaagctggaaaaagc

SEQ ID NO: 32731 - DNA, 16 bp, H. sapiens
agaagctggaaaagga

SEQ ID NO: 32732 - DNA, 16 bp, H. sapiens
agaagctggaaccaca

SEQ ID NO: 32733 - DNA, 16 bp, H. sapiens
agaagctggaagccat

SEQ ID NO: 32734 - DNA, 16 bp, H. sapiens
agaagctggacacaaa

SEQ ID NO: 32735 - DNA, 16 bp, H. sapiens
agaagctggagaaggc

SEQ ID NO: 32736 - DNA, 16 bp, H. sapiens
agaagctggagctgct

SEQ ID NO: 32737 - DNA, 16 bp, H. sapiens
agaagctggaggaaga

SEQ ID NO: 32738 - DNA, 16 bp, H. sapiens
agaagctggcagaggc

SEQ ID NO: 32739 - DNA, 16 bp, H. sapiens
agaagctgggaccaca

SEQ ID NO: 32740 - DNA, 17 bp, H. sapiens
agaagctgggattacag

SEQ ID NO: 32741 - DNA, 16 bp, H. sapiens
agaagctgggcagatg

SEQ ID NO: 32742 - DNA, 16 bp, H. sapiens
agaagctggtggagca

SEQ ID NO: 32743 - DNA, 16 bp, H. sapiens
agaagctggttccagg

SEQ ID NO: 32744 - DNA, 16 bp, H. sapiens
agaagctgtctgagaa

SEQ ID NO: 32745 - DNA, 16 bp, H. sapiens
agaagcttcaactctg

SEQ ID NO: 32746 - DNA, 16 bp, H. sapiens
agaagcttccagagga

SEQ ID NO: 32747 - DNA, 16 bp, H. sapiens
agaagcttctctggat

SEQ ID NO: 32748 - DNA, 16 bp, H. sapiens
agaagcttcttttttt

SEQ ID NO: 32749 - DNA, 16 bp, H. sapiens
agaagctttatttttt

SEQ ID NO: 32750 - DNA, 16 bp, H. sapiens
agaagctttgtgagaa

SEQ ID NO: 32751 - DNA, 16 bp, H. sapiens
agaagcttttaaactt

SEQ ID NO: 32752 - DNA, 16 bp, H. sapiens
agaagctttttggctt

SEQ ID NO: 32753 - DNA, 16 bp, H. sapiens
agaaggaaaaaactcc

SEQ ID NO: 32754 - DNA, 16 bp, H. sapiens
agaaggaaaacaaatt

SEQ ID NO: 32755 - DNA, 16 bp, H. sapiens
agaaggaaaacatttt

SEQ ID NO: 32756 - DNA, 16 bp, H. sapiens
agaaggaaaactaata

SEQ ID NO: 32757 - DNA, 16 bp, H. sapiens
agaaggaaaactggaa

SEQ ID NO: 32758 - DNA, 16 bp, H. sapiens
agaaggaaaatgaaca

SEQ ID NO: 32759 - DNA, 16 bp, H. sapiens
agaaggaaaatgacat

SEQ ID NO: 32760 - DNA, 16 bp, H. sapiens
agaaggaaaatggcag

SEQ ID NO: 32761 - DNA, 16 bp, H. sapiens
agaaggaaaatgtgtg

SEQ ID NO: 32762 - DNA, 16 bp, H. sapiens
agaaggaaacataggg

SEQ ID NO: 32763 - DNA, 16 bp, H. sapiens
agaaggaaacccagga

SEQ ID NO: 32764 - DNA, 16 bp, H. sapiens
agaaggaaacctccag

SEQ ID NO: 32765 - DNA, 16 bp, H. sapiens
agaaggaaacttagaa

SEQ ID NO: 32766 - DNA, 16 bp, H. sapiens
agaaggaaatatttga

SEQ ID NO: 32767 - DNA, 16 bp, H. sapiens
agaaggaaatgctgtc

SEQ ID NO: 32768 - DNA, 16 bp, H. sapiens
agaaggaaattattta

SEQ ID NO: 32769 - DNA, 16 bp, H. sapiens
agaaggaaattctgtc

SEQ ID NO: 32770 - DNA, 16 bp, H. sapiens
agaaggaaatttagaa

SEQ ID NO: 32771 - DNA, 16 bp, H. sapiens
agaaggaacagcatgt

SEQ ID NO: 32772 - DNA, 16 bp, H. sapiens
agaaggaacagcttcc

SEQ ID NO: 32773 - DNA, 16 bp, H. sapiens
agaaggaagaagttct

SEQ ID NO: 32774 - DNA, 16 bp, H. sapiens
agaaggaagcaatctg

SEQ ID NO: 32775 - DNA, 16 bp, H. sapiens
agaaggaaggaatgca

SEQ ID NO: 32776 - DNA, 16 bp, H. sapiens
agaaggaagtaaaatt

SEQ ID NO: 32777 - DNA, 16 bp, H. sapiens
agaaggaagtcactat

SEQ ID NO: 32778 - DNA, 16 bp, H. sapiens
agaaggaatcccagcc

SEQ ID NO: 32779 - DNA, 16 bp, H. sapiens
agaaggaatttctaag

SEQ ID NO: 32780 - DNA, 16 bp, H. sapiens
agaaggaatttgaaaa

SEQ ID NO: 32781 - DNA, 16 bp, H. sapiens
agaaggactcacagaa

SEQ ID NO: 32782 - DNA, 16 bp, H. sapiens
agaaggacttgtttgc

SEQ ID NO: 32783 - DNA, 16 bp, H. sapiens
agaaggactttgtctt

SEQ ID NO: 32784 - DNA, 16 bp, H. sapiens
agaaggagaaactgag

SEQ ID NO: 32785 - DNA, 16 bp, H. sapiens
agaaggagcaggcagc

SEQ ID NO: 32786 - DNA, 16 bp, H. sapiens
agaaggaggagctggt

SEQ ID NO: 32787 - DNA, 16 bp, H. sapiens
agaaggaggctgggca

SEQ ID NO: 32788 - DNA, 16 bp, H. sapiens
agaaggatcaaataga

SEQ ID NO: 32789 - DNA, 16 bp, H. sapiens
agaaggatgtgtttgc

SEQ ID NO: 32790 - DNA, 16 bp, H. sapiens
agaaggatttaacctt

SEQ ID NO: 32791 - DNA, 16 bp, H. sapiens
agaaggatttaactct

SEQ ID NO: 32792 - DNA, 16 bp, H. sapiens
agaaggattttttaaa

SEQ ID NO: 32793 - DNA, 16 bp, H. sapiens
agaaggcaaagcagga

SEQ ID NO: 32794 - DNA, 16 bp, H. sapiens
agaaggcaatgtgaag

SEQ ID NO: 32795 - DNA, 16 bp, H. sapiens
agaaggcacagagaag

SEQ ID NO: 32796 - DNA, 16 bp, H. sapiens
agaaggcagagccagg

SEQ ID NO: 32797 - DNA, 16 bp, H. sapiens
agaaggcagaggcagg

SEQ ID NO: 32798 - DNA, 16 bp, H. sapiens
agaaggcagatgattt

SEQ ID NO: 32799 - DNA, 16 bp, H. sapiens
agaaggcagctgtcta

SEQ ID NO: 32800 - DNA, 16 bp, H. sapiens
agaaggcaggaaggca

SEQ ID NO: 32801 - DNA, 16 bp, H. sapiens
agaaggcatggaagct

SEQ ID NO: 32802 - DNA, 16 bp, H. sapiens
agaaggccaccgtggt

SEQ ID NO: 32803 - DNA, 16 bp, H. sapiens
agaaggcctctctgag

SEQ ID NO: 32804 - DNA, 16 bp, H. sapiens
agaaggcggctgtctg

SEQ ID NO: 32805 - DNA, 16 bp, H. sapiens
agaaggctgaggcagg

SEQ ID NO: 32806 - DNA, 16 bp, H. sapiens
agaaggctgaggtggg

SEQ ID NO: 32807 - DNA, 16 bp, H. sapiens
agaaggctgggcgtgg

SEQ ID NO: 32808 - DNA, 16 bp, H. sapiens
agaaggctggggtggg

SEQ ID NO: 32809 - DNA, 16 bp, H. sapiens
agaaggcttcagatga

SEQ ID NO: 32810 - DNA, 16 bp, H. sapiens
agaaggcttcctggag

SEQ ID NO: 32811 - DNA, 16 bp, H. sapiens
agaagggaaactgagg

SEQ ID NO: 32812 - DNA, 16 bp, H. sapiens
agaagggaaatgtgga

SEQ ID NO: 32813 - DNA, 16 bp, H. sapiens
agaagggaacagacac

SEQ ID NO: 32814 - DNA, 16 bp, H. sapiens
agaagggacctggtgg

SEQ ID NO: 32815 - DNA, 16 bp, H. sapiens
agaagggagcaacaga

SEQ ID NO: 32816 - DNA, 16 bp, H. sapiens
agaagggccaggtgtg

SEQ ID NO: 32817 - DNA, 16 bp, H. sapiens
agaaggggaaatttgg

SEQ ID NO: 32818 - DNA, 16 bp, H. sapiens
agaaggggatggactt

SEQ ID NO: 32819 - DNA, 16 bp, H. sapiens
agaagggggaggtgct

SEQ ID NO: 32820 - DNA, 16 bp, H. sapiens
agaagggtgaggcagg

SEQ ID NO: 32821 - DNA, 16 bp, H. sapiens
agaagggtttttctga

SEQ ID NO: 32822 - DNA, 16 bp, H. sapiens
agaaggtaacattgga

SEQ ID NO: 32823 - DNA, 16 bp, H. sapiens
agaaggtactcagtaa

SEQ ID NO: 32824 - DNA, 16 bp, H. sapiens
agaaggtcaaggctgc

SEQ ID NO: 32825 - DNA, 16 bp, H. sapiens
agaaggtcagagagaa

SEQ ID NO: 32826 - DNA, 16 bp, H. sapiens
agaaggtgacatttca

SEQ ID NO: 32827 - DNA, 16 bp, H. sapiens
agaaggtgacatttga

SEQ ID NO: 32828 - DNA, 16 bp, H. sapiens
agaaggtggaaaggca

SEQ ID NO: 32829 - DNA, 16 bp, H. sapiens
agaaggtggagtttgc

SEQ ID NO: 32830 - DNA, 16 bp, H. sapiens
agaaggtggtcatctg

SEQ ID NO: 32831 - DNA, 16 bp, H. sapiens
agaaggtgtctgcttc

SEQ ID NO: 32832 - DNA, 16 bp, H. sapiens
agaaggttgagaccag

SEQ ID NO: 32833 - DNA, 16 bp, H. sapiens
agaaggttttgttttg

SEQ ID NO: 32834 - DNA, 16 bp, H. sapiens
agaaggtttttaattt

SEQ ID NO: 32835 - DNA, 16 bp, H. sapiens
agaagtaaaatttctg

SEQ ID NO: 32836 - DNA, 16 bp, H. sapiens
agaagtaaaattttct

SEQ ID NO: 32837 - DNA, 16 bp, H. sapiens
agaagtaattgcagtt

SEQ ID NO: 32838 - DNA, 16 bp, H. sapiens
agaagtaattttttaa

SEQ ID NO: 32839 - DNA, 16 bp, H. sapiens
agaagtacaaaacact

SEQ ID NO: 32840 - DNA, 16 bp, H. sapiens
agaagtacaaagaaga

SEQ ID NO: 32841 - DNA, 16 bp, H. sapiens
agaagtacaaagagga

SEQ ID NO: 32842 - DNA, 16 bp, H. sapiens
agaagtacattgcctt

SEQ ID NO: 32843 - DNA, 16 bp, H. sapiens
agaagtagagtcctta

SEQ ID NO: 32844 - DNA, 16 bp, H. sapiens
agaagtcaagcagatg

SEQ ID NO: 32845 - DNA, 16 bp, H. sapiens
agaagtcagcagtctg

SEQ ID NO: 32846 - DNA, 16 bp, H. sapiens
agaagtcagtctgaaa

SEQ ID NO: 32847 - DNA, 16 bp, H. sapiens
agaagtccaagaacaa

SEQ ID NO: 32848 - DNA, 16 bp, H. sapiens
agaagtccaagatgaa

SEQ ID NO: 32849 - DNA, 16 bp, H. sapiens
agaagtctgaaaccaa

SEQ ID NO: 32850 - DNA, 16 bp, H. sapiens
agaagtctttaaagga

SEQ ID NO: 32851 - DNA, 16 bp, H. sapiens
agaagtgaaaaggccc

SEQ ID NO: 32852 - DNA, 16 bp, H. sapiens
agaagtgaaattgtct

SEQ ID NO: 32853 - DNA, 16 bp, H. sapiens
agaagtgacagaaaat

SEQ ID NO: 32854 - DNA, 16 bp, H. sapiens
agaagtgactgttaca

SEQ ID NO: 32855 - DNA, 16 bp, H. sapiens
agaagtgcagtggtgt

SEQ ID NO: 32856 - DNA, 16 bp, H. sapiens
agaagtggaacaagac

SEQ ID NO: 32857 - DNA, 16 bp, H. sapiens
agaagtggagactgaa

SEQ ID NO: 32858 - DNA, 16 bp, H. sapiens
agaagtggagcctgaa

SEQ ID NO: 32859 - DNA, 16 bp, H. sapiens
agaagtggagttgctg

SEQ ID NO: 32860 - DNA, 16 bp, H. sapiens
agaagtggcagagctg

SEQ ID NO: 32861 - DNA, 16 bp, H. sapiens
agaagtggctgattcc

SEQ ID NO: 32862 - DNA, 16 bp, H. sapiens
agaagtgggattgctg

SEQ ID NO: 32863 - DNA, 16 bp, H. sapiens
agaagtgggcttcaga

SEQ ID NO: 32864 - DNA, 16 bp, H. sapiens
agaagtggtgagagca

SEQ ID NO: 32865 - DNA, 16 bp, H. sapiens
agaagtgtcttttgcc

SEQ ID NO: 32866 - DNA, 16 bp, H. sapiens
agaagtgttctggaat

SEQ ID NO: 32867 - DNA, 16 bp, H. sapiens
agaagttaaataactt

SEQ ID NO: 32868 - DNA, 16 bp, H. sapiens
agaagttaaataattt

SEQ ID NO: 32869 - DNA, 16 bp, H. sapiens
agaagttaaatgactt

SEQ ID NO: 32870 - DNA, 16 bp, H. sapiens
agaagttaagaattga

SEQ ID NO: 32871 - DNA, 16 bp, H. sapiens
agaagttaatttgctt

SEQ ID NO: 32872 - DNA, 16 bp, H. sapiens
agaagttcaagatcaa

SEQ ID NO: 32873 - DNA, 16 bp, H. sapiens
agaagttctcctgcct

SEQ ID NO: 32874 - DNA, 16 bp, H. sapiens
agaagttctggaggcc

SEQ ID NO: 32875 - DNA, 16 bp, H. sapiens
agaagttctgttttga

SEQ ID NO: 32876 - DNA, 16 bp, H. sapiens
agaagttgaaacagtt

SEQ ID NO: 32877 - DNA, 16 bp, H. sapiens
agaagttgaagaggac

SEQ ID NO: 32878 - DNA, 16 bp, H. sapiens
agaagttgattctaac

SEQ ID NO: 32879 - DNA, 16 bp, H. sapiens
agaagttgcaaaaata

SEQ ID NO: 32880 - DNA, 16 bp, H. sapiens
agaagttgctgaagaa

SEQ ID NO: 32881 - DNA, 16 bp, H. sapiens
agaagttgctttatga

SEQ ID NO: 32882 - DNA, 26 bp, H. sapiens
agaagttggcacaaaggagttatggg

SEQ ID NO: 32883 - DNA, 16 bp, H. sapiens
agaagttgtagtgagc

SEQ ID NO: 32884 - DNA, 16 bp, H. sapiens
agaagtttacagaaaa

SEQ ID NO: 32885 - DNA, 16 bp, H. sapiens
agaagtttagatttta

SEQ ID NO: 32886 - DNA, 16 bp, H. sapiens
agaagtttagggaaaa

SEQ ID NO: 32887 - DNA, 16 bp, H. sapiens
agaagtttcaaataaa

SEQ ID NO: 32888 - DNA, 16 bp, H. sapiens
agaagtttcagtgagc

SEQ ID NO: 32889 - DNA, 16 bp, H. sapiens
agaagtttcccagaat

SEQ ID NO: 32890 - DNA, 16 bp, H. sapiens
agaagtttctgctgcc

SEQ ID NO: 32891 - DNA, 16 bp, H. sapiens
agaagtttgaaatatt

SEQ ID NO: 32892 - DNA, 16 bp, H. sapiens
agaagtttgaaatcag

SEQ ID NO: 32893 - DNA, 16 bp, H. sapiens
agaagtttgcttcagg

SEQ ID NO: 32894 - DNA, 16 bp, H. sapiens
agaagtttggagaaaa

SEQ ID NO: 32895 - DNA, 16 bp, H. sapiens
agaagttttactgtgg

SEQ ID NO: 32896 - DNA, 16 bp, H. sapiens
agaagttttgaatttt

SEQ ID NO: 32897 - DNA, 16 bp, H. sapiens
agaagttttttagttt

SEQ ID NO: 32898 - DNA, 16 bp, H. sapiens
agaataaaaaacattt

SEQ ID NO: 32899 - DNA, 16 bp, H. sapiens
agaataaaaaatatct

SEQ ID NO: 32900 - DNA, 16 bp, H. sapiens
agaataaaaatcatat

SEQ ID NO: 32901 - DNA, 16 bp, H. sapiens
agaataaaaatgtcag

SEQ ID NO: 32902 - DNA, 16 bp, H. sapiens
agaataaaaatgtttt

SEQ ID NO: 32903 - DNA, 16 bp, H. sapiens
agaataaaaattcttt

SEQ ID NO: 32904 - DNA, 16 bp, H. sapiens
agaataaaacatattt

SEQ ID NO: 32905 - DNA, 16 bp, H. sapiens
agaataaaacatttaa

SEQ ID NO: 32906 - DNA, 16 bp, H. sapiens
agaataaaatatgtag

SEQ ID NO: 32907 - DNA, 16 bp, H. sapiens
agaataaaatcttaaa

SEQ ID NO: 32908 - DNA, 16 bp, H. sapiens
agaataaaatgtattt

SEQ ID NO: 32909 - DNA, 16 bp, H. sapiens
agaataaagaaagcat

SEQ ID NO: 32910 - DNA, 16 bp, H. sapiens
agaataaagaaattca

SEQ ID NO: 32911 - DNA, 16 bp, H. sapiens
agaataaagacatttc

SEQ ID NO: 32912 - DNA, 16 bp, H. sapiens
agaataaagctgaagg

SEQ ID NO: 32913 - DNA, 16 bp, H. sapiens
agaataaatacttaat

SEQ ID NO: 32914 - DNA, 16 bp, H. sapiens
agaataaatccaaaga

SEQ ID NO: 32915 - DNA, 16 bp, H. sapiens
agaataaatctcttaa

SEQ ID NO: 32916 - DNA, 16 bp, H. sapiens
agaataaatgttttta

SEQ ID NO: 32917 - DNA, 16 bp, H. sapiens
agaataaatttctgtt

SEQ ID NO: 32918 - DNA, 16 bp, H. sapiens
agaataaatttgtgtt

SEQ ID NO: 32919 - DNA, 16 bp, H. sapiens
agaataagaatatttt

SEQ ID NO: 32920 - DNA, 16 bp, H. sapiens
agaataagacagcctt

SEQ ID NO: 32921 - DNA, 16 bp, H. sapiens
agaataagcaaaacta

SEQ ID NO: 32922 - DNA, 16 bp, H. sapiens
agaataagcaaatcca

SEQ ID NO: 32923 - DNA, 16 bp, H. sapiens
agaataagtttgatga

SEQ ID NO: 32924 - DNA, 16 bp, H. sapiens
agaataatggctttca

SEQ ID NO: 32925 - DNA, 16 bp, H. sapiens
agaataatttcagaaa

SEQ ID NO: 32926 - DNA, 16 bp, H. sapiens
agaataattttctttt

SEQ ID NO: 32927 - DNA, 16 bp, H. sapiens
agaatacacaaagaac

SEQ ID NO: 32928 - DNA, 16 bp, H. sapiens
agaatacacatttttt

SEQ ID NO: 32929 - DNA, 16 bp, H. sapiens
agaatacagcagtgaa

SEQ ID NO: 32930 - DNA, 16 bp, H. sapiens
agaatacagccatatt

SEQ ID NO: 32931 - DNA, 16 bp, H. sapiens
agaatacagtatatat

SEQ ID NO: 32932 - DNA, 16 bp, H. sapiens
agaatacatatttttc

SEQ ID NO: 32933 - DNA, 16 bp, H. sapiens
agaatacatctcttca

SEQ ID NO: 32934 - DNA, 16 bp, H. sapiens
agaataccatttgacc

SEQ ID NO: 32935 - DNA, 16 bp, H. sapiens
agaatacctgaaactg

SEQ ID NO: 32936 - DNA, 24 bp, H. sapiens
agaatactatgcagccataaaaaa

SEQ ID NO: 32937 - DNA, 16 bp, H. sapiens
agaatactctaatact

SEQ ID NO: 32938 - DNA, 16 bp, H. sapiens
agaatactgggattac

SEQ ID NO: 32939 - DNA, 16 bp, H. sapiens
agaatacttaaaatct

SEQ ID NO: 32940 - DNA, 16 bp, H. sapiens
agaatactttttaaaa

SEQ ID NO: 32941 - DNA, 16 bp, H. sapiens
agaatacttttttttt

SEQ ID NO: 32942 - DNA, 16 bp, H. sapiens
agaatagaaatttatt

SEQ ID NO: 32943 - DNA, 16 bp, H. sapiens
agaatagcacaagaaa

SEQ ID NO: 32944 - DNA, 16 bp, H. sapiens
agaatagcacgggaaa

SEQ ID NO: 32945 - DNA, 16 bp, H. sapiens
agaatagcctggacaa

SEQ ID NO: 32946 - DNA, 16 bp, H. sapiens
agaatagtgcctggca

SEQ ID NO: 32947 - DNA, 16 bp, H. sapiens
agaatagtgtctggca

SEQ ID NO: 32948 - DNA, 16 bp, H. sapiens
agaatagtttacacac

SEQ ID NO: 32949 - DNA, 16 bp, H. sapiens
agaatatacatttttc

SEQ ID NO: 32950 - DNA, 16 bp, H. sapiens
agaatatactttgtat

SEQ ID NO: 32951 - DNA, 16 bp, H. sapiens
agaatatagaatattt

SEQ ID NO: 32952 - DNA, 16 bp, H. sapiens
agaatatataaaaatc

SEQ ID NO: 32953 - DNA, 16 bp, H. sapiens
agaatatatttacata

SEQ ID NO: 32954 - DNA, 16 bp, H. sapiens
agaatatatttagttt

SEQ ID NO: 32955 - DNA, 16 bp, H. sapiens
agaatatccaaataaa

SEQ ID NO: 32956 - DNA, 16 bp, H. sapiens
agaatatctttttaaa

SEQ ID NO: 32957 - DNA, 16 bp, H. sapiens
agaatatgactttatt

SEQ ID NO: 32958 - DNA, 16 bp, H. sapiens
agaatatggcaaagat

SEQ ID NO: 32959 - DNA, 16 bp, H. sapiens
agaatatggcagaagt

SEQ ID NO: 32960 - DNA, 16 bp, H. sapiens
agaatattcaggactt

SEQ ID NO: 32961 - DNA, 16 bp, H. sapiens
agaatattctacccaa

SEQ ID NO: 32962 - DNA, 16 bp, H. sapiens
agaatattgatatttt

SEQ ID NO: 32963 - DNA, 16 bp, H. sapiens
agaatatttcaaattt

SEQ ID NO: 32964 - DNA, 16 bp, H. sapiens
agaatatttccatcac

SEQ ID NO: 32965 - DNA, 16 bp, H. sapiens
agaatatttgaaatat

SEQ ID NO: 32966 - DNA, 16 bp, H. sapiens
agaatatttgatattt

SEQ ID NO: 32967 - DNA, 16 bp, H. sapiens
agaatatttgtctttt

SEQ ID NO: 32968 - DNA, 16 bp, H. sapiens
agaatattttattcaa

SEQ ID NO: 32969 - DNA, 16 bp, H. sapiens
agaatattttcactga

SEQ ID NO: 32970 - DNA, 16 bp, H. sapiens
agaatattttcatcac

SEQ ID NO: 32971 - DNA, 16 bp, H. sapiens
agaatatttttcttca

SEQ ID NO: 32972 - DNA, 16 bp, H. sapiens
agaatcaaatgagaaa

SEQ ID NO: 32973 - DNA, 16 bp, H. sapiens
agaatcaagagcaaac

SEQ ID NO: 32974 - DNA, 17 bp, H. sapiens
agaatcacctgaacccg

SEQ ID NO: 32975 - DNA, 16 bp, H. sapiens
agaatcacctggaaaa

SEQ ID NO: 32976 - DNA, 16 bp, H. sapiens
agaatcacctgggaaa

SEQ ID NO: 32977 - DNA, 16 bp, H. sapiens
agaatcactcgaacct

SEQ ID NO: 32978 - DNA, 16 bp, H. sapiens
agaatcactcgagccc

SEQ ID NO: 32979 - DNA, 16 bp, H. sapiens
agaatcacttaaacca

SEQ ID NO: 32980 - DNA, 16 bp, H. sapiens
agaatcacttgaactg

SEQ ID NO: 32981 - DNA, 16 bp, H. sapiens
agaatcacttggagag

SEQ ID NO: 32982 - DNA, 16 bp, H. sapiens
agaatcactttgaacc

SEQ ID NO: 32983 - DNA, 16 bp, H. sapiens
agaatcagaaaggaaa

SEQ ID NO: 32984 - DNA, 25 bp, H. sapiens
agaatcagaacatggagattggtgc

SEQ ID NO: 32985 - DNA, 16 bp, H. sapiens
agaatcagagaaaaat

SEQ ID NO: 32986 - DNA, 16 bp, H. sapiens
agaatcaggcaacact

SEQ ID NO: 32987 - DNA, 16 bp, H. sapiens
agaatcataaaatgtt

SEQ ID NO: 32988 - DNA, 16 bp, H. sapiens
agaatcatctggaagg

SEQ ID NO: 32989 - DNA, 16 bp, H. sapiens
agaatcatggcccctc

SEQ ID NO: 32990 - DNA, 16 bp, H. sapiens
agaatcatttgttgaa

SEQ ID NO: 32991 - DNA, 16 bp, H. sapiens
agaatccaccaaaaaa

SEQ ID NO: 32992 - DNA, 16 bp, H. sapiens
agaatccagctgtctt

SEQ ID NO: 32993 - DNA, 16 bp, H. sapiens
agaatccccatctcta

SEQ ID NO: 32994 - DNA, 16 bp, H. sapiens
agaatcctatatccag

SEQ ID NO: 32995 - DNA, 16 bp, H. sapiens
agaatcctggaagaaa

SEQ ID NO: 32996 - DNA, 16 bp, H. sapiens
agaatcctgttaggtc

SEQ ID NO: 32997 - DNA, 16 bp, H. sapiens
agaatcgcatgaaccc

SEQ ID NO: 32998 - DNA, 19 bp, H. sapiens
agaatcgcttgaaccagga

SEQ ID NO: 32999 - DNA, 21 bp, H. sapiens
agaatcgcttgaacctggaag

SEQ ID NO: 33000 - DNA, 16 bp, H. sapiens
agaatcgcttgaacgt

SEQ ID NO: 33001 - DNA, 18 bp, H. sapiens
agaatcgtgtgaacctgg

SEQ ID NO: 33002 - DNA, 16 bp, H. sapiens
agaatctaataatttt

SEQ ID NO: 33003 - DNA, 16 bp, H. sapiens
agaatctacaaagaaa

SEQ ID NO: 33004 - DNA, 16 bp, H. sapiens
agaatctataatgaac

SEQ ID NO: 33005 - DNA, 16 bp, H. sapiens
agaatctcaggcccca

SEQ ID NO: 33006 - DNA, 18 bp, H. sapiens
agaatctctgggacacag

SEQ ID NO: 33007 - DNA, 16 bp, H. sapiens
agaatctcttgaagcc

SEQ ID NO: 33008 - DNA, 16 bp, H. sapiens
agaatctgaacccagg

SEQ ID NO: 33009 - DNA, 16 bp, H. sapiens
agaatctgcatttcca

SEQ ID NO: 33010 - DNA, 16 bp, H. sapiens
agaatctgcatttgaa

SEQ ID NO: 33011 - DNA, 16 bp, H. sapiens
agaatctggctctgtc

SEQ ID NO: 33012 - DNA, 17 bp, H. sapiens
agaatcttaagagctgt

SEQ ID NO: 33013 - DNA, 16 bp, H. sapiens
agaatcttctttttct

SEQ ID NO: 33014 - DNA, 16 bp, H. sapiens
agaatcttgctctgtc

SEQ ID NO: 33015 - DNA, 16 bp, H. sapiens
agaatgaaaaggcaag

SEQ ID NO: 33016 - DNA, 16 bp, H. sapiens
agaatgaaactgcatc

SEQ ID NO: 33017 - DNA, 16 bp, H. sapiens
agaatgaaactggata

SEQ ID NO: 33018 - DNA, 16 bp, H. sapiens
agaatgaaagtggatc

SEQ ID NO: 33019 - DNA, 16 bp, H. sapiens
agaatgaaatcacatc

SEQ ID NO: 33020 - DNA, 16 bp, H. sapiens
agaatgaaatggaaat

SEQ ID NO: 33021 - DNA, 16 bp, H. sapiens
agaatgaagaaaacag

SEQ ID NO: 33022 - DNA, 16 bp, H. sapiens
agaatgaagaaaagca

SEQ ID NO: 33023 - DNA, 16 bp, H. sapiens
agaatgaagacctctg

SEQ ID NO: 33024 - DNA, 16 bp, H. sapiens
agaatgaagctgcaga

SEQ ID NO: 33025 - DNA, 16 bp, H. sapiens
agaatgaagttggatt

SEQ ID NO: 33026 - DNA, 16 bp, H. sapiens
agaatgaatgcaggag

SEQ ID NO: 33027 - DNA, 16 bp, H. sapiens
agaatgaccaaaatcc

SEQ ID NO: 33028 - DNA, 16 bp, H. sapiens
agaatgactaaaatta

SEQ ID NO: 33029 - DNA, 16 bp, H. sapiens
agaatgagaccatgtc

SEQ ID NO: 33030 - DNA, 16 bp, H. sapiens
agaatgagaccttgtc

SEQ ID NO: 33031 - DNA, 16 bp, H. sapiens
agaatgagatcatctc

SEQ ID NO: 33032 - DNA, 16 bp, H. sapiens
agaatgagatcctgcc

SEQ ID NO: 33033 - DNA, 16 bp, H. sapiens
agaatgagattgatga

SEQ ID NO: 33034 - DNA, 16 bp, H. sapiens
agaatgagctagataa

SEQ ID NO: 33035 - DNA, 16 bp, H. sapiens
agaatgaggcagaaaa

SEQ ID NO: 33036 - DNA, 16 bp, H. sapiens
agaatgagttcatgtg

SEQ ID NO: 33037 - DNA, 16 bp, H. sapiens
agaatgagtttgacaa

SEQ ID NO: 33038 - DNA, 16 bp, H. sapiens
agaatgatattagaaa

SEQ ID NO: 33039 - DNA, 16 bp, H. sapiens
agaatgatgatgatga

SEQ ID NO: 33040 - DNA, 29 bp, H. sapiens
agaatgatggtttccagcttcatccatgt

SEQ ID NO: 33041 - DNA, 16 bp, H. sapiens
agaatgatgtgaaccc

SEQ ID NO: 33042 - DNA, 16 bp, H. sapiens
agaatgatttataatc

SEQ ID NO: 33043 - DNA, 16 bp, H. sapiens
agaatgatttttaaaa

SEQ ID NO: 33044 - DNA, 16 bp, H. sapiens
agaatgcagagaaaaa

SEQ ID NO: 33045 - DNA, 16 bp, H. sapiens
agaatgcagagaaaag

SEQ ID NO: 33046 - DNA, 16 bp, H. sapiens
agaatgcagcagaagt

SEQ ID NO: 33047 - DNA, 16 bp, H. sapiens
agaatgcccatcctgt

SEQ ID NO: 33048 - DNA, 16 bp, H. sapiens
agaatgcctcttctcc

SEQ ID NO: 33049 - DNA, 16 bp, H. sapiens
agaatgctggtagaaa

SEQ ID NO: 33050 - DNA, 16 bp, H. sapiens
agaatggaaagcaggg

SEQ ID NO: 33051 - DNA, 24 bp, H. sapiens
agaatggaaccaagatggaaaaca

SEQ ID NO: 33052 - DNA, 24 bp, H. sapiens
agaatggaaccaagctggaaaaca

SEQ ID NO: 33053 - DNA, 16 bp, H. sapiens
agaatggaataataca

SEQ ID NO: 33054 - DNA, 16 bp, H. sapiens
agaatggaatagaatg

SEQ ID NO: 33055 - DNA, 16 bp, H. sapiens
agaatggactaataca

SEQ ID NO: 33056 - DNA, 16 bp, H. sapiens
agaatggagaatccag

SEQ ID NO: 33057 - DNA, 16 bp, H. sapiens
agaatggagaatggaa

SEQ ID NO: 33058 - DNA, 16 bp, H. sapiens
agaatggagaatggtg

SEQ ID NO: 33059 - DNA, 16 bp, H. sapiens
agaatggattaataca

SEQ ID NO: 33060 - DNA, 16 bp, H. sapiens
agaatggcaccaagcc

SEQ ID NO: 33061 - DNA, 16 bp, H. sapiens
agaatggccaaaataa

SEQ ID NO: 33062 - DNA, 16 bp, H. sapiens
agaatggcctgaacct

SEQ ID NO: 33063 - DNA, 20 bp, H. sapiens
agaatggcgtgaacccggga

SEQ ID NO: 33064 - DNA, 16 bp, H. sapiens
agaatggctaaaataa

SEQ ID NO: 33065 - DNA, 16 bp, H. sapiens
agaatggctaccccat

SEQ ID NO: 33066 - DNA, 16 bp, H. sapiens
agaatggctattaaca

SEQ ID NO: 33067 - DNA, 16 bp, H. sapiens
agaatggctttaaaaa

SEQ ID NO: 33068 - DNA, 16 bp, H. sapiens
agaatgggaaaaaatt

SEQ ID NO: 33069 - DNA, 16 bp, H. sapiens
agaatgggagaaagtt

SEQ ID NO: 33070 - DNA, 16 bp, H. sapiens
agaatgggagagaatt

SEQ ID NO: 33071 - DNA, 16 bp, H. sapiens
agaatgggaggaaaat

SEQ ID NO: 33072 - DNA, 16 bp, H. sapiens
agaatggggaaaaatt

SEQ ID NO: 33073 - DNA, 16 bp, H. sapiens
agaatggtgactcctt

SEQ ID NO: 33074 - DNA, 16 bp, H. sapiens
agaatggtggttggca

SEQ ID NO: 33075 - DNA, 16 bp, H. sapiens
agaatggtttcctggg

SEQ ID NO: 33076 - DNA, 16 bp, H. sapiens
agaatgtaatatttta

SEQ ID NO: 33077 - DNA, 16 bp, H. sapiens
agaatgtacaaggaac

SEQ ID NO: 33078 - DNA, 16 bp, H. sapiens
agaatgtattatatat

SEQ ID NO: 33079 - DNA, 16 bp, H. sapiens
agaatgtatttttaaa

SEQ ID NO: 33080 - DNA, 16 bp, H. sapiens
agaatgtgaatgtatt

SEQ ID NO: 33081 - DNA, 16 bp, H. sapiens
agaatgtgaggtcctg

SEQ ID NO: 33082 - DNA, 16 bp, H. sapiens
agaatgtggaaagact

SEQ ID NO: 33083 - DNA, 16 bp, H. sapiens
agaatgtggctttgga

SEQ ID NO: 33084 - DNA, 16 bp, H. sapiens
agaatgtgtaagcaaa

SEQ ID NO: 33085 - DNA, 16 bp, H. sapiens
agaatgttacataaac

SEQ ID NO: 33086 - DNA, 16 bp, H. sapiens
agaatgttcacagcaa

SEQ ID NO: 33087 - DNA, 16 bp, H. sapiens
agaatgttccatgcac

SEQ ID NO: 33088 - DNA, 16 bp, H. sapiens
agaatgttctggaatt

SEQ ID NO: 33089 - DNA, 16 bp, H. sapiens
agaatgttgaatatta

SEQ ID NO: 33090 - DNA, 16 bp, H. sapiens
agaatgttttatatat

SEQ ID NO: 33091 - DNA, 16 bp, H. sapiens
agaatgttttcatctt

SEQ ID NO: 33092 - DNA, 16 bp, H. sapiens
agaatgttttctttaa

SEQ ID NO: 33093 - DNA, 16 bp, H. sapiens
agaatgtttttcaaaa

SEQ ID NO: 33094 - DNA, 16 bp, H. sapiens
agaattaaactttttt

SEQ ID NO: 33095 - DNA, 16 bp, H. sapiens
agaattaaatgagata

SEQ ID NO: 33096 - DNA, 16 bp, H. sapiens
agaattaaccatcaca

SEQ ID NO: 33097 - DNA, 16 bp, H. sapiens
agaattaatggaatat

SEQ ID NO: 33098 - DNA, 16 bp, H. sapiens
agaattacaaaacact

SEQ ID NO: 33099 - DNA, 16 bp, H. sapiens
agaattaccaaagtgt

SEQ ID NO: 33100 - DNA, 16 bp, H. sapiens
agaattacctggggag

SEQ ID NO: 33101 - DNA, 16 bp, H. sapiens
agaattagagaaaact

SEQ ID NO: 33102 - DNA, 16 bp, H. sapiens
agaattagatagtggt

SEQ ID NO: 33103 - DNA, 16 bp, H. sapiens
agaattaggaaaaaac

SEQ ID NO: 33104 - DNA, 16 bp, H. sapiens
agaattatagaccaat

SEQ ID NO: 33105 - DNA, 16 bp, H. sapiens
agaattatatttcttt

SEQ ID NO: 33106 - DNA, 16 bp, H. sapiens
agaattatccagcccc

SEQ ID NO: 33107 - DNA, 16 bp, H. sapiens
agaattatgttttaaa

SEQ ID NO: 33108 - DNA, 16 bp, H. sapiens
agaattattgtgagga

SEQ ID NO: 33109 - DNA, 16 bp, H. sapiens
agaattatttattttc

SEQ ID NO: 33110 - DNA, 16 bp, H. sapiens
agaattatttcttttc

SEQ ID NO: 33111 - DNA, 16 bp, H. sapiens
agaattcaaaatagct

SEQ ID NO: 33112 - DNA, 16 bp, H. sapiens
agaattcaccaaccat

SEQ ID NO: 33113 - DNA, 16 bp, H. sapiens
agaattcaccagtgaa

SEQ ID NO: 33114 - DNA, 16 bp, H. sapiens
agaattcagaaaagaa

SEQ ID NO: 33115 - DNA, 16 bp, H. sapiens
agaattcagaatatgg

SEQ ID NO: 33116 - DNA, 16 bp, H. sapiens
agaattcagagtccag

SEQ ID NO: 33117 - DNA, 16 bp, H. sapiens
agaattcagcaatgaa

SEQ ID NO: 33118 - DNA, 16 bp, H. sapiens
agaattcagcagagaa

SEQ ID NO: 33119 - DNA, 16 bp, H. sapiens
agaattcagctataaa

SEQ ID NO: 33120 - DNA, 16 bp, H. sapiens
agaattcagctgcaaa

SEQ ID NO: 33121 - DNA, 16 bp, H. sapiens
agaattcaggcccctc

SEQ ID NO: 33122 - DNA, 16 bp, H. sapiens
agaattcagtcacatg

SEQ ID NO: 33123 - DNA, 16 bp, H. sapiens
agaattcattcactat

SEQ ID NO: 33124 - DNA, 16 bp, H. sapiens
agaattcattttcttg

SEQ ID NO: 33125 - DNA, 16 bp, H. sapiens
agaattccagaaggag

SEQ ID NO: 33126 - DNA, 16 bp, H. sapiens
agaattccaggcagag

SEQ ID NO: 33127 - DNA, 16 bp, H. sapiens
agaattcctgttgctc

SEQ ID NO: 33128 - DNA, 16 bp, H. sapiens
agaattctatacacag

SEQ ID NO: 33129 - DNA, 16 bp, H. sapiens
agaattctctgatggt

SEQ ID NO: 33130 - DNA, 16 bp, H. sapiens
agaattctgtaccctg

SEQ ID NO: 33131 - DNA, 16 bp, H. sapiens
agaattcttccagatt

SEQ ID NO: 33132 - DNA, 16 bp, H. sapiens
agaattcttgctgaag

SEQ ID NO: 33133 - DNA, 16 bp, H. sapiens
agaattctttctttat

SEQ ID NO: 33134 - DNA, 16 bp, H. sapiens
agaattctttttaaaa

SEQ ID NO: 33135 - DNA, 16 bp, H. sapiens
agaattctttttcttt

SEQ ID NO: 33136 - DNA, 16 bp, H. sapiens
agaattgatatcttaa

SEQ ID NO: 33137 - DNA, 16 bp, H. sapiens
agaattgcaaattaaa

SEQ ID NO: 33138 - DNA, 16 bp, H. sapiens
agaattgccagataaa

SEQ ID NO: 33139 - DNA, 16 bp, H. sapiens
agaattgctagaacct

SEQ ID NO: 33140 - DNA, 16 bp, H. sapiens
agaattgcttgaaatc

SEQ ID NO: 33141 - DNA, 16 bp, H. sapiens
agaattgcttgaacaa

SEQ ID NO: 33142 - DNA, 16 bp, H. sapiens
agaattgcttgaacac

SEQ ID NO: 33143 - DNA, 17 bp, H. sapiens
agaattgcttgaacccg

SEQ ID NO: 33144 - DNA, 16 bp, H. sapiens
agaattgcttgaactg

SEQ ID NO: 33145 - DNA, 16 bp, H. sapiens
agaattgcttgaagcc

SEQ ID NO: 33146 - DNA, 16 bp, H. sapiens
agaattgcttgaagct

SEQ ID NO: 33147 - DNA, 16 bp, H. sapiens
agaattgcttgaatcc

SEQ ID NO: 33148 - DNA, 16 bp, H. sapiens
agaattgcttgagccc

SEQ ID NO: 33149 - DNA, 16 bp, H. sapiens
agaattgctttccttt

SEQ ID NO: 33150 - DNA, 16 bp, H. sapiens
agaattggaaaagact

SEQ ID NO: 33151 - DNA, 16 bp, H. sapiens
agaattggaagttctg

SEQ ID NO: 33152 - DNA, 16 bp, H. sapiens
agaattggataaattc

SEQ ID NO: 33153 - DNA, 16 bp, H. sapiens
agaattggtgggttct

SEQ ID NO: 33154 - DNA, 16 bp, H. sapiens
agaattggttccttcc

SEQ ID NO: 33155 - DNA, 16 bp, H. sapiens
agaattgtctgaatca

SEQ ID NO: 33156 - DNA, 16 bp, H. sapiens
agaattgtgaaagaat

SEQ ID NO: 33157 - DNA, 16 bp, H. sapiens
agaattgtgagagaat

SEQ ID NO: 33158 - DNA, 16 bp, H. sapiens
agaattgtttaaaccc

SEQ ID NO: 33159 - DNA, 16 bp, H. sapiens
agaattgttttctttt

SEQ ID NO: 33160 - DNA, 16 bp, H. sapiens
agaattgttttttcca

SEQ ID NO: 33161 - DNA, 16 bp, H. sapiens
agaatttaaagaattt

SEQ ID NO: 33162 - DNA, 16 bp, H. sapiens
agaatttaaagtctgt

SEQ ID NO: 33163 - DNA, 16 bp, H. sapiens
agaatttaagacaaaa

SEQ ID NO: 33164 - DNA, 16 bp, H. sapiens
agaatttaaggaagaa

SEQ ID NO: 33165 - DNA, 16 bp, H. sapiens
agaatttaagtgactt

SEQ ID NO: 33166 - DNA, 16 bp, H. sapiens
agaatttaattccttt

SEQ ID NO: 33167 - DNA, 16 bp, H. sapiens
agaatttagaatattt

SEQ ID NO: 33168 - DNA, 16 bp, H. sapiens
agaatttatcatttta

SEQ ID NO: 33169 - DNA, 16 bp, H. sapiens
agaatttatgatgaag

SEQ ID NO: 33170 - DNA, 16 bp, H. sapiens
agaatttatttattca

SEQ ID NO: 33171 - DNA, 16 bp, H. sapiens
agaatttatttttcct

SEQ ID NO: 33172 - DNA, 16 bp, H. sapiens
agaatttcaaatattt

SEQ ID NO: 33173 - DNA, 16 bp, H. sapiens
agaatttcaaatttct

SEQ ID NO: 33174 - DNA, 16 bp, H. sapiens
agaatttcagaaagaa

SEQ ID NO: 33175 - DNA, 16 bp, H. sapiens
agaatttcagaccaat

SEQ ID NO: 33176 - DNA, 16 bp, H. sapiens
agaatttcataataca

SEQ ID NO: 33177 - DNA, 16 bp, H. sapiens
agaatttcatatccaa

SEQ ID NO: 33178 - DNA, 16 bp, H. sapiens
agaatttcatgttttt

SEQ ID NO: 33179 - DNA, 16 bp, H. sapiens
agaatttcattcattt

SEQ ID NO: 33180 - DNA, 16 bp, H. sapiens
agaatttcattctttc

SEQ ID NO: 33181 - DNA, 16 bp, H. sapiens
agaatttcattctttt

SEQ ID NO: 33182 - DNA, 16 bp, H. sapiens
agaatttccattttat

SEQ ID NO: 33183 - DNA, 16 bp, H. sapiens
agaatttcccccaaat

SEQ ID NO: 33184 - DNA, 16 bp, H. sapiens
agaatttcctcctctt

SEQ ID NO: 33185 - DNA, 16 bp, H. sapiens
agaatttccttctttt

SEQ ID NO: 33186 - DNA, 16 bp, H. sapiens
agaatttcctttttta

SEQ ID NO: 33187 - DNA, 16 bp, H. sapiens
agaatttcgctcttgt

SEQ ID NO: 33188 - DNA, 16 bp, H. sapiens
agaatttctaaataaa

SEQ ID NO: 33189 - DNA, 16 bp, H. sapiens
agaatttctttaattt

SEQ ID NO: 33190 - DNA, 16 bp, H. sapiens
agaatttcttttttat

SEQ ID NO: 33191 - DNA, 16 bp, H. sapiens
agaatttgaaaactat

SEQ ID NO: 33192 - DNA, 16 bp, H. sapiens
agaatttgaaagatat

SEQ ID NO: 33193 - DNA, 16 bp, H. sapiens
agaatttgaagaaaat

SEQ ID NO: 33194 - DNA, 16 bp, H. sapiens
agaatttgactctttt

SEQ ID NO: 33195 - DNA, 16 bp, H. sapiens
agaatttgagaaaaat

SEQ ID NO: 33196 - DNA, 16 bp, H. sapiens
agaatttgcatttctg

SEQ ID NO: 33197 - DNA, 16 bp, H. sapiens
agaatttgcattttaa

SEQ ID NO: 33198 - DNA, 16 bp, H. sapiens
agaatttgctgaagtt

SEQ ID NO: 33199 - DNA, 16 bp, H. sapiens
agaatttgcttttctt

SEQ ID NO: 33200 - DNA, 16 bp, H. sapiens
agaatttggaaaatat

SEQ ID NO: 33201 - DNA, 16 bp, H. sapiens
agaatttggaaactat

SEQ ID NO: 33202 - DNA, 16 bp, H. sapiens
agaatttggaaataaa

SEQ ID NO: 33203 - DNA, 16 bp, H. sapiens
agaatttgtctgtgaa

SEQ ID NO: 33204 - DNA, 16 bp, H. sapiens
agaattttaaaaagga

SEQ ID NO: 33205 - DNA, 16 bp, H. sapiens
agaattttaaaacatt

SEQ ID NO: 33206 - DNA, 16 bp, H. sapiens
agaattttaaaagtat

SEQ ID NO: 33207 - DNA, 16 bp, H. sapiens
agaattttaaaatcaa

SEQ ID NO: 33208 - DNA, 16 bp, H. sapiens
agaattttaaatgttc

SEQ ID NO: 33209 - DNA, 16 bp, H. sapiens
agaattttacttttgg

SEQ ID NO: 33210 - DNA, 16 bp, H. sapiens
agaattttatacaaat

SEQ ID NO: 33211 - DNA, 16 bp, H. sapiens
agaattttatagccag

SEQ ID NO: 33212 - DNA, 16 bp, H. sapiens
agaattttatgaaaat

SEQ ID NO: 33213 - DNA, 16 bp, H. sapiens
agaattttattcactt

SEQ ID NO: 33214 - DNA, 16 bp, H. sapiens
agaattttcattttaa

SEQ ID NO: 33215 - DNA, 16 bp, H. sapiens
agaattttcattttta

SEQ ID NO: 33216 - DNA, 16 bp, H. sapiens
agaattttccagtgaa

SEQ ID NO: 33217 - DNA, 16 bp, H. sapiens
agaattttctcctttt

SEQ ID NO: 33218 - DNA, 16 bp, H. sapiens
agaattttcttcctct

SEQ ID NO: 33219 - DNA, 16 bp, H. sapiens
agaattttctttaatt

SEQ ID NO: 33220 - DNA, 16 bp, H. sapiens
agaattttgaaaaaga

SEQ ID NO: 33221 - DNA, 16 bp, H. sapiens
agaattttgaagaaaa

SEQ ID NO: 33222 - DNA, 16 bp, H. sapiens
agaattttgatagaaa

SEQ ID NO: 33223 - DNA, 16 bp, H. sapiens
agaattttgattggga

SEQ ID NO: 33224 - DNA, 16 bp, H. sapiens
agaattttgctgtgaa

SEQ ID NO: 33225 - DNA, 16 bp, H. sapiens
agaattttggaaaaat

SEQ ID NO: 33226 - DNA, 16 bp, H. sapiens
agaattttgtcttttt

SEQ ID NO: 33227 - DNA, 16 bp, H. sapiens
agaatttttaaaaaca

SEQ ID NO: 33228 - DNA, 16 bp, H. sapiens
agaatttttaacattt

SEQ ID NO: 33229 - DNA, 16 bp, H. sapiens
agaatttttatatctt

SEQ ID NO: 33230 - DNA, 16 bp, H. sapiens
agaatttttatttcta

SEQ ID NO: 33231 - DNA, 16 bp, H. sapiens
agaatttttatttctt

SEQ ID NO: 33232 - DNA, 16 bp, H. sapiens
agaatttttcagattt

SEQ ID NO: 33233 - DNA, 16 bp, H. sapiens
agaatttttctttgtt

SEQ ID NO: 33234 - DNA, 16 bp, H. sapiens
agaattttttctttct

SEQ ID NO: 33235 - DNA, 16 bp, H. sapiens
agaatttttttcatgt

SEQ ID NO: 33236 - DNA, 16 bp, H. sapiens
agaatttttttcttaa

SEQ ID NO: 33237 - DNA, 16 bp, H. sapiens
agaatttttttcttct

SEQ ID NO: 33238 - DNA, 16 bp, H. sapiens
agaatttttttgtaga

SEQ ID NO: 33239 - DNA, 16 bp, H. sapiens
agaattttttttcctt

SEQ ID NO: 33240 - DNA, 16 bp, H. sapiens
agacaaaaaatttttt

SEQ ID NO: 33241 - DNA, 16 bp, H. sapiens
agacaaaaagcaaatt

SEQ ID NO: 33242 - DNA, 16 bp, H. sapiens
agacaaaaagtaacag

SEQ ID NO: 33243 - DNA, 16 bp, H. sapiens
agacaaaaattagctg

SEQ ID NO: 33244 - DNA, 16 bp, H. sapiens
agacaaaaattatttt

SEQ ID NO: 33245 - DNA, 16 bp, H. sapiens
agacaaaaattttaaa

SEQ ID NO: 33246 - DNA, 17 bp, H. sapiens
agacaaaactcctcaga

SEQ ID NO: 33247 - DNA, 16 bp, H. sapiens
agacaaaattgataaa

SEQ ID NO: 33248 - DNA, 16 bp, H. sapiens
agacaaaatttatttt

SEQ ID NO: 33249 - DNA, 16 bp, H. sapiens
agacaaacaaatactg

SEQ ID NO: 33250 - DNA, 16 bp, H. sapiens
agacaaacattttaaa

SEQ ID NO: 33251 - DNA, 16 bp, H. sapiens
agacaaacctggccaa

SEQ ID NO: 33252 - DNA, 16 bp, H. sapiens
agacaaagagaaaatt

SEQ ID NO: 33253 - DNA, 16 bp, H. sapiens
agacaaagagaattct

SEQ ID NO: 33254 - DNA, 16 bp, H. sapiens
agacaaagagagagat

SEQ ID NO: 33255 - DNA, 16 bp, H. sapiens
agacaaagagggatat

SEQ ID NO: 33256 - DNA, 16 bp, H. sapiens
agacaaaggactttat

SEQ ID NO: 33257 - DNA, 16 bp, H. sapiens
agacaaagtcaaagag

SEQ ID NO: 33258 - DNA, 16 bp, H. sapiens
agacaaagttttgctt

SEQ ID NO: 33259 - DNA, 16 bp, H. sapiens
agacaaatgattgcat

SEQ ID NO: 33260 - DNA, 16 bp, H. sapiens
agacaaattcagaata

SEQ ID NO: 33261 - DNA, 16 bp, H. sapiens
agacaaatttagagag

SEQ ID NO: 33262 - DNA, 16 bp, H. sapiens
agacaaatttataaaa

SEQ ID NO: 33263 - DNA, 16 bp, H. sapiens
agacaacagaaattta

SEQ ID NO: 33264 - DNA, 16 bp, H. sapiens
agacaagagtctctct

SEQ ID NO: 33265 - DNA, 16 bp, H. sapiens
agacaagagttacatc

SEQ ID NO: 33266 - DNA, 19 bp, H. sapiens
agacaagattagagaaaaa

SEQ ID NO: 33267 - DNA, 16 bp, H. sapiens
agacaagattgaaaac

SEQ ID NO: 33268 - DNA, 16 bp, H. sapiens
agacaagatttcgcca

SEQ ID NO: 33269 - DNA, 16 bp, H. sapiens
agacaagcaaaagctg

SEQ ID NO: 33270 - DNA, 16 bp, H. sapiens
agacaagcaaatgctc

SEQ ID NO: 33271 - DNA, 18 bp, H. sapiens
agacaagcaaatgctgag

SEQ ID NO: 33272 - DNA, 16 bp, H. sapiens
agacaagcagagagac

SEQ ID NO: 33273 - DNA, 16 bp, H. sapiens
agacaagcctggacaa

SEQ ID NO: 33274 - DNA, 17 bp, H. sapiens
agacaagcctggcaaca

SEQ ID NO: 33275 - DNA, 16 bp, H. sapiens
agacaagcctggccaa

SEQ ID NO: 33276 - DNA, 16 bp, H. sapiens
agacaagcctgggcaa

SEQ ID NO: 33277 - DNA, 16 bp, H. sapiens
agacaaggccactctg

SEQ ID NO: 33278 - DNA, 16 bp, H. sapiens
agacaagggtgccctc

SEQ ID NO: 33279 - DNA, 16 bp, H. sapiens
agacaaggtaatttat

SEQ ID NO: 33280 - DNA, 16 bp, H. sapiens
agacaaggtttctcca

SEQ ID NO: 33281 - DNA, 16 bp, H. sapiens
agacaagtctgggcaa

SEQ ID NO: 33282 - DNA, 16 bp, H. sapiens
agacaatatttaaaat

SEQ ID NO: 33283 - DNA, 16 bp, H. sapiens
agacaatcatgtggtt

SEQ ID NO: 33284 - DNA, 16 bp, H. sapiens
agacaatcctggccaa

SEQ ID NO: 33285 - DNA, 16 bp, H. sapiens
agacaatgaaaataat

SEQ ID NO: 33286 - DNA, 16 bp, H. sapiens
agacaatgaaatattt

SEQ ID NO: 33287 - DNA, 16 bp, H. sapiens
agacaatgaggaaaag

SEQ ID NO: 33288 - DNA, 16 bp, H. sapiens
agacaatgaggaagaa

SEQ ID NO: 33289 - DNA, 16 bp, H. sapiens
agacaatggagactca

SEQ ID NO: 33290 - DNA, 16 bp, H. sapiens
agacaatggagtatta

SEQ ID NO: 33291 - DNA, 16 bp, H. sapiens
agacaatgggaaaaag

SEQ ID NO: 33292 - DNA, 16 bp, H. sapiens
agacaatgtatataaa

SEQ ID NO: 33293 - DNA, 16 bp, H. sapiens
agacaattctaaaatt

SEQ ID NO: 33294 - DNA, 16 bp, H. sapiens
agacaattcttccagt

SEQ ID NO: 33295 - DNA, 16 bp, H. sapiens
agacacaaaaaacctt

SEQ ID NO: 33296 - DNA, 16 bp, H. sapiens
agacacaaatccaaac

SEQ ID NO: 33297 - DNA, 16 bp, H. sapiens
agacacaaggtgctga

SEQ ID NO: 33298 - DNA, 16 bp, H. sapiens
agacacacacacgcac

SEQ ID NO: 33299 - DNA, 16 bp, H. sapiens
agacacacacagacac

SEQ ID NO: 33300 - DNA, 16 bp, H. sapiens
agacacacacagatac

SEQ ID NO: 33301 - DNA, 16 bp, H. sapiens
agacacacacgcacac

SEQ ID NO: 33302 - DNA, 16 bp, H. sapiens
agacacacagagggga

SEQ ID NO: 33303 - DNA, 16 bp, H. sapiens
agacacacaggggaga

SEQ ID NO: 33304 - DNA, 16 bp, H. sapiens
agacacacatagcctc

SEQ ID NO: 33305 - DNA, 24 bp, H. sapiens
agacacacataggctcaaaataaa

SEQ ID NO: 33306 - DNA, 16 bp, H. sapiens
agacacacatatacat

SEQ ID NO: 33307 - DNA, 16 bp, H. sapiens
agacacacatgcatac

SEQ ID NO: 33308 - DNA, 16 bp, H. sapiens
agacacagaaaaggcc

SEQ ID NO: 33309 - DNA, 16 bp, H. sapiens
agacacagaaaggtta

SEQ ID NO: 33310 - DNA, 16 bp, H. sapiens
agacacagacacagag

SEQ ID NO: 33311 - DNA, 16 bp, H. sapiens
agacacagagacaaag

SEQ ID NO: 33312 - DNA, 24 bp, H. sapiens
agacacagagacaaagtatagaga

SEQ ID NO: 33313 - DNA, 26 bp, H. sapiens
agacacagagacaaagtatagagaaa

SEQ ID NO: 33314 - DNA, 16 bp, H. sapiens
agacacagagatggaa

SEQ ID NO: 33315 - DNA, 16 bp, H. sapiens
agacacagagcgctga

SEQ ID NO: 33316 - DNA, 16 bp, H. sapiens
agacacagaggcagag

SEQ ID NO: 33317 - DNA, 16 bp, H. sapiens
agacacagaggcagga

SEQ ID NO: 33318 - DNA, 16 bp, H. sapiens
agacacagcaagaaag

SEQ ID NO: 33319 - DNA, 16 bp, H. sapiens
agacacaggcagagag

SEQ ID NO: 33320 - DNA, 16 bp, H. sapiens
agacacaggccaggca

SEQ ID NO: 33321 - DNA, 16 bp, H. sapiens
agacacataattttca

SEQ ID NO: 33322 - DNA, 16 bp, H. sapiens
agacacatctgaagga

SEQ ID NO: 33323 - DNA, 16 bp, H. sapiens
agacacatgcacacac

SEQ ID NO: 33324 - DNA, 23 bp, H. sapiens
agacacatgcacacgtatattta

SEQ ID NO: 33325 - DNA, 16 bp, H. sapiens
agacacatggagcaga

SEQ ID NO: 33326 - DNA, 16 bp, H. sapiens
agacacatttttaaaa

SEQ ID NO: 33327 - DNA, 16 bp, H. sapiens
agacaccaaagaacat

SEQ ID NO: 33328 - DNA, 16 bp, H. sapiens
agacaccatctcaaac

SEQ ID NO: 33329 - DNA, 16 bp, H. sapiens
agacaccatctccaaa

SEQ ID NO: 33330 - DNA, 16 bp, H. sapiens
agacaccatttcacct

SEQ ID NO: 33331 - DNA, 16 bp, H. sapiens
agacacccagaaataa

SEQ ID NO: 33332 - DNA, 16 bp, H. sapiens
agacaccgagctagct

SEQ ID NO: 33333 - DNA, 16 bp, H. sapiens
agacacctcaccaaag

SEQ ID NO: 33334 - DNA, 16 bp, H. sapiens
agacacctcatacagg

SEQ ID NO: 33335 - DNA, 16 bp, H. sapiens
agacacctgaaaatgt

SEQ ID NO: 33336 - DNA, 16 bp, H. sapiens
agacacgcacacacac

SEQ ID NO: 33337 - DNA, 16 bp, H. sapiens
agacactaaatatttt

SEQ ID NO: 33338 - DNA, 16 bp, H. sapiens
agacactcaataaatg

SEQ ID NO: 33339 - DNA, 16 bp, H. sapiens
agacactcagtaaata

SEQ ID NO: 33340 - DNA, 16 bp, H. sapiens
agacactgaaaaataa

SEQ ID NO: 33341 - DNA, 16 bp, H. sapiens
agacactgaagaacat

SEQ ID NO: 33342 - DNA, 16 bp, H. sapiens
agacactgaatcttct

SEQ ID NO: 33343 - DNA, 16 bp, H. sapiens
agacactgaggctcag

SEQ ID NO: 33344 - DNA, 16 bp, H. sapiens
agacactgctgaaaga

SEQ ID NO: 33345 - DNA, 16 bp, H. sapiens
agacactggaaaaaaa

SEQ ID NO: 33346 - DNA, 16 bp, H. sapiens
agacactggggaatac

SEQ ID NO: 33347 - DNA, 17 bp, H. sapiens
agacactggggcctacc

SEQ ID NO: 33348 - DNA, 16 bp, H. sapiens
agacactggggcctgt

SEQ ID NO: 33349 - DNA, 16 bp, H. sapiens
agacactggtggcatt

SEQ ID NO: 33350 - DNA, 16 bp, H. sapiens
agacactgtctcaaat

SEQ ID NO: 33351 - DNA, 16 bp, H. sapiens
agacactgtctccaaa

SEQ ID NO: 33352 - DNA, 16 bp, H. sapiens
agacactgtctttaca

SEQ ID NO: 33353 - DNA, 16 bp, H. sapiens
agacactgtggaaagc

SEQ ID NO: 33354 - DNA, 16 bp, H. sapiens
agacacttaataaata

SEQ ID NO: 33355 - DNA, 16 bp, H. sapiens
agacacttcttgaaag

SEQ ID NO: 33356 - DNA, 16 bp, H. sapiens
agacacttttcaaaga

SEQ ID NO: 33357 - DNA, 16 bp, H. sapiens
agacagaaaaactgag

SEQ ID NO: 33358 - DNA, 16 bp, H. sapiens
agacagaaaatagaag

SEQ ID NO: 33359 - DNA, 16 bp, H. sapiens
agacagaaaatgagaa

SEQ ID NO: 33360 - DNA, 16 bp, H. sapiens
agacagaaagcaaatt

SEQ ID NO: 33361 - DNA, 16 bp, H. sapiens
agacagaaagcagatt

SEQ ID NO: 33362 - DNA, 16 bp, H. sapiens
agacagaaagtacatt

SEQ ID NO: 33363 - DNA, 16 bp, H. sapiens
agacagaaagtagaat

SEQ ID NO: 33364 - DNA, 16 bp, H. sapiens
agacagaaagtaggtt

SEQ ID NO: 33365 - DNA, 17 bp, H. sapiens
agacagaaagtcaacaa

SEQ ID NO: 33366 - DNA, 16 bp, H. sapiens
agacagaaagtcagca

SEQ ID NO: 33367 - DNA, 16 bp, H. sapiens
agacagaaagtgaaca

SEQ ID NO: 33368 - DNA, 22 bp, H. sapiens
agacagaaagttaacaaggata

SEQ ID NO: 33369 - DNA, 16 bp, H. sapiens
agacagaaatcaagaa

SEQ ID NO: 33370 - DNA, 16 bp, H. sapiens
agacagaaattagaat

SEQ ID NO: 33371 - DNA, 16 bp, H. sapiens
agacagaaattttaaa

SEQ ID NO: 33372 - DNA, 16 bp, H. sapiens
agacagaagaaatctg

SEQ ID NO: 33373 - DNA, 16 bp, H. sapiens
agacagaagcagaaca

SEQ ID NO: 33374 - DNA, 16 bp, H. sapiens
agacagaatgaggaag

SEQ ID NO: 33375 - DNA, 16 bp, H. sapiens
agacagaatttcacca

SEQ ID NO: 33376 - DNA, 16 bp, H. sapiens
agacagaatttcactg

SEQ ID NO: 33377 - DNA, 16 bp, H. sapiens
agacagacaaattcct

SEQ ID NO: 33378 - DNA, 16 bp, H. sapiens
agacagacaagaatag

SEQ ID NO: 33379 - DNA, 16 bp, H. sapiens
agacagacacacatac

SEQ ID NO: 33380 - DNA, 16 bp, H. sapiens
agacagacagacaaac

SEQ ID NO: 33381 - DNA, 16 bp, H. sapiens
agacagacagacaaga

SEQ ID NO: 33382 - DNA, 16 bp, H. sapiens
agacagacagacaagg

SEQ ID NO: 33383 - DNA, 16 bp, H. sapiens
agacagacagacacag

SEQ ID NO: 33384 - DNA, 17 bp, H. sapiens
agacagacagacagaca

SEQ ID NO: 33385 - DNA, 16 bp, H. sapiens
agacagacatatagac

SEQ ID NO: 33386 - DNA, 16 bp, H. sapiens
agacagacatggtggc

SEQ ID NO: 33387 - DNA, 16 bp, H. sapiens
agacagactctcactg

SEQ ID NO: 33388 - DNA, 16 bp, H. sapiens
agacagagaaactgag

SEQ ID NO: 33389 - DNA, 16 bp, H. sapiens
agacagagaagggcat

SEQ ID NO: 33390 - DNA, 16 bp, H. sapiens
agacagagaatgagtt

SEQ ID NO: 33391 - DNA, 16 bp, H. sapiens
agacagagacaaagac

SEQ ID NO: 33392 - DNA, 16 bp, H. sapiens
agacagagacacagag

SEQ ID NO: 33393 - DNA, 16 bp, H. sapiens
agacagagacagagat

SEQ ID NO: 33394 - DNA, 16 bp, H. sapiens
agacagagacagaggc

SEQ ID NO: 33395 - DNA, 16 bp, H. sapiens
agacagagacagtgag

SEQ ID NO: 33396 - DNA, 16 bp, H. sapiens
agacagagaccatcct

SEQ ID NO: 33397 - DNA, 16 bp, H. sapiens
agacagagactcactc

SEQ ID NO: 33398 - DNA, 16 bp, H. sapiens
agacagagagagacag

SEQ ID NO: 33399 - DNA, 16 bp, H. sapiens
agacagagagagagac

SEQ ID NO: 33400 - DNA, 16 bp, H. sapiens
agacagagagagagat

SEQ ID NO: 33401 - DNA, 16 bp, H. sapiens
agacagagcagccctg

SEQ ID NO: 33402 - DNA, 16 bp, H. sapiens
agacagagccactgca

SEQ ID NO: 33403 - DNA, 16 bp, H. sapiens
agacagagcctcattc

SEQ ID NO: 33404 - DNA, 16 bp, H. sapiens
agacagagcctcgctt

SEQ ID NO: 33405 - DNA, 16 bp, H. sapiens
agacagagctagactc

SEQ ID NO: 33406 - DNA, 16 bp, H. sapiens
agacagaggcagaaga

SEQ ID NO: 33407 - DNA, 16 bp, H. sapiens
agacagaggcagagag

SEQ ID NO: 33408 - DNA, 16 bp, H. sapiens
agacagaggcagagcc

SEQ ID NO: 33409 - DNA, 16 bp, H. sapiens
agacagaggcaggagg

SEQ ID NO: 33410 - DNA, 16 bp, H. sapiens
agacagaggctcagag

SEQ ID NO: 33411 - DNA, 16 bp, H. sapiens
agacagaggttgcatt

SEQ ID NO: 33412 - DNA, 16 bp, H. sapiens
agacagagtctcatta

SEQ ID NO: 33413 - DNA, 16 bp, H. sapiens
agacagagtctcgccc

SEQ ID NO: 33414 - DNA, 17 bp, H. sapiens
agacagagtctcgctgt

SEQ ID NO: 33415 - DNA, 16 bp, H. sapiens
agacagagtctggttc

SEQ ID NO: 33416 - DNA, 17 bp, H. sapiens
agacagagtcttgatct

SEQ ID NO: 33417 - DNA, 16 bp, H. sapiens
agacagagttccgctc

SEQ ID NO: 33418 - DNA, 18 bp, H. sapiens
agacagagtttcaccatg

SEQ ID NO: 33419 - DNA, 16 bp, H. sapiens
agacagagtttcacta

SEQ ID NO: 33420 - DNA, 16 bp, H. sapiens
agacagagtttcactt

SEQ ID NO: 33421 - DNA, 16 bp, H. sapiens
agacagagtttcatca

SEQ ID NO: 33422 - DNA, 17 bp, H. sapiens
agacagagtttcgctcc

SEQ ID NO: 33423 - DNA, 18 bp, H. sapiens
agacagagttttgctctc

SEQ ID NO: 33424 - DNA, 16 bp, H. sapiens
agacagatagacagat

SEQ ID NO: 33425 - DNA, 16 bp, H. sapiens
agacagatcaaccaga

SEQ ID NO: 33426 - DNA, 16 bp, H. sapiens
agacagatcaatgagg

SEQ ID NO: 33427 - DNA, 16 bp, H. sapiens
agacagcaagaccaac

SEQ ID NO: 33428 - DNA, 16 bp, H. sapiens
agacagcaagagagag

SEQ ID NO: 33429 - DNA, 16 bp, H. sapiens
agacagcagaagcagg

SEQ ID NO: 33430 - DNA, 16 bp, H. sapiens
agacagcagcattccc

SEQ ID NO: 33431 - DNA, 16 bp, H. sapiens
agacagcaggcagctg

SEQ ID NO: 33432 - DNA, 16 bp, H. sapiens
agacagcaggccctga

SEQ ID NO: 33433 - DNA, 16 bp, H. sapiens
agacagcatcttgctc

SEQ ID NO: 33434 - DNA, 16 bp, H. sapiens
agacagcccccattac

SEQ ID NO: 33435 - DNA, 16 bp, H. sapiens
agacaggaaacaacag

SEQ ID NO: 33436 - DNA, 16 bp, H. sapiens
agacaggaaatagaaa

SEQ ID NO: 33437 - DNA, 16 bp, H. sapiens
agacaggaacaacaga

SEQ ID NO: 33438 - DNA, 16 bp, H. sapiens
agacaggaagatgtga

SEQ ID NO: 33439 - DNA, 16 bp, H. sapiens
agacaggaaggaagca

SEQ ID NO: 33440 - DNA, 16 bp, H. sapiens
agacaggagaactgct

SEQ ID NO: 33441 - DNA, 16 bp, H. sapiens
agacaggagttcaaga

SEQ ID NO: 33442 - DNA, 16 bp, H. sapiens
agacaggatctcactt

SEQ ID NO: 33443 - DNA, 16 bp, H. sapiens
agacaggatttcaaca

SEQ ID NO: 33444 - DNA, 17 bp, H. sapiens
agacaggatttcaccgt

SEQ ID NO: 33445 - DNA, 16 bp, H. sapiens
agacaggcagagagaa

SEQ ID NO: 33446 - DNA, 16 bp, H. sapiens
agacaggcatttcctc

SEQ ID NO: 33447 - DNA, 18 bp, H. sapiens
agacaggccaacattcaa

SEQ ID NO: 33448 - DNA, 16 bp, H. sapiens
agacaggcctggccaa

SEQ ID NO: 33449 - DNA, 16 bp, H. sapiens
agacaggctcctgggc

SEQ ID NO: 33450 - DNA, 16 bp, H. sapiens
agacagggaagctctc

SEQ ID NO: 33451 - DNA, 16 bp, H. sapiens
agacagggacaggtcc

SEQ ID NO: 33452 - DNA, 16 bp, H. sapiens
agacagggcctggctc

SEQ ID NO: 33453 - DNA, 16 bp, H. sapiens
agacaggggaattgca

SEQ ID NO: 33454 - DNA, 16 bp, H. sapiens
agacaggggtccagtt

SEQ ID NO: 33455 - DNA, 18 bp, H. sapiens
agacagggtcatttataa

SEQ ID NO: 33456 - DNA, 16 bp, H. sapiens
agacagggtctcacta

SEQ ID NO: 33457 - DNA, 16 bp, H. sapiens
agacagggtctcgctt

SEQ ID NO: 33458 - DNA, 16 bp, H. sapiens
agacagggtctggctt

SEQ ID NO: 33459 - DNA, 16 bp, H. sapiens
agacagggtcttgctg

SEQ ID NO: 33460 - DNA, 16 bp, H. sapiens
agacagggtcttgctt

SEQ ID NO: 33461 - DNA, 16 bp, H. sapiens
agacagggtgacagag

SEQ ID NO: 33462 - DNA, 17 bp, H. sapiens
agacagggtttcgctgt

SEQ ID NO: 33463 - DNA, 16 bp, H. sapiens
agacagggttttgcta

SEQ ID NO: 33464 - DNA, 16 bp, H. sapiens
agacagggtttttcca

SEQ ID NO: 33465 - DNA, 16 bp, H. sapiens
agacaggtcttgctct

SEQ ID NO: 33466 - DNA, 16 bp, H. sapiens
agacaggttctggctc

SEQ ID NO: 33467 - DNA, 16 bp, H. sapiens
agacagtaacagatca

SEQ ID NO: 33468 - DNA, 16 bp, H. sapiens
agacagtcacaaaagg

SEQ ID NO: 33469 - DNA, 16 bp, H. sapiens
agacagtccagaaata

SEQ ID NO: 33470 - DNA, 16 bp, H. sapiens
agacagtctcaaaaaa

SEQ ID NO: 33471 - DNA, 16 bp, H. sapiens
agacagtctcactttg

SEQ ID NO: 33472 - DNA, 16 bp, H. sapiens
agacagtctctctctg

SEQ ID NO: 33473 - DNA, 16 bp, H. sapiens
agacagtctggctctg

SEQ ID NO: 33474 - DNA, 16 bp, H. sapiens
agacagtcttcaagct

SEQ ID NO: 33475 - DNA, 16 bp, H. sapiens
agacagtgagagagag

SEQ ID NO: 33476 - DNA, 16 bp, H. sapiens
agacagtgagatcctt

SEQ ID NO: 33477 - DNA, 16 bp, H. sapiens
agacagtggactggag

SEQ ID NO: 33478 - DNA, 17 bp, H. sapiens
agacagtggccttcctc

SEQ ID NO: 33479 - DNA, 16 bp, H. sapiens
agacagtgggcgcagg

SEQ ID NO: 33480 - DNA, 16 bp, H. sapiens
agacagtgtctcactg

SEQ ID NO: 33481 - DNA, 16 bp, H. sapiens
agacagtgtctcgctt

SEQ ID NO: 33482 - DNA, 16 bp, H. sapiens
agacagtgtgtgcagg

SEQ ID NO: 33483 - DNA, 16 bp, H. sapiens
agacagtttgctataa

SEQ ID NO: 33484 - DNA, 16 bp, H. sapiens
agacagtttggtgatt

SEQ ID NO: 33485 - DNA, 16 bp, H. sapiens
agacagttttcaaaag

SEQ ID NO: 33486 - DNA, 16 bp, H. sapiens
agacagttttccaaag

SEQ ID NO: 33487 - DNA, 21 bp, H. sapiens
agacataagaaactccatttt

SEQ ID NO: 33488 - DNA, 16 bp, H. sapiens
agacataagaaatgag

SEQ ID NO: 33489 - DNA, 21 bp, H. sapiens
agacataagagactccatttt

SEQ ID NO: 33490 - DNA, 16 bp, H. sapiens
agacatacatatatac

SEQ ID NO: 33491 - DNA, 16 bp, H. sapiens
agacatagacacacac

SEQ ID NO: 33492 - DNA, 16 bp, H. sapiens
agacatagaccaatgg

SEQ ID NO: 33493 - DNA, 16 bp, H. sapiens
agacatagaggaaact

SEQ ID NO: 33494 - DNA, 16 bp, H. sapiens
agacatagcaataaaa

SEQ ID NO: 33495 - DNA, 16 bp, H. sapiens
agacatatatatatat

SEQ ID NO: 33496 - DNA, 16 bp, H. sapiens
agacatatttaaaaat

SEQ ID NO: 33497 - DNA, 16 bp, H. sapiens
agacatcaaaaagata

SEQ ID NO: 33498 - DNA, 16 bp, H. sapiens
agacatcaaagctaga

SEQ ID NO: 33499 - DNA, 16 bp, H. sapiens
agacatcaagggaatg

SEQ ID NO: 33500 - DNA, 16 bp, H. sapiens
agacatcaatcaacat

SEQ ID NO: 33501 - DNA, 16 bp, H. sapiens
agacatcacaagaaaa

SEQ ID NO: 33502 - DNA, 16 bp, H. sapiens
agacatcacatgtcgg

SEQ ID NO: 33503 - DNA, 16 bp, H. sapiens
agacatcatctctaca

SEQ ID NO: 33504 - DNA, 16 bp, H. sapiens
agacatccctgagact

SEQ ID NO: 33505 - DNA, 16 bp, H. sapiens
agacatctcccagtgt

SEQ ID NO: 33506 - DNA, 16 bp, H. sapiens
agacatgaatgcacac

SEQ ID NO: 33507 - DNA, 16 bp, H. sapiens
agacatgagcagggca

SEQ ID NO: 33508 - DNA, 16 bp, H. sapiens
agacatgagccaccac

SEQ ID NO: 33509 - DNA, 16 bp, H. sapiens
agacatgagccaccgt

SEQ ID NO: 33510 - DNA, 16 bp, H. sapiens
agacatgataactaaa

SEQ ID NO: 33511 - DNA, 16 bp, H. sapiens
agacatgatcatgcca

SEQ ID NO: 33512 - DNA, 16 bp, H. sapiens
agacatgcaatttacc

SEQ ID NO: 33513 - DNA, 16 bp, H. sapiens
agacatggaacagatt

SEQ ID NO: 33514 - DNA, 16 bp, H. sapiens
agacatggaatcatcc

SEQ ID NO: 33515 - DNA, 17 bp, H. sapiens
agacatggatgaaattg

SEQ ID NO: 33516 - DNA, 16 bp, H. sapiens
agacatggcccctgcc

SEQ ID NO: 33517 - DNA, 16 bp, H. sapiens
agacatgggagacttc

SEQ ID NO: 33518 - DNA, 18 bp, H. sapiens
agacatggggtttcaccg

SEQ ID NO: 33519 - DNA, 16 bp, H. sapiens
agacatggtctcactc

SEQ ID NO: 33520 - DNA, 16 bp, H. sapiens
agacatggtggctgtg

SEQ ID NO: 33521 - DNA, 16 bp, H. sapiens
agacattaaaagaaat

SEQ ID NO: 33522 - DNA, 16 bp, H. sapiens
agacattaaataattt

SEQ ID NO: 33523 - DNA, 17 bp, H. sapiens
agacattaatgcagcca

SEQ ID NO: 33524 - DNA, 16 bp, H. sapiens
agacattatactttct

SEQ ID NO: 33525 - DNA, 21 bp, H. sapiens
agacattccattgcccaggga

SEQ ID NO: 33526 - DNA, 16 bp, H. sapiens
agacattctcagatga

SEQ ID NO: 33527 - DNA, 16 bp, H. sapiens
agacattctggttttt

SEQ ID NO: 33528 - DNA, 16 bp, H. sapiens
agacattctttttttt

SEQ ID NO: 33529 - DNA, 16 bp, H. sapiens
agacattgcagaagaa

SEQ ID NO: 33530 - DNA, 16 bp, H. sapiens
agacattgccaaatgt

SEQ ID NO: 33531 - DNA, 16 bp, H. sapiens
agacattgtctctaca

SEQ ID NO: 33532 - DNA, 16 bp, H. sapiens
agacatttaaaatttt

SEQ ID NO: 33533 - DNA, 16 bp, H. sapiens
agacatttaaacaaat

SEQ ID NO: 33534 - DNA, 16 bp, H. sapiens
agacatttatgtgacc

SEQ ID NO: 33535 - DNA, 16 bp, H. sapiens
agacatttatttttca

SEQ ID NO: 33536 - DNA, 16 bp, H. sapiens
agacatttctgaaaag

SEQ ID NO: 33537 - DNA, 16 bp, H. sapiens
agacatttcttctgcc

SEQ ID NO: 33538 - DNA, 16 bp, H. sapiens
agacatttctttaaag

SEQ ID NO: 33539 - DNA, 16 bp, H. sapiens
agacatttgaaaatat

SEQ ID NO: 33540 - DNA, 16 bp, H. sapiens
agacatttggtctaaa

SEQ ID NO: 33541 - DNA, 16 bp, H. sapiens
agacatttgttgaatg

SEQ ID NO: 33542 - DNA, 16 bp, H. sapiens
agacattttaaaaaat

SEQ ID NO: 33543 - DNA, 16 bp, H. sapiens
agacattttaaaaata

SEQ ID NO: 33544 - DNA, 16 bp, H. sapiens
agacattttaaaatta

SEQ ID NO: 33545 - DNA, 16 bp, H. sapiens
agacattttaattttt

SEQ ID NO: 33546 - DNA, 16 bp, H. sapiens
agacattttattttac

SEQ ID NO: 33547 - DNA, 16 bp, H. sapiens
agacattttcagacat

SEQ ID NO: 33548 - DNA, 16 bp, H. sapiens
agacattttcttaaaa

SEQ ID NO: 33549 - DNA, 16 bp, H. sapiens
agacattttgaatttt

SEQ ID NO: 33550 - DNA, 16 bp, H. sapiens
agacattttgatacag

SEQ ID NO: 33551 - DNA, 16 bp, H. sapiens
agacatttttaaaaat

SEQ ID NO: 33552 - DNA, 16 bp, H. sapiens
agacatttttaaagaa

SEQ ID NO: 33553 - DNA, 16 bp, H. sapiens
agacatttttctaaag

SEQ ID NO: 33554 - DNA, 16 bp, H. sapiens
agacatttttcttgtc

SEQ ID NO: 33555 - DNA, 16 bp, H. sapiens
agacattttttaaaaa

SEQ ID NO: 33556 - DNA, 16 bp, H. sapiens
agacattttttaatgt

SEQ ID NO: 33557 - DNA, 16 bp, H. sapiens
agacatttttttccct

SEQ ID NO: 33558 - DNA, 16 bp, H. sapiens
agaccaaaatgtttga

SEQ ID NO: 33559 - DNA, 16 bp, H. sapiens
agaccaaactggccaa

SEQ ID NO: 33560 - DNA, 16 bp, H. sapiens
agaccaaagaatgact

SEQ ID NO: 33561 - DNA, 16 bp, H. sapiens
agaccaaatatatatt

SEQ ID NO: 33562 - DNA, 16 bp, H. sapiens
agaccaacaaagagac

SEQ ID NO: 33563 - DNA, 17 bp, H. sapiens
agaccaacatggtgaaa

SEQ ID NO: 33564 - DNA, 16 bp, H. sapiens
agaccaacctagccaa

SEQ ID NO: 33565 - DNA, 16 bp, H. sapiens
agaccaacctgaccaa

SEQ ID NO: 33566 - DNA, 16 bp, H. sapiens
agaccaacctggacaa

SEQ ID NO: 33567 - DNA, 16 bp, H. sapiens
agaccaacctggataa

SEQ ID NO: 33568 - DNA, 16 bp, H. sapiens
agaccaacctggccaa

SEQ ID NO: 33569 - DNA, 16 bp, H. sapiens
agaccaacctgggcaa

SEQ ID NO: 33570 - DNA, 16 bp, H. sapiens
agaccaagaacccacc

SEQ ID NO: 33571 - DNA, 16 bp, H. sapiens
agaccaagaaccctgg

SEQ ID NO: 33572 - DNA, 16 bp, H. sapiens
agaccaagactctgtc

SEQ ID NO: 33573 - DNA, 16 bp, H. sapiens
agaccaagctgggcaa

SEQ ID NO: 33574 - DNA, 16 bp, H. sapiens
agaccaaggagggcag

SEQ ID NO: 33575 - DNA, 16 bp, H. sapiens
agaccaaggcaggcag

SEQ ID NO: 33576 - DNA, 16 bp, H. sapiens
agaccaaggcaggtga

SEQ ID NO: 33577 - DNA, 16 bp, H. sapiens
agaccaaggtggaagg

SEQ ID NO: 33578 - DNA, 16 bp, H. sapiens
agaccaaggttctttt

SEQ ID NO: 33579 - DNA, 16 bp, H. sapiens
agaccaatatggtgaa

SEQ ID NO: 33580 - DNA, 16 bp, H. sapiens
agaccaatctaggcaa

SEQ ID NO: 33581 - DNA, 16 bp, H. sapiens
agaccaatctgagcaa

SEQ ID NO: 33582 - DNA, 16 bp, H. sapiens
agaccaatgaaagaga

SEQ ID NO: 33583 - DNA, 16 bp, H. sapiens
agaccaatggaaccaa

SEQ ID NO: 33584 - DNA, 16 bp, H. sapiens
agaccaattacatcag

SEQ ID NO: 33585 - DNA, 16 bp, H. sapiens
agaccacacagcagga

SEQ ID NO: 33586 - DNA, 17 bp, H. sapiens
agaccacactggccaac

SEQ ID NO: 33587 - DNA, 16 bp, H. sapiens
agaccacagagataaa

SEQ ID NO: 33588 - DNA, 16 bp, H. sapiens
agaccaccctgaccaa

SEQ ID NO: 33589 - DNA, 16 bp, H. sapiens
agaccaccctggccaa

SEQ ID NO: 33590 - DNA, 18 bp, H. sapiens
agaccaccctggctaaca

SEQ ID NO: 33591 - DNA, 16 bp, H. sapiens
agaccaccctgggcaa

SEQ ID NO: 33592 - DNA, 16 bp, H. sapiens
agaccaccctggtcaa

SEQ ID NO: 33593 - DNA, 16 bp, H. sapiens
agaccacctcagccag

SEQ ID NO: 33594 - DNA, 16 bp, H. sapiens
agaccacctctgcctg

SEQ ID NO: 33595 - DNA, 16 bp, H. sapiens
agaccacgaacccacc

SEQ ID NO: 33596 - DNA, 16 bp, H. sapiens
agaccacgagcccacc

SEQ ID NO: 33597 - DNA, 17 bp, H. sapiens
agaccacggtgaaaccc

SEQ ID NO: 33598 - DNA, 16 bp, H. sapiens
agaccacgtctctaca

SEQ ID NO: 33599 - DNA, 16 bp, H. sapiens
agaccactagccagac

SEQ ID NO: 33600 - DNA, 16 bp, H. sapiens
agaccactgcaataaa

SEQ ID NO: 33601 - DNA, 18 bp, H. sapiens
agaccacttggctccctg

SEQ ID NO: 33602 - DNA, 16 bp, H. sapiens
agaccagaagaaccac

SEQ ID NO: 33603 - DNA, 16 bp, H. sapiens
agaccagaccagacca

SEQ ID NO: 33604 - DNA, 16 bp, H. sapiens
agaccagactgaccaa

SEQ ID NO: 33605 - DNA, 16 bp, H. sapiens
agaccagactggacaa

SEQ ID NO: 33606 - DNA, 16 bp, H. sapiens
agaccagactggccaa

SEQ ID NO: 33607 - DNA, 16 bp, H. sapiens
agaccagactgggcaa

SEQ ID NO: 33608 - DNA, 16 bp, H. sapiens
agaccagcaagggcaa

SEQ ID NO: 33609 - DNA, 16 bp, H. sapiens
agaccagcagaaagga

SEQ ID NO: 33610 - DNA, 16 bp, H. sapiens
agaccagcagcaccag

SEQ ID NO: 33611 - DNA, 16 bp, H. sapiens
agaccagcagcatcaa

SEQ ID NO: 33612 - DNA, 16 bp, H. sapiens
agaccagcatgaccaa

SEQ ID NO: 33613 - DNA, 16 bp, H. sapiens
agaccagcatggccaa

SEQ ID NO: 33614 - DNA, 16 bp, H. sapiens
agaccagcatggtcaa

SEQ ID NO: 33615 - DNA, 16 bp, H. sapiens
agaccagccagaccaa

SEQ ID NO: 33616 - DNA, 16 bp, H. sapiens
agaccagccagagcaa

SEQ ID NO: 33617 - DNA, 16 bp, H. sapiens
agaccagccaggacaa

SEQ ID NO: 33618 - DNA, 16 bp, H. sapiens
agaccagccaggccaa

SEQ ID NO: 33619 - DNA, 16 bp, H. sapiens
agaccagccagggcaa

SEQ ID NO: 33620 - DNA, 16 bp, H. sapiens
agaccagcccaaccaa

SEQ ID NO: 33621 - DNA, 16 bp, H. sapiens
agaccagcccaggcaa

SEQ ID NO: 33622 - DNA, 16 bp, H. sapiens
agaccagccccatctc

SEQ ID NO: 33623 - DNA, 16 bp, H. sapiens
agaccagcccgaccaa

SEQ ID NO: 33624 - DNA, 16 bp, H. sapiens
agaccagcccggccaa

SEQ ID NO: 33625 - DNA, 16 bp, H. sapiens
agaccagcccgggcaa

SEQ ID NO: 33626 - DNA, 16 bp, H. sapiens
agaccagccggggcaa

SEQ ID NO: 33627 - DNA, 16 bp, H. sapiens
agaccagcctaaccaa

SEQ ID NO: 33628 - DNA, 16 bp, H. sapiens
agaccagcctagacaa

SEQ ID NO: 33629 - DNA, 16 bp, H. sapiens
agaccagcctagccaa

SEQ ID NO: 33630 - DNA, 16 bp, H. sapiens
agaccagcctagctaa

SEQ ID NO: 33631 - DNA, 16 bp, H. sapiens
agaccagcctaggcaa

SEQ ID NO: 33632 - DNA, 16 bp, H. sapiens
agaccagcctcgccaa

SEQ ID NO: 33633 - DNA, 16 bp, H. sapiens
agaccagcctcgtcaa

SEQ ID NO: 33634 - DNA, 16 bp, H. sapiens
agaccagcctgacaaa

SEQ ID NO: 33635 - DNA, 16 bp, H. sapiens
agaccagcctgaccaa

SEQ ID NO: 33636 - DNA, 21 bp, H. sapiens
agaccagcctgaccaacatga

SEQ ID NO: 33637 - DNA, 16 bp, H. sapiens
agaccagcctgaccac

SEQ ID NO: 33638 - DNA, 16 bp, H. sapiens
agaccagcctgaccag

SEQ ID NO: 33639 - DNA, 16 bp, H. sapiens
agaccagcctgaccat

SEQ ID NO: 33640 - DNA, 16 bp, H. sapiens
agaccagcctgacgaa

SEQ ID NO: 33641 - DNA, 16 bp, H. sapiens
agaccagcctgactaa

SEQ ID NO: 33642 - DNA, 16 bp, H. sapiens
agaccagcctgactga

SEQ ID NO: 33643 - DNA, 16 bp, H. sapiens
agaccagcctgagaaa

SEQ ID NO: 33644 - DNA, 16 bp, H. sapiens
agaccagcctgagcaa

SEQ ID NO: 33645 - DNA, 16 bp, H. sapiens
agaccagcctgaggaa

SEQ ID NO: 33646 - DNA, 16 bp, H. sapiens
agaccagcctgatcaa

SEQ ID NO: 33647 - DNA, 16 bp, H. sapiens
agaccagcctgcccaa

SEQ ID NO: 33648 - DNA, 16 bp, H. sapiens
agaccagcctggaaaa

SEQ ID NO: 33649 - DNA, 16 bp, H. sapiens
agaccagcctggacaa

SEQ ID NO: 33650 - DNA, 16 bp, H. sapiens
agaccagcctggacag

SEQ ID NO: 33651 - DNA, 16 bp, H. sapiens
agaccagcctggatga

SEQ ID NO: 33652 - DNA, 16 bp, H. sapiens
agaccagcctggcaaa

SEQ ID NO: 33653 - DNA, 16 bp, H. sapiens
agaccagcctggcaac

SEQ ID NO: 33654 - DNA, 16 bp, H. sapiens
agaccagcctggccaa

SEQ ID NO: 33655 - DNA, 16 bp, H. sapiens
agaccagcctggccac

SEQ ID NO: 33656 - DNA, 16 bp, H. sapiens
agaccagcctggccag

SEQ ID NO: 33657 - DNA, 16 bp, H. sapiens
agaccagcctggccat

SEQ ID NO: 33658 - DNA, 16 bp, H. sapiens
agaccagcctggccca

SEQ ID NO: 33659 - DNA, 16 bp, H. sapiens
agaccagcctggccga

SEQ ID NO: 33660 - DNA, 16 bp, H. sapiens
agaccagcctggctaa

SEQ ID NO: 33661 - DNA, 16 bp, H. sapiens
agaccagcctggctga

SEQ ID NO: 33662 - DNA, 16 bp, H. sapiens
agaccagcctgggaaa

SEQ ID NO: 33663 - DNA, 16 bp, H. sapiens
agaccagcctgggaac

SEQ ID NO: 33664 - DNA, 16 bp, H. sapiens
agaccagcctgggcaa

SEQ ID NO: 33665 - DNA, 16 bp, H. sapiens
agaccagcctgggcag

SEQ ID NO: 33666 - DNA, 16 bp, H. sapiens
agaccagcctgggcca

SEQ ID NO: 33667 - DNA, 20 bp, H. sapiens
agaccagcctgggccacatg

SEQ ID NO: 33668 - DNA, 16 bp, H. sapiens
agaccagcctgggcta

SEQ ID NO: 33669 - DNA, 16 bp, H. sapiens
agaccagcctggggca

SEQ ID NO: 33670 - DNA, 16 bp, H. sapiens
agaccagcctgggggc

SEQ ID NO: 33671 - DNA, 16 bp, H. sapiens
agaccagcctgggtaa

SEQ ID NO: 33672 - DNA, 16 bp, H. sapiens
agaccagcctgggtat

SEQ ID NO: 33673 - DNA, 16 bp, H. sapiens
agaccagcctggtaac

SEQ ID NO: 33674 - DNA, 16 bp, H. sapiens
agaccagcctggtcaa

SEQ ID NO: 33675 - DNA, 16 bp, H. sapiens
agaccagcctgtccaa

SEQ ID NO: 33676 - DNA, 16 bp, H. sapiens
agaccagcctgtgcaa

SEQ ID NO: 33677 - DNA, 16 bp, H. sapiens
agaccagcctgttcaa

SEQ ID NO: 33678 - DNA, 16 bp, H. sapiens
agaccagccttaccaa

SEQ ID NO: 33679 - DNA, 16 bp, H. sapiens
agaccagccttgacaa

SEQ ID NO: 33680 - DNA, 16 bp, H. sapiens
agaccagccttggcaa

SEQ ID NO: 33681 - DNA, 16 bp, H. sapiens
agaccagcgtgaccaa

SEQ ID NO: 33682 - DNA, 16 bp, H. sapiens
agaccagcgtgggcaa

SEQ ID NO: 33683 - DNA, 16 bp, H. sapiens
agaccagcgtggtcaa

SEQ ID NO: 33684 - DNA, 26 bp, H. sapiens
agaccagctcagtcagggagacccta

SEQ ID NO: 33685 - DNA, 16 bp, H. sapiens
agaccagctggggcaa

SEQ ID NO: 33686 - DNA, 16 bp, H. sapiens
agaccagcttaggcaa

SEQ ID NO: 33687 - DNA, 16 bp, H. sapiens
agaccagcttgaccaa

SEQ ID NO: 33688 - DNA, 16 bp, H. sapiens
agaccagcttggccaa

SEQ ID NO: 33689 - DNA, 16 bp, H. sapiens
agaccagcttggccag

SEQ ID NO: 33690 - DNA, 16 bp, H. sapiens
agaccagcttgggcaa

SEQ ID NO: 33691 - DNA, 16 bp, H. sapiens
agaccagcttgtgcaa

SEQ ID NO: 33692 - DNA, 16 bp, H. sapiens
agaccaggagaaaata

SEQ ID NO: 33693 - DNA, 17 bp, H. sapiens
agaccaggagattccct

SEQ ID NO: 33694 - DNA, 18 bp, H. sapiens
agaccaggcgcggtggct

SEQ ID NO: 33695 - DNA, 16 bp, H. sapiens
agaccaggctggccaa

SEQ ID NO: 33696 - DNA, 16 bp, H. sapiens
agaccaggctgggcaa

SEQ ID NO: 33697 - DNA, 16 bp, H. sapiens
agaccagggatgctgc

SEQ ID NO: 33698 - DNA, 16 bp, H. sapiens
agaccaggtatggtgg

SEQ ID NO: 33699 - DNA, 16 bp, H. sapiens
agaccagtctgaccaa

SEQ ID NO: 33700 - DNA, 16 bp, H. sapiens
agaccagtctgagcaa

SEQ ID NO: 33701 - DNA, 16 bp, H. sapiens
agaccagtctggcaac

SEQ ID NO: 33702 - DNA, 16 bp, H. sapiens
agaccagtctggccaa

SEQ ID NO: 33703 - DNA, 16 bp, H. sapiens
agaccagtctgggaaa

SEQ ID NO: 33704 - DNA, 16 bp, H. sapiens
agaccagtctgggcaa

SEQ ID NO: 33705 - DNA, 16 bp, H. sapiens
agaccagtctggtcaa

SEQ ID NO: 33706 - DNA, 16 bp, H. sapiens
agaccagtggttctca

SEQ ID NO: 33707 - DNA, 16 bp, H. sapiens
agaccagtgtcctgaa

SEQ ID NO: 33708 - DNA, 16 bp, H. sapiens
agaccagtgtgggcaa

SEQ ID NO: 33709 - DNA, 16 bp, H. sapiens
agaccagtttgggcaa

SEQ ID NO: 33710 - DNA, 18 bp, H. sapiens
agaccatactggctaaca

SEQ ID NO: 33711 - DNA, 16 bp, H. sapiens
agaccatagagcagga

SEQ ID NO: 33712 - DNA, 18 bp, H. sapiens
agaccatcccggctaaca

SEQ ID NO: 33713 - DNA, 18 bp, H. sapiens
agaccatcctagctaaca

SEQ ID NO: 33714 - DNA, 18 bp, H. sapiens
agaccatcctcgccaaca

SEQ ID NO: 33715 - DNA, 16 bp, H. sapiens
agaccatcctgaacaa

SEQ ID NO: 33716 - DNA, 18 bp, H. sapiens
agaccatcctgaccaaca

SEQ ID NO: 33717 - DNA, 18 bp, H. sapiens
agaccatcctgactaaca

SEQ ID NO: 33718 - DNA, 16 bp, H. sapiens
agaccatcctgcccaa

SEQ ID NO: 33719 - DNA, 18 bp, H. sapiens
agaccatcctgcctaaca

SEQ ID NO: 33720 - DNA, 16 bp, H. sapiens
agaccatcctggacaa

SEQ ID NO: 33721 - DNA, 16 bp, H. sapiens
agaccatcctggagaa

SEQ ID NO: 33722 - DNA, 16 bp, H. sapiens
agaccatcctggccaa

SEQ ID NO: 33723 - DNA, 17 bp, H. sapiens
agaccatcctggccaaa

SEQ ID NO: 33724 - DNA, 16 bp, H. sapiens
agaccatcctggccat

SEQ ID NO: 33725 - DNA, 16 bp, H. sapiens
agaccatcctggccca

SEQ ID NO: 33726 - DNA, 18 bp, H. sapiens
agaccatcctggctaaca

SEQ ID NO: 33727 - DNA, 18 bp, H. sapiens
agaccatcctggctaacg

SEQ ID NO: 33728 - DNA, 17 bp, H. sapiens
agaccatcctggctaag

SEQ ID NO: 33729 - DNA, 17 bp, H. sapiens
agaccatcctggctaat

SEQ ID NO: 33730 - DNA, 16 bp, H. sapiens
agaccatcctggctac

SEQ ID NO: 33731 - DNA, 16 bp, H. sapiens
agaccatcctggctag

SEQ ID NO: 33732 - DNA, 16 bp, H. sapiens
agaccatcctggctat

SEQ ID NO: 33733 - DNA, 16 bp, H. sapiens
agaccatcctgggcaa

SEQ ID NO: 33734 - DNA, 18 bp, H. sapiens
agaccatcctggttaaca

SEQ ID NO: 33735 - DNA, 18 bp, H. sapiens
agaccatcctgtctaaca

SEQ ID NO: 33736 - DNA, 18 bp, H. sapiens
agaccatcgtggctaaca

SEQ ID NO: 33737 - DNA, 18 bp, H. sapiens
agaccatcttggctaaca

SEQ ID NO: 33738 - DNA, 18 bp, H. sapiens
agaccatgctggctaaca

SEQ ID NO: 33739 - DNA, 20 bp, H. sapiens
agaccattctggccaacatg

SEQ ID NO: 33740 - DNA, 18 bp, H. sapiens
agaccattctggctaaca

SEQ ID NO: 33741 - DNA, 16 bp, H. sapiens
agaccattgtggccaa

SEQ ID NO: 33742 - DNA, 16 bp, H. sapiens
agaccatttttaaaaa

SEQ ID NO: 33743 - DNA, 16 bp, H. sapiens
agacccagaagagaga

SEQ ID NO: 33744 - DNA, 16 bp, H. sapiens
agacccagagagagga

SEQ ID NO: 33745 - DNA, 16 bp, H. sapiens
agacccaggaatccag

SEQ ID NO: 33746 - DNA, 16 bp, H. sapiens
agacccaggagagcca

SEQ ID NO: 33747 - DNA, 16 bp, H. sapiens
agacccagtgggaggt

SEQ ID NO: 33748 - DNA, 16 bp, H. sapiens
agaccccaactctaca

SEQ ID NO: 33749 - DNA, 16 bp, H. sapiens
agaccccacctcttaa

SEQ ID NO: 33750 - DNA, 16 bp, H. sapiens
agaccccagcccctcc

SEQ ID NO: 33751 - DNA, 16 bp, H. sapiens
agaccccagtgtctgt

SEQ ID NO: 33752 - DNA, 16 bp, H. sapiens
agaccccatctcaaaa

SEQ ID NO: 33753 - DNA, 16 bp, H. sapiens
agaccccatctccaca

SEQ ID NO: 33754 - DNA, 16 bp, H. sapiens
agaccccatctctaaa

SEQ ID NO: 33755 - DNA, 16 bp, H. sapiens
agaccccatctctaca

SEQ ID NO: 33756 - DNA, 16 bp, H. sapiens
agaccccatcttaaaa

SEQ ID NO: 33757 - DNA, 16 bp, H. sapiens
agaccccatttctaca

SEQ ID NO: 33758 - DNA, 17 bp, H. sapiens
agacccccagtggatgt

SEQ ID NO: 33759 - DNA, 16 bp, H. sapiens
agacccccatctctaa

SEQ ID NO: 33760 - DNA, 16 bp, H. sapiens
agacccccatctctat

SEQ ID NO: 33761 - DNA, 16 bp, H. sapiens
agacccccatctctta

SEQ ID NO: 33762 - DNA, 16 bp, H. sapiens
agacccctacctctca

SEQ ID NO: 33763 - DNA, 16 bp, H. sapiens
agaccccttccttcca

SEQ ID NO: 33764 - DNA, 16 bp, H. sapiens
agaccctacctcaaaa

SEQ ID NO: 33765 - DNA, 16 bp, H. sapiens
agaccctacctcttaa

SEQ ID NO: 33766 - DNA, 16 bp, H. sapiens
agaccctattcacctg

SEQ ID NO: 33767 - DNA, 16 bp, H. sapiens
agaccctatttcaaaa

SEQ ID NO: 33768 - DNA, 16 bp, H. sapiens
agaccctcatctcaaa

SEQ ID NO: 33769 - DNA, 16 bp, H. sapiens
agaccctcctctccca

SEQ ID NO: 33770 - DNA, 16 bp, H. sapiens
agaccctcctgcctca

SEQ ID NO: 33771 - DNA, 16 bp, H. sapiens
agaccctgagacaagg

SEQ ID NO: 33772 - DNA, 16 bp, H. sapiens
agaccctgcctctgaa

SEQ ID NO: 33773 - DNA, 16 bp, H. sapiens
agaccctgcctttaaa

SEQ ID NO: 33774 - DNA, 16 bp, H. sapiens
agaccctgggcccagc

SEQ ID NO: 33775 - DNA, 16 bp, H. sapiens
agaccctggtgtgtga

SEQ ID NO: 33776 - DNA, 16 bp, H. sapiens
agaccctgtcataaaa

SEQ ID NO: 33777 - DNA, 16 bp, H. sapiens
agaccctgtctagaaa

SEQ ID NO: 33778 - DNA, 16 bp, H. sapiens
agaccctgtctcaaaa

SEQ ID NO: 33779 - DNA, 16 bp, H. sapiens
agaccctgtctcaaga

SEQ ID NO: 33780 - DNA, 16 bp, H. sapiens
agaccctgtctctaaa

SEQ ID NO: 33781 - DNA, 16 bp, H. sapiens
agaccctgtctgtaca

SEQ ID NO: 33782 - DNA, 16 bp, H. sapiens
agaccctgtcttaaaa

SEQ ID NO: 33783 - DNA, 16 bp, H. sapiens
agaccctgtttcaaaa

SEQ ID NO: 33784 - DNA, 16 bp, H. sapiens
agaccctgtttcttta

SEQ ID NO: 33785 - DNA, 16 bp, H. sapiens
agacccttcaaaaaat

SEQ ID NO: 33786 - DNA, 16 bp, H. sapiens
agaccgagactctgtc

SEQ ID NO: 33787 - DNA, 16 bp, H. sapiens
agaccgaggcgggtgg

SEQ ID NO: 33788 - DNA, 16 bp, H. sapiens
agaccgaggtgggtgg

SEQ ID NO: 33789 - DNA, 16 bp, H. sapiens
agaccgagtctcattc

SEQ ID NO: 33790 - DNA, 16 bp, H. sapiens
agaccgagtctcgctc

SEQ ID NO: 33791 - DNA, 16 bp, H. sapiens
agaccggcctggtcaa

SEQ ID NO: 33792 - DNA, 16 bp, H. sapiens
agaccgtggagaggga

SEQ ID NO: 33793 - DNA, 16 bp, H. sapiens
agaccgtggggagagg

SEQ ID NO: 33794 - DNA, 16 bp, H. sapiens
agaccgtgtctcaaaa

SEQ ID NO: 33795 - DNA, 16 bp, H. sapiens
agacctaaaacaataa

SEQ ID NO: 33796 - DNA, 16 bp, H. sapiens
agacctacagaagagg

SEQ ID NO: 33797 - DNA, 16 bp, H. sapiens
agacctatggtgaaaa

SEQ ID NO: 33798 - DNA, 16 bp, H. sapiens
agacctcaccagaagc

SEQ ID NO: 33799 - DNA, 16 bp, H. sapiens
agacctcagaagaaac

SEQ ID NO: 33800 - DNA, 17 bp, H. sapiens
agacctcaggtgatcca

SEQ ID NO: 33801 - DNA, 16 bp, H. sapiens
agacctcatctctaaa

SEQ ID NO: 33802 - DNA, 16 bp, H. sapiens
agacctccccagccac

SEQ ID NO: 33803 - DNA, 16 bp, H. sapiens
agacctcctctctaca

SEQ ID NO: 33804 - DNA, 16 bp, H. sapiens
agacctgaaattataa

SEQ ID NO: 33805 - DNA, 16 bp, H. sapiens
agacctgaattcaaat

SEQ ID NO: 33806 - DNA, 16 bp, H. sapiens
agacctgcagcagagg

SEQ ID NO: 33807 - DNA, 16 bp, H. sapiens
agacctgcctggccaa

SEQ ID NO: 33808 - DNA, 16 bp, H. sapiens
agacctgcctgggcaa

SEQ ID NO: 33809 - DNA, 16 bp, H. sapiens
agacctgctttacaag

SEQ ID NO: 33810 - DNA, 16 bp, H. sapiens
agacctggattcaaat

SEQ ID NO: 33811 - DNA, 16 bp, H. sapiens
agacctggattcaagt

SEQ ID NO: 33812 - DNA, 16 bp, H. sapiens
agacctggccaacatg

SEQ ID NO: 33813 - DNA, 16 bp, H. sapiens
agacctgggttccaat

SEQ ID NO: 33814 - DNA, 16 bp, H. sapiens
agacctgggttccagt

SEQ ID NO: 33815 - DNA, 16 bp, H. sapiens
agacctgggtttgaat

SEQ ID NO: 33816 - DNA, 16 bp, H. sapiens
agacctgtctcctggg

SEQ ID NO: 33817 - DNA, 16 bp, H. sapiens
agaccttcctggccaa

SEQ ID NO: 33818 - DNA, 18 bp, H. sapiens
agaccttcctggctaaca

SEQ ID NO: 33819 - DNA, 16 bp, H. sapiens
agaccttctagtggga

SEQ ID NO: 33820 - DNA, 16 bp, H. sapiens
agaccttggtcagatg

SEQ ID NO: 33821 - DNA, 16 bp, H. sapiens
agaccttgtcaaaaaa

SEQ ID NO: 33822 - DNA, 16 bp, H. sapiens
agaccttgtctcaaaa

SEQ ID NO: 33823 - DNA, 16 bp, H. sapiens
agaccttgtctcaaca

SEQ ID NO: 33824 - DNA, 16 bp, H. sapiens
agaccttgtctcagaa

SEQ ID NO: 33825 - DNA, 16 bp, H. sapiens
agaccttgtctcgaaa

SEQ ID NO: 33826 - DNA, 16 bp, H. sapiens
agaccttgtctctaaa

SEQ ID NO: 33827 - DNA, 16 bp, H. sapiens
agacctttatcagata

SEQ ID NO: 33828 - DNA, 16 bp, H. sapiens
agacctttgtggtgag

SEQ ID NO: 33829 - DNA, 20 bp, H. sapiens
agacctttgttcacgtgttt

SEQ ID NO: 33830 - DNA, 17 bp, H. sapiens
agacgaagtcttgctct

SEQ ID NO: 33831 - DNA, 16 bp, H. sapiens
agacgaggaagctgag

SEQ ID NO: 33832 - DNA, 16 bp, H. sapiens
agacgaggtttcacca

SEQ ID NO: 33833 - DNA, 16 bp, H. sapiens
agacgaggtttcttca

SEQ ID NO: 33834 - DNA, 16 bp, H. sapiens
agacggagatgaggaa

SEQ ID NO: 33835 - DNA, 16 bp, H. sapiens
agacggagtctcacct

SEQ ID NO: 33836 - DNA, 17 bp, H. sapiens
agacggagtctcgcact

SEQ ID NO: 33837 - DNA, 16 bp, H. sapiens
agacggagtctcgctt

SEQ ID NO: 33838 - DNA, 17 bp, H. sapiens
agacggagtctctcact

SEQ ID NO: 33839 - DNA, 19 bp, H. sapiens
agacggagtctggctctgt

SEQ ID NO: 33840 - DNA, 17 bp, H. sapiens
agacggagtcttggtct

SEQ ID NO: 33841 - DNA, 18 bp, H. sapiens
agacggagtttccctctt

SEQ ID NO: 33842 - DNA, 16 bp, H. sapiens
agacggagtttcgctt

SEQ ID NO: 33843 - DNA, 17 bp, H. sapiens
agacggagttttgttct

SEQ ID NO: 33844 - DNA, 16 bp, H. sapiens
agacgggcatggtggc

SEQ ID NO: 33845 - DNA, 17 bp, H. sapiens
agacggggtggcggctg

SEQ ID NO: 33846 - DNA, 20 bp, H. sapiens
agacggggtttcaccatgct

SEQ ID NO: 33847 - DNA, 17 bp, H. sapiens
agacgggtttcaccatg

SEQ ID NO: 33848 - DNA, 17 bp, H. sapiens
agactaaaccaggagga

SEQ ID NO: 33849 - DNA, 16 bp, H. sapiens
agactaaaggagaaaa

SEQ ID NO: 33850 - DNA, 16 bp, H. sapiens
agactaaatgatgaac

SEQ ID NO: 33851 - DNA, 16 bp, H. sapiens
agactaagaaaagaga

SEQ ID NO: 33852 - DNA, 16 bp, H. sapiens
agactaaggagacatg

SEQ ID NO: 33853 - DNA, 16 bp, H. sapiens
agactaatacagtaca

SEQ ID NO: 33854 - DNA, 16 bp, H. sapiens
agactacaaatcaaag

SEQ ID NO: 33855 - DNA, 16 bp, H. sapiens
agactacacttcccag

SEQ ID NO: 33856 - DNA, 16 bp, H. sapiens
agactacaggtgcacc

SEQ ID NO: 33857 - DNA, 16 bp, H. sapiens
agactacatttcccag

SEQ ID NO: 33858 - DNA, 16 bp, H. sapiens
agactagcctaggtaa

SEQ ID NO: 33859 - DNA, 16 bp, H. sapiens
agactagcctgaccaa

SEQ ID NO: 33860 - DNA, 16 bp, H. sapiens
agactagcctgagcaa

SEQ ID NO: 33861 - DNA, 16 bp, H. sapiens
agactagcctggacaa

SEQ ID NO: 33862 - DNA, 16 bp, H. sapiens
agactagcctggataa

SEQ ID NO: 33863 - DNA, 16 bp, H. sapiens
agactagcctggccaa

SEQ ID NO: 33864 - DNA, 16 bp, H. sapiens
agactagcctggccag

SEQ ID NO: 33865 - DNA, 16 bp, H. sapiens
agactagcctggctaa

SEQ ID NO: 33866 - DNA, 16 bp, H. sapiens
agactagcctgggaaa

SEQ ID NO: 33867 - DNA, 16 bp, H. sapiens
agactagcctgggcaa

SEQ ID NO: 33868 - DNA, 16 bp, H. sapiens
agactagcctggtcaa

SEQ ID NO: 33869 - DNA, 16 bp, H. sapiens
agactaggagaaaata

SEQ ID NO: 33870 - DNA, 16 bp, H. sapiens
agactaggcattgaag

SEQ ID NO: 33871 - DNA, 18 bp, H. sapiens
agactatcctggctaaca

SEQ ID NO: 33872 - DNA, 16 bp, H. sapiens
agactatgccactgca

SEQ ID NO: 33873 - DNA, 16 bp, H. sapiens
agactattctggctaa

SEQ ID NO: 33874 - DNA, 16 bp, H. sapiens
agactcaaataattaa

SEQ ID NO: 33875 - DNA, 16 bp, H. sapiens
agactcacctaacaca

SEQ ID NO: 33876 - DNA, 17 bp, H. sapiens
agactcactgggtggct

SEQ ID NO: 33877 - DNA, 16 bp, H. sapiens
agactcagaaagaaaa

SEQ ID NO: 33878 - DNA, 16 bp, H. sapiens
agactcagagagatta

SEQ ID NO: 33879 - DNA, 16 bp, H. sapiens
agactcagccagactc

SEQ ID NO: 33880 - DNA, 16 bp, H. sapiens
agactcagtcaaaaaa

SEQ ID NO: 33881 - DNA, 16 bp, H. sapiens
agactcagtctccaaa

SEQ ID NO: 33882 - DNA, 16 bp, H. sapiens
agactcatatcaaaac

SEQ ID NO: 33883 - DNA, 16 bp, H. sapiens
agactcatccagaaag

SEQ ID NO: 33884 - DNA, 16 bp, H. sapiens
agactcattcattcat

SEQ ID NO: 33885 - DNA, 16 bp, H. sapiens
agactccaaatcaaaa

SEQ ID NO: 33886 - DNA, 16 bp, H. sapiens
agactccacacagctc

SEQ ID NO: 33887 - DNA, 16 bp, H. sapiens
agactccacctcctgg

SEQ ID NO: 33888 - DNA, 16 bp, H. sapiens
agactccagcctgggc

SEQ ID NO: 33889 - DNA, 18 bp, H. sapiens
agactccatcccaaaaaa

SEQ ID NO: 33890 - DNA, 16 bp, H. sapiens
agactccatctaaaaa

SEQ ID NO: 33891 - DNA, 17 bp, H. sapiens
agactccatctcaaaaa

SEQ ID NO: 33892 - DNA, 16 bp, H. sapiens
agactccatctccccc

SEQ ID NO: 33893 - DNA, 16 bp, H. sapiens
agactccatctctaca

SEQ ID NO: 33894 - DNA, 16 bp, H. sapiens
agactccatttctaaa

SEQ ID NO: 33895 - DNA, 16 bp, H. sapiens
agactcccaagcagct

SEQ ID NO: 33896 - DNA, 16 bp, H. sapiens
agactcctgacctcag

SEQ ID NO: 33897 - DNA, 16 bp, H. sapiens
agactcctgggtctga

SEQ ID NO: 33898 - DNA, 16 bp, H. sapiens
agactcctgttgggac

SEQ ID NO: 33899 - DNA, 16 bp, H. sapiens
agactccttccttcca

SEQ ID NO: 33900 - DNA, 16 bp, H. sapiens
agactcggtctcaaaa

SEQ ID NO: 33901 - DNA, 16 bp, H. sapiens
agactctctgggacac

SEQ ID NO: 33902 - DNA, 16 bp, H. sapiens
agactctgaagccaga

SEQ ID NO: 33903 - DNA, 16 bp, H. sapiens
agactctgcaggtgga

SEQ ID NO: 33904 - DNA, 16 bp, H. sapiens
agactctgcctcccag

SEQ ID NO: 33905 - DNA, 16 bp, H. sapiens
agactctggctcaaaa

SEQ ID NO: 33906 - DNA, 16 bp, H. sapiens
agactctgtatcaaaa

SEQ ID NO: 33907 - DNA, 16 bp, H. sapiens
agactctgtcaaaaaa

SEQ ID NO: 33908 - DNA, 17 bp, H. sapiens
agactctgtcacacaca

SEQ ID NO: 33909 - DNA, 18 bp, H. sapiens
agactctgtctcaaaaat

SEQ ID NO: 33910 - DNA, 16 bp, H. sapiens
agactctgtgagattc

SEQ ID NO: 33911 - DNA, 16 bp, H. sapiens
agactgaaaaatcaaa

SEQ ID NO: 33912 - DNA, 16 bp, H. sapiens
agactgaaaaccataa

SEQ ID NO: 33913 - DNA, 16 bp, H. sapiens
agactgaaaagacaaa

SEQ ID NO: 33914 - DNA, 16 bp, H. sapiens
agactgaaagaaaata

SEQ ID NO: 33915 - DNA, 16 bp, H. sapiens
agactgaaagtgaaga

SEQ ID NO: 33916 - DNA, 16 bp, H. sapiens
agactgaaataattaa

SEQ ID NO: 33917 - DNA, 16 bp, H. sapiens
agactgaagactgcac

SEQ ID NO: 33918 - DNA, 16 bp, H. sapiens
agactgaagcaggtgg

SEQ ID NO: 33919 - DNA, 16 bp, H. sapiens
agactgaagtgcaatg

SEQ ID NO: 33920 - DNA, 16 bp, H. sapiens
agactgaagtgcagtg

SEQ ID NO: 33921 - DNA, 16 bp, H. sapiens
agactgaatgtttgtg

SEQ ID NO: 33922 - DNA, 16 bp, H. sapiens
agactgacaccccaca

SEQ ID NO: 33923 - DNA, 16 bp, H. sapiens
agactgagaaagagaa

SEQ ID NO: 33924 - DNA, 16 bp, H. sapiens
agactgagcagcagca

SEQ ID NO: 33925 - DNA, 16 bp, H. sapiens
agactgaggaggaaga

SEQ ID NO: 33926 - DNA, 16 bp, H. sapiens
agactgaggaggagga

SEQ ID NO: 33927 - DNA, 16 bp, H. sapiens
agactgaggagggtgg

SEQ ID NO: 33928 - DNA, 16 bp, H. sapiens
agactgaggcacagaa

SEQ ID NO: 33929 - DNA, 16 bp, H. sapiens
agactgaggcagcagg

SEQ ID NO: 33930 - DNA, 16 bp, H. sapiens
agactgaggcaggcgg

SEQ ID NO: 33931 - DNA, 16 bp, H. sapiens
agactgaggcccagag

SEQ ID NO: 33932 - DNA, 16 bp, H. sapiens
agactgagtaatttaa

SEQ ID NO: 33933 - DNA, 16 bp, H. sapiens
agactgagtaatttat

SEQ ID NO: 33934 - DNA, 17 bp, H. sapiens
agactgagtctcactct

SEQ ID NO: 33935 - DNA, 16 bp, H. sapiens
agactgagtcttactc

SEQ ID NO: 33936 - DNA, 16 bp, H. sapiens
agactgagtttcactc

SEQ ID NO: 33937 - DNA, 16 bp, H. sapiens
agactgcaggcacaca

SEQ ID NO: 33938 - DNA, 16 bp, H. sapiens
agactgcctctccaga

SEQ ID NO: 33939 - DNA, 16 bp, H. sapiens
agactgctacattgtg

SEQ ID NO: 33940 - DNA, 16 bp, H. sapiens
agactgcttctttaaa

SEQ ID NO: 33941 - DNA, 16 bp, H. sapiens
agactgctttgtgatg

SEQ ID NO: 33942 - DNA, 16 bp, H. sapiens
agactggaaaactgga

SEQ ID NO: 33943 - DNA, 16 bp, H. sapiens
agactggaaaagaaga

SEQ ID NO: 33944 - DNA, 16 bp, H. sapiens
agactggaacagtttg

SEQ ID NO: 33945 - DNA, 16 bp, H. sapiens
agactggaagaaaaca

SEQ ID NO: 33946 - DNA, 16 bp, H. sapiens
agactggaataaatat

SEQ ID NO: 33947 - DNA, 16 bp, H. sapiens
agactggaccaagcag

SEQ ID NO: 33948 - DNA, 16 bp, H. sapiens
agactggactgcagtg

SEQ ID NO: 33949 - DNA, 16 bp, H. sapiens
agactggagaaagaaa

SEQ ID NO: 33950 - DNA, 16 bp, H. sapiens
agactggagagcagtg

SEQ ID NO: 33951 - DNA, 16 bp, H. sapiens
agactggaggcaggga

SEQ ID NO: 33952 - DNA, 16 bp, H. sapiens
agactggataaagaaa

SEQ ID NO: 33953 - DNA, 16 bp, H. sapiens
agactggatagagaaa

SEQ ID NO: 33954 - DNA, 57 bp, H. sapiens
agactggattaagaaaatgtggcacatatacaccatggaatactatgcagccataaa

SEQ ID NO: 33955 - DNA, 16 bp, H. sapiens
agactggcagattgga

SEQ ID NO: 33956 - DNA, 16 bp, H. sapiens
agactggcctgggaaa

SEQ ID NO: 33957 - DNA, 16 bp, H. sapiens
agactggcctgggcaa

SEQ ID NO: 33958 - DNA, 16 bp, H. sapiens
agactggcgtgcagtg

SEQ ID NO: 33959 - DNA, 16 bp, H. sapiens
agactgggaaatccaa

SEQ ID NO: 33960 - DNA, 16 bp, H. sapiens
agactgggaagttcaa

SEQ ID NO: 33961 - DNA, 16 bp, H. sapiens
agactgggcaacatag

SEQ ID NO: 33962 - DNA, 18 bp, H. sapiens
agactgggcacagtggct

SEQ ID NO: 33963 - DNA, 16 bp, H. sapiens
agactgggctcctctc

SEQ ID NO: 33964 - DNA, 16 bp, H. sapiens
agactggggcccagcc

SEQ ID NO: 33965 - DNA, 16 bp, H. sapiens
agactggggtcttgct

SEQ ID NO: 33966 - DNA, 16 bp, H. sapiens
agactgggttatttat

SEQ ID NO: 33967 - DNA, 16 bp, H. sapiens
agactgggtttcacca

SEQ ID NO: 33968 - DNA, 16 bp, H. sapiens
agactggttaaagaaa

SEQ ID NO: 33969 - DNA, 16 bp, H. sapiens
agactggttagacagt

SEQ ID NO: 33970 - DNA, 16 bp, H. sapiens
agactgtaaaccaaca

SEQ ID NO: 33971 - DNA, 16 bp, H. sapiens
agactgtactgggaaa

SEQ ID NO: 33972 - DNA, 16 bp, H. sapiens
agactgtctcaaaaac

SEQ ID NO: 33973 - DNA, 17 bp, H. sapiens
agactgtctcctcaagt

SEQ ID NO: 33974 - DNA, 16 bp, H. sapiens
agactgtcttccaaag

SEQ ID NO: 33975 - DNA, 16 bp, H. sapiens
agactgtgaaattatt

SEQ ID NO: 33976 - DNA, 16 bp, H. sapiens
agactgtgaagatttt

SEQ ID NO: 33977 - DNA, 16 bp, H. sapiens
agactgtggagaaata

SEQ ID NO: 33978 - DNA, 16 bp, H. sapiens
agactgtgggaaaagc

SEQ ID NO: 33979 - DNA, 16 bp, H. sapiens
agactgtgggaaccca

SEQ ID NO: 33980 - DNA, 16 bp, H. sapiens
agactgtggtgagcca

SEQ ID NO: 33981 - DNA, 16 bp, H. sapiens
agactgtgtctcaaaa

SEQ ID NO: 33982 - DNA, 16 bp, H. sapiens
agactgttttccaaag

SEQ ID NO: 33983 - DNA, 16 bp, H. sapiens
agacttaaaaacagaa

SEQ ID NO: 33984 - DNA, 16 bp, H. sapiens
agacttaaaaaggaag

SEQ ID NO: 33985 - DNA, 16 bp, H. sapiens
agacttaaatataaaa

SEQ ID NO: 33986 - DNA, 16 bp, H. sapiens
agacttaattgtaaaa

SEQ ID NO: 33987 - DNA, 16 bp, H. sapiens
agacttaatttttaaa

SEQ ID NO: 33988 - DNA, 16 bp, H. sapiens
agacttcaacattcca

SEQ ID NO: 33989 - DNA, 16 bp, H. sapiens
agacttcagaacaagg

SEQ ID NO: 33990 - DNA, 16 bp, H. sapiens
agacttcaggaaactt

SEQ ID NO: 33991 - DNA, 16 bp, H. sapiens
agacttcaggggaaga

SEQ ID NO: 33992 - DNA, 16 bp, H. sapiens
agacttcagtgagctg

SEQ ID NO: 33993 - DNA, 16 bp, H. sapiens
agacttcagtggagga

SEQ ID NO: 33994 - DNA, 16 bp, H. sapiens
agacttcatactggag

SEQ ID NO: 33995 - DNA, 16 bp, H. sapiens
agacttcatctcaaaa

SEQ ID NO: 33996 - DNA, 16 bp, H. sapiens
agacttcattaaaatt

SEQ ID NO: 33997 - DNA, 16 bp, H. sapiens
agacttccagcctcca

SEQ ID NO: 33998 - DNA, 18 bp, H. sapiens
agacttccagcctccaaa

SEQ ID NO: 33999 - DNA, 16 bp, H. sapiens
agacttcccagactcc

SEQ ID NO: 34000 - DNA, 16 bp, H. sapiens
agacttcccagcttcc

SEQ ID NO: 34001 - DNA, 16 bp, H. sapiens
agacttcctctcaaaa

SEQ ID NO: 34002 - DNA, 16 bp, H. sapiens
agacttcctgaatcag

SEQ ID NO: 34003 - DNA, 16 bp, H. sapiens
agacttcctggaggag

SEQ ID NO: 34004 - DNA, 16 bp, H. sapiens
agacttctaaggtttt

SEQ ID NO: 34005 - DNA, 16 bp, H. sapiens
agacttctctcaaaaa

SEQ ID NO: 34006 - DNA, 16 bp, H. sapiens
agacttctgacctcca

SEQ ID NO: 34007 - DNA, 16 bp, H. sapiens
agacttctgcctgaac

SEQ ID NO: 34008 - DNA, 16 bp, H. sapiens
agacttctttgtgatg

SEQ ID NO: 34009 - DNA, 16 bp, H. sapiens
agacttgaaagtaaaa

SEQ ID NO: 34010 - DNA, 16 bp, H. sapiens
agacttgaaagtcaaa

SEQ ID NO: 34011 - DNA, 16 bp, H. sapiens
agacttgaagccagca

SEQ ID NO: 34012 - DNA, 16 bp, H. sapiens
agacttgagccaccac

SEQ ID NO: 34013 - DNA, 16 bp, H. sapiens
agacttggacccaacc

SEQ ID NO: 34014 - DNA, 16 bp, H. sapiens
agacttggatttgaat

SEQ ID NO: 34015 - DNA, 16 bp, H. sapiens
agacttggcagcttcc

SEQ ID NO: 34016 - DNA, 16 bp, H. sapiens
agacttggtaatttat

SEQ ID NO: 34017 - DNA, 16 bp, H. sapiens
agacttggtctcaaaa

SEQ ID NO: 34018 - DNA, 16 bp, H. sapiens
agacttgtctcagata

SEQ ID NO: 34019 - DNA, 16 bp, H. sapiens
agacttgtttgtgtgg

SEQ ID NO: 34020 - DNA, 16 bp, H. sapiens
agactttaaaagaaaa

SEQ ID NO: 34021 - DNA, 16 bp, H. sapiens
agactttaaatcagct

SEQ ID NO: 34022 - DNA, 16 bp, H. sapiens
agactttaattttttt

SEQ ID NO: 34023 - DNA, 16 bp, H. sapiens
agactttactgaagtt

SEQ ID NO: 34024 - DNA, 16 bp, H. sapiens
agactttattcagatt

SEQ ID NO: 34025 - DNA, 16 bp, H. sapiens
agactttatttttaaa

SEQ ID NO: 34026 - DNA, 16 bp, H. sapiens
agactttattttttct

SEQ ID NO: 34027 - DNA, 16 bp, H. sapiens
agactttgaagaaaaa

SEQ ID NO: 34028 - DNA, 16 bp, H. sapiens
agactttgctgataaa

SEQ ID NO: 34029 - DNA, 16 bp, H. sapiens
agactttgctggagtt

SEQ ID NO: 34030 - DNA, 16 bp, H. sapiens
agactttggagtcaga

SEQ ID NO: 34031 - DNA, 16 bp, H. sapiens
agactttgtctcaaaa

SEQ ID NO: 34032 - DNA, 16 bp, H. sapiens
agactttgtctttaaa

SEQ ID NO: 34033 - DNA, 16 bp, H. sapiens
agacttttaatgatgg

SEQ ID NO: 34034 - DNA, 16 bp, H. sapiens
agacttttcagcagaa

SEQ ID NO: 34035 - DNA, 16 bp, H. sapiens
agacttttcagtggaa

SEQ ID NO: 34036 - DNA, 16 bp, H. sapiens
agacttttctcctcag

SEQ ID NO: 34037 - DNA, 16 bp, H. sapiens
agacttttggggactg

SEQ ID NO: 34038 - DNA, 16 bp, H. sapiens
agactttttatttatt

SEQ ID NO: 34039 - DNA, 16 bp, H. sapiens
agactttttccaaact

SEQ ID NO: 34040 - DNA, 16 bp, H. sapiens
agagaaaaaaactgag

SEQ ID NO: 34041 - DNA, 16 bp, H. sapiens
agagaaaaaatagact

SEQ ID NO: 34042 - DNA, 16 bp, H. sapiens
agagaaaaaatggcag

SEQ ID NO: 34043 - DNA, 16 bp, H. sapiens
agagaaaaacaaagtt

SEQ ID NO: 34044 - DNA, 16 bp, H. sapiens
agagaaaaacatttaa

SEQ ID NO: 34045 - DNA, 16 bp, H. sapiens
agagaaaaacatttgc

SEQ ID NO: 34046 - DNA, 16 bp, H. sapiens
agagaaaaactggaaa

SEQ ID NO: 34047 - DNA, 16 bp, H. sapiens
agagaaaaagaaagct

SEQ ID NO: 34048 - DNA, 16 bp, H. sapiens
agagaaaaagcaaatg

SEQ ID NO: 34049 - DNA, 16 bp, H. sapiens
agagaaaaaggacatt

SEQ ID NO: 34050 - DNA, 16 bp, H. sapiens
agagaaaaatatgcaa

SEQ ID NO: 34051 - DNA, 16 bp, H. sapiens
agagaaaaatctgaaa

SEQ ID NO: 34052 - DNA, 16 bp, H. sapiens
agagaaaaatcttgaa

SEQ ID NO: 34053 - DNA, 16 bp, H. sapiens
agagaaaaatgaacag

SEQ ID NO: 34054 - DNA, 16 bp, H. sapiens
agagaaaaatgaacat

SEQ ID NO: 34055 - DNA, 16 bp, H. sapiens
agagaaaaatggtttt

SEQ ID NO: 34056 - DNA, 16 bp, H. sapiens
agagaaaacaaacttt

SEQ ID NO: 34057 - DNA, 16 bp, H. sapiens
agagaaaacaaatgat

SEQ ID NO: 34058 - DNA, 16 bp, H. sapiens
agagaaaacactgaaa

SEQ ID NO: 34059 - DNA, 16 bp, H. sapiens
agagaaaacagaagat

SEQ ID NO: 34060 - DNA, 16 bp, H. sapiens
agagaaaaccaaattt

SEQ ID NO: 34061 - DNA, 16 bp, H. sapiens
agagaaaaccttaaaa

SEQ ID NO: 34062 - DNA, 16 bp, H. sapiens
agagaaaagagaaatc

SEQ ID NO: 34063 - DNA, 16 bp, H. sapiens
agagaaaagatttttt

SEQ ID NO: 34064 - DNA, 16 bp, H. sapiens
agagaaaagtcagaaa

SEQ ID NO: 34065 - DNA, 16 bp, H. sapiens
agagaaaatattcaaa

SEQ ID NO: 34066 - DNA, 16 bp, H. sapiens
agagaaaatattgcaa

SEQ ID NO: 34067 - DNA, 16 bp, H. sapiens
agagaaaatcagtgaa

SEQ ID NO: 34068 - DNA, 16 bp, H. sapiens
agagaaaatctgcatt

SEQ ID NO: 34069 - DNA, 16 bp, H. sapiens
agagaaaatgactttt

SEQ ID NO: 34070 - DNA, 16 bp, H. sapiens
agagaaaatgttaaag

SEQ ID NO: 34071 - DNA, 16 bp, H. sapiens
agagaaaattattttt

SEQ ID NO: 34072 - DNA, 16 bp, H. sapiens
agagaaaattcaaata

SEQ ID NO: 34073 - DNA, 16 bp, H. sapiens
agagaaaattttaaga

SEQ ID NO: 34074 - DNA, 16 bp, H. sapiens
agagaaacaaaaatgt

SEQ ID NO: 34075 - DNA, 16 bp, H. sapiens
agagaaacacaaatta

SEQ ID NO: 34076 - DNA, 16 bp, H. sapiens
agagaaacacacagag

SEQ ID NO: 34077 - DNA, 16 bp, H. sapiens
agagaaacagaactgg

SEQ ID NO: 34078 - DNA, 16 bp, H. sapiens
agagaaacagaatgaa

SEQ ID NO: 34079 - DNA, 16 bp, H. sapiens
agagaaacagacccaa

SEQ ID NO: 34080 - DNA, 16 bp, H. sapiens
agagaaacatttattt

SEQ ID NO: 34081 - DNA, 16 bp, H. sapiens
agagaaaccccgtctc

SEQ ID NO: 34082 - DNA, 16 bp, H. sapiens
agagaaacctgaaaaa

SEQ ID NO: 34083 - DNA, 16 bp, H. sapiens
agagaaactgaggaaa

SEQ ID NO: 34084 - DNA, 16 bp, H. sapiens
agagaaactgaggaag

SEQ ID NO: 34085 - DNA, 16 bp, H. sapiens
agagaaactgaggcac

SEQ ID NO: 34086 - DNA, 18 bp, H. sapiens
agagaaactggaggcttt

SEQ ID NO: 34087 - DNA, 16 bp, H. sapiens
agagaaacttccagtc

SEQ ID NO: 34088 - DNA, 16 bp, H. sapiens
agagaaacttctttgt

SEQ ID NO: 34089 - DNA, 16 bp, H. sapiens
agagaaagaaactgag

SEQ ID NO: 34090 - DNA, 16 bp, H. sapiens
agagaaagaaggccat

SEQ ID NO: 34091 - DNA, 16 bp, H. sapiens
agagaaagacagctta

SEQ ID NO: 34092 - DNA, 16 bp, H. sapiens
agagaaagagaaagct

SEQ ID NO: 34093 - DNA, 16 bp, H. sapiens
agagaaagagaagact

SEQ ID NO: 34094 - DNA, 16 bp, H. sapiens
agagaaagagactaga

SEQ ID NO: 34095 - DNA, 16 bp, H. sapiens
agagaaagagactctg

SEQ ID NO: 34096 - DNA, 16 bp, H. sapiens
agagaaagagactgaa

SEQ ID NO: 34097 - DNA, 16 bp, H. sapiens
agagaaagagatacag

SEQ ID NO: 34098 - DNA, 16 bp, H. sapiens
agagaaagagatcaaa

SEQ ID NO: 34099 - DNA, 16 bp, H. sapiens
agagaaagagatttta

SEQ ID NO: 34100 - DNA, 16 bp, H. sapiens
agagaaagagctggag

SEQ ID NO: 34101 - DNA, 16 bp, H. sapiens
agagaaagaggctggg

SEQ ID NO: 34102 - DNA, 16 bp, H. sapiens
agagaaagatatcaat

SEQ ID NO: 34103 - DNA, 16 bp, H. sapiens
agagaaagcatttaaa

SEQ ID NO: 34104 - DNA, 16 bp, H. sapiens
agagaaagccaaattt

SEQ ID NO: 34105 - DNA, 16 bp, H. sapiens
agagaaagccacaaag

SEQ ID NO: 34106 - DNA, 16 bp, H. sapiens
agagaaagcctggctg

SEQ ID NO: 34107 - DNA, 16 bp, H. sapiens
agagaaagctgaaaac

SEQ ID NO: 34108 - DNA, 16 bp, H. sapiens
agagaaaggactcaaa

SEQ ID NO: 34109 - DNA, 16 bp, H. sapiens
agagaaaggattccct

SEQ ID NO: 34110 - DNA, 16 bp, H. sapiens
agagaaaggggaaccc

SEQ ID NO: 34111 - DNA, 16 bp, H. sapiens
agagaaaggtcggctt

SEQ ID NO: 34112 - DNA, 16 bp, H. sapiens
agagaaagtagattag

SEQ ID NO: 34113 - DNA, 16 bp, H. sapiens
agagaaagtattttta

SEQ ID NO: 34114 - DNA, 16 bp, H. sapiens
agagaaagtggtttct

SEQ ID NO: 34115 - DNA, 16 bp, H. sapiens
agagaaagttgaaaac

SEQ ID NO: 34116 - DNA, 16 bp, H. sapiens
agagaaataaaagcat

SEQ ID NO: 34117 - DNA, 16 bp, H. sapiens
agagaaataaaatcct

SEQ ID NO: 34118 - DNA, 16 bp, H. sapiens
agagaaatacaaatga

SEQ ID NO: 34119 - DNA, 16 bp, H. sapiens
agagaaatagacaaat

SEQ ID NO: 34120 - DNA, 16 bp, H. sapiens
agagaaatataatttt

SEQ ID NO: 34121 - DNA, 16 bp, H. sapiens
agagaaatcaaagaag

SEQ ID NO: 34122 - DNA, 16 bp, H. sapiens
agagaaatccaaatca

SEQ ID NO: 34123 - DNA, 16 bp, H. sapiens
agagaaatctgaaaaa

SEQ ID NO: 34124 - DNA, 16 bp, H. sapiens
agagaaatctgaaaac

SEQ ID NO: 34125 - DNA, 16 bp, H. sapiens
agagaaatctgacata

SEQ ID NO: 34126 - DNA, 16 bp, H. sapiens
agagaaatctttaaaa

SEQ ID NO: 34127 - DNA, 16 bp, H. sapiens
agagaaatgaaaacct

SEQ ID NO: 34128 - DNA, 16 bp, H. sapiens
agagaaatgaaaactt

SEQ ID NO: 34129 - DNA, 16 bp, H. sapiens
agagaaatgaaaattt

SEQ ID NO: 34130 - DNA, 16 bp, H. sapiens
agagaaatgaaatcat

SEQ ID NO: 34131 - DNA, 16 bp, H. sapiens
agagaaatgaagactt

SEQ ID NO: 34132 - DNA, 16 bp, H. sapiens
agagaaatgcaaagaa

SEQ ID NO: 34133 - DNA, 16 bp, H. sapiens
agagaaatggaaactt

SEQ ID NO: 34134 - DNA, 16 bp, H. sapiens
agagaaatggaaatca

SEQ ID NO: 34135 - DNA, 16 bp, H. sapiens
agagaaatggagagat

SEQ ID NO: 34136 - DNA, 16 bp, H. sapiens
agagaaatgttttatt

SEQ ID NO: 34137 - DNA, 16 bp, H. sapiens
agagaaattaaaacag

SEQ ID NO: 34138 - DNA, 16 bp, H. sapiens
agagaaattaactttt

SEQ ID NO: 34139 - DNA, 16 bp, H. sapiens
agagaaattcaaatca

SEQ ID NO: 34140 - DNA, 16 bp, H. sapiens
agagaaattctacaaa

SEQ ID NO: 34141 - DNA, 16 bp, H. sapiens
agagaaattggaaaat

SEQ ID NO: 34142 - DNA, 16 bp, H. sapiens
agagaaatttagaaat

SEQ ID NO: 34143 - DNA, 16 bp, H. sapiens
agagaaatttagaatt

SEQ ID NO: 34144 - DNA, 16 bp, H. sapiens
agagaaatttagagaa

SEQ ID NO: 34145 - DNA, 16 bp, H. sapiens
agagaaatttcagaaa

SEQ ID NO: 34146 - DNA, 16 bp, H. sapiens
agagaaatttcatttt

SEQ ID NO: 34147 - DNA, 16 bp, H. sapiens
agagaacaacttcatc

SEQ ID NO: 34148 - DNA, 16 bp, H. sapiens
agagaacaatcaaata

SEQ ID NO: 34149 - DNA, 16 bp, H. sapiens
agagaacacagaaata

SEQ ID NO: 34150 - DNA, 16 bp, H. sapiens
agagaacacagataga

SEQ ID NO: 34151 - DNA, 16 bp, H. sapiens
agagaacagcctgggc

SEQ ID NO: 34152 - DNA, 16 bp, H. sapiens
agagaacccagaaaga

SEQ ID NO: 34153 - DNA, 16 bp, H. sapiens
agagaacccagaaata

SEQ ID NO: 34154 - DNA, 16 bp, H. sapiens
agagaacccagcaata

SEQ ID NO: 34155 - DNA, 16 bp, H. sapiens
agagaaccctaacaca

SEQ ID NO: 34156 - DNA, 16 bp, H. sapiens
agagaactaaaattag

SEQ ID NO: 34157 - DNA, 16 bp, H. sapiens
agagaactataaaaca

SEQ ID NO: 34158 - DNA, 16 bp, H. sapiens
agagaacttaggaact

SEQ ID NO: 34159 - DNA, 16 bp, H. sapiens
agagaagaaaatgaca

SEQ ID NO: 34160 - DNA, 16 bp, H. sapiens
agagaagaaaatttta

SEQ ID NO: 34161 - DNA, 16 bp, H. sapiens
agagaagaaagcttca

SEQ ID NO: 34162 - DNA, 16 bp, H. sapiens
agagaagaaagtattt

SEQ ID NO: 34163 - DNA, 16 bp, H. sapiens
agagaagaaataacca

SEQ ID NO: 34164 - DNA, 16 bp, H. sapiens
agagaagaaatcagaa

SEQ ID NO: 34165 - DNA, 16 bp, H. sapiens
agagaagaacaaagtt

SEQ ID NO: 34166 - DNA, 16 bp, H. sapiens
agagaagaaggcagac

SEQ ID NO: 34167 - DNA, 16 bp, H. sapiens
agagaagaattttaca

SEQ ID NO: 34168 - DNA, 16 bp, H. sapiens
agagaagaattttatt

SEQ ID NO: 34169 - DNA, 16 bp, H. sapiens
agagaagacaggtgag

SEQ ID NO: 34170 - DNA, 18 bp, H. sapiens
agagaagaccttaaatga

SEQ ID NO: 34171 - DNA, 16 bp, H. sapiens
agagaagaggcaggtc

SEQ ID NO: 34172 - DNA, 16 bp, H. sapiens
agagaagagggcagca

SEQ ID NO: 34173 - DNA, 16 bp, H. sapiens
agagaagagtcaagga

SEQ ID NO: 34174 - DNA, 16 bp, H. sapiens
agagaagatactttgt

SEQ ID NO: 34175 - DNA, 16 bp, H. sapiens
agagaagatctaaata

SEQ ID NO: 34176 - DNA, 16 bp, H. sapiens
agagaagatcttaaat

SEQ ID NO: 34177 - DNA, 16 bp, H. sapiens
agagaagcaaaggcac

SEQ ID NO: 34178 - DNA, 16 bp, H. sapiens
agagaagcaactcatc

SEQ ID NO: 34179 - DNA, 16 bp, H. sapiens
agagaagcagaaccag

SEQ ID NO: 34180 - DNA, 16 bp, H. sapiens
agagaagcagagacag

SEQ ID NO: 34181 - DNA, 16 bp, H. sapiens
agagaagcagcagcag

SEQ ID NO: 34182 - DNA, 16 bp, H. sapiens
agagaagccagaggaa

SEQ ID NO: 34183 - DNA, 16 bp, H. sapiens
agagaagcctgggcaa

SEQ ID NO: 34184 - DNA, 16 bp, H. sapiens
agagaagctgaaggag

SEQ ID NO: 34185 - DNA, 16 bp, H. sapiens
agagaaggaaaacaat

SEQ ID NO: 34186 - DNA, 16 bp, H. sapiens
agagaaggaaacactt

SEQ ID NO: 34187 - DNA, 16 bp, H. sapiens
agagaaggaaactgaa

SEQ ID NO: 34188 - DNA, 16 bp, H. sapiens
agagaaggaaataaca

SEQ ID NO: 34189 - DNA, 16 bp, H. sapiens
agagaaggaaatgtga

SEQ ID NO: 34190 - DNA, 16 bp, H. sapiens
agagaaggaagaagtt

SEQ ID NO: 34191 - DNA, 16 bp, H. sapiens
agagaaggagcatctg

SEQ ID NO: 34192 - DNA, 16 bp, H. sapiens
agagaaggaggcttca

SEQ ID NO: 34193 - DNA, 16 bp, H. sapiens
agagaaggagtttcac

SEQ ID NO: 34194 - DNA, 16 bp, H. sapiens
agagaaggcttcctgg

SEQ ID NO: 34195 - DNA, 16 bp, H. sapiens
agagaagggaagttta

SEQ ID NO: 34196 - DNA, 16 bp, H. sapiens
agagaagggcagggtc

SEQ ID NO: 34197 - DNA, 16 bp, H. sapiens
agagaagtcagagaag

SEQ ID NO: 34198 - DNA, 16 bp, H. sapiens
agagaagtcagagaga

SEQ ID NO: 34199 - DNA, 16 bp, H. sapiens
agagaagtgtgtgtgt

SEQ ID NO: 34200 - DNA, 16 bp, H. sapiens
agagaagttaacagat

SEQ ID NO: 34201 - DNA, 16 bp, H. sapiens
agagaagtttacagaa

SEQ ID NO: 34202 - DNA, 16 bp, H. sapiens
agagaagtttctgaga

SEQ ID NO: 34203 - DNA, 16 bp, H. sapiens
agagaagttttaagtt

SEQ ID NO: 34204 - DNA, 16 bp, H. sapiens
agagaataaatgtgtg

SEQ ID NO: 34205 - DNA, 16 bp, H. sapiens
agagaatactataaaa

SEQ ID NO: 34206 - DNA, 16 bp, H. sapiens
agagaatatttccaaa

SEQ ID NO: 34207 - DNA, 16 bp, H. sapiens
agagaatatttgcaaa

SEQ ID NO: 34208 - DNA, 16 bp, H. sapiens
agagaatcaagaaata

SEQ ID NO: 34209 - DNA, 16 bp, H. sapiens
agagaatcaatgaaaa

SEQ ID NO: 34210 - DNA, 16 bp, H. sapiens
agagaatcatttgaac

SEQ ID NO: 34211 - DNA, 16 bp, H. sapiens
agagaatctagaaata

SEQ ID NO: 34212 - DNA, 16 bp, H. sapiens
agagaatctccttccc

SEQ ID NO: 34213 - DNA, 16 bp, H. sapiens
agagaatctttgtcag

SEQ ID NO: 34214 - DNA, 16 bp, H. sapiens
agagaatgaagcagaa

SEQ ID NO: 34215 - DNA, 16 bp, H. sapiens
agagaatgagaagaca

SEQ ID NO: 34216 - DNA, 16 bp, H. sapiens
agagaatgagacagag

SEQ ID NO: 34217 - DNA, 16 bp, H. sapiens
agagaatgagagtgaa

SEQ ID NO: 34218 - DNA, 16 bp, H. sapiens
agagaatgaggaagac

SEQ ID NO: 34219 - DNA, 16 bp, H. sapiens
agagaatgaggaagat

SEQ ID NO: 34220 - DNA, 16 bp, H. sapiens
agagaatggagaatta

SEQ ID NO: 34221 - DNA, 16 bp, H. sapiens
agagaatgggacattt

SEQ ID NO: 34222 - DNA, 16 bp, H. sapiens
agagaatgtgtgtgtg

SEQ ID NO: 34223 - DNA, 16 bp, H. sapiens
agagaattatttttaa

SEQ ID NO: 34224 - DNA, 16 bp, H. sapiens
agagaattcatactgg

SEQ ID NO: 34225 - DNA, 16 bp, H. sapiens
agagaattctgaaaaa

SEQ ID NO: 34226 - DNA, 16 bp, H. sapiens
agagaattcttccaaa

SEQ ID NO: 34227 - DNA, 16 bp, H. sapiens
agagaattgaaaatat

SEQ ID NO: 34228 - DNA, 16 bp, H. sapiens
agagaattgaagagag

SEQ ID NO: 34229 - DNA, 18 bp, H. sapiens
agagaattgcttgaacct

SEQ ID NO: 34230 - DNA, 16 bp, H. sapiens
agagaattttagacaa

SEQ ID NO: 34231 - DNA, 17 bp, H. sapiens
agagaattttagatcaa

SEQ ID NO: 34232 - DNA, 16 bp, H. sapiens
agagaattttgaaaat

SEQ ID NO: 34233 - DNA, 16 bp, H. sapiens
agagacaaagaagatc

SEQ ID NO: 34234 - DNA, 16 bp, H. sapiens
agagacaaagacacag

SEQ ID NO: 34235 - DNA, 16 bp, H. sapiens
agagacaaagcagcaa

SEQ ID NO: 34236 - DNA, 16 bp, H. sapiens
agagacaaaggccatt

SEQ ID NO: 34237 - DNA, 16 bp, H. sapiens
agagacaaagtctcac

SEQ ID NO: 34238 - DNA, 16 bp, H. sapiens
agagacaaagtctccc

SEQ ID NO: 34239 - DNA, 16 bp, H. sapiens
agagacaaatcaagaa

SEQ ID NO: 34240 - DNA, 16 bp, H. sapiens
agagacaaggaaagta

SEQ ID NO: 34241 - DNA, 16 bp, H. sapiens
agagacaagggttcac

SEQ ID NO: 34242 - DNA, 16 bp, H. sapiens
agagacaaggtttctc

SEQ ID NO: 34243 - DNA, 16 bp, H. sapiens
agagacacacacacag

SEQ ID NO: 34244 - DNA, 25 bp, H. sapiens
agagacacacatagctggtcaaaca

SEQ ID NO: 34245 - DNA, 16 bp, H. sapiens
agagacacagagacag

SEQ ID NO: 34246 - DNA, 16 bp, H. sapiens
agagacaccagagaac

SEQ ID NO: 34247 - DNA, 16 bp, H. sapiens
agagacactagcagtc

SEQ ID NO: 34248 - DNA, 16 bp, H. sapiens
agagacagaaaacata

SEQ ID NO: 34249 - DNA, 16 bp, H. sapiens
agagacagaaaatgga

SEQ ID NO: 34250 - DNA, 16 bp, H. sapiens
agagacagaaagtaaa

SEQ ID NO: 34251 - DNA, 16 bp, H. sapiens
agagacagaaagtaga

SEQ ID NO: 34252 - DNA, 16 bp, H. sapiens
agagacagaaagttga

SEQ ID NO: 34253 - DNA, 16 bp, H. sapiens
agagacagaatctcac

SEQ ID NO: 34254 - DNA, 16 bp, H. sapiens
agagacagaatcttgc

SEQ ID NO: 34255 - DNA, 16 bp, H. sapiens
agagacagaatgtaga

SEQ ID NO: 34256 - DNA, 16 bp, H. sapiens
agagacagacacacag

SEQ ID NO: 34257 - DNA, 16 bp, H. sapiens
agagacagacccaccc

SEQ ID NO: 34258 - DNA, 16 bp, H. sapiens
agagacagactgcctc

SEQ ID NO: 34259 - DNA, 16 bp, H. sapiens
agagacagagaaatca

SEQ ID NO: 34260 - DNA, 16 bp, H. sapiens
agagacagagacagag

SEQ ID NO: 34261 - DNA, 16 bp, H. sapiens
agagacagagacagca

SEQ ID NO: 34262 - DNA, 16 bp, H. sapiens
agagacagagactgag

SEQ ID NO: 34263 - DNA, 16 bp, H. sapiens
agagacagagagacag

SEQ ID NO: 34264 - DNA, 16 bp, H. sapiens
agagacagagagcaag

SEQ ID NO: 34265 - DNA, 16 bp, H. sapiens
agagacagagaggcag

SEQ ID NO: 34266 - DNA, 16 bp, H. sapiens
agagacagagaggctg

SEQ ID NO: 34267 - DNA, 16 bp, H. sapiens
agagacagagagtgaa

SEQ ID NO: 34268 - DNA, 16 bp, H. sapiens
agagacagagccagga

SEQ ID NO: 34269 - DNA, 16 bp, H. sapiens
agagacagagtctcac

SEQ ID NO: 34270 - DNA, 16 bp, H. sapiens
agagacagagttttgc

SEQ ID NO: 34271 - DNA, 16 bp, H. sapiens
agagacagcatctcac

SEQ ID NO: 34272 - DNA, 16 bp, H. sapiens
agagacagcgtttctc

SEQ ID NO: 34273 - DNA, 16 bp, H. sapiens
agagacaggaaggcag

SEQ ID NO: 34274 - DNA, 16 bp, H. sapiens
agagacaggaagtgga

SEQ ID NO: 34275 - DNA, 16 bp, H. sapiens
agagacaggagaatca

SEQ ID NO: 34276 - DNA, 16 bp, H. sapiens
agagacaggaggcaga

SEQ ID NO: 34277 - DNA, 16 bp, H. sapiens
agagacaggaggcagc

SEQ ID NO: 34278 - DNA, 16 bp, H. sapiens
agagacaggatttcat

SEQ ID NO: 34279 - DNA, 16 bp, H. sapiens
agagacaggcaggagt

SEQ ID NO: 34280 - DNA, 16 bp, H. sapiens
agagacaggctcttgc

SEQ ID NO: 34281 - DNA, 16 bp, H. sapiens
agagacagggacacag

SEQ ID NO: 34282 - DNA, 16 bp, H. sapiens
agagacagggctttgc

SEQ ID NO: 34283 - DNA, 16 bp, H. sapiens
agagacagggtcttct

SEQ ID NO: 34284 - DNA, 16 bp, H. sapiens
agagacaggttttcat

SEQ ID NO: 34285 - DNA, 16 bp, H. sapiens
agagacagtgagaaag

SEQ ID NO: 34286 - DNA, 16 bp, H. sapiens
agagacagtgtttctc

SEQ ID NO: 34287 - DNA, 16 bp, H. sapiens
agagacatggagaagg

SEQ ID NO: 34288 - DNA, 16 bp, H. sapiens
agagacatggtcttgc

SEQ ID NO: 34289 - DNA, 16 bp, H. sapiens
agagacatttcataat

SEQ ID NO: 34290 - DNA, 16 bp, H. sapiens
agagacatttttaaaa

SEQ ID NO: 34291 - DNA, 16 bp, H. sapiens
agagaccaagaaccca

SEQ ID NO: 34292 - DNA, 16 bp, H. sapiens
agagaccaagaaggcc

SEQ ID NO: 34293 - DNA, 16 bp, H. sapiens
agagaccaccaaacag

SEQ ID NO: 34294 - DNA, 16 bp, H. sapiens
agagaccaccctggcc

SEQ ID NO: 34295 - DNA, 16 bp, H. sapiens
agagaccagagagaga

SEQ ID NO: 34296 - DNA, 16 bp, H. sapiens
agagaccagcctgacc

SEQ ID NO: 34297 - DNA, 16 bp, H. sapiens
agagaccagcctggct

SEQ ID NO: 34298 - DNA, 16 bp, H. sapiens
agagaccagcttggcc

SEQ ID NO: 34299 - DNA, 16 bp, H. sapiens
agagaccatcctttcc

SEQ ID NO: 34300 - DNA, 16 bp, H. sapiens
agagacccacccccag

SEQ ID NO: 34301 - DNA, 16 bp, H. sapiens
agagacccagagagag

SEQ ID NO: 34302 - DNA, 16 bp, H. sapiens
agagacccaggcctgg

SEQ ID NO: 34303 - DNA, 16 bp, H. sapiens
agagacccaggctcct

SEQ ID NO: 34304 - DNA, 16 bp, H. sapiens
agagacccatttcaca

SEQ ID NO: 34305 - DNA, 16 bp, H. sapiens
agagaccccatctcta

SEQ ID NO: 34306 - DNA, 17 bp, H. sapiens
agagaccctgtctcaaa

SEQ ID NO: 34307 - DNA, 16 bp, H. sapiens
agagaccctgtctcta

SEQ ID NO: 34308 - DNA, 16 bp, H. sapiens
agagacctacaaaaag

SEQ ID NO: 34309 - DNA, 16 bp, H. sapiens
agagacctggaacaga

SEQ ID NO: 34310 - DNA, 16 bp, H. sapiens
agagacctggagccag

SEQ ID NO: 34311 - DNA, 16 bp, H. sapiens
agagaccttcctgctt

SEQ ID NO: 34312 - DNA, 16 bp, H. sapiens
agagaccttttttttt

SEQ ID NO: 34313 - DNA, 16 bp, H. sapiens
agagacgggatctcac

SEQ ID NO: 34314 - DNA, 16 bp, H. sapiens
agagacgggatttcac

SEQ ID NO: 34315 - DNA, 17 bp, H. sapiens
agagacggggtctcact

SEQ ID NO: 34316 - DNA, 16 bp, H. sapiens
agagactccagcacag

SEQ ID NO: 34317 - DNA, 17 bp, H. sapiens
agagactccatctcaaa

SEQ ID NO: 34318 - DNA, 16 bp, H. sapiens
agagactctgatttaa

SEQ ID NO: 34319 - DNA, 16 bp, H. sapiens
agagactgaaataatt

SEQ ID NO: 34320 - DNA, 18 bp, H. sapiens
agagactgagaaaagaaa

SEQ ID NO: 34321 - DNA, 16 bp, H. sapiens
agagactgagaaagag

SEQ ID NO: 34322 - DNA, 16 bp, H. sapiens
agagactgagaaggag

SEQ ID NO: 34323 - DNA, 16 bp, H. sapiens
agagactgagacagga

SEQ ID NO: 34324 - DNA, 16 bp, H. sapiens
agagactgagagaaaa

SEQ ID NO: 34325 - DNA, 16 bp, H. sapiens
agagactgcagtaaag

SEQ ID NO: 34326 - DNA, 16 bp, H. sapiens
agagactggaaagaaa

SEQ ID NO: 34327 - DNA, 16 bp, H. sapiens
agagactggaggcatt

SEQ ID NO: 34328 - DNA, 16 bp, H. sapiens
agagactgggaagaaa

SEQ ID NO: 34329 - DNA, 16 bp, H. sapiens
agagacttagagatgc

SEQ ID NO: 34330 - DNA, 16 bp, H. sapiens
agagacttgcccaagg

SEQ ID NO: 34331 - DNA, 16 bp, H. sapiens
agagacttgcttgaac

SEQ ID NO: 34332 - DNA, 16 bp, H. sapiens
agagactttaaaaata

SEQ ID NO: 34333 - DNA, 16 bp, H. sapiens
agagactttttaaaat

SEQ ID NO: 34334 - DNA, 16 bp, H. sapiens
agagagaaaaaaatct

SEQ ID NO: 34335 - DNA, 16 bp, H. sapiens
agagagaaaaatatca

SEQ ID NO: 34336 - DNA, 16 bp, H. sapiens
agagagaaaaatcaag

SEQ ID NO: 34337 - DNA, 16 bp, H. sapiens
agagagaaaaatgttt

SEQ ID NO: 34338 - DNA, 16 bp, H. sapiens
agagagaaaagaaact

SEQ ID NO: 34339 - DNA, 16 bp, H. sapiens
agagagaaaagatggc

SEQ ID NO: 34340 - DNA, 16 bp, H. sapiens
agagagaaaatgaaca

SEQ ID NO: 34341 - DNA, 16 bp, H. sapiens
agagagaaaatgattt

SEQ ID NO: 34342 - DNA, 16 bp, H. sapiens
agagagaaaattcaaa

SEQ ID NO: 34343 - DNA, 16 bp, H. sapiens
agagagaaacacacag

SEQ ID NO: 34344 - DNA, 16 bp, H. sapiens
agagagaaagaaggcc

SEQ ID NO: 34345 - DNA, 16 bp, H. sapiens
agagagaaagaatttt

SEQ ID NO: 34346 - DNA, 16 bp, H. sapiens
agagagaaagagaact

SEQ ID NO: 34347 - DNA, 16 bp, H. sapiens
agagagaaagattgag

SEQ ID NO: 34348 - DNA, 16 bp, H. sapiens
agagagaaagcccagg

SEQ ID NO: 34349 - DNA, 16 bp, H. sapiens
agagagaaagctctgg

SEQ ID NO: 34350 - DNA, 16 bp, H. sapiens
agagagaaataaaact

SEQ ID NO: 34351 - DNA, 16 bp, H. sapiens
agagagaaataaagca

SEQ ID NO: 34352 - DNA, 16 bp, H. sapiens
agagagaaatgactta

SEQ ID NO: 34353 - DNA, 16 bp, H. sapiens
agagagaacactggaa

SEQ ID NO: 34354 - DNA, 16 bp, H. sapiens
agagagaagatggcca

SEQ ID NO: 34355 - DNA, 16 bp, H. sapiens
agagagaagcagcagc

SEQ ID NO: 34356 - DNA, 16 bp, H. sapiens
agagagaagcattctg

SEQ ID NO: 34357 - DNA, 16 bp, H. sapiens
agagagaaggtggcca

SEQ ID NO: 34358 - DNA, 16 bp, H. sapiens
agagagaagtatcaaa

SEQ ID NO: 34359 - DNA, 16 bp, H. sapiens
agagagaagtttatag

SEQ ID NO: 34360 - DNA, 16 bp, H. sapiens
agagagaattaaatga

SEQ ID NO: 34361 - DNA, 16 bp, H. sapiens
agagagacaaagtcaa

SEQ ID NO: 34362 - DNA, 16 bp, H. sapiens
agagagacacacagag

SEQ ID NO: 34363 - DNA, 16 bp, H. sapiens
agagagacagaaagta

SEQ ID NO: 34364 - DNA, 16 bp, H. sapiens
agagagacagaaagtc

SEQ ID NO: 34365 - DNA, 16 bp, H. sapiens
agagagacagagacca

SEQ ID NO: 34366 - DNA, 16 bp, H. sapiens
agagagacagagagac

SEQ ID NO: 34367 - DNA, 16 bp, H. sapiens
agagagacagagatga

SEQ ID NO: 34368 - DNA, 16 bp, H. sapiens
agagagaccaagagag

SEQ ID NO: 34369 - DNA, 16 bp, H. sapiens
agagagaccatattca

SEQ ID NO: 34370 - DNA, 16 bp, H. sapiens
agagagacccagtctc

SEQ ID NO: 34371 - DNA, 16 bp, H. sapiens
agagagacccctgtct

SEQ ID NO: 34372 - DNA, 17 bp, H. sapiens
agagagaccctgtctct

SEQ ID NO: 34373 - DNA, 16 bp, H. sapiens
agagagacggggtttc

SEQ ID NO: 34374 - DNA, 16 bp, H. sapiens
agagagactctgtctc

SEQ ID NO: 34375 - DNA, 16 bp, H. sapiens
agagagagaaactgag

SEQ ID NO: 34376 - DNA, 16 bp, H. sapiens
agagagagaaactgtg

SEQ ID NO: 34377 - DNA, 16 bp, H. sapiens
agagagagaaagatct

SEQ ID NO: 34378 - DNA, 16 bp, H. sapiens
agagagagaaatcaaa

SEQ ID NO: 34379 - DNA, 16 bp, H. sapiens
agagagagaaattgag

SEQ ID NO: 34380 - DNA, 16 bp, H. sapiens
agagagagaagaccca

SEQ ID NO: 34381 - DNA, 16 bp, H. sapiens
agagagagaagataca

SEQ ID NO: 34382 - DNA, 16 bp, H. sapiens
agagagagaagattca

SEQ ID NO: 34383 - DNA, 16 bp, H. sapiens
agagagagaagcagca

SEQ ID NO: 34384 - DNA, 16 bp, H. sapiens
agagagagaagctggg

SEQ ID NO: 34385 - DNA, 16 bp, H. sapiens
agagagagaatcagga

SEQ ID NO: 34386 - DNA, 16 bp, H. sapiens
agagagagaatgaatg

SEQ ID NO: 34387 - DNA, 16 bp, H. sapiens
agagagagaatggggc

SEQ ID NO: 34388 - DNA, 16 bp, H. sapiens
agagagagacagacac

SEQ ID NO: 34389 - DNA, 16 bp, H. sapiens
agagagagacagagac

SEQ ID NO: 34390 - DNA, 16 bp, H. sapiens
agagagagacagattg

SEQ ID NO: 34391 - DNA, 16 bp, H. sapiens
agagagagacagcaga

SEQ ID NO: 34392 - DNA, 16 bp, H. sapiens
agagagagacattttt

SEQ ID NO: 34393 - DNA, 16 bp, H. sapiens
agagagagaccctatc

SEQ ID NO: 34394 - DNA, 16 bp, H. sapiens
agagagagactccctc

SEQ ID NO: 34395 - DNA, 17 bp, H. sapiens
agagagagactccgtct

SEQ ID NO: 34396 - DNA, 16 bp, H. sapiens
agagagagactctgtc

SEQ ID NO: 34397 - DNA, 16 bp, H. sapiens
agagagagactgactg

SEQ ID NO: 34398 - DNA, 16 bp, H. sapiens
agagagagagaaactc

SEQ ID NO: 34399 - DNA, 16 bp, H. sapiens
agagagagagaaactg

SEQ ID NO: 34400 - DNA, 16 bp, H. sapiens
agagagagagaacatt

SEQ ID NO: 34401 - DNA, 16 bp, H. sapiens
agagagagagaaggcc

SEQ ID NO: 34402 - DNA, 16 bp, H. sapiens
agagagagagaatttg

SEQ ID NO: 34403 - DNA, 16 bp, H. sapiens
agagagagagacacag

SEQ ID NO: 34404 - DNA, 16 bp, H. sapiens
agagagagagacccag

SEQ ID NO: 34405 - DNA, 16 bp, H. sapiens
agagagagagactgaa

SEQ ID NO: 34406 - DNA, 16 bp, H. sapiens
agagagagagagagcc

SEQ ID NO: 34407 - DNA, 16 bp, H. sapiens
agagagagagagagct

SEQ ID NO: 34408 - DNA, 16 bp, H. sapiens
agagagagagagagtc

SEQ ID NO: 34409 - DNA, 16 bp, H. sapiens
agagagagagagagtt

SEQ ID NO: 34410 - DNA, 16 bp, H. sapiens
agagagagagagatac

SEQ ID NO: 34411 - DNA, 16 bp, H. sapiens
agagagagagagcgtg

SEQ ID NO: 34412 - DNA, 16 bp, H. sapiens
agagagagagagctca

SEQ ID NO: 34413 - DNA, 16 bp, H. sapiens
agagagagagaggctt

SEQ ID NO: 34414 - DNA, 16 bp, H. sapiens
agagagagagagttct

SEQ ID NO: 34415 - DNA, 16 bp, H. sapiens
agagagagagatcaaa

SEQ ID NO: 34416 - DNA, 16 bp, H. sapiens
agagagagagatgatg

SEQ ID NO: 34417 - DNA, 16 bp, H. sapiens
agagagagagattaga

SEQ ID NO: 34418 - DNA, 16 bp, H. sapiens
agagagagagattgga

SEQ ID NO: 34419 - DNA, 16 bp, H. sapiens
agagagagagattggt

SEQ ID NO: 34420 - DNA, 16 bp, H. sapiens
agagagagagatttca

SEQ ID NO: 34421 - DNA, 16 bp, H. sapiens
agagagagagcgcgag

SEQ ID NO: 34422 - DNA, 16 bp, H. sapiens
agagagagaggacaca

SEQ ID NO: 34423 - DNA, 16 bp, H. sapiens
agagagagaggccagg

SEQ ID NO: 34424 - DNA, 16 bp, H. sapiens
agagagagagtatgtg

SEQ ID NO: 34425 - DNA, 16 bp, H. sapiens
agagagagagtcttgc

SEQ ID NO: 34426 - DNA, 16 bp, H. sapiens
agagagagagtgattt

SEQ ID NO: 34427 - DNA, 16 bp, H. sapiens
agagagagagtttgac

SEQ ID NO: 34428 - DNA, 16 bp, H. sapiens
agagagagataggccc

SEQ ID NO: 34429 - DNA, 16 bp, H. sapiens
agagagagattgaaga

SEQ ID NO: 34430 - DNA, 16 bp, H. sapiens
agagagagcaacagag

SEQ ID NO: 34431 - DNA, 16 bp, H. sapiens
agagagagcaagacag

SEQ ID NO: 34432 - DNA, 16 bp, H. sapiens
agagagagccagagag

SEQ ID NO: 34433 - DNA, 16 bp, H. sapiens
agagagagcccagaaa

SEQ ID NO: 34434 - DNA, 16 bp, H. sapiens
agagagagcgagagca

SEQ ID NO: 34435 - DNA, 16 bp, H. sapiens
agagagagcttatgca

SEQ ID NO: 34436 - DNA, 16 bp, H. sapiens
agagagaggcagacag

SEQ ID NO: 34437 - DNA, 16 bp, H. sapiens
agagagaggcaggcag

SEQ ID NO: 34438 - DNA, 16 bp, H. sapiens
agagagaggccaagaa

SEQ ID NO: 34439 - DNA, 16 bp, H. sapiens
agagagagggagagtt

SEQ ID NO: 34440 - DNA, 16 bp, H. sapiens
agagagagggttttac

SEQ ID NO: 34441 - DNA, 16 bp, H. sapiens
agagagatatatatat

SEQ ID NO: 34442 - DNA, 16 bp, H. sapiens
agagagatcccatctc

SEQ ID NO: 34443 - DNA, 16 bp, H. sapiens
agagagatgaaataat

SEQ ID NO: 34444 - DNA, 16 bp, H. sapiens
agagagatgactttga

SEQ ID NO: 34445 - DNA, 16 bp, H. sapiens
agagagatggagtttc

SEQ ID NO: 34446 - DNA, 16 bp, H. sapiens
agagagatttgaagca

SEQ ID NO: 34447 - DNA, 16 bp, H. sapiens
agagagatttttaaaa

SEQ ID NO: 34448 - DNA, 16 bp, H. sapiens
agagagattttttttc

SEQ ID NO: 34449 - DNA, 16 bp, H. sapiens
agagagcaagacccca

SEQ ID NO: 34450 - DNA, 16 bp, H. sapiens
agagagcaagattctg

SEQ ID NO: 34451 - DNA, 16 bp, H. sapiens
agagagcacagaaata

SEQ ID NO: 34452 - DNA, 16 bp, H. sapiens
agagagcagaaggatg

SEQ ID NO: 34453 - DNA, 16 bp, H. sapiens
agagagcagagcccag

SEQ ID NO: 34454 - DNA, 19 bp, H. sapiens
agagagcagcccacgggca

SEQ ID NO: 34455 - DNA, 16 bp, H. sapiens
agagagcagcctggcc

SEQ ID NO: 34456 - DNA, 16 bp, H. sapiens
agagagcatcaggaaa

SEQ ID NO: 34457 - DNA, 16 bp, H. sapiens
agagagcatccctgtc

SEQ ID NO: 34458 - DNA, 16 bp, H. sapiens
agagagccaagatcat

SEQ ID NO: 34459 - DNA, 16 bp, H. sapiens
agagagccaccatcct

SEQ ID NO: 34460 - DNA, 16 bp, H. sapiens
agagagccagaccctg

SEQ ID NO: 34461 - DNA, 16 bp, H. sapiens
agagagccagagagag

SEQ ID NO: 34462 - DNA, 16 bp, H. sapiens
agagagccagtcttca

SEQ ID NO: 34463 - DNA, 16 bp, H. sapiens
agagagccctcaccag

SEQ ID NO: 34464 - DNA, 16 bp, H. sapiens
agagagccctcatcag

SEQ ID NO: 34465 - DNA, 16 bp, H. sapiens
agagagccctccccag

SEQ ID NO: 34466 - DNA, 16 bp, H. sapiens
agagagcctcccacct

SEQ ID NO: 34467 - DNA, 16 bp, H. sapiens
agagagcgagcgagag

SEQ ID NO: 34468 - DNA, 16 bp, H. sapiens
agagagcgagcgagcg

SEQ ID NO: 34469 - DNA, 16 bp, H. sapiens
agagagctcagaaata

SEQ ID NO: 34470 - DNA, 16 bp, H. sapiens
agagagctccagcaga

SEQ ID NO: 34471 - DNA, 16 bp, H. sapiens
agagagctgctgatga

SEQ ID NO: 34472 - DNA, 16 bp, H. sapiens
agagagcttgtgcagg

SEQ ID NO: 34473 - DNA, 16 bp, H. sapiens
agagaggaaaactgag

SEQ ID NO: 34474 - DNA, 16 bp, H. sapiens
agagaggaaagccatg

SEQ ID NO: 34475 - DNA, 16 bp, H. sapiens
agagaggaaagccatt

SEQ ID NO: 34476 - DNA, 16 bp, H. sapiens
agagaggacacaagca

SEQ ID NO: 34477 - DNA, 16 bp, H. sapiens
agagaggacacagaga

SEQ ID NO: 34478 - DNA, 16 bp, H. sapiens
agagaggacatccctg

SEQ ID NO: 34479 - DNA, 16 bp, H. sapiens
agagaggagaagcagc

SEQ ID NO: 34480 - DNA, 16 bp, H. sapiens
agagaggagaccctgg

SEQ ID NO: 34481 - DNA, 16 bp, H. sapiens
agagaggaggccaggc

SEQ ID NO: 34482 - DNA, 16 bp, H. sapiens
agagaggaggcctgga

SEQ ID NO: 34483 - DNA, 16 bp, H. sapiens
agagaggaggggctgg

SEQ ID NO: 34484 - DNA, 16 bp, H. sapiens
agagaggatcttgctc

SEQ ID NO: 34485 - DNA, 16 bp, H. sapiens
agagaggcacagagaa

SEQ ID NO: 34486 - DNA, 16 bp, H. sapiens
agagaggcagaggcag

SEQ ID NO: 34487 - DNA, 16 bp, H. sapiens
agagaggcatgaaaag

SEQ ID NO: 34488 - DNA, 16 bp, H. sapiens
agagaggcatgaaaca

SEQ ID NO: 34489 - DNA, 16 bp, H. sapiens
agagaggccccaggag

SEQ ID NO: 34490 - DNA, 16 bp, H. sapiens
agagaggcctggggag

SEQ ID NO: 34491 - DNA, 16 bp, H. sapiens
agagaggctaaggcag

SEQ ID NO: 34492 - DNA, 16 bp, H. sapiens
agagaggctctgtctc

SEQ ID NO: 34493 - DNA, 16 bp, H. sapiens
agagaggctgagaaat

SEQ ID NO: 34494 - DNA, 16 bp, H. sapiens
agagaggctgagacag

SEQ ID NO: 34495 - DNA, 16 bp, H. sapiens
agagaggctgaggagg

SEQ ID NO: 34496 - DNA, 16 bp, H. sapiens
agagaggctgaggtgg

SEQ ID NO: 34497 - DNA, 16 bp, H. sapiens
agagaggctgggatga

SEQ ID NO: 34498 - DNA, 16 bp, H. sapiens
agagaggctggggctg

SEQ ID NO: 34499 - DNA, 16 bp, H. sapiens
agagaggcttcaggag

SEQ ID NO: 34500 - DNA, 16 bp, H. sapiens
agagagggaaaatgat

SEQ ID NO: 34501 - DNA, 16 bp, H. sapiens
agagagggaaagtgac

SEQ ID NO: 34502 - DNA, 16 bp, H. sapiens
agagagggaatccttg

SEQ ID NO: 34503 - DNA, 16 bp, H. sapiens
agagagggagacacag

SEQ ID NO: 34504 - DNA, 16 bp, H. sapiens
agagagggagagaatt

SEQ ID NO: 34505 - DNA, 16 bp, H. sapiens
agagaggggccctggg

SEQ ID NO: 34506 - DNA, 16 bp, H. sapiens
agagaggggttttgcc

SEQ ID NO: 34507 - DNA, 16 bp, H. sapiens
agagagggtctcacca

SEQ ID NO: 34508 - DNA, 16 bp, H. sapiens
agagagggtctctctc

SEQ ID NO: 34509 - DNA, 16 bp, H. sapiens
agagagggttcttgga

SEQ ID NO: 34510 - DNA, 16 bp, H. sapiens
agagaggtggctggag

SEQ ID NO: 34511 - DNA, 16 bp, H. sapiens
agagaggttaaatatc

SEQ ID NO: 34512 - DNA, 16 bp, H. sapiens
agagaggttaagcagc

SEQ ID NO: 34513 - DNA, 16 bp, H. sapiens
agagagtacaatggtg

SEQ ID NO: 34514 - DNA, 16 bp, H. sapiens
agagagtagcagctca

SEQ ID NO: 34515 - DNA, 16 bp, H. sapiens
agagagtcagcaaaga

SEQ ID NO: 34516 - DNA, 16 bp, H. sapiens
agagagtcagcaaagg

SEQ ID NO: 34517 - DNA, 16 bp, H. sapiens
agagagtcctcaccag

SEQ ID NO: 34518 - DNA, 16 bp, H. sapiens
agagagtcttactctg

SEQ ID NO: 34519 - DNA, 16 bp, H. sapiens
agagagtgaaaagaca

SEQ ID NO: 34520 - DNA, 16 bp, H. sapiens
agagagtgagacagag

SEQ ID NO: 34521 - DNA, 16 bp, H. sapiens
agagagtgcatccttg

SEQ ID NO: 34522 - DNA, 16 bp, H. sapiens
agagagtgccactgca

SEQ ID NO: 34523 - DNA, 16 bp, H. sapiens
agagagttttatttct

SEQ ID NO: 34524 - DNA, 16 bp, H. sapiens
agagataagaaaactg

SEQ ID NO: 34525 - DNA, 16 bp, H. sapiens
agagataatattttaa

SEQ ID NO: 34526 - DNA, 17 bp, H. sapiens
agagatacaaactacca

SEQ ID NO: 34527 - DNA, 16 bp, H. sapiens
agagatacagagacag

SEQ ID NO: 34528 - DNA, 16 bp, H. sapiens
agagatacagcagtga

SEQ ID NO: 34529 - DNA, 16 bp, H. sapiens
agagatactgcaggtt

SEQ ID NO: 34530 - DNA, 16 bp, H. sapiens
agagatagagatgaga

SEQ ID NO: 34531 - DNA, 16 bp, H. sapiens
agagatagaggtagag

SEQ ID NO: 34532 - DNA, 16 bp, H. sapiens
agagatagatattatt

SEQ ID NO: 34533 - DNA, 16 bp, H. sapiens
agagatagggtcttgc

SEQ ID NO: 34534 - DNA, 16 bp, H. sapiens
agagatagtttgattt

SEQ ID NO: 34535 - DNA, 16 bp, H. sapiens
agagatatctgccctc

SEQ ID NO: 34536 - DNA, 16 bp, H. sapiens
agagatatttggtagt

SEQ ID NO: 34537 - DNA, 16 bp, H. sapiens
agagatattttcaaaa

SEQ ID NO: 34538 - DNA, 16 bp, H. sapiens
agagatcagagaaaga

SEQ ID NO: 34539 - DNA, 16 bp, H. sapiens
agagatcagatagttg

SEQ ID NO: 34540 - DNA, 16 bp, H. sapiens
agagatcatctagtcc

SEQ ID NO: 34541 - DNA, 16 bp, H. sapiens
agagatcccttccttc

SEQ ID NO: 34542 - DNA, 16 bp, H. sapiens
agagatcgagaacatc

SEQ ID NO: 34543 - DNA, 16 bp, H. sapiens
agagatctctcacctc

SEQ ID NO: 34544 - DNA, 16 bp, H. sapiens
agagatctgttgtaca

SEQ ID NO: 34545 - DNA, 16 bp, H. sapiens
agagatcttgaaagga

SEQ ID NO: 34546 - DNA, 16 bp, H. sapiens
agagatgaaaaataca

SEQ ID NO: 34547 - DNA, 16 bp, H. sapiens
agagatgaagaaacag

SEQ ID NO: 34548 - DNA, 16 bp, H. sapiens
agagatgaagaaatta

SEQ ID NO: 34549 - DNA, 16 bp, H. sapiens
agagatgaataaaaca

SEQ ID NO: 34550 - DNA, 16 bp, H. sapiens
agagatgacacaaaca

SEQ ID NO: 34551 - DNA, 16 bp, H. sapiens
agagatgagatgagat

SEQ ID NO: 34552 - DNA, 16 bp, H. sapiens
agagatgaggaaactg

SEQ ID NO: 34553 - DNA, 16 bp, H. sapiens
agagatgaggtcttgc

SEQ ID NO: 34554 - DNA, 16 bp, H. sapiens
agagatgatggtggct

SEQ ID NO: 34555 - DNA, 16 bp, H. sapiens
agagatgatttaaagc

SEQ ID NO: 34556 - DNA, 16 bp, H. sapiens
agagatgcaaagaaaa

SEQ ID NO: 34557 - DNA, 16 bp, H. sapiens
agagatgcaggtcagc

SEQ ID NO: 34558 - DNA, 16 bp, H. sapiens
agagatggaaaacaga

SEQ ID NO: 34559 - DNA, 16 bp, H. sapiens
agagatggaaaatata

SEQ ID NO: 34560 - DNA, 16 bp, H. sapiens
agagatggaatttcac

SEQ ID NO: 34561 - DNA, 16 bp, H. sapiens
agagatggagaccatc

SEQ ID NO: 34562 - DNA, 16 bp, H. sapiens
agagatggagagagat

SEQ ID NO: 34563 - DNA, 16 bp, H. sapiens
agagatggagcaagag

SEQ ID NO: 34564 - DNA, 16 bp, H. sapiens
agagatggaggccatc

SEQ ID NO: 34565 - DNA, 16 bp, H. sapiens
agagatggagtctcgc

SEQ ID NO: 34566 - DNA, 16 bp, H. sapiens
agagatggataaattt

SEQ ID NO: 34567 - DNA, 16 bp, H. sapiens
agagatggatggtggt

SEQ ID NO: 34568 - DNA, 16 bp, H. sapiens
agagatggattctcac

SEQ ID NO: 34569 - DNA, 16 bp, H. sapiens
agagatggctagtgct

SEQ ID NO: 34570 - DNA, 16 bp, H. sapiens
agagatgggagttcac

SEQ ID NO: 34571 - DNA, 16 bp, H. sapiens
agagatgggatcttgt

SEQ ID NO: 34572 - DNA, 16 bp, H. sapiens
agagatgggatttcac

SEQ ID NO: 34573 - DNA, 16 bp, H. sapiens
agagatgggatttcat

SEQ ID NO: 34574 - DNA, 16 bp, H. sapiens
agagatgggctttctc

SEQ ID NO: 34575 - DNA, 16 bp, H. sapiens
agagatggggcttttc

SEQ ID NO: 34576 - DNA, 17 bp, H. sapiens
agagatggggtctcgct

SEQ ID NO: 34577 - DNA, 18 bp, H. sapiens
agagatggggtttcaccg

SEQ ID NO: 34578 - DNA, 16 bp, H. sapiens
agagatggggtttcgc

SEQ ID NO: 34579 - DNA, 16 bp, H. sapiens
agagatggtggtggct

SEQ ID NO: 34580 - DNA, 16 bp, H. sapiens
agagatgtgctggctt

SEQ ID NO: 34581 - DNA, 16 bp, H. sapiens
agagatgtggtctcgc

SEQ ID NO: 34582 - DNA, 16 bp, H. sapiens
agagatgttaaataat

SEQ ID NO: 34583 - DNA, 16 bp, H. sapiens
agagattaagtgactt

SEQ ID NO: 34584 - DNA, 16 bp, H. sapiens
agagattcaaacccag

SEQ ID NO: 34585 - DNA, 18 bp, H. sapiens
agagattcagcttcttcc

SEQ ID NO: 34586 - DNA, 16 bp, H. sapiens
agagattcagtttctt

SEQ ID NO: 34587 - DNA, 16 bp, H. sapiens
agagattcctttttct

SEQ ID NO: 34588 - DNA, 16 bp, H. sapiens
agagattctgttttga

SEQ ID NO: 34589 - DNA, 16 bp, H. sapiens
agagattcttgtacat

SEQ ID NO: 34590 - DNA, 16 bp, H. sapiens
agagattcttgtgtct

SEQ ID NO: 34591 - DNA, 16 bp, H. sapiens
agagattgaagtgagc

SEQ ID NO: 34592 - DNA, 16 bp, H. sapiens
agagattgcaataaag

SEQ ID NO: 34593 - DNA, 16 bp, H. sapiens
agagattggaatgatg

SEQ ID NO: 34594 - DNA, 16 bp, H. sapiens
agagattgggtcttgc

SEQ ID NO: 34595 - DNA, 16 bp, H. sapiens
agagattgtatagaat

SEQ ID NO: 34596 - DNA, 16 bp, H. sapiens
agagattgttttattt

SEQ ID NO: 34597 - DNA, 16 bp, H. sapiens
agagatttactgaaaa

SEQ ID NO: 34598 - DNA, 16 bp, H. sapiens
agagatttattgcaaa

SEQ ID NO: 34599 - DNA, 16 bp, H. sapiens
agagatttgtagaact

SEQ ID NO: 34600 - DNA, 31 bp, H. sapiens
agagattttgtcaccaccaggcctgccctac

SEQ ID NO: 34601 - DNA, 16 bp, H. sapiens
agagatttttaaaaat

SEQ ID NO: 34602 - DNA, 16 bp, H. sapiens
agagatttttaaataa

SEQ ID NO: 34603 - DNA, 16 bp, H. sapiens
agagattttttaaaat

SEQ ID NO: 34604 - DNA, 16 bp, H. sapiens
agagatttttttaaag

SEQ ID NO: 34605 - DNA, 16 bp, H. sapiens
agagatttttttcatt

SEQ ID NO: 34606 - DNA, 16 bp, H. sapiens
agagcaaaaatgtaaa

SEQ ID NO: 34607 - DNA, 16 bp, H. sapiens
agagcaaaattccgtc

SEQ ID NO: 34608 - DNA, 16 bp, H. sapiens
agagcaaagaagaaat

SEQ ID NO: 34609 - DNA, 16 bp, H. sapiens
agagcaaagccctgtc

SEQ ID NO: 34610 - DNA, 16 bp, H. sapiens
agagcaaccactaaaa

SEQ ID NO: 34611 - DNA, 16 bp, H. sapiens
agagcaacttcatctt

SEQ ID NO: 34612 - DNA, 16 bp, H. sapiens
agagcaagaacctgtc

SEQ ID NO: 34613 - DNA, 16 bp, H. sapiens
agagcaagaattcatc

SEQ ID NO: 34614 - DNA, 16 bp, H. sapiens
agagcaagacagtctc

SEQ ID NO: 34615 - DNA, 16 bp, H. sapiens
agagcaagaccctgtc

SEQ ID NO: 34616 - DNA, 16 bp, H. sapiens
agagcaagaccttctc

SEQ ID NO: 34617 - DNA, 16 bp, H. sapiens
agagcaagactccgcc

SEQ ID NO: 34618 - DNA, 16 bp, H. sapiens
agagcaagactctctg

SEQ ID NO: 34619 - DNA, 16 bp, H. sapiens
agagcaagactctgtc

SEQ ID NO: 34620 - DNA, 16 bp, H. sapiens
agagcaagactgtccc

SEQ ID NO: 34621 - DNA, 16 bp, H. sapiens
agagcaagactttgtc

SEQ ID NO: 34622 - DNA, 16 bp, H. sapiens
agagcaagatcctgtc

SEQ ID NO: 34623 - DNA, 16 bp, H. sapiens
agagcaagattctgcc

SEQ ID NO: 34624 - DNA, 16 bp, H. sapiens
agagcaagattgtgtc

SEQ ID NO: 34625 - DNA, 16 bp, H. sapiens
agagcaaggattcaaa

SEQ ID NO: 34626 - DNA, 16 bp, H. sapiens
agagcaatggcacaat

SEQ ID NO: 34627 - DNA, 16 bp, H. sapiens
agagcaattaaaaata

SEQ ID NO: 34628 - DNA, 16 bp, H. sapiens
agagcacaggcagaat

SEQ ID NO: 34629 - DNA, 16 bp, H. sapiens
agagcacagggaggcc

SEQ ID NO: 34630 - DNA, 16 bp, H. sapiens
agagcacagggatgcc

SEQ ID NO: 34631 - DNA, 16 bp, H. sapiens
agagcaccagctgcag

SEQ ID NO: 34632 - DNA, 16 bp, H. sapiens
agagcacctactgtgc

SEQ ID NO: 34633 - DNA, 16 bp, H. sapiens
agagcacctgtcaaag

SEQ ID NO: 34634 - DNA, 16 bp, H. sapiens
agagcagaaaagatga

SEQ ID NO: 34635 - DNA, 16 bp, H. sapiens
agagcagaaacaaata

SEQ ID NO: 34636 - DNA, 16 bp, H. sapiens
agagcagaaggcagag

SEQ ID NO: 34637 - DNA, 16 bp, H. sapiens
agagcagaagttttaa

SEQ ID NO: 34638 - DNA, 16 bp, H. sapiens
agagcagacaactggt

SEQ ID NO: 34639 - DNA, 16 bp, H. sapiens
agagcagagcagagaa

SEQ ID NO: 34640 - DNA, 16 bp, H. sapiens
agagcagaggccagag

SEQ ID NO: 34641 - DNA, 16 bp, H. sapiens
agagcagattagtgcc

SEQ ID NO: 34642 - DNA, 16 bp, H. sapiens
agagcagcagcagcag

SEQ ID NO: 34643 - DNA, 16 bp, H. sapiens
agagcagcagcatggg

SEQ ID NO: 34644 - DNA, 16 bp, H. sapiens
agagcagcaggaggag

SEQ ID NO: 34645 - DNA, 16 bp, H. sapiens
agagcagccagagtga

SEQ ID NO: 34646 - DNA, 16 bp, H. sapiens
agagcagccccaaggg

SEQ ID NO: 34647 - DNA, 16 bp, H. sapiens
agagcagccctgaggg

SEQ ID NO: 34648 - DNA, 16 bp, H. sapiens
agagcagcctagacaa

SEQ ID NO: 34649 - DNA, 16 bp, H. sapiens
agagcagcctgatcaa

SEQ ID NO: 34650 - DNA, 16 bp, H. sapiens
agagcagcctggaaga

SEQ ID NO: 34651 - DNA, 16 bp, H. sapiens
agagcagcctggccaa

SEQ ID NO: 34652 - DNA, 16 bp, H. sapiens
agagcagcctggtcaa

SEQ ID NO: 34653 - DNA, 16 bp, H. sapiens
agagcagctcacagaa

SEQ ID NO: 34654 - DNA, 16 bp, H. sapiens
agagcagctccaagac

SEQ ID NO: 34655 - DNA, 16 bp, H. sapiens
agagcagctgtgctgt

SEQ ID NO: 34656 - DNA, 16 bp, H. sapiens
agagcaggaatagcta

SEQ ID NO: 34657 - DNA, 16 bp, H. sapiens
agagcaggaatgaaaa

SEQ ID NO: 34658 - DNA, 16 bp, H. sapiens
agagcaggaccttgtc

SEQ ID NO: 34659 - DNA, 16 bp, H. sapiens
agagcaggattctgtc

SEQ ID NO: 34660 - DNA, 16 bp, H. sapiens
agagcagggaccttgt

SEQ ID NO: 34661 - DNA, 16 bp, H. sapiens
agagcagggactcaaa

SEQ ID NO: 34662 - DNA, 16 bp, H. sapiens
agagcaggggcacaat

SEQ ID NO: 34663 - DNA, 16 bp, H. sapiens
agagcagtgatgctgg

SEQ ID NO: 34664 - DNA, 16 bp, H. sapiens
agagcagtgctgtcca

SEQ ID NO: 34665 - DNA, 16 bp, H. sapiens
agagcagtgcttctcc

SEQ ID NO: 34666 - DNA, 16 bp, H. sapiens
agagcagtgtgtagag

SEQ ID NO: 34667 - DNA, 16 bp, H. sapiens
agagcagtgtgtggag

SEQ ID NO: 34668 - DNA, 16 bp, H. sapiens
agagcagtttcagtgg

SEQ ID NO: 34669 - DNA, 16 bp, H. sapiens
agagcatcagtgaact

SEQ ID NO: 34670 - DNA, 16 bp, H. sapiens
agagcatcctggccaa

SEQ ID NO: 34671 - DNA, 16 bp, H. sapiens
agagcatgagctctgg

SEQ ID NO: 34672 - DNA, 16 bp, H. sapiens
agagcattttcatcac

SEQ ID NO: 34673 - DNA, 16 bp, H. sapiens
agagcatttttaaaaa

SEQ ID NO: 34674 - DNA, 16 bp, H. sapiens
agagccaaactccatc

SEQ ID NO: 34675 - DNA, 16 bp, H. sapiens
agagccaaatcatatt

SEQ ID NO: 34676 - DNA, 16 bp, H. sapiens
agagccaacaggattt

SEQ ID NO: 34677 - DNA, 16 bp, H. sapiens
agagccaactgaaaga

SEQ ID NO: 34678 - DNA, 16 bp, H. sapiens
agagccaattccagaa

SEQ ID NO: 34679 - DNA, 16 bp, H. sapiens
agagccacaggggcag

SEQ ID NO: 34680 - DNA, 16 bp, H. sapiens
agagccaccagcagct

SEQ ID NO: 34681 - DNA, 16 bp, H. sapiens
agagccactgcacctg

SEQ ID NO: 34682 - DNA, 16 bp, H. sapiens
agagccagactccctc

SEQ ID NO: 34683 - DNA, 16 bp, H. sapiens
agagccagactctgtc

SEQ ID NO: 34684 - DNA, 16 bp, H. sapiens
agagccagagagagaa

SEQ ID NO: 34685 - DNA, 16 bp, H. sapiens
agagccagcaaaggag

SEQ ID NO: 34686 - DNA, 16 bp, H. sapiens
agagccagcaggctgg

SEQ ID NO: 34687 - DNA, 16 bp, H. sapiens
agagccaggatttgaa

SEQ ID NO: 34688 - DNA, 16 bp, H. sapiens
agagccaggccttgtc

SEQ ID NO: 34689 - DNA, 17 bp, H. sapiens
agagccaggcgtggtgg

SEQ ID NO: 34690 - DNA, 16 bp, H. sapiens
agagccagggccagag

SEQ ID NO: 34691 - DNA, 16 bp, H. sapiens
agagccagggttcaaa

SEQ ID NO: 34692 - DNA, 16 bp, H. sapiens
agagccagtctcaaaa

SEQ ID NO: 34693 - DNA, 16 bp, H. sapiens
agagccagtgccctta

SEQ ID NO: 34694 - DNA, 16 bp, H. sapiens
agagccatgaacagag

SEQ ID NO: 34695 - DNA, 16 bp, H. sapiens
agagcccacactgcca

SEQ ID NO: 34696 - DNA, 16 bp, H. sapiens
agagcccacatttcca

SEQ ID NO: 34697 - DNA, 16 bp, H. sapiens
agagcccagagcccag

SEQ ID NO: 34698 - DNA, 16 bp, H. sapiens
agagcccaggaggcag

SEQ ID NO: 34699 - DNA, 16 bp, H. sapiens
agagcccaggaggtgg

SEQ ID NO: 34700 - DNA, 16 bp, H. sapiens
agagcccaggagttca

SEQ ID NO: 34701 - DNA, 16 bp, H. sapiens
agagccccagggcctt

SEQ ID NO: 34702 - DNA, 26 bp, H. sapiens
agagccctcagaaataacgccgctta

SEQ ID NO: 34703 - DNA, 16 bp, H. sapiens
agagccctcttcctgg

SEQ ID NO: 34704 - DNA, 16 bp, H. sapiens
agagccctgcccctgc

SEQ ID NO: 34705 - DNA, 17 bp, H. sapiens
agagccctgtaattgct

SEQ ID NO: 34706 - DNA, 16 bp, H. sapiens
agagcccttgagcctt

SEQ ID NO: 34707 - DNA, 18 bp, H. sapiens
agagccgagatcatgcca

SEQ ID NO: 34708 - DNA, 16 bp, H. sapiens
agagcctcaccagcag

SEQ ID NO: 34709 - DNA, 16 bp, H. sapiens
agagcctccagaaaag

SEQ ID NO: 34710 - DNA, 16 bp, H. sapiens
agagcctctctctgtc

SEQ ID NO: 34711 - DNA, 17 bp, H. sapiens
agagcctgaaaaactgc

SEQ ID NO: 34712 - DNA, 16 bp, H. sapiens
agagcctgaagagcca

SEQ ID NO: 34713 - DNA, 16 bp, H. sapiens
agagcctgagattctg

SEQ ID NO: 34714 - DNA, 16 bp, H. sapiens
agagcctgcagaacca

SEQ ID NO: 34715 - DNA, 16 bp, H. sapiens
agagcctgcatttcca

SEQ ID NO: 34716 - DNA, 16 bp, H. sapiens
agagcctgcatttcta

SEQ ID NO: 34717 - DNA, 16 bp, H. sapiens
agagcctggagttctg

SEQ ID NO: 34718 - DNA, 16 bp, H. sapiens
agagcctggattcaaa

SEQ ID NO: 34719 - DNA, 16 bp, H. sapiens
agagcctgggaaaaaa

SEQ ID NO: 34720 - DNA, 16 bp, H. sapiens
agagcctgtctaaaaa

SEQ ID NO: 34721 - DNA, 16 bp, H. sapiens
agagccttcaccagaa

SEQ ID NO: 34722 - DNA, 16 bp, H. sapiens
agagccttcagaggga

SEQ ID NO: 34723 - DNA, 16 bp, H. sapiens
agagccttgaagatga

SEQ ID NO: 34724 - DNA, 16 bp, H. sapiens
agagcctttttttttt

SEQ ID NO: 34725 - DNA, 17 bp, H. sapiens
agagcgaaactacgtct

SEQ ID NO: 34726 - DNA, 16 bp, H. sapiens
agagcgaaactatgtc

SEQ ID NO: 34727 - DNA, 16 bp, H. sapiens
agagcgacactctgtc

SEQ ID NO: 34728 - DNA, 16 bp, H. sapiens
agagcgagaatccatc

SEQ ID NO: 34729 - DNA, 16 bp, H. sapiens
agagcgagacagtctc

SEQ ID NO: 34730 - DNA, 17 bp, H. sapiens
agagcgagactccatca

SEQ ID NO: 34731 - DNA, 16 bp, H. sapiens
agagcgagacttcttc

SEQ ID NO: 34732 - DNA, 16 bp, H. sapiens
agagcgagagaccctg

SEQ ID NO: 34733 - DNA, 16 bp, H. sapiens
agagcgagagactctg

SEQ ID NO: 34734 - DNA, 16 bp, H. sapiens
agagcgagagagacag

SEQ ID NO: 34735 - DNA, 16 bp, H. sapiens
agagcgagagagcgag

SEQ ID NO: 34736 - DNA, 16 bp, H. sapiens
agagcgagcagcagca

SEQ ID NO: 34737 - DNA, 16 bp, H. sapiens
agagcgggactctgtc

SEQ ID NO: 34738 - DNA, 16 bp, H. sapiens
agagctaaaaccagaa

SEQ ID NO: 34739 - DNA, 16 bp, H. sapiens
agagctaaaatgttca

SEQ ID NO: 34740 - DNA, 16 bp, H. sapiens
agagctaaacactggg

SEQ ID NO: 34741 - DNA, 16 bp, H. sapiens
agagctaaataaatgt

SEQ ID NO: 34742 - DNA, 16 bp, H. sapiens
agagctaaatcatgaa

SEQ ID NO: 34743 - DNA, 17 bp, H. sapiens
agagctaactatcctga

SEQ ID NO: 34744 - DNA, 16 bp, H. sapiens
agagctagaattagaa

SEQ ID NO: 34745 - DNA, 16 bp, H. sapiens
agagctagaatttgaa

SEQ ID NO: 34746 - DNA, 16 bp, H. sapiens
agagctagactctgcc

SEQ ID NO: 34747 - DNA, 16 bp, H. sapiens
agagctaggatttgaa

SEQ ID NO: 34748 - DNA, 16 bp, H. sapiens
agagctagggtggggg

SEQ ID NO: 34749 - DNA, 16 bp, H. sapiens
agagctagttgttaaa

SEQ ID NO: 34750 - DNA, 16 bp, H. sapiens
agagctattctccttt

SEQ ID NO: 34751 - DNA, 16 bp, H. sapiens
agagctatttaaaaat

SEQ ID NO: 34752 - DNA, 16 bp, H. sapiens
agagctcaccccaggt

SEQ ID NO: 34753 - DNA, 16 bp, H. sapiens
agagctcatatagcca

SEQ ID NO: 34754 - DNA, 16 bp, H. sapiens
agagctccaggcagag

SEQ ID NO: 34755 - DNA, 16 bp, H. sapiens
agagctcccagaggga

SEQ ID NO: 34756 - DNA, 16 bp, H. sapiens
agagctccctgtggga

SEQ ID NO: 34757 - DNA, 16 bp, H. sapiens
agagctcctcctgcct

SEQ ID NO: 34758 - DNA, 16 bp, H. sapiens
agagctcctgaaagaa

SEQ ID NO: 34759 - DNA, 16 bp, H. sapiens
agagctcctggaggaa

SEQ ID NO: 34760 - DNA, 16 bp, H. sapiens
agagctctgccctcat

SEQ ID NO: 34761 - DNA, 16 bp, H. sapiens
agagctctggctggca

SEQ ID NO: 34762 - DNA, 16 bp, H. sapiens
agagctctggtgtctc

SEQ ID NO: 34763 - DNA, 16 bp, H. sapiens
agagctgagactggaa

SEQ ID NO: 34764 - DNA, 16 bp, H. sapiens
agagctgagagcccca

SEQ ID NO: 34765 - DNA, 18 bp, H. sapiens
agagctgagattgcacca

SEQ ID NO: 34766 - DNA, 19 bp, H. sapiens
agagctgagttcaagtcct

SEQ ID NO: 34767 - DNA, 16 bp, H. sapiens
agagctgcaatctagt

SEQ ID NO: 34768 - DNA, 16 bp, H. sapiens
agagctgcaggctgag

SEQ ID NO: 34769 - DNA, 16 bp, H. sapiens
agagctgctctctgct

SEQ ID NO: 34770 - DNA, 16 bp, H. sapiens
agagctgctgaaggaa

SEQ ID NO: 34771 - DNA, 16 bp, H. sapiens
agagctgctgcacagc

SEQ ID NO: 34772 - DNA, 16 bp, H. sapiens
agagctgcttagagaa

SEQ ID NO: 34773 - DNA, 16 bp, H. sapiens
agagctggaaggcagg

SEQ ID NO: 34774 - DNA, 16 bp, H. sapiens
agagctggagagagag

SEQ ID NO: 34775 - DNA, 16 bp, H. sapiens
agagctggaggaggag

SEQ ID NO: 34776 - DNA, 16 bp, H. sapiens
agagctggaggctgag

SEQ ID NO: 34777 - DNA, 16 bp, H. sapiens
agagctggaggtgagc

SEQ ID NO: 34778 - DNA, 16 bp, H. sapiens
agagctggagtctcac

SEQ ID NO: 34779 - DNA, 16 bp, H. sapiens
agagctgggaccacag

SEQ ID NO: 34780 - DNA, 16 bp, H. sapiens
agagctgggatgacag

SEQ ID NO: 34781 - DNA, 16 bp, H. sapiens
agagctgggcacagtg

SEQ ID NO: 34782 - DNA, 16 bp, H. sapiens
agagctgggcgcagtg

SEQ ID NO: 34783 - DNA, 16 bp, H. sapiens
agagctgggctctgag

SEQ ID NO: 34784 - DNA, 16 bp, H. sapiens
agagctggggagaggg

SEQ ID NO: 34785 - DNA, 16 bp, H. sapiens
agagctggggaggagg

SEQ ID NO: 34786 - DNA, 16 bp, H. sapiens
agagctgtaacactta

SEQ ID NO: 34787 - DNA, 16 bp, H. sapiens
agagctgtgagaaaag

SEQ ID NO: 34788 - DNA, 16 bp, H. sapiens
agagctgtgagaagaa

SEQ ID NO: 34789 - DNA, 16 bp, H. sapiens
agagctgtgagaagag

SEQ ID NO: 34790 - DNA, 16 bp, H. sapiens
agagctgtggtgggct

SEQ ID NO: 34791 - DNA, 16 bp, H. sapiens
agagcttaaaaataaa

SEQ ID NO: 34792 - DNA, 16 bp, H. sapiens
agagcttagaacagtg

SEQ ID NO: 34793 - DNA, 16 bp, H. sapiens
agagcttcaaaatgca

SEQ ID NO: 34794 - DNA, 16 bp, H. sapiens
agagcttccctgtccc

SEQ ID NO: 34795 - DNA, 16 bp, H. sapiens
agagcttctcccagta

SEQ ID NO: 34796 - DNA, 16 bp, H. sapiens
agagcttctgcagagc

SEQ ID NO: 34797 - DNA, 16 bp, H. sapiens
agagcttctgcctcca

SEQ ID NO: 34798 - DNA, 16 bp, H. sapiens
agagcttgtctctaca

SEQ ID NO: 34799 - DNA, 16 bp, H. sapiens
agagcttgtgcacagc

SEQ ID NO: 34800 - DNA, 16 bp, H. sapiens
agagctttatttccaa

SEQ ID NO: 34801 - DNA, 16 bp, H. sapiens
agagctttgaagagag

SEQ ID NO: 34802 - DNA, 16 bp, H. sapiens
agagctttgggaggct

SEQ ID NO: 34803 - DNA, 16 bp, H. sapiens
agagcttttcactttt

SEQ ID NO: 34804 - DNA, 16 bp, H. sapiens
agagctttttaaaaac

SEQ ID NO: 34805 - DNA, 16 bp, H. sapiens
agaggaaaaaactgaa

SEQ ID NO: 34806 - DNA, 16 bp, H. sapiens
agaggaaaaacacagt

SEQ ID NO: 34807 - DNA, 16 bp, H. sapiens
agaggaaaaagaactg

SEQ ID NO: 34808 - DNA, 16 bp, H. sapiens
agaggaaaatctatag

SEQ ID NO: 34809 - DNA, 16 bp, H. sapiens
agaggaaaattaatag

SEQ ID NO: 34810 - DNA, 16 bp, H. sapiens
agaggaaacagaaata

SEQ ID NO: 34811 - DNA, 16 bp, H. sapiens
agaggaaacattttct

SEQ ID NO: 34812 - DNA, 16 bp, H. sapiens
agaggaaactgaggct

SEQ ID NO: 34813 - DNA, 16 bp, H. sapiens
agaggaaagaaaacat

SEQ ID NO: 34814 - DNA, 16 bp, H. sapiens
agaggaaaggtgaatt

SEQ ID NO: 34815 - DNA, 16 bp, H. sapiens
agaggaaagtacagag

SEQ ID NO: 34816 - DNA, 16 bp, H. sapiens
agaggaaagtttacag

SEQ ID NO: 34817 - DNA, 16 bp, H. sapiens
agaggaaagtttatat

SEQ ID NO: 34818 - DNA, 16 bp, H. sapiens
agaggaaataacagaa

SEQ ID NO: 34819 - DNA, 16 bp, H. sapiens
agaggaaatttgaaca

SEQ ID NO: 34820 - DNA, 16 bp, H. sapiens
agaggaacaaattaaa

SEQ ID NO: 34821 - DNA, 16 bp, H. sapiens
agaggaactctcaaaa

SEQ ID NO: 34822 - DNA, 16 bp, H. sapiens
agaggaactggtacca

SEQ ID NO: 34823 - DNA, 16 bp, H. sapiens
agaggaagaaaatcag

SEQ ID NO: 34824 - DNA, 16 bp, H. sapiens
agaggaagaaactaaa

SEQ ID NO: 34825 - DNA, 16 bp, H. sapiens
agaggaagaagccaag

SEQ ID NO: 34826 - DNA, 16 bp, H. sapiens
agaggaagaagctgag

SEQ ID NO: 34827 - DNA, 16 bp, H. sapiens
agaggaagacacagag

SEQ ID NO: 34828 - DNA, 16 bp, H. sapiens
agaggaagacccaccc

SEQ ID NO: 34829 - DNA, 16 bp, H. sapiens
agaggaagactcagtc

SEQ ID NO: 34830 - DNA, 16 bp, H. sapiens
agaggaagactccatc

SEQ ID NO: 34831 - DNA, 16 bp, H. sapiens
agaggaagagacagca

SEQ ID NO: 34832 - DNA, 16 bp, H. sapiens
agaggaagagagacct

SEQ ID NO: 34833 - DNA, 16 bp, H. sapiens
agaggaagaggctgag

SEQ ID NO: 34834 - DNA, 16 bp, H. sapiens
agaggaagattttaat

SEQ ID NO: 34835 - DNA, 16 bp, H. sapiens
agaggaagcagcagca

SEQ ID NO: 34836 - DNA, 16 bp, H. sapiens
agaggaaggcctctgt

SEQ ID NO: 34837 - DNA, 16 bp, H. sapiens
agaggaagtcaaacta

SEQ ID NO: 34838 - DNA, 16 bp, H. sapiens
agaggaagtcaagttg

SEQ ID NO: 34839 - DNA, 16 bp, H. sapiens
agaggaagtgaaattg

SEQ ID NO: 34840 - DNA, 16 bp, H. sapiens
agaggaatataaagca

SEQ ID NO: 34841 - DNA, 16 bp, H. sapiens
agaggaatcaaggatg

SEQ ID NO: 34842 - DNA, 16 bp, H. sapiens
agaggaatgagcagga

SEQ ID NO: 34843 - DNA, 16 bp, H. sapiens
agaggaatgtggaagg

SEQ ID NO: 34844 - DNA, 16 bp, H. sapiens
agaggaattctggttt

SEQ ID NO: 34845 - DNA, 16 bp, H. sapiens
agaggaatttgaagcc

SEQ ID NO: 34846 - DNA, 16 bp, H. sapiens
agaggaattttggaag

SEQ ID NO: 34847 - DNA, 16 bp, H. sapiens
agaggacacacacaca

SEQ ID NO: 34848 - DNA, 16 bp, H. sapiens
agaggacacagacaaa

SEQ ID NO: 34849 - DNA, 16 bp, H. sapiens
agaggacatcaaaaaa

SEQ ID NO: 34850 - DNA, 16 bp, H. sapiens
agaggacatggagaaa

SEQ ID NO: 34851 - DNA, 16 bp, H. sapiens
agaggacattcaaacc

SEQ ID NO: 34852 - DNA, 16 bp, H. sapiens
agaggacccagaaata

SEQ ID NO: 34853 - DNA, 16 bp, H. sapiens
agaggactgacttcaa

SEQ ID NO: 34854 - DNA, 16 bp, H. sapiens
agaggacttgaaatat

SEQ ID NO: 34855 - DNA, 16 bp, H. sapiens
agaggacttgaaatgt

SEQ ID NO: 34856 - DNA, 16 bp, H. sapiens
agaggagaaaattgag

SEQ ID NO: 34857 - DNA, 16 bp, H. sapiens
agaggagaaactgagg

SEQ ID NO: 34858 - DNA, 16 bp, H. sapiens
agaggagaagtcagtg

SEQ ID NO: 34859 - DNA, 16 bp, H. sapiens
agaggagacagagaca

SEQ ID NO: 34860 - DNA, 16 bp, H. sapiens
agaggagacatcacta

SEQ ID NO: 34861 - DNA, 16 bp, H. sapiens
agaggagaccctgggg

SEQ ID NO: 34862 - DNA, 16 bp, H. sapiens
agaggagactcagttt

SEQ ID NO: 34863 - DNA, 16 bp, H. sapiens
agaggagagaacactt

SEQ ID NO: 34864 - DNA, 16 bp, H. sapiens
agaggagagagacaca

SEQ ID NO: 34865 - DNA, 16 bp, H. sapiens
agaggagaggacacag

SEQ ID NO: 34866 - DNA, 16 bp, H. sapiens
agaggagagggctggg

SEQ ID NO: 34867 - DNA, 16 bp, H. sapiens
agaggagatttggaca

SEQ ID NO: 34868 - DNA, 16 bp, H. sapiens
agaggagatttttttt

SEQ ID NO: 34869 - DNA, 16 bp, H. sapiens
agaggagcaaaggcaa

SEQ ID NO: 34870 - DNA, 16 bp, H. sapiens
agaggagcaagagcaa

SEQ ID NO: 34871 - DNA, 16 bp, H. sapiens
agaggagcaggccttg

SEQ ID NO: 34872 - DNA, 16 bp, H. sapiens
agaggagcctgaggag

SEQ ID NO: 34873 - DNA, 16 bp, H. sapiens
agaggagcctgggcaa

SEQ ID NO: 34874 - DNA, 16 bp, H. sapiens
agaggagctagtacca

SEQ ID NO: 34875 - DNA, 16 bp, H. sapiens
agaggagctggaggag

SEQ ID NO: 34876 - DNA, 16 bp, H. sapiens
agaggagctggttcca

SEQ ID NO: 34877 - DNA, 16 bp, H. sapiens
agaggaggaaactaaa

SEQ ID NO: 34878 - DNA, 16 bp, H. sapiens
agaggaggaaactgag

SEQ ID NO: 34879 - DNA, 16 bp, H. sapiens
agaggaggaagctgag

SEQ ID NO: 34880 - DNA, 16 bp, H. sapiens
agaggaggagactgag

SEQ ID NO: 34881 - DNA, 16 bp, H. sapiens
agaggaggagccaaga

SEQ ID NO: 34882 - DNA, 16 bp, H. sapiens
agaggaggaggagcca

SEQ ID NO: 34883 - DNA, 16 bp, H. sapiens
agaggaggaggctggg

SEQ ID NO: 34884 - DNA, 16 bp, H. sapiens
agaggaggcagaggca

SEQ ID NO: 34885 - DNA, 16 bp, H. sapiens
agaggaggccctggag

SEQ ID NO: 34886 - DNA, 16 bp, H. sapiens
agaggaggctgggaaa

SEQ ID NO: 34887 - DNA, 16 bp, H. sapiens
agaggagggaacactt

SEQ ID NO: 34888 - DNA, 16 bp, H. sapiens
agaggaggggccaggc

SEQ ID NO: 34889 - DNA, 16 bp, H. sapiens
agaggaggggctggag

SEQ ID NO: 34890 - DNA, 16 bp, H. sapiens
agaggaggtgatgttt

SEQ ID NO: 34891 - DNA, 16 bp, H. sapiens
agaggaggtgccaggc

SEQ ID NO: 34892 - DNA, 16 bp, H. sapiens
agaggagtcaaattca

SEQ ID NO: 34893 - DNA, 16 bp, H. sapiens
agaggagtccctcctt

SEQ ID NO: 34894 - DNA, 16 bp, H. sapiens
agaggagtgactttga

SEQ ID NO: 34895 - DNA, 16 bp, H. sapiens
agaggagtttgagacc

SEQ ID NO: 34896 - DNA, 16 bp, H. sapiens
agaggatcactggagg

SEQ ID NO: 34897 - DNA, 16 bp, H. sapiens
agaggatcctgaaagc

SEQ ID NO: 34898 - DNA, 16 bp, H. sapiens
agaggatggcttgagc

SEQ ID NO: 34899 - DNA, 17 bp, H. sapiens
agaggatgggaaataaa

SEQ ID NO: 34900 - DNA, 16 bp, H. sapiens
agaggatgtgaagaaa

SEQ ID NO: 34901 - DNA, 16 bp, H. sapiens
agaggatgtggagaat

SEQ ID NO: 34902 - DNA, 16 bp, H. sapiens
agaggattacttgaac

SEQ ID NO: 34903 - DNA, 16 bp, H. sapiens
agaggatttaaagtat

SEQ ID NO: 34904 - DNA, 16 bp, H. sapiens
agaggattttaaatgt

SEQ ID NO: 34905 - DNA, 16 bp, H. sapiens
agaggcaaaagaaaat

SEQ ID NO: 34906 - DNA, 16 bp, H. sapiens
agaggcacatgccacc

SEQ ID NO: 34907 - DNA, 16 bp, H. sapiens
agaggcacctgccacc

SEQ ID NO: 34908 - DNA, 16 bp, H. sapiens
agaggcagaaattaga

SEQ ID NO: 34909 - DNA, 16 bp, H. sapiens
agaggcagaagctgca

SEQ ID NO: 34910 - DNA, 16 bp, H. sapiens
agaggcagaaggacag

SEQ ID NO: 34911 - DNA, 16 bp, H. sapiens
agaggcagaaggcaga

SEQ ID NO: 34912 - DNA, 16 bp, H. sapiens
agaggcagaatttgaa

SEQ ID NO: 34913 - DNA, 16 bp, H. sapiens
agaggcagacagatca

SEQ ID NO: 34914 - DNA, 16 bp, H. sapiens
agaggcagacaggcag

SEQ ID NO: 34915 - DNA, 16 bp, H. sapiens
agaggcagagacagag

SEQ ID NO: 34916 - DNA, 16 bp, H. sapiens
agaggcagagactgag

SEQ ID NO: 34917 - DNA, 16 bp, H. sapiens
agaggcagagccagga

SEQ ID NO: 34918 - DNA, 16 bp, H. sapiens
agaggcagagccctca

SEQ ID NO: 34919 - DNA, 16 bp, H. sapiens
agaggcagagctgccc

SEQ ID NO: 34920 - DNA, 16 bp, H. sapiens
agaggcagagctggaa

SEQ ID NO: 34921 - DNA, 16 bp, H. sapiens
agaggcagagggaggt

SEQ ID NO: 34922 - DNA, 16 bp, H. sapiens
agaggcagcagaggga

SEQ ID NO: 34923 - DNA, 16 bp, H. sapiens
agaggcagccaagtag

SEQ ID NO: 34924 - DNA, 16 bp, H. sapiens
agaggcagctgtttga

SEQ ID NO: 34925 - DNA, 18 bp, H. sapiens
agaggcaggagaatggcg

SEQ ID NO: 34926 - DNA, 16 bp, H. sapiens
agaggcaggaggatca

SEQ ID NO: 34927 - DNA, 16 bp, H. sapiens
agaggcaggattcaaa

SEQ ID NO: 34928 - DNA, 16 bp, H. sapiens
agaggcaggcagagag

SEQ ID NO: 34929 - DNA, 16 bp, H. sapiens
agaggcagggctgggg

SEQ ID NO: 34930 - DNA, 16 bp, H. sapiens
agaggcaggggctgtg

SEQ ID NO: 34931 - DNA, 16 bp, H. sapiens
agaggcagggttttgc

SEQ ID NO: 34932 - DNA, 17 bp, H. sapiens
agaggcaggtggattgc

SEQ ID NO: 34933 - DNA, 16 bp, H. sapiens
agaggcagtggcagaa

SEQ ID NO: 34934 - DNA, 16 bp, H. sapiens
agaggcattcccagaa

SEQ ID NO: 34935 - DNA, 16 bp, H. sapiens
agaggccaaagcagga

SEQ ID NO: 34936 - DNA, 16 bp, H. sapiens
agaggccaacagtcaa

SEQ ID NO: 34937 - DNA, 16 bp, H. sapiens
agaggccaaggcaaga

SEQ ID NO: 34938 - DNA, 16 bp, H. sapiens
agaggccaaggcgggc

SEQ ID NO: 34939 - DNA, 16 bp, H. sapiens
agaggccaaggcgggt

SEQ ID NO: 34940 - DNA, 16 bp, H. sapiens
agaggccaaggtgggc

SEQ ID NO: 34941 - DNA, 17 bp, H. sapiens
agaggccaaggtgggtg

SEQ ID NO: 34942 - DNA, 16 bp, H. sapiens
agaggccagaaggcag

SEQ ID NO: 34943 - DNA, 17 bp, H. sapiens
agaggccagacacggtg

SEQ ID NO: 34944 - DNA, 16 bp, H. sapiens
agaggccagaggccag

SEQ ID NO: 34945 - DNA, 16 bp, H. sapiens
agaggccaggcagcag

SEQ ID NO: 34946 - DNA, 16 bp, H. sapiens
agaggccaggcagtgg

SEQ ID NO: 34947 - DNA, 16 bp, H. sapiens
agaggccaggtgctgt

SEQ ID NO: 34948 - DNA, 16 bp, H. sapiens
agaggcccaggtggga

SEQ ID NO: 34949 - DNA, 16 bp, H. sapiens
agaggccccagagagc

SEQ ID NO: 34950 - DNA, 16 bp, H. sapiens
agaggccgaggcaggc

SEQ ID NO: 34951 - DNA, 16 bp, H. sapiens
agaggcctaggaggga

SEQ ID NO: 34952 - DNA, 16 bp, H. sapiens
agaggcctcaggagaa

SEQ ID NO: 34953 - DNA, 16 bp, H. sapiens
agaggcctcaggggaa

SEQ ID NO: 34954 - DNA, 16 bp, H. sapiens
agaggcctccactgtg

SEQ ID NO: 34955 - DNA, 16 bp, H. sapiens
agaggcctgaggaaaa

SEQ ID NO: 34956 - DNA, 16 bp, H. sapiens
agaggcctggcctctg

SEQ ID NO: 34957 - DNA, 16 bp, H. sapiens
agaggccttcctcttt

SEQ ID NO: 34958 - DNA, 16 bp, H. sapiens
agaggcgggaggatag

SEQ ID NO: 34959 - DNA, 16 bp, H. sapiens
agaggcggggtttcat

SEQ ID NO: 34960 - DNA, 16 bp, H. sapiens
agaggctaagaaactt

SEQ ID NO: 34961 - DNA, 16 bp, H. sapiens
agaggctaagaagtcc

SEQ ID NO: 34962 - DNA, 16 bp, H. sapiens
agaggctcaataaatg

SEQ ID NO: 34963 - DNA, 16 bp, H. sapiens
agaggctcatgtctgt

SEQ ID NO: 34964 - DNA, 19 bp, H. sapiens
agaggctcgaaaagcagca

SEQ ID NO: 34965 - DNA, 16 bp, H. sapiens
agaggctctccatgag

SEQ ID NO: 34966 - DNA, 16 bp, H. sapiens
agaggctctctgattt

SEQ ID NO: 34967 - DNA, 16 bp, H. sapiens
agaggctgaagcaaga

SEQ ID NO: 34968 - DNA, 16 bp, H. sapiens
agaggctgaagcagaa

SEQ ID NO: 34969 - DNA, 16 bp, H. sapiens
agaggctgaagcagga

SEQ ID NO: 34970 - DNA, 16 bp, H. sapiens
agaggctgaagcaggt

SEQ ID NO: 34971 - DNA, 16 bp, H. sapiens
agaggctgagaagggt

SEQ ID NO: 34972 - DNA, 16 bp, H. sapiens
agaggctgagacacga

SEQ ID NO: 34973 - DNA, 16 bp, H. sapiens
agaggctgagaggcag

SEQ ID NO: 34974 - DNA, 16 bp, H. sapiens
agaggctgagccagga

SEQ ID NO: 34975 - DNA, 16 bp, H. sapiens
agaggctgaggaaggc

SEQ ID NO: 34976 - DNA, 16 bp, H. sapiens
agaggctgaggagggc

SEQ ID NO: 34977 - DNA, 16 bp, H. sapiens
agaggctgaggcacaa

SEQ ID NO: 34978 - DNA, 16 bp, H. sapiens
agaggctgaggcagca

SEQ ID NO: 34979 - DNA, 16 bp, H. sapiens
agaggctgaggcaggc

SEQ ID NO: 34980 - DNA, 16 bp, H. sapiens
agaggctgaggcggga

SEQ ID NO: 34981 - DNA, 16 bp, H. sapiens
agaggctgagggagga

SEQ ID NO: 34982 - DNA, 16 bp, H. sapiens
agaggctgaggtagaa

SEQ ID NO: 34983 - DNA, 16 bp, H. sapiens
agaggctgaggtggga

SEQ ID NO: 34984 - DNA, 16 bp, H. sapiens
agaggctgcagaacaa

SEQ ID NO: 34985 - DNA, 16 bp, H. sapiens
agaggctgcagagagc

SEQ ID NO: 34986 - DNA, 19 bp, H. sapiens
agaggctgcagtgagctgt

SEQ ID NO: 34987 - DNA, 16 bp, H. sapiens
agaggctgcagtgagt

SEQ ID NO: 34988 - DNA, 16 bp, H. sapiens
agaggctgccatgaag

SEQ ID NO: 34989 - DNA, 16 bp, H. sapiens
agaggctggaacagtt

SEQ ID NO: 34990 - DNA, 16 bp, H. sapiens
agaggctggaagaatt

SEQ ID NO: 34991 - DNA, 16 bp, H. sapiens
agaggctggagaagag

SEQ ID NO: 34992 - DNA, 16 bp, H. sapiens
agaggctggaggagag

SEQ ID NO: 34993 - DNA, 16 bp, H. sapiens
agaggctggaggaggc

SEQ ID NO: 34994 - DNA, 16 bp, H. sapiens
agaggctgggaaagat

SEQ ID NO: 34995 - DNA, 16 bp, H. sapiens
agaggctgggaagggg

SEQ ID NO: 34996 - DNA, 16 bp, H. sapiens
agaggctgggaagggt

SEQ ID NO: 34997 - DNA, 16 bp, H. sapiens
agaggctgggaatggt

SEQ ID NO: 34998 - DNA, 16 bp, H. sapiens
agaggctgggcccagt

SEQ ID NO: 34999 - DNA, 16 bp, H. sapiens
agaggctggggaggag

SEQ ID NO: 35000 - DNA, 16 bp, H. sapiens
agaggctggggaggct

SEQ ID NO: 35001 - DNA, 16 bp, H. sapiens
agaggctggggagggt

SEQ ID NO: 35002 - DNA, 16 bp, H. sapiens
agaggctggggcagaa

SEQ ID NO: 35003 - DNA, 16 bp, H. sapiens
agaggctggggcagga

SEQ ID NO: 35004 - DNA, 16 bp, H. sapiens
agaggctgggggcaga

SEQ ID NO: 35005 - DNA, 20 bp, H. sapiens
agaggctgggtgcagtggct

SEQ ID NO: 35006 - DNA, 16 bp, H. sapiens
agaggctgtcttttcc

SEQ ID NO: 35007 - DNA, 16 bp, H. sapiens
agaggctgtgcccaca

SEQ ID NO: 35008 - DNA, 16 bp, H. sapiens
agaggcttcagagaga

SEQ ID NO: 35009 - DNA, 16 bp, H. sapiens
agaggcttcatctgca

SEQ ID NO: 35010 - DNA, 16 bp, H. sapiens
agaggcttccccagtt

SEQ ID NO: 35011 - DNA, 16 bp, H. sapiens
agaggcttgatcagat

SEQ ID NO: 35012 - DNA, 24 bp, H. sapiens
agaggcttggcagttccctgttag

SEQ ID NO: 35013 - DNA, 16 bp, H. sapiens
agaggcttttgaatgt

SEQ ID NO: 35014 - DNA, 16 bp, H. sapiens
agagggaaaaaaatca

SEQ ID NO: 35015 - DNA, 16 bp, H. sapiens
agagggaaaaatggtt

SEQ ID NO: 35016 - DNA, 16 bp, H. sapiens
agagggaaactctgtt

SEQ ID NO: 35017 - DNA, 16 bp, H. sapiens
agagggaaactgaggc

SEQ ID NO: 35018 - DNA, 16 bp, H. sapiens
agagggaaatttatac

SEQ ID NO: 35019 - DNA, 27 bp, H. sapiens
agagggaaatttatagcactaaatgcc

SEQ ID NO: 35020 - DNA, 16 bp, H. sapiens
agagggaagacacaga

SEQ ID NO: 35021 - DNA, 16 bp, H. sapiens
agagggaaggacaagt

SEQ ID NO: 35022 - DNA, 16 bp, H. sapiens
agagggaatcctccct

SEQ ID NO: 35023 - DNA, 16 bp, H. sapiens
agagggaattctgcct

SEQ ID NO: 35024 - DNA, 16 bp, H. sapiens
agagggacagaactaa

SEQ ID NO: 35025 - DNA, 16 bp, H. sapiens
agagggagaaaatatt

SEQ ID NO: 35026 - DNA, 16 bp, H. sapiens
agagggagaagatcag

SEQ ID NO: 35027 - DNA, 16 bp, H. sapiens
agagggagaagctgag

SEQ ID NO: 35028 - DNA, 16 bp, H. sapiens
agagggagacggagac

SEQ ID NO: 35029 - DNA, 16 bp, H. sapiens
agagggaggacacaga

SEQ ID NO: 35030 - DNA, 16 bp, H. sapiens
agagggaggacagagc

SEQ ID NO: 35031 - DNA, 16 bp, H. sapiens
agagggaggaggtgcc

SEQ ID NO: 35032 - DNA, 16 bp, H. sapiens
agagggaggcaggtgg

SEQ ID NO: 35033 - DNA, 16 bp, H. sapiens
agagggaggctggagg

SEQ ID NO: 35034 - DNA, 16 bp, H. sapiens
agagggcaaccttgtc

SEQ ID NO: 35035 - DNA, 16 bp, H. sapiens
agagggcaagcagaag

SEQ ID NO: 35036 - DNA, 16 bp, H. sapiens
agagggcaggctgcag

SEQ ID NO: 35037 - DNA, 16 bp, H. sapiens
agagggcaggggctgc

SEQ ID NO: 35038 - DNA, 16 bp, H. sapiens
agagggcatcctgtct

SEQ ID NO: 35039 - DNA, 16 bp, H. sapiens
agagggccaagcaggt

SEQ ID NO: 35040 - DNA, 16 bp, H. sapiens
agagggccaaggctct

SEQ ID NO: 35041 - DNA, 16 bp, H. sapiens
agagggccaggcatgg

SEQ ID NO: 35042 - DNA, 16 bp, H. sapiens
agagggccaggtgcag

SEQ ID NO: 35043 - DNA, 16 bp, H. sapiens
agagggccctgcccca

SEQ ID NO: 35044 - DNA, 16 bp, H. sapiens
agagggcctggcacac

SEQ ID NO: 35045 - DNA, 16 bp, H. sapiens
agagggcctgggagga

SEQ ID NO: 35046 - DNA, 16 bp, H. sapiens
agagggctgaggtggg

SEQ ID NO: 35047 - DNA, 16 bp, H. sapiens
agagggctggggagag

SEQ ID NO: 35048 - DNA, 16 bp, H. sapiens
agaggggagaggtgct

SEQ ID NO: 35049 - DNA, 16 bp, H. sapiens
agaggggaggtgccag

SEQ ID NO: 35050 - DNA, 16 bp, H. sapiens
agaggggcacccacca

SEQ ID NO: 35051 - DNA, 16 bp, H. sapiens
agaggggcctgattgt

SEQ ID NO: 35052 - DNA, 16 bp, H. sapiens
agaggggcttctggct

SEQ ID NO: 35053 - DNA, 74 bp, H. sapiens
agagggggatgtgtcagggtcacaagacaattgtggggagagggtcagcagacaaacacgtgaacaaaggtctt

SEQ ID NO: 35054 - DNA, 16 bp, H. sapiens
agagggggcttccagg

SEQ ID NO: 35055 - DNA, 16 bp, H. sapiens
agagggtaagtaactt

SEQ ID NO: 35056 - DNA, 16 bp, H. sapiens
agagggtctgtgggtt

SEQ ID NO: 35057 - DNA, 16 bp, H. sapiens
agagggtgagccaaag

SEQ ID NO: 35058 - DNA, 16 bp, H. sapiens
agagggtgcaagagaa

SEQ ID NO: 35059 - DNA, 16 bp, H. sapiens
agagggtgcaagtccc

SEQ ID NO: 35060 - DNA, 16 bp, H. sapiens
agagggtgcagtgagc

SEQ ID NO: 35061 - DNA, 16 bp, H. sapiens
agaggtaaaataattt

SEQ ID NO: 35062 - DNA, 16 bp, H. sapiens
agaggtaaagtaattt

SEQ ID NO: 35063 - DNA, 16 bp, H. sapiens
agaggtaaccactatt

SEQ ID NO: 35064 - DNA, 16 bp, H. sapiens
agaggtaatcaaatta

SEQ ID NO: 35065 - DNA, 16 bp, H. sapiens
agaggtacaaagaaga

SEQ ID NO: 35066 - DNA, 16 bp, H. sapiens
agaggtacaaagatga

SEQ ID NO: 35067 - DNA, 16 bp, H. sapiens
agaggtacaagcagga

SEQ ID NO: 35068 - DNA, 16 bp, H. sapiens
agaggtacatctaact

SEQ ID NO: 35069 - DNA, 16 bp, H. sapiens
agaggtagaatttgaa

SEQ ID NO: 35070 - DNA, 16 bp, H. sapiens
agaggtcactctcatt

SEQ ID NO: 35071 - DNA, 16 bp, H. sapiens
agaggtcagagaggga

SEQ ID NO: 35072 - DNA, 19 bp, H. sapiens
agaggtcaggagttcaaga

SEQ ID NO: 35073 - DNA, 16 bp, H. sapiens
agaggtcaggagtttg

SEQ ID NO: 35074 - DNA, 16 bp, H. sapiens
agaggtcagggatgct

SEQ ID NO: 35075 - DNA, 16 bp, H. sapiens
agaggtcagggcatgg

SEQ ID NO: 35076 - DNA, 18 bp, H. sapiens
agaggtcatccctgtctt

SEQ ID NO: 35077 - DNA, 16 bp, H. sapiens
agaggtcatgtgagca

SEQ ID NO: 35078 - DNA, 16 bp, H. sapiens
agaggtccaagatcaa

SEQ ID NO: 35079 - DNA, 16 bp, H. sapiens
agaggtccagtttcag

SEQ ID NO: 35080 - DNA, 16 bp, H. sapiens
agaggtctgtgccagg

SEQ ID NO: 35081 - DNA, 16 bp, H. sapiens
agaggtcttcatggaa

SEQ ID NO: 35082 - DNA, 16 bp, H. sapiens
agaggtcttcatggca

SEQ ID NO: 35083 - DNA, 16 bp, H. sapiens
agaggtgaagtgactt

SEQ ID NO: 35084 - DNA, 16 bp, H. sapiens
agaggtgacagagcag

SEQ ID NO: 35085 - DNA, 16 bp, H. sapiens
agaggtgacatttgaa

SEQ ID NO: 35086 - DNA, 16 bp, H. sapiens
agaggtgaggaagatg

SEQ ID NO: 35087 - DNA, 16 bp, H. sapiens
agaggtgccctcccta

SEQ ID NO: 35088 - DNA, 16 bp, H. sapiens
agaggtggaagaaaat

SEQ ID NO: 35089 - DNA, 16 bp, H. sapiens
agaggtggaatctaca

SEQ ID NO: 35090 - DNA, 16 bp, H. sapiens
agaggtggaggcagag

SEQ ID NO: 35091 - DNA, 16 bp, H. sapiens
agaggtggaggcagga

SEQ ID NO: 35092 - DNA, 16 bp, H. sapiens
agaggtggaggtggca

SEQ ID NO: 35093 - DNA, 16 bp, H. sapiens
agaggtggcagaggca

SEQ ID NO: 35094 - DNA, 16 bp, H. sapiens
agaggtggggctcaga

SEQ ID NO: 35095 - DNA, 16 bp, H. sapiens
agaggtggggttttac

SEQ ID NO: 35096 - DNA, 18 bp, H. sapiens
agaggtgggtggatcact

SEQ ID NO: 35097 - DNA, 16 bp, H. sapiens
agaggttaaataactt

SEQ ID NO: 35098 - DNA, 16 bp, H. sapiens
agaggttaagtaactt

SEQ ID NO: 35099 - DNA, 16 bp, H. sapiens
agaggttaggacttca

SEQ ID NO: 35100 - DNA, 16 bp, H. sapiens
agaggttcagtgactt

SEQ ID NO: 35101 - DNA, 22 bp, H. sapiens
agaggttcatccctacccttct

SEQ ID NO: 35102 - DNA, 16 bp, H. sapiens
agaggttccaagatgg

SEQ ID NO: 35103 - DNA, 16 bp, H. sapiens
agaggttgaggtggga

SEQ ID NO: 35104 - DNA, 16 bp, H. sapiens
agaggttgcagcgagc

SEQ ID NO: 35105 - DNA, 16 bp, H. sapiens
agaggttgcagtaagc

SEQ ID NO: 35106 - DNA, 16 bp, H. sapiens
agaggttgcagtgaga

SEQ ID NO: 35107 - DNA, 16 bp, H. sapiens
agaggttgcagtgagc

SEQ ID NO: 35108 - DNA, 16 bp, H. sapiens
agaggttgcagtgagt

SEQ ID NO: 35109 - DNA, 16 bp, H. sapiens
agaggttgcggtgagt

SEQ ID NO: 35110 - DNA, 22 bp, H. sapiens
agaggttgctgtgagctgagat

SEQ ID NO: 35111 - DNA, 16 bp, H. sapiens
agaggttggaagaatt

SEQ ID NO: 35112 - DNA, 16 bp, H. sapiens
agaggttggcagtgag

SEQ ID NO: 35113 - DNA, 16 bp, H. sapiens
agaggttgtagtgagc

SEQ ID NO: 35114 - DNA, 16 bp, H. sapiens
agaggtttaatagact

SEQ ID NO: 35115 - DNA, 16 bp, H. sapiens
agaggtttaatggaat

SEQ ID NO: 35116 - DNA, 16 bp, H. sapiens
agaggtttcagggagc

SEQ ID NO: 35117 - DNA, 16 bp, H. sapiens
agaggtttctggccag

SEQ ID NO: 35118 - DNA, 16 bp, H. sapiens
agaggtttttttcttt

SEQ ID NO: 35119 - DNA, 16 bp, H. sapiens
agagtaaacagacagc

SEQ ID NO: 35120 - DNA, 16 bp, H. sapiens
agagtaaacagataac

SEQ ID NO: 35121 - DNA, 16 bp, H. sapiens
agagtaaagaggactt

SEQ ID NO: 35122 - DNA, 16 bp, H. sapiens
agagtaacatgctgta

SEQ ID NO: 35123 - DNA, 16 bp, H. sapiens
agagtaaccaaaacag

SEQ ID NO: 35124 - DNA, 16 bp, H. sapiens
agagtaagaccctgtc

SEQ ID NO: 35125 - DNA, 17 bp, H. sapiens
agagtaagactcagtct

SEQ ID NO: 35126 - DNA, 16 bp, H. sapiens
agagtaagcagcagca

SEQ ID NO: 35127 - DNA, 31 bp, H. sapiens
agagtacaaaagagagaaattttaaagctgg

SEQ ID NO: 35128 - DNA, 16 bp, H. sapiens
agagtacccagaaata

SEQ ID NO: 35129 - DNA, 16 bp, H. sapiens
agagtagagtgactat

SEQ ID NO: 35130 - DNA, 16 bp, H. sapiens
agagtagctgagatta

SEQ ID NO: 35131 - DNA, 16 bp, H. sapiens
agagtagtggttttcc

SEQ ID NO: 35132 - DNA, 16 bp, H. sapiens
agagtatacatttttt

SEQ ID NO: 35133 - DNA, 16 bp, H. sapiens
agagtatatgcccttt

SEQ ID NO: 35134 - DNA, 16 bp, H. sapiens
agagtatcaggaaaaa

SEQ ID NO: 35135 - DNA, 16 bp, H. sapiens
agagtatttttttctt

SEQ ID NO: 35136 - DNA, 16 bp, H. sapiens
agagtcaaaggaatga

SEQ ID NO: 35137 - DNA, 16 bp, H. sapiens
agagtcaaatcaagaa

SEQ ID NO: 35138 - DNA, 16 bp, H. sapiens
agagtcaagattcaaa

SEQ ID NO: 35139 - DNA, 16 bp, H. sapiens
agagtcaagatttgaa

SEQ ID NO: 35140 - DNA, 16 bp, H. sapiens
agagtcagagaaagag

SEQ ID NO: 35141 - DNA, 16 bp, H. sapiens
agagtcagagacagag

SEQ ID NO: 35142 - DNA, 16 bp, H. sapiens
agagtcagagagagat

SEQ ID NO: 35143 - DNA, 16 bp, H. sapiens
agagtcagccaaggga

SEQ ID NO: 35144 - DNA, 16 bp, H. sapiens
agagtcaggatctcac

SEQ ID NO: 35145 - DNA, 19 bp, H. sapiens
agagtcagtgaagggagat

SEQ ID NO: 35146 - DNA, 16 bp, H. sapiens
agagtccaattaacaa

SEQ ID NO: 35147 - DNA, 16 bp, H. sapiens
agagtccacactgggg

SEQ ID NO: 35148 - DNA, 16 bp, H. sapiens
agagtccagaaacaaa

SEQ ID NO: 35149 - DNA, 16 bp, H. sapiens
agagtccagaaataaa

SEQ ID NO: 35150 - DNA, 16 bp, H. sapiens
agagtccatttcaaaa

SEQ ID NO: 35151 - DNA, 16 bp, H. sapiens
agagtccctactgggg

SEQ ID NO: 35152 - DNA, 16 bp, H. sapiens
agagtccctgtttccc

SEQ ID NO: 35153 - DNA, 16 bp, H. sapiens
agagtctacaaaaaga

SEQ ID NO: 35154 - DNA, 16 bp, H. sapiens
agagtctacaagaaac

SEQ ID NO: 35155 - DNA, 16 bp, H. sapiens
agagtctcaccatgtt

SEQ ID NO: 35156 - DNA, 16 bp, H. sapiens
agagtctcactgtgtc

SEQ ID NO: 35157 - DNA, 17 bp, H. sapiens
agagtctcgctctgtca

SEQ ID NO: 35158 - DNA, 17 bp, H. sapiens
agagtctcgctgtgtcg

SEQ ID NO: 35159 - DNA, 16 bp, H. sapiens
agagtctctctctctc

SEQ ID NO: 35160 - DNA, 16 bp, H. sapiens
agagtctctgtctcaa

SEQ ID NO: 35161 - DNA, 16 bp, H. sapiens
agagtctgtttcaaaa

SEQ ID NO: 35162 - DNA, 21 bp, H. sapiens
agagtcttctctaaactcccc

SEQ ID NO: 35163 - DNA, 17 bp, H. sapiens
agagtcttgctctgtcg

SEQ ID NO: 35164 - DNA, 16 bp, H. sapiens
agagtgaaaccctgtc

SEQ ID NO: 35165 - DNA, 16 bp, H. sapiens
agagtgaaacctcatc

SEQ ID NO: 35166 - DNA, 16 bp, H. sapiens
agagtgaaactgtgtc

SEQ ID NO: 35167 - DNA, 21 bp, H. sapiens
agagtgaacaggcaacctaca

SEQ ID NO: 35168 - DNA, 19 bp, H. sapiens
agagtgaacaggcaacctg

SEQ ID NO: 35169 - DNA, 16 bp, H. sapiens
agagtgaacatgcaac

SEQ ID NO: 35170 - DNA, 16 bp, H. sapiens
agagtgaactctgtct

SEQ ID NO: 35171 - DNA, 16 bp, H. sapiens
agagtgaccatatttt

SEQ ID NO: 35172 - DNA, 16 bp, H. sapiens
agagtgaccctgtctc

SEQ ID NO: 35173 - DNA, 16 bp, H. sapiens
agagtgacctctggtc

SEQ ID NO: 35174 - DNA, 16 bp, H. sapiens
agagtgagaaaaatgg

SEQ ID NO: 35175 - DNA, 16 bp, H. sapiens
agagtgagaacctgtc

SEQ ID NO: 35176 - DNA, 16 bp, H. sapiens
agagtgagaagcagca

SEQ ID NO: 35177 - DNA, 16 bp, H. sapiens
agagtgagaatctgtc

SEQ ID NO: 35178 - DNA, 16 bp, H. sapiens
agagtgagacactgtc

SEQ ID NO: 35179 - DNA, 16 bp, H. sapiens
agagtgagaccctgtt

SEQ ID NO: 35180 - DNA, 17 bp, H. sapiens
agagtgagactcagtct

SEQ ID NO: 35181 - DNA, 17 bp, H. sapiens
agagtgagactccgttt

SEQ ID NO: 35182 - DNA, 16 bp, H. sapiens
agagtgagactctgta

SEQ ID NO: 35183 - DNA, 16 bp, H. sapiens
agagtgagactgtgtc

SEQ ID NO: 35184 - DNA, 17 bp, H. sapiens
agagtgagacttcatct

SEQ ID NO: 35185 - DNA, 17 bp, H. sapiens
agagtgagacttcgtct

SEQ ID NO: 35186 - DNA, 17 bp, H. sapiens
agagtgagatcctgtca

SEQ ID NO: 35187 - DNA, 17 bp, H. sapiens
agagtgagattccatct

SEQ ID NO: 35188 - DNA, 16 bp, H. sapiens
agagtgagattccgtc

SEQ ID NO: 35189 - DNA, 16 bp, H. sapiens
agagtgagattccttc

SEQ ID NO: 35190 - DNA, 16 bp, H. sapiens
agagtgaggctctgtc

SEQ ID NO: 35191 - DNA, 16 bp, H. sapiens
agagtgagggcctgag

SEQ ID NO: 35192 - DNA, 16 bp, H. sapiens
agagtgagtgagtgtg

SEQ ID NO: 35193 - DNA, 16 bp, H. sapiens
agagtgatatcctgtc

SEQ ID NO: 35194 - DNA, 16 bp, H. sapiens
agagtgcaatgatgtg

SEQ ID NO: 35195 - DNA, 16 bp, H. sapiens
agagtgcaatggcgca

SEQ ID NO: 35196 - DNA, 16 bp, H. sapiens
agagtgcagagatgcc

SEQ ID NO: 35197 - DNA, 16 bp, H. sapiens
agagtgcagtggcgca

SEQ ID NO: 35198 - DNA, 16 bp, H. sapiens
agagtgcagtggtatg

SEQ ID NO: 35199 - DNA, 17 bp, H. sapiens
agagtgcagtggtgtga

SEQ ID NO: 35200 - DNA, 16 bp, H. sapiens
agagtgccgactggtg

SEQ ID NO: 35201 - DNA, 16 bp, H. sapiens
agagtgccgattggtg

SEQ ID NO: 35202 - DNA, 16 bp, H. sapiens
agagtgcctagcacat

SEQ ID NO: 35203 - DNA, 16 bp, H. sapiens
agagtggaagaaaatc

SEQ ID NO: 35204 - DNA, 16 bp, H. sapiens
agagtggaagcaggaa

SEQ ID NO: 35205 - DNA, 16 bp, H. sapiens
agagtggaaggatggt

SEQ ID NO: 35206 - DNA, 16 bp, H. sapiens
agagtggcaagctgaa

SEQ ID NO: 35207 - DNA, 16 bp, H. sapiens
agagtggcagagcagc

SEQ ID NO: 35208 - DNA, 16 bp, H. sapiens
agagtgggagaaaatg

SEQ ID NO: 35209 - DNA, 16 bp, H. sapiens
agagtgggagaaaatt

SEQ ID NO: 35210 - DNA, 16 bp, H. sapiens
agagtgggagagatta

SEQ ID NO: 35211 - DNA, 16 bp, H. sapiens
agagtgggcaaacagg

SEQ ID NO: 35212 - DNA, 16 bp, H. sapiens
agagtgtaattgaatt

SEQ ID NO: 35213 - DNA, 16 bp, H. sapiens
agagtgtgtgtgtgtg

SEQ ID NO: 35214 - DNA, 16 bp, H. sapiens
agagtgtttccaactt

SEQ ID NO: 35215 - DNA, 16 bp, H. sapiens
agagtgttttcccact

SEQ ID NO: 35216 - DNA, 16 bp, H. sapiens
agagttaaaacttcct

SEQ ID NO: 35217 - DNA, 16 bp, H. sapiens
agagttaaaactttct

SEQ ID NO: 35218 - DNA, 16 bp, H. sapiens
agagttaaatgaaata

SEQ ID NO: 35219 - DNA, 16 bp, H. sapiens
agagttaccacattat

SEQ ID NO: 35220 - DNA, 16 bp, H. sapiens
agagttaggtgaaatt

SEQ ID NO: 35221 - DNA, 16 bp, H. sapiens
agagttattgtgaaga

SEQ ID NO: 35222 - DNA, 16 bp, H. sapiens
agagttcaaaaccagc

SEQ ID NO: 35223 - DNA, 18 bp, H. sapiens
agagttcaagatcagcct

SEQ ID NO: 35224 - DNA, 16 bp, H. sapiens
agagttcaagcaattc

SEQ ID NO: 35225 - DNA, 16 bp, H. sapiens
agagttcaagcccagc

SEQ ID NO: 35226 - DNA, 18 bp, H. sapiens
agagttcaaggccagcct

SEQ ID NO: 35227 - DNA, 16 bp, H. sapiens
agagttcagtggcatg

SEQ ID NO: 35228 - DNA, 16 bp, H. sapiens
agagttcatgttccct

SEQ ID NO: 35229 - DNA, 16 bp, H. sapiens
agagttccacaaatct

SEQ ID NO: 35230 - DNA, 16 bp, H. sapiens
agagttcctgaaggaa

SEQ ID NO: 35231 - DNA, 16 bp, H. sapiens
agagttctcaaagaac

SEQ ID NO: 35232 - DNA, 16 bp, H. sapiens
agagttctcctttctc

SEQ ID NO: 35233 - DNA, 16 bp, H. sapiens
agagttctgatggaga

SEQ ID NO: 35234 - DNA, 16 bp, H. sapiens
agagttcttgcattgg

SEQ ID NO: 35235 - DNA, 16 bp, H. sapiens
agagttgagattcaaa

SEQ ID NO: 35236 - DNA, 16 bp, H. sapiens
agagttgggactttca

SEQ ID NO: 35237 - DNA, 16 bp, H. sapiens
agagttgtatgagagt

SEQ ID NO: 35238 - DNA, 16 bp, H. sapiens
agagttgtgcaaacat

SEQ ID NO: 35239 - DNA, 16 bp, H. sapiens
agagttgtgcaaccat

SEQ ID NO: 35240 - DNA, 16 bp, H. sapiens
agagtttaaaaatatt

SEQ ID NO: 35241 - DNA, 16 bp, H. sapiens
agagtttaaataattt

SEQ ID NO: 35242 - DNA, 16 bp, H. sapiens
agagtttacttttttt

SEQ ID NO: 35243 - DNA, 16 bp, H. sapiens
agagtttagaaataga

SEQ ID NO: 35244 - DNA, 16 bp, H. sapiens
agagtttatttgagca

SEQ ID NO: 35245 - DNA, 16 bp, H. sapiens
agagtttatttttaaa

SEQ ID NO: 35246 - DNA, 16 bp, H. sapiens
agagtttcactctgtc

SEQ ID NO: 35247 - DNA, 16 bp, H. sapiens
agagtttcagtttctc

SEQ ID NO: 35248 - DNA, 16 bp, H. sapiens
agagtttcagttttgg

SEQ ID NO: 35249 - DNA, 16 bp, H. sapiens
agagtttcattttttt

SEQ ID NO: 35250 - DNA, 16 bp, H. sapiens
agagtttctgctgaga

SEQ ID NO: 35251 - DNA, 16 bp, H. sapiens
agagtttcttccatct

SEQ ID NO: 35252 - DNA, 16 bp, H. sapiens
agagtttgacttcctc

SEQ ID NO: 35253 - DNA, 20 bp, H. sapiens
agagtttgagaccagcttgg

SEQ ID NO: 35254 - DNA, 16 bp, H. sapiens
agagtttgctgtgagc

SEQ ID NO: 35255 - DNA, 16 bp, H. sapiens
agagttttacttcttt

SEQ ID NO: 35256 - DNA, 16 bp, H. sapiens
agagttttataaaata

SEQ ID NO: 35257 - DNA, 16 bp, H. sapiens
agagttttatcatgaa

SEQ ID NO: 35258 - DNA, 16 bp, H. sapiens
agagttttatctataa

SEQ ID NO: 35259 - DNA, 16 bp, H. sapiens
agagttttattagttt

SEQ ID NO: 35260 - DNA, 16 bp, H. sapiens
agagttttctacatat

SEQ ID NO: 35261 - DNA, 16 bp, H. sapiens
agagttttctttcttt

SEQ ID NO: 35262 - DNA, 16 bp, H. sapiens
agagttttgttttctt

SEQ ID NO: 35263 - DNA, 16 bp, H. sapiens
agagtttttaacctga

SEQ ID NO: 35264 - DNA, 16 bp, H. sapiens
agagtttttatagttt

SEQ ID NO: 35265 - DNA, 16 bp, H. sapiens
agagtttttattatga

SEQ ID NO: 35266 - DNA, 16 bp, H. sapiens
agagtttttttaaaaa

SEQ ID NO: 35267 - DNA, 16 bp, H. sapiens
agataaaaactatttt

SEQ ID NO: 35268 - DNA, 16 bp, H. sapiens
agataaaaactgtaaa

SEQ ID NO: 35269 - DNA, 16 bp, H. sapiens
agataaaaatgcaaat

SEQ ID NO: 35270 - DNA, 16 bp, H. sapiens
agataaaacagacttt

SEQ ID NO: 35271 - DNA, 16 bp, H. sapiens
agataaaactttcttt

SEQ ID NO: 35272 - DNA, 16 bp, H. sapiens
agataaaagaaaatct

SEQ ID NO: 35273 - DNA, 16 bp, H. sapiens
agataaaataaacttt

SEQ ID NO: 35274 - DNA, 16 bp, H. sapiens
agataaaatgaatttt

SEQ ID NO: 35275 - DNA, 16 bp, H. sapiens
agataaaatgatgaga

SEQ ID NO: 35276 - DNA, 16 bp, H. sapiens
agataaacctggagga

SEQ ID NO: 35277 - DNA, 16 bp, H. sapiens
agataaagaaaacatg

SEQ ID NO: 35278 - DNA, 16 bp, H. sapiens
agataaagaaaatgtg

SEQ ID NO: 35279 - DNA, 16 bp, H. sapiens
agataaagaaactgag

SEQ ID NO: 35280 - DNA, 16 bp, H. sapiens
agataaagagaaaatc

SEQ ID NO: 35281 - DNA, 16 bp, H. sapiens
agataaagattttttt

SEQ ID NO: 35282 - DNA, 16 bp, H. sapiens
agataaagggcatcca

SEQ ID NO: 35283 - DNA, 16 bp, H. sapiens
agataaatggaacaga

SEQ ID NO: 35284 - DNA, 16 bp, H. sapiens
agataaatgtttattt

SEQ ID NO: 35285 - DNA, 16 bp, H. sapiens
agataacattggaaaa

SEQ ID NO: 35286 - DNA, 16 bp, H. sapiens
agataaccacctttaa

SEQ ID NO: 35287 - DNA, 16 bp, H. sapiens
agataacttgttttct

SEQ ID NO: 35288 - DNA, 16 bp, H. sapiens
agataagaaaacagag

SEQ ID NO: 35289 - DNA, 16 bp, H. sapiens
agataagaaaactgag

SEQ ID NO: 35290 - DNA, 16 bp, H. sapiens
agataagaaacttgtt

SEQ ID NO: 35291 - DNA, 16 bp, H. sapiens
agataagcagagagcc

SEQ ID NO: 35292 - DNA, 16 bp, H. sapiens
agataaggaaaccaag

SEQ ID NO: 35293 - DNA, 16 bp, H. sapiens
agataaggaaactgag

SEQ ID NO: 35294 - DNA, 16 bp, H. sapiens
agataaggaaattgaa

SEQ ID NO: 35295 - DNA, 16 bp, H. sapiens
agataagggaacttca

SEQ ID NO: 35296 - DNA, 16 bp, H. sapiens
agataataaacaagta

SEQ ID NO: 35297 - DNA, 16 bp, H. sapiens
agataataaatgtatg

SEQ ID NO: 35298 - DNA, 16 bp, H. sapiens
agataatacattttta

SEQ ID NO: 35299 - DNA, 16 bp, H. sapiens
agataatatattcaaa

SEQ ID NO: 35300 - DNA, 16 bp, H. sapiens
agataatctatgtaaa

SEQ ID NO: 35301 - DNA, 16 bp, H. sapiens
agataatgaatgtaaa

SEQ ID NO: 35302 - DNA, 16 bp, H. sapiens
agataatgattcctct

SEQ ID NO: 35303 - DNA, 16 bp, H. sapiens
agataatggatatgtt

SEQ ID NO: 35304 - DNA, 16 bp, H. sapiens
agataatgtatatgaa

SEQ ID NO: 35305 - DNA, 16 bp, H. sapiens
agataattcagaaaaa

SEQ ID NO: 35306 - DNA, 16 bp, H. sapiens
agataattctcaaaag

SEQ ID NO: 35307 - DNA, 16 bp, H. sapiens
agataatttatgtaaa

SEQ ID NO: 35308 - DNA, 16 bp, H. sapiens
agataatttctttcta

SEQ ID NO: 35309 - DNA, 16 bp, H. sapiens
agataattttcatatt

SEQ ID NO: 35310 - DNA, 16 bp, H. sapiens
agataattttgaagaa

SEQ ID NO: 35311 - DNA, 16 bp, H. sapiens
agataattttgcttct

SEQ ID NO: 35312 - DNA, 16 bp, H. sapiens
agatacaaaaatcaat

SEQ ID NO: 35313 - DNA, 16 bp, H. sapiens
agatacaaaaattctt

SEQ ID NO: 35314 - DNA, 16 bp, H. sapiens
agatacaaagatgaat

SEQ ID NO: 35315 - DNA, 18 bp, H. sapiens
agatacaaaggttctcca

SEQ ID NO: 35316 - DNA, 16 bp, H. sapiens
agatacaaagtattga

SEQ ID NO: 35317 - DNA, 16 bp, H. sapiens
agatacaaagtcaaca

SEQ ID NO: 35318 - DNA, 16 bp, H. sapiens
agatacaaataaaatt

SEQ ID NO: 35319 - DNA, 16 bp, H. sapiens
agatacaatgcaaaaa

SEQ ID NO: 35320 - DNA, 16 bp, H. sapiens
agatacaattttattt

SEQ ID NO: 35321 - DNA, 16 bp, H. sapiens
agatacacaatataaa

SEQ ID NO: 35322 - DNA, 16 bp, H. sapiens
agatacagaaataaat

SEQ ID NO: 35323 - DNA, 16 bp, H. sapiens
agatacagaaataata

SEQ ID NO: 35324 - DNA, 16 bp, H. sapiens
agatacagaaatgaat

SEQ ID NO: 35325 - DNA, 16 bp, H. sapiens
agatacagatacagat

SEQ ID NO: 35326 - DNA, 16 bp, H. sapiens
agatacagatagatag

SEQ ID NO: 35327 - DNA, 30 bp, H. sapiens
agatacagcattacctggaaagaagctaaa

SEQ ID NO: 35328 - DNA, 16 bp, H. sapiens
agatacaggaagctca

SEQ ID NO: 35329 - DNA, 16 bp, H. sapiens
agatacatacatatat

SEQ ID NO: 35330 - DNA, 16 bp, H. sapiens
agatacatgctgaaat

SEQ ID NO: 35331 - DNA, 16 bp, H. sapiens
agatacattttttaaa

SEQ ID NO: 35332 - DNA, 16 bp, H. sapiens
agataccaccacacac

SEQ ID NO: 35333 - DNA, 16 bp, H. sapiens
agataccacttcacat

SEQ ID NO: 35334 - DNA, 16 bp, H. sapiens
agataccatctcaggc

SEQ ID NO: 35335 - DNA, 16 bp, H. sapiens
agataccatcttatgc

SEQ ID NO: 35336 - DNA, 16 bp, H. sapiens
agatactcaaaaatgt

SEQ ID NO: 35337 - DNA, 16 bp, H. sapiens
agatactgaaacattt

SEQ ID NO: 35338 - DNA, 16 bp, H. sapiens
agatactgccaaattg

SEQ ID NO: 35339 - DNA, 16 bp, H. sapiens
agatactggtgccatg

SEQ ID NO: 35340 - DNA, 16 bp, H. sapiens
agatactgtgtttttt

SEQ ID NO: 35341 - DNA, 16 bp, H. sapiens
agatacttctcaaaat

SEQ ID NO: 35342 - DNA, 16 bp, H. sapiens
agatactttgttttct

SEQ ID NO: 35343 - DNA, 16 bp, H. sapiens
agatacttttcaaaag

SEQ ID NO: 35344 - DNA, 16 bp, H. sapiens
agatagaaaaactgaa

SEQ ID NO: 35345 - DNA, 16 bp, H. sapiens
agatagaaatatttat

SEQ ID NO: 35346 - DNA, 16 bp, H. sapiens
agatagatagaagata

SEQ ID NO: 35347 - DNA, 16 bp, H. sapiens
agatagatagatatac

SEQ ID NO: 35348 - DNA, 16 bp, H. sapiens
agatagatagtaaata

SEQ ID NO: 35349 - DNA, 16 bp, H. sapiens
agatagccaggcccct

SEQ ID NO: 35350 - DNA, 16 bp, H. sapiens
agatagcgccactgca

SEQ ID NO: 35351 - DNA, 16 bp, H. sapiens
agatagcttcctgaaa

SEQ ID NO: 35352 - DNA, 16 bp, H. sapiens
agataggagaaaacca

SEQ ID NO: 35353 - DNA, 16 bp, H. sapiens
agatagggaaactgaa

SEQ ID NO: 35354 - DNA, 16 bp, H. sapiens
agatagggtcttgcta

SEQ ID NO: 35355 - DNA, 16 bp, H. sapiens
agataggtaggtagat

SEQ ID NO: 35356 - DNA, 16 bp, H. sapiens
agatagtaaatatttt

SEQ ID NO: 35357 - DNA, 16 bp, H. sapiens
agatagtaaatgtttt

SEQ ID NO: 35358 - DNA, 16 bp, H. sapiens
agatagtgaaaatagt

SEQ ID NO: 35359 - DNA, 16 bp, H. sapiens
agatagtgagcatagt

SEQ ID NO: 35360 - DNA, 16 bp, H. sapiens
agatagtgatgatggt

SEQ ID NO: 35361 - DNA, 16 bp, H. sapiens
agatagtgattttatt

SEQ ID NO: 35362 - DNA, 16 bp, H. sapiens
agatataaaatataca

SEQ ID NO: 35363 - DNA, 16 bp, H. sapiens
agatataaacagaaac

SEQ ID NO: 35364 - DNA, 16 bp, H. sapiens
agatataaagcaaata

SEQ ID NO: 35365 - DNA, 16 bp, H. sapiens
agatataatccacata

SEQ ID NO: 35366 - DNA, 16 bp, H. sapiens
agatataatttttctt

SEQ ID NO: 35367 - DNA, 16 bp, H. sapiens
agatatatatatggat

SEQ ID NO: 35368 - DNA, 16 bp, H. sapiens
agatatattatgcaaa

SEQ ID NO: 35369 - DNA, 16 bp, H. sapiens
agatatattatttgca

SEQ ID NO: 35370 - DNA, 16 bp, H. sapiens
agatatcaatatttaa

SEQ ID NO: 35371 - DNA, 16 bp, H. sapiens
agatatcaggagaaag

SEQ ID NO: 35372 - DNA, 16 bp, H. sapiens
agatatctatctatat

SEQ ID NO: 35373 - DNA, 16 bp, H. sapiens
agatatctgcactctc

SEQ ID NO: 35374 - DNA, 16 bp, H. sapiens
agatatgacactaaaa

SEQ ID NO: 35375 - DNA, 16 bp, H. sapiens
agatatgcaaatactt

SEQ ID NO: 35376 - DNA, 16 bp, H. sapiens
agatatgcaaattaaa

SEQ ID NO: 35377 - DNA, 16 bp, H. sapiens
agatatgggaaagttt

SEQ ID NO: 35378 - DNA, 16 bp, H. sapiens
agatatgtacaagaat

SEQ ID NO: 35379 - DNA, 16 bp, H. sapiens
agatatgtatacatat

SEQ ID NO: 35380 - DNA, 16 bp, H. sapiens
agatatgtattatata

SEQ ID NO: 35381 - DNA, 16 bp, H. sapiens
agatatgtgatttgaa

SEQ ID NO: 35382 - DNA, 16 bp, H. sapiens
agatattaattggatt

SEQ ID NO: 35383 - DNA, 16 bp, H. sapiens
agatattacaagaaaa

SEQ ID NO: 35384 - DNA, 16 bp, H. sapiens
agatattaggcctttg

SEQ ID NO: 35385 - DNA, 23 bp, H. sapiens
agatattatccaggagaacttcc

SEQ ID NO: 35386 - DNA, 16 bp, H. sapiens
agatattattattatc

SEQ ID NO: 35387 - DNA, 16 bp, H. sapiens
agatattcaacacttc

SEQ ID NO: 35388 - DNA, 16 bp, H. sapiens
agatattcaacttctt

SEQ ID NO: 35389 - DNA, 16 bp, H. sapiens
agatattccttctaag

SEQ ID NO: 35390 - DNA, 16 bp, H. sapiens
agatattggaattcct

SEQ ID NO: 35391 - DNA, 16 bp, H. sapiens
agatattgtgtgtgtg

SEQ ID NO: 35392 - DNA, 16 bp, H. sapiens
agatatttataaaaca

SEQ ID NO: 35393 - DNA, 16 bp, H. sapiens
agatatttattttaag

SEQ ID NO: 35394 - DNA, 16 bp, H. sapiens
agatatttcaaagaaa

SEQ ID NO: 35395 - DNA, 16 bp, H. sapiens
agatatttcacatttt

SEQ ID NO: 35396 - DNA, 16 bp, H. sapiens
agatatttcataattt

SEQ ID NO: 35397 - DNA, 16 bp, H. sapiens
agatatttcattaaaa

SEQ ID NO: 35398 - DNA, 16 bp, H. sapiens
agatatttcattttca

SEQ ID NO: 35399 - DNA, 16 bp, H. sapiens
agatattttaaaatgt

SEQ ID NO: 35400 - DNA, 16 bp, H. sapiens
agatattttaagtaaa

SEQ ID NO: 35401 - DNA, 16 bp, H. sapiens
agatattttaatttca

SEQ ID NO: 35402 - DNA, 16 bp, H. sapiens
agatattttacaaaat

SEQ ID NO: 35403 - DNA, 16 bp, H. sapiens
agatattttagttttc

SEQ ID NO: 35404 - DNA, 16 bp, H. sapiens
agatattttatacata

SEQ ID NO: 35405 - DNA, 16 bp, H. sapiens
agatattttatttgaa

SEQ ID NO: 35406 - DNA, 16 bp, H. sapiens
agatattttcaaaatt

SEQ ID NO: 35407 - DNA, 16 bp, H. sapiens
agatattttcatattt

SEQ ID NO: 35408 - DNA, 16 bp, H. sapiens
agatattttctaaatt

SEQ ID NO: 35409 - DNA, 16 bp, H. sapiens
agatattttctccatt

SEQ ID NO: 35410 - DNA, 16 bp, H. sapiens
agatattttcttagta

SEQ ID NO: 35411 - DNA, 16 bp, H. sapiens
agatatttttaaaaca

SEQ ID NO: 35412 - DNA, 16 bp, H. sapiens
agatatttttaaagaa

SEQ ID NO: 35413 - DNA, 16 bp, H. sapiens
agatatttttcttcca

SEQ ID NO: 35414 - DNA, 16 bp, H. sapiens
agatatttttgaaata

SEQ ID NO: 35415 - DNA, 16 bp, H. sapiens
agatatttttttcctt

SEQ ID NO: 35416 - DNA, 16 bp, H. sapiens
agatcaaaaacactgt

SEQ ID NO: 35417 - DNA, 16 bp, H. sapiens
agatcaaaccaatgta

SEQ ID NO: 35418 - DNA, 16 bp, H. sapiens
agatcaaagaagaaat

SEQ ID NO: 35419 - DNA, 16 bp, H. sapiens
agatcaaagcactggc

SEQ ID NO: 35420 - DNA, 18 bp, H. sapiens
agatcaaattcacacata

SEQ ID NO: 35421 - DNA, 16 bp, H. sapiens
agatcaacctgggcaa

SEQ ID NO: 35422 - DNA, 16 bp, H. sapiens
agatcaacgcagaagg

SEQ ID NO: 35423 - DNA, 16 bp, H. sapiens
agatcaagaaagacaa

SEQ ID NO: 35424 - DNA, 16 bp, H. sapiens
agatcaagaaatagaa

SEQ ID NO: 35425 - DNA, 16 bp, H. sapiens
agatcaagcagaagaa

SEQ ID NO: 35426 - DNA, 16 bp, H. sapiens
agatcaaggaggcctg

SEQ ID NO: 35427 - DNA, 16 bp, H. sapiens
agatcaagggaacaga

SEQ ID NO: 35428 - DNA, 16 bp, H. sapiens
agatcaaggtgtcagc

SEQ ID NO: 35429 - DNA, 16 bp, H. sapiens
agatcaaggtgtgggc

SEQ ID NO: 35430 - DNA, 16 bp, H. sapiens
agatcaatggacacaa

SEQ ID NO: 35431 - DNA, 16 bp, H. sapiens
agatcacaacactgca

SEQ ID NO: 35432 - DNA, 16 bp, H. sapiens
agatcacaagggcagg

SEQ ID NO: 35433 - DNA, 16 bp, H. sapiens
agatcacaccactcac

SEQ ID NO: 35434 - DNA, 16 bp, H. sapiens
agatcaccaagacaga

SEQ ID NO: 35435 - DNA, 16 bp, H. sapiens
agatcaccaggtcaag

SEQ ID NO: 35436 - DNA, 16 bp, H. sapiens
agatcacctgaggtcc

SEQ ID NO: 35437 - DNA, 16 bp, H. sapiens
agatcacgccactcca

SEQ ID NO: 35438 - DNA, 16 bp, H. sapiens
agatcacgccatagca

SEQ ID NO: 35439 - DNA, 16 bp, H. sapiens
agatcactaaaactta

SEQ ID NO: 35440 - DNA, 16 bp, H. sapiens
agatcactccagcctg

SEQ ID NO: 35441 - DNA, 16 bp, H. sapiens
agatcactgcagcctc

SEQ ID NO: 35442 - DNA, 16 bp, H. sapiens
agatcactgcagcttc

SEQ ID NO: 35443 - DNA, 16 bp, H. sapiens
agatcactggagccca

SEQ ID NO: 35444 - DNA, 17 bp, H. sapiens
agatcacttgaggccaa

SEQ ID NO: 35445 - DNA, 16 bp, H. sapiens
agatcacttgaggtcg

SEQ ID NO: 35446 - DNA, 16 bp, H. sapiens
agatcacttgatccca

SEQ ID NO: 35447 - DNA, 16 bp, H. sapiens
agatcacttggggtca

SEQ ID NO: 35448 - DNA, 16 bp, H. sapiens
agatcagaaatgaaag

SEQ ID NO: 35449 - DNA, 16 bp, H. sapiens
agatcagacactaacc

SEQ ID NO: 35450 - DNA, 16 bp, H. sapiens
agatcagactggccaa

SEQ ID NO: 35451 - DNA, 16 bp, H. sapiens
agatcagagaagaatt

SEQ ID NO: 35452 - DNA, 16 bp, H. sapiens
agatcagagagttgta

SEQ ID NO: 35453 - DNA, 16 bp, H. sapiens
agatcagagcagaaag

SEQ ID NO: 35454 - DNA, 16 bp, H. sapiens
agatcagagtgccagc

SEQ ID NO: 35455 - DNA, 16 bp, H. sapiens
agatcagatggtttta

SEQ ID NO: 35456 - DNA, 16 bp, H. sapiens
agatcagattgttgta

SEQ ID NO: 35457 - DNA, 16 bp, H. sapiens
agatcagatttttttt

SEQ ID NO: 35458 - DNA, 16 bp, H. sapiens
agatcagcctaggcaa

SEQ ID NO: 35459 - DNA, 16 bp, H. sapiens
agatcagcctgaccaa

SEQ ID NO: 35460 - DNA, 16 bp, H. sapiens
agatcagcctggccaa

SEQ ID NO: 35461 - DNA, 18 bp, H. sapiens
agatcagcctggctaaca

SEQ ID NO: 35462 - DNA, 16 bp, H. sapiens
agatcagcctgggcaa

SEQ ID NO: 35463 - DNA, 16 bp, H. sapiens
agatcagcctgtccaa

SEQ ID NO: 35464 - DNA, 17 bp, H. sapiens
agatcagctgcagacaa

SEQ ID NO: 35465 - DNA, 16 bp, H. sapiens
agatcagcttaggcaa

SEQ ID NO: 35466 - DNA, 16 bp, H. sapiens
agatcagcttggacaa

SEQ ID NO: 35467 - DNA, 16 bp, H. sapiens
agatcagcttggccaa

SEQ ID NO: 35468 - DNA, 16 bp, H. sapiens
agatcaggaacaagac

SEQ ID NO: 35469 - DNA, 16 bp, H. sapiens
agatcaggagactgag

SEQ ID NO: 35470 - DNA, 16 bp, H. sapiens
agatcaggagtttgaa

SEQ ID NO: 35471 - DNA, 16 bp, H. sapiens
agatcaggcatttcca

SEQ ID NO: 35472 - DNA, 16 bp, H. sapiens
agatcaggccaggcac

SEQ ID NO: 35473 - DNA, 16 bp, H. sapiens
agatcaggggttgcca

SEQ ID NO: 35474 - DNA, 16 bp, H. sapiens
agatcagtctgggcaa

SEQ ID NO: 35475 - DNA, 16 bp, H. sapiens
agatcagtggtcccca

SEQ ID NO: 35476 - DNA, 16 bp, H. sapiens
agatcatagcagaact

SEQ ID NO: 35477 - DNA, 16 bp, H. sapiens
agatcatatggtagtt

SEQ ID NO: 35478 - DNA, 16 bp, H. sapiens
agatcatcaagacaga

SEQ ID NO: 35479 - DNA, 18 bp, H. sapiens
agatcatcagccagggcc

SEQ ID NO: 35480 - DNA, 16 bp, H. sapiens
agatcatcaggcatta

SEQ ID NO: 35481 - DNA, 16 bp, H. sapiens
agatcatccaggaaaa

SEQ ID NO: 35482 - DNA, 16 bp, H. sapiens
agatcatcccactgca

SEQ ID NO: 35483 - DNA, 16 bp, H. sapiens
agatcatcctggccaa

SEQ ID NO: 35484 - DNA, 18 bp, H. sapiens
agatcatcctggctaaca

SEQ ID NO: 35485 - DNA, 16 bp, H. sapiens
agatcatgaaggtgga

SEQ ID NO: 35486 - DNA, 16 bp, H. sapiens
agatcatgagtgaact

SEQ ID NO: 35487 - DNA, 18 bp, H. sapiens
agatcatgctactgcact

SEQ ID NO: 35488 - DNA, 16 bp, H. sapiens
agatcatgggacttct

SEQ ID NO: 35489 - DNA, 16 bp, H. sapiens
agatcatgtctctgca

SEQ ID NO: 35490 - DNA, 16 bp, H. sapiens
agatcattcagtattt

SEQ ID NO: 35491 - DNA, 16 bp, H. sapiens
agatcatttacattca

SEQ ID NO: 35492 - DNA, 16 bp, H. sapiens
agatcatttgaaccca

SEQ ID NO: 35493 - DNA, 16 bp, H. sapiens
agatcattttggaatt

SEQ ID NO: 35494 - DNA, 16 bp, H. sapiens
agatccaagaagagaa

SEQ ID NO: 35495 - DNA, 16 bp, H. sapiens
agatccaatggtgctt

SEQ ID NO: 35496 - DNA, 16 bp, H. sapiens
agatccaccccctgcc

SEQ ID NO: 35497 - DNA, 16 bp, H. sapiens
agatccacctgcctca

SEQ ID NO: 35498 - DNA, 17 bp, H. sapiens
agatccactgacagctt

SEQ ID NO: 35499 - DNA, 16 bp, H. sapiens
agatccagagagaaga

SEQ ID NO: 35500 - DNA, 16 bp, H. sapiens
agatccatcagagaat

SEQ ID NO: 35501 - DNA, 16 bp, H. sapiens
agatccatttgttcta

SEQ ID NO: 35502 - DNA, 16 bp, H. sapiens
agatcccaccactgca

SEQ ID NO: 35503 - DNA, 16 bp, H. sapiens
agatcccatctcaaga

SEQ ID NO: 35504 - DNA, 16 bp, H. sapiens
agatcccatctcacac

SEQ ID NO: 35505 - DNA, 16 bp, H. sapiens
agatcccatctctcca

SEQ ID NO: 35506 - DNA, 16 bp, H. sapiens
agatccccaggtgatt

SEQ ID NO: 35507 - DNA, 16 bp, H. sapiens
agatccgatggtttta

SEQ ID NO: 35508 - DNA, 16 bp, H. sapiens
agatcctatctaaaaa

SEQ ID NO: 35509 - DNA, 16 bp, H. sapiens
agatcctcctgcctcg

SEQ ID NO: 35510 - DNA, 16 bp, H. sapiens
agatcctcctgccttg

SEQ ID NO: 35511 - DNA, 16 bp, H. sapiens
agatcctcctgcttca

SEQ ID NO: 35512 - DNA, 16 bp, H. sapiens
agatcctgccactgct

SEQ ID NO: 35513 - DNA, 16 bp, H. sapiens
agatcctggagaggat

SEQ ID NO: 35514 - DNA, 16 bp, H. sapiens
agatcctgggcttttc

SEQ ID NO: 35515 - DNA, 16 bp, H. sapiens
agatcctgtctcagaa

SEQ ID NO: 35516 - DNA, 16 bp, H. sapiens
agatcctgtttctaca

SEQ ID NO: 35517 - DNA, 16 bp, H. sapiens
agatccttcatgaatg

SEQ ID NO: 35518 - DNA, 16 bp, H. sapiens
agatcgagaccacggt

SEQ ID NO: 35519 - DNA, 16 bp, H. sapiens
agatcgagaccatctt

SEQ ID NO: 35520 - DNA, 16 bp, H. sapiens
agatcgagccattgta

SEQ ID NO: 35521 - DNA, 16 bp, H. sapiens
agatcgcaccaccgca

SEQ ID NO: 35522 - DNA, 16 bp, H. sapiens
agatcgcaccactgcg

SEQ ID NO: 35523 - DNA, 17 bp, H. sapiens
agatcgcaccattgcaa

SEQ ID NO: 35524 - DNA, 18 bp, H. sapiens
agatcgcaccattgcacc

SEQ ID NO: 35525 - DNA, 18 bp, H. sapiens
agatcgcgccattacact

SEQ ID NO: 35526 - DNA, 18 bp, H. sapiens
agatcgcgccattgcacc

SEQ ID NO: 35527 - DNA, 16 bp, H. sapiens
agatcgtgccattgta

SEQ ID NO: 35528 - DNA, 16 bp, H. sapiens
agatctaaatgtgaaa

SEQ ID NO: 35529 - DNA, 16 bp, H. sapiens
agatctaatggtttaa

SEQ ID NO: 35530 - DNA, 16 bp, H. sapiens
agatctaggaggaact

SEQ ID NO: 35531 - DNA, 16 bp, H. sapiens
agatctaggttcaaat

SEQ ID NO: 35532 - DNA, 16 bp, H. sapiens
agatctcagaaataaa

SEQ ID NO: 35533 - DNA, 16 bp, H. sapiens
agatctcagccctgct

SEQ ID NO: 35534 - DNA, 16 bp, H. sapiens
agatctcaggagttgg

SEQ ID NO: 35535 - DNA, 17 bp, H. sapiens
agatctcatcttgaatt

SEQ ID NO: 35536 - DNA, 16 bp, H. sapiens
agatctcatggtttta

SEQ ID NO: 35537 - DNA, 16 bp, H. sapiens
agatctcatgttaagt

SEQ ID NO: 35538 - DNA, 16 bp, H. sapiens
agatctcctgagaatt

SEQ ID NO: 35539 - DNA, 17 bp, H. sapiens
agatctcggctcactgc

SEQ ID NO: 35540 - DNA, 16 bp, H. sapiens
agatctctacaataaa

SEQ ID NO: 35541 - DNA, 16 bp, H. sapiens
agatctctcaaaacta

SEQ ID NO: 35542 - DNA, 16 bp, H. sapiens
agatctgagttcaaat

SEQ ID NO: 35543 - DNA, 16 bp, H. sapiens
agatctgatagtttta

SEQ ID NO: 35544 - DNA, 16 bp, H. sapiens
agatctgatgatttta

SEQ ID NO: 35545 - DNA, 16 bp, H. sapiens
agatctgatggtttta

SEQ ID NO: 35546 - DNA, 16 bp, H. sapiens
agatctgatggttttg

SEQ ID NO: 35547 - DNA, 16 bp, H. sapiens
agatctgcccgccttg

SEQ ID NO: 35548 - DNA, 19 bp, H. sapiens
agatctgcctgcctcggcc

SEQ ID NO: 35549 - DNA, 16 bp, H. sapiens
agatctgggatggggc

SEQ ID NO: 35550 - DNA, 16 bp, H. sapiens
agatctggggtggggc

SEQ ID NO: 35551 - DNA, 16 bp, H. sapiens
agatctggtgagaact

SEQ ID NO: 35552 - DNA, 16 bp, H. sapiens
agatctgtgcatttca

SEQ ID NO: 35553 - DNA, 16 bp, H. sapiens
agatcttacatttaag

SEQ ID NO: 35554 - DNA, 16 bp, H. sapiens
agatcttagcaacctc

SEQ ID NO: 35555 - DNA, 16 bp, H. sapiens
agatcttcatcctcat

SEQ ID NO: 35556 - DNA, 16 bp, H. sapiens
agatcttcatttcttt

SEQ ID NO: 35557 - DNA, 16 bp, H. sapiens
agatcttgacactgca

SEQ ID NO: 35558 - DNA, 16 bp, H. sapiens
agatcttgtctcagaa

SEQ ID NO: 35559 - DNA, 16 bp, H. sapiens
agatctttctaaaatg

SEQ ID NO: 35560 - DNA, 16 bp, H. sapiens
agatctttctgacttt

SEQ ID NO: 35561 - DNA, 16 bp, H. sapiens
agatcttttacttctt

SEQ ID NO: 35562 - DNA, 16 bp, H. sapiens
agatctttttaacttt

SEQ ID NO: 35563 - DNA, 16 bp, H. sapiens
agatctttttcttcca

SEQ ID NO: 35564 - DNA, 16 bp, H. sapiens
agatgaaaaaaatcat

SEQ ID NO: 35565 - DNA, 16 bp, H. sapiens
agatgaaaaagctgag

SEQ ID NO: 35566 - DNA, 16 bp, H. sapiens
agatgaaaacttccca

SEQ ID NO: 35567 - DNA, 16 bp, H. sapiens
agatgaaaagactgag

SEQ ID NO: 35568 - DNA, 16 bp, H. sapiens
agatgaaaagagacaa

SEQ ID NO: 35569 - DNA, 16 bp, H. sapiens
agatgaaaagagttct

SEQ ID NO: 35570 - DNA, 16 bp, H. sapiens
agatgaaaataacatt

SEQ ID NO: 35571 - DNA, 16 bp, H. sapiens
agatgaaaatatattt

SEQ ID NO: 35572 - DNA, 16 bp, H. sapiens
agatgaaaattctaaa

SEQ ID NO: 35573 - DNA, 16 bp, H. sapiens
agatgaaagacttaaa

SEQ ID NO: 35574 - DNA, 16 bp, H. sapiens
agatgaaataagattg

SEQ ID NO: 35575 - DNA, 16 bp, H. sapiens
agatgaaatagatgaa

SEQ ID NO: 35576 - DNA, 16 bp, H. sapiens
agatgaaatggaccaa

SEQ ID NO: 35577 - DNA, 16 bp, H. sapiens
agatgaaatgttctgt

SEQ ID NO: 35578 - DNA, 16 bp, H. sapiens
agatgaaattcccatg

SEQ ID NO: 35579 - DNA, 16 bp, H. sapiens
agatgaaattggaaat

SEQ ID NO: 35580 - DNA, 16 bp, H. sapiens
agatgaacaatgagaa

SEQ ID NO: 35581 - DNA, 16 bp, H. sapiens
agatgaaccaggtacc

SEQ ID NO: 35582 - DNA, 16 bp, H. sapiens
agatgaacctggaaga

SEQ ID NO: 35583 - DNA, 16 bp, H. sapiens
agatgaagaaaaagca

SEQ ID NO: 35584 - DNA, 16 bp, H. sapiens
agatgaagaaaaatca

SEQ ID NO: 35585 - DNA, 16 bp, H. sapiens
agatgaagaaaatgtg

SEQ ID NO: 35586 - DNA, 16 bp, H. sapiens
agatgaagaaaccaag

SEQ ID NO: 35587 - DNA, 16 bp, H. sapiens
agatgaagaaactaaa

SEQ ID NO: 35588 - DNA, 16 bp, H. sapiens
agatgaagaaactaag

SEQ ID NO: 35589 - DNA, 16 bp, H. sapiens
agatgaagaaactgaa

SEQ ID NO: 35590 - DNA, 16 bp, H. sapiens
agatgaagaaactgag

SEQ ID NO: 35591 - DNA, 16 bp, H. sapiens
agatgaagaaatcaaa

SEQ ID NO: 35592 - DNA, 16 bp, H. sapiens
agatgaagaaatcaag

SEQ ID NO: 35593 - DNA, 16 bp, H. sapiens
agatgaagaaatgcat

SEQ ID NO: 35594 - DNA, 16 bp, H. sapiens
agatgaagaaatgggg

SEQ ID NO: 35595 - DNA, 16 bp, H. sapiens
agatgaagaacctgag

SEQ ID NO: 35596 - DNA, 16 bp, H. sapiens
agatgaagaagcagaa

SEQ ID NO: 35597 - DNA, 16 bp, H. sapiens
agatgaagaagctgaa

SEQ ID NO: 35598 - DNA, 16 bp, H. sapiens
agatgaagaagctgag

SEQ ID NO: 35599 - DNA, 16 bp, H. sapiens
agatgaagacaaagaa

SEQ ID NO: 35600 - DNA, 16 bp, H. sapiens
agatgaagacactgaa

SEQ ID NO: 35601 - DNA, 16 bp, H. sapiens
agatgaagacagaaaa

SEQ ID NO: 35602 - DNA, 16 bp, H. sapiens
agatgaagaccatcct

SEQ ID NO: 35603 - DNA, 16 bp, H. sapiens
agatgaagagaatgag

SEQ ID NO: 35604 - DNA, 16 bp, H. sapiens
agatgaagagactgag

SEQ ID NO: 35605 - DNA, 16 bp, H. sapiens
agatgaagagatggat

SEQ ID NO: 35606 - DNA, 16 bp, H. sapiens
agatgaagcctctagg

SEQ ID NO: 35607 - DNA, 16 bp, H. sapiens
agatgaagctggagaa

SEQ ID NO: 35608 - DNA, 16 bp, H. sapiens
agatgaagctggagag

SEQ ID NO: 35609 - DNA, 16 bp, H. sapiens
agatgaaggaattgag

SEQ ID NO: 35610 - DNA, 16 bp, H. sapiens
agatgaaggagaagca

SEQ ID NO: 35611 - DNA, 16 bp, H. sapiens
agatgaaggcagagat

SEQ ID NO: 35612 - DNA, 16 bp, H. sapiens
agatgaagtcagagag

SEQ ID NO: 35613 - DNA, 16 bp, H. sapiens
agatgaagtcttacta

SEQ ID NO: 35614 - DNA, 17 bp, H. sapiens
agatgaagtcttgctct

SEQ ID NO: 35615 - DNA, 16 bp, H. sapiens
agatgaataaatacaa

SEQ ID NO: 35616 - DNA, 16 bp, H. sapiens
agatgaatcttgaaga

SEQ ID NO: 35617 - DNA, 16 bp, H. sapiens
agatgaatgaaaatga

SEQ ID NO: 35618 - DNA, 16 bp, H. sapiens
agatgaatgcacaaat

SEQ ID NO: 35619 - DNA, 16 bp, H. sapiens
agatgaatggattaag

SEQ ID NO: 35620 - DNA, 16 bp, H. sapiens
agatgaattaaagatt

SEQ ID NO: 35621 - DNA, 16 bp, H. sapiens
agatgaatttaacaaa

SEQ ID NO: 35622 - DNA, 16 bp, H. sapiens
agatgaattttataat

SEQ ID NO: 35623 - DNA, 16 bp, H. sapiens
agatgaatttttaaaa

SEQ ID NO: 35624 - DNA, 16 bp, H. sapiens
agatgacaaaaatgaa

SEQ ID NO: 35625 - DNA, 16 bp, H. sapiens
agatgacaaaactaag

SEQ ID NO: 35626 - DNA, 16 bp, H. sapiens
agatgacaaaattgag

SEQ ID NO: 35627 - DNA, 16 bp, H. sapiens
agatgacaaagatgaa

SEQ ID NO: 35628 - DNA, 16 bp, H. sapiens
agatgacaaataaaca

SEQ ID NO: 35629 - DNA, 16 bp, H. sapiens
agatgacagagatgtt

SEQ ID NO: 35630 - DNA, 16 bp, H. sapiens
agatgacaggatctca

SEQ ID NO: 35631 - DNA, 16 bp, H. sapiens
agatgacatgactgtc

SEQ ID NO: 35632 - DNA, 16 bp, H. sapiens
agatgacatgattcca

SEQ ID NO: 35633 - DNA, 16 bp, H. sapiens
agatgacctgatggag

SEQ ID NO: 35634 - DNA, 16 bp, H. sapiens
agatgacttgattgta

SEQ ID NO: 35635 - DNA, 16 bp, H. sapiens
agatgactttgagggg

SEQ ID NO: 35636 - DNA, 16 bp, H. sapiens
agatgagaaaaattga

SEQ ID NO: 35637 - DNA, 16 bp, H. sapiens
agatgagaaaacagat

SEQ ID NO: 35638 - DNA, 16 bp, H. sapiens
agatgagaaaacaggc

SEQ ID NO: 35639 - DNA, 16 bp, H. sapiens
agatgagaaaactgag

SEQ ID NO: 35640 - DNA, 16 bp, H. sapiens
agatgagaaaactgga

SEQ ID NO: 35641 - DNA, 16 bp, H. sapiens
agatgagaaaacttaa

SEQ ID NO: 35642 - DNA, 16 bp, H. sapiens
agatgagaaaatggag

SEQ ID NO: 35643 - DNA, 16 bp, H. sapiens
agatgagaaaattgag

SEQ ID NO: 35644 - DNA, 16 bp, H. sapiens
agatgagaaaatttag

SEQ ID NO: 35645 - DNA, 16 bp, H. sapiens
agatgagaaacttctt

SEQ ID NO: 35646 - DNA, 16 bp, H. sapiens
agatgagaaagaatta

SEQ ID NO: 35647 - DNA, 16 bp, H. sapiens
agatgagaaagctaag

SEQ ID NO: 35648 - DNA, 16 bp, H. sapiens
agatgagaaagttcta

SEQ ID NO: 35649 - DNA, 16 bp, H. sapiens
agatgagaaattactt

SEQ ID NO: 35650 - DNA, 16 bp, H. sapiens
agatgagaacaacaga

SEQ ID NO: 35651 - DNA, 16 bp, H. sapiens
agatgagaagaaacca

SEQ ID NO: 35652 - DNA, 16 bp, H. sapiens
agatgagaaggagcca

SEQ ID NO: 35653 - DNA, 16 bp, H. sapiens
agatgagaatccagtt

SEQ ID NO: 35654 - DNA, 16 bp, H. sapiens
agatgagagatgagaa

SEQ ID NO: 35655 - DNA, 16 bp, H. sapiens
agatgagagtgcacat

SEQ ID NO: 35656 - DNA, 16 bp, H. sapiens
agatgagcaaagaaag

SEQ ID NO: 35657 - DNA, 16 bp, H. sapiens
agatgaggaaaacaga

SEQ ID NO: 35658 - DNA, 16 bp, H. sapiens
agatgaggaaacaagg

SEQ ID NO: 35659 - DNA, 16 bp, H. sapiens
agatgaggaaacagat

SEQ ID NO: 35660 - DNA, 16 bp, H. sapiens
agatgaggaaaccgag

SEQ ID NO: 35661 - DNA, 16 bp, H. sapiens
agatgaggaaactaag

SEQ ID NO: 35662 - DNA, 16 bp, H. sapiens
agatgaggaaactgaa

SEQ ID NO: 35663 - DNA, 16 bp, H. sapiens
agatgaggaaactgag

SEQ ID NO: 35664 - DNA, 16 bp, H. sapiens
agatgaggaaatgaag

SEQ ID NO: 35665 - DNA, 17 bp, H. sapiens
agatgaggaacttgtta

SEQ ID NO: 35666 - DNA, 16 bp, H. sapiens
agatgaggaagaacca

SEQ ID NO: 35667 - DNA, 16 bp, H. sapiens
agatgaggaagatgag

SEQ ID NO: 35668 - DNA, 16 bp, H. sapiens
agatgaggaagccaag

SEQ ID NO: 35669 - DNA, 16 bp, H. sapiens
agatgaggaagctgag

SEQ ID NO: 35670 - DNA, 16 bp, H. sapiens
agatgaggaatctgag

SEQ ID NO: 35671 - DNA, 16 bp, H. sapiens
agatgaggacactgag

SEQ ID NO: 35672 - DNA, 16 bp, H. sapiens
agatgaggacagtgag

SEQ ID NO: 35673 - DNA, 16 bp, H. sapiens
agatgaggagacagag

SEQ ID NO: 35674 - DNA, 16 bp, H. sapiens
agatgaggagactgag

SEQ ID NO: 35675 - DNA, 16 bp, H. sapiens
agatgaggagattgag

SEQ ID NO: 35676 - DNA, 16 bp, H. sapiens
agatgaggcaactgag

SEQ ID NO: 35677 - DNA, 16 bp, H. sapiens
agatgaggccagagag

SEQ ID NO: 35678 - DNA, 16 bp, H. sapiens
agatgaggcccagaga

SEQ ID NO: 35679 - DNA, 16 bp, H. sapiens
agatgagggagctgag

SEQ ID NO: 35680 - DNA, 16 bp, H. sapiens
agatgagtctcctgaa

SEQ ID NO: 35681 - DNA, 16 bp, H. sapiens
agatgatacatataca

SEQ ID NO: 35682 - DNA, 16 bp, H. sapiens
agatgatagatagaaa

SEQ ID NO: 35683 - DNA, 16 bp, H. sapiens
agatgatagatttaaa

SEQ ID NO: 35684 - DNA, 16 bp, H. sapiens
agatgatatcctgaaa

SEQ ID NO: 35685 - DNA, 16 bp, H. sapiens
agatgatatgtaaatg

SEQ ID NO: 35686 - DNA, 16 bp, H. sapiens
agatgatattgcattg

SEQ ID NO: 35687 - DNA, 16 bp, H. sapiens
agatgatattttaaaa

SEQ ID NO: 35688 - DNA, 16 bp, H. sapiens
agatgatcatatgctt

SEQ ID NO: 35689 - DNA, 16 bp, H. sapiens
agatgatcatttggtt

SEQ ID NO: 35690 - DNA, 16 bp, H. sapiens
agatgatccacctgcc

SEQ ID NO: 35691 - DNA, 16 bp, H. sapiens
agatgatccagcagca

SEQ ID NO: 35692 - DNA, 16 bp, H. sapiens
agatgatctctctctc

SEQ ID NO: 35693 - DNA, 16 bp, H. sapiens
agatgatgaatatgtt

SEQ ID NO: 35694 - DNA, 16 bp, H. sapiens
agatgatgagttgata

SEQ ID NO: 35695 - DNA, 16 bp, H. sapiens
agatgatgatgatggt

SEQ ID NO: 35696 - DNA, 16 bp, H. sapiens
agatgatggaaatgtt

SEQ ID NO: 35697 - DNA, 16 bp, H. sapiens
agatgatggtgatgat

SEQ ID NO: 35698 - DNA, 16 bp, H. sapiens
agatgatgtggagaaa

SEQ ID NO: 35699 - DNA, 16 bp, H. sapiens
agatgattaaatcatg

SEQ ID NO: 35700 - DNA, 16 bp, H. sapiens
agatgattatatggtt

SEQ ID NO: 35701 - DNA, 16 bp, H. sapiens
agatgattatgtggtt

SEQ ID NO: 35702 - DNA, 16 bp, H. sapiens
agatgattctgatgat

SEQ ID NO: 35703 - DNA, 16 bp, H. sapiens
agatgattctttgttg

SEQ ID NO: 35704 - DNA, 16 bp, H. sapiens
agatgatttaaaacat

SEQ ID NO: 35705 - DNA, 16 bp, H. sapiens
agatgatttagagtat

SEQ ID NO: 35706 - DNA, 16 bp, H. sapiens
agatgatttatttaaa

SEQ ID NO: 35707 - DNA, 16 bp, H. sapiens
agatgatttttaaaat

SEQ ID NO: 35708 - DNA, 16 bp, H. sapiens
agatgcaaaaattctt

SEQ ID NO: 35709 - DNA, 16 bp, H. sapiens
agatgcaaattaaaat

SEQ ID NO: 35710 - DNA, 16 bp, H. sapiens
agatgcaaattctcag

SEQ ID NO: 35711 - DNA, 16 bp, H. sapiens
agatgcacagggcaag

SEQ ID NO: 35712 - DNA, 16 bp, H. sapiens
agatgcactgaaaact

SEQ ID NO: 35713 - DNA, 16 bp, H. sapiens
agatgcagaaaaagcc

SEQ ID NO: 35714 - DNA, 16 bp, H. sapiens
agatgcagaaactgag

SEQ ID NO: 35715 - DNA, 16 bp, H. sapiens
agatgcagaagaggcc

SEQ ID NO: 35716 - DNA, 16 bp, H. sapiens
agatgcagacactgag

SEQ ID NO: 35717 - DNA, 18 bp, H. sapiens
agatgcagaccatcctgg

SEQ ID NO: 35718 - DNA, 16 bp, H. sapiens
agatgcagatgctggt

SEQ ID NO: 35719 - DNA, 16 bp, H. sapiens
agatgcagcccctcaa

SEQ ID NO: 35720 - DNA, 16 bp, H. sapiens
agatgcagctggaggc

SEQ ID NO: 35721 - DNA, 16 bp, H. sapiens
agatgcagctgtacaa

SEQ ID NO: 35722 - DNA, 16 bp, H. sapiens
agatgcaggaggcaga

SEQ ID NO: 35723 - DNA, 16 bp, H. sapiens
agatgcaggctgggag

SEQ ID NO: 35724 - DNA, 16 bp, H. sapiens
agatgcagggactctg

SEQ ID NO: 35725 - DNA, 16 bp, H. sapiens
agatgcagttgctctg

SEQ ID NO: 35726 - DNA, 16 bp, H. sapiens
agatgcattattaggt

SEQ ID NO: 35727 - DNA, 16 bp, H. sapiens
agatgccaaaatcctc

SEQ ID NO: 35728 - DNA, 16 bp, H. sapiens
agatgccaacaccatg

SEQ ID NO: 35729 - DNA, 16 bp, H. sapiens
agatgccagctggagc

SEQ ID NO: 35730 - DNA, 16 bp, H. sapiens
agatgcccaatcttga

SEQ ID NO: 35731 - DNA, 16 bp, H. sapiens
agatgcccatcaatga

SEQ ID NO: 35732 - DNA, 16 bp, H. sapiens
agatgcccatcagcag

SEQ ID NO: 35733 - DNA, 16 bp, H. sapiens
agatgccctttatttc

SEQ ID NO: 35734 - DNA, 16 bp, H. sapiens
agatgcctgctcccac

SEQ ID NO: 35735 - DNA, 16 bp, H. sapiens
agatgcgtagtttgca

SEQ ID NO: 35736 - DNA, 16 bp, H. sapiens
agatgctaaaattctt

SEQ ID NO: 35737 - DNA, 16 bp, H. sapiens
agatgctatgaagaaa

SEQ ID NO: 35738 - DNA, 16 bp, H. sapiens
agatgctcaataaaca

SEQ ID NO: 35739 - DNA, 16 bp, H. sapiens
agatgctcagcatcat

SEQ ID NO: 35740 - DNA, 16 bp, H. sapiens
agatgctctctgcacc

SEQ ID NO: 35741 - DNA, 16 bp, H. sapiens
agatgctgaaaaggcc

SEQ ID NO: 35742 - DNA, 16 bp, H. sapiens
agatgctgaaaccctg

SEQ ID NO: 35743 - DNA, 16 bp, H. sapiens
agatgctgaattttgt

SEQ ID NO: 35744 - DNA, 17 bp, H. sapiens
agatgctgcagaggatg

SEQ ID NO: 35745 - DNA, 16 bp, H. sapiens
agatgctgcaggagaa

SEQ ID NO: 35746 - DNA, 16 bp, H. sapiens
agatgctgcatttttt

SEQ ID NO: 35747 - DNA, 16 bp, H. sapiens
agatgctgctgaggtt

SEQ ID NO: 35748 - DNA, 16 bp, H. sapiens
agatgctggaaaggat

SEQ ID NO: 35749 - DNA, 16 bp, H. sapiens
agatgctggagaagat

SEQ ID NO: 35750 - DNA, 16 bp, H. sapiens
agatgctggagagcat

SEQ ID NO: 35751 - DNA, 16 bp, H. sapiens
agatgctggcagaaga

SEQ ID NO: 35752 - DNA, 16 bp, H. sapiens
agatgctggggaggct

SEQ ID NO: 35753 - DNA, 16 bp, H. sapiens
agatgctggtgaagtt

SEQ ID NO: 35754 - DNA, 17 bp, H. sapiens
agatgctggtgaggtta

SEQ ID NO: 35755 - DNA, 16 bp, H. sapiens
agatgctggtgtggat

SEQ ID NO: 35756 - DNA, 16 bp, H. sapiens
agatgctgtctccaaa

SEQ ID NO: 35757 - DNA, 16 bp, H. sapiens
agatgcttaataaatg

SEQ ID NO: 35758 - DNA, 20 bp, H. sapiens
agatgcttgaaggcagcatg

SEQ ID NO: 35759 - DNA, 16 bp, H. sapiens
agatggaaaaagatat

SEQ ID NO: 35760 - DNA, 16 bp, H. sapiens
agatggaaaagaagac

SEQ ID NO: 35761 - DNA, 16 bp, H. sapiens
agatggaaaccatcct

SEQ ID NO: 35762 - DNA, 16 bp, H. sapiens
agatggaaactactcc

SEQ ID NO: 35763 - DNA, 16 bp, H. sapiens
agatggaaatatggat

SEQ ID NO: 35764 - DNA, 16 bp, H. sapiens
agatggaaatttaaaa

SEQ ID NO: 35765 - DNA, 16 bp, H. sapiens
agatggaatctcaccc

SEQ ID NO: 35766 - DNA, 16 bp, H. sapiens
agatggaatctcactg

SEQ ID NO: 35767 - DNA, 16 bp, H. sapiens
agatggaatctctgtc

SEQ ID NO: 35768 - DNA, 16 bp, H. sapiens
agatggacagagagag

SEQ ID NO: 35769 - DNA, 16 bp, H. sapiens
agatggagaaagaggc

SEQ ID NO: 35770 - DNA, 16 bp, H. sapiens
agatggagaaagtgag

SEQ ID NO: 35771 - DNA, 16 bp, H. sapiens
agatggagaacatcct

SEQ ID NO: 35772 - DNA, 16 bp, H. sapiens
agatggagacagagat

SEQ ID NO: 35773 - DNA, 16 bp, H. sapiens
agatggagaccatctt

SEQ ID NO: 35774 - DNA, 16 bp, H. sapiens
agatggagaccatgct

SEQ ID NO: 35775 - DNA, 16 bp, H. sapiens
agatggagagatggag

SEQ ID NO: 35776 - DNA, 17 bp, H. sapiens
agatggagatcatcctg

SEQ ID NO: 35777 - DNA, 16 bp, H. sapiens
agatggaggcagagat

SEQ ID NO: 35778 - DNA, 16 bp, H. sapiens
agatggaggtctcact

SEQ ID NO: 35779 - DNA, 16 bp, H. sapiens
agatggaggttgcagc

SEQ ID NO: 35780 - DNA, 16 bp, H. sapiens
agatggagtcactttt

SEQ ID NO: 35781 - DNA, 17 bp, H. sapiens
agatggagtctcactct

SEQ ID NO: 35782 - DNA, 18 bp, H. sapiens
agatggagtctcactctt

SEQ ID NO: 35783 - DNA, 16 bp, H. sapiens
agatggagtctcactg

SEQ ID NO: 35784 - DNA, 16 bp, H. sapiens
agatggagtctcactt

SEQ ID NO: 35785 - DNA, 16 bp, H. sapiens
agatggagtctcatct

SEQ ID NO: 35786 - DNA, 16 bp, H. sapiens
agatggagtctcgccc

SEQ ID NO: 35787 - DNA, 19 bp, H. sapiens
agatggagtctcgctctgc

SEQ ID NO: 35788 - DNA, 18 bp, H. sapiens
agatggagtctcgctctt

SEQ ID NO: 35789 - DNA, 17 bp, H. sapiens
agatggagtcttgctct

SEQ ID NO: 35790 - DNA, 16 bp, H. sapiens
agatggagttcgctct

SEQ ID NO: 35791 - DNA, 16 bp, H. sapiens
agatggagttgaggaa

SEQ ID NO: 35792 - DNA, 16 bp, H. sapiens
agatggagttgctttg

SEQ ID NO: 35793 - DNA, 16 bp, H. sapiens
agatggagtttcaccc

SEQ ID NO: 35794 - DNA, 19 bp, H. sapiens
agatggagtttcgctctgt

SEQ ID NO: 35795 - DNA, 16 bp, H. sapiens
agatggagtttcgctg

SEQ ID NO: 35796 - DNA, 16 bp, H. sapiens
agatggagtttctctt

SEQ ID NO: 35797 - DNA, 16 bp, H. sapiens
agatggagtttgcagt

SEQ ID NO: 35798 - DNA, 18 bp, H. sapiens
agatggagttttgctcgt

SEQ ID NO: 35799 - DNA, 16 bp, H. sapiens
agatggagtttttttt

SEQ ID NO: 35800 - DNA, 16 bp, H. sapiens
agatggataaactgag

SEQ ID NO: 35801 - DNA, 16 bp, H. sapiens
agatggataaattgca

SEQ ID NO: 35802 - DNA, 16 bp, H. sapiens
agatggatggatgtgt

SEQ ID NO: 35803 - DNA, 16 bp, H. sapiens
agatggattcacagat

SEQ ID NO: 35804 - DNA, 16 bp, H. sapiens
agatggcaacaataaa

SEQ ID NO: 35805 - DNA, 16 bp, H. sapiens
agatggcaccaatgca

SEQ ID NO: 35806 - DNA, 16 bp, H. sapiens
agatggcacctggaaa

SEQ ID NO: 35807 - DNA, 16 bp, H. sapiens
agatggcagaagaaaa

SEQ ID NO: 35808 - DNA, 16 bp, H. sapiens
agatggcagcactgca

SEQ ID NO: 35809 - DNA, 16 bp, H. sapiens
agatggcagctccttc

SEQ ID NO: 35810 - DNA, 16 bp, H. sapiens
agatggcatctcatta

SEQ ID NO: 35811 - DNA, 16 bp, H. sapiens
agatggcatcttcttc

SEQ ID NO: 35812 - DNA, 16 bp, H. sapiens
agatggcatctttttc

SEQ ID NO: 35813 - DNA, 16 bp, H. sapiens
agatggcatttcacca

SEQ ID NO: 35814 - DNA, 16 bp, H. sapiens
agatggccaataagca

SEQ ID NO: 35815 - DNA, 16 bp, H. sapiens
agatggccaccatcct

SEQ ID NO: 35816 - DNA, 16 bp, H. sapiens
agatggccaccttctc

SEQ ID NO: 35817 - DNA, 16 bp, H. sapiens
agatggccatcttctt

SEQ ID NO: 35818 - DNA, 17 bp, H. sapiens
agatggctcacgcctgt

SEQ ID NO: 35819 - DNA, 16 bp, H. sapiens
agatggctgaggtggg

SEQ ID NO: 35820 - DNA, 16 bp, H. sapiens
agatgggaaaaaaaca

SEQ ID NO: 35821 - DNA, 16 bp, H. sapiens
agatgggaaaactgaa

SEQ ID NO: 35822 - DNA, 16 bp, H. sapiens
agatgggaaaactgag

SEQ ID NO: 35823 - DNA, 16 bp, H. sapiens
agatgggaagattgct

SEQ ID NO: 35824 - DNA, 16 bp, H. sapiens
agatgggacttaaact

SEQ ID NO: 35825 - DNA, 16 bp, H. sapiens
agatgggagaattgct

SEQ ID NO: 35826 - DNA, 16 bp, H. sapiens
agatgggaggacagct

SEQ ID NO: 35827 - DNA, 16 bp, H. sapiens
agatgggaggagacca

SEQ ID NO: 35828 - DNA, 16 bp, H. sapiens
agatgggaggatcact

SEQ ID NO: 35829 - DNA, 16 bp, H. sapiens
agatgggatcttgcca

SEQ ID NO: 35830 - DNA, 16 bp, H. sapiens
agatgggatttcatta

SEQ ID NO: 35831 - DNA, 16 bp, H. sapiens
agatgggatttcgcca

SEQ ID NO: 35832 - DNA, 16 bp, H. sapiens
agatgggcaaaagatt

SEQ ID NO: 35833 - DNA, 16 bp, H. sapiens
agatgggcagatcacc

SEQ ID NO: 35834 - DNA, 16 bp, H. sapiens
agatgggcagatcatg

SEQ ID NO: 35835 - DNA, 16 bp, H. sapiens
agatgggcaggtgcag

SEQ ID NO: 35836 - DNA, 16 bp, H. sapiens
agatgggctttcacta

SEQ ID NO: 35837 - DNA, 16 bp, H. sapiens
agatggggaaaatgaa

SEQ ID NO: 35838 - DNA, 16 bp, H. sapiens
agatggggaaactaag

SEQ ID NO: 35839 - DNA, 16 bp, H. sapiens
agatggggagaaaaca

SEQ ID NO: 35840 - DNA, 16 bp, H. sapiens
agatggggagacagag

SEQ ID NO: 35841 - DNA, 16 bp, H. sapiens
agatggggcagctggg

SEQ ID NO: 35842 - DNA, 16 bp, H. sapiens
agatggggcctgatgg

SEQ ID NO: 35843 - DNA, 16 bp, H. sapiens
agatggggcctttggg

SEQ ID NO: 35844 - DNA, 16 bp, H. sapiens
agatggggctttacca

SEQ ID NO: 35845 - DNA, 16 bp, H. sapiens
agatgggggtctcact

SEQ ID NO: 35846 - DNA, 17 bp, H. sapiens
agatggggtcttgctat

SEQ ID NO: 35847 - DNA, 16 bp, H. sapiens
agatggggtcttgctt

SEQ ID NO: 35848 - DNA, 16 bp, H. sapiens
agatggggtcttgtta

SEQ ID NO: 35849 - DNA, 18 bp, H. sapiens
agatggggtttctccata

SEQ ID NO: 35850 - DNA, 16 bp, H. sapiens
agatggggttttacct

SEQ ID NO: 35851 - DNA, 17 bp, H. sapiens
agatggggttttgccac

SEQ ID NO: 35852 - DNA, 17 bp, H. sapiens
agatggggttttgctct

SEQ ID NO: 35853 - DNA, 17 bp, H. sapiens
agatggggttttgctgt

SEQ ID NO: 35854 - DNA, 16 bp, H. sapiens
agatgggtgggtgagt

SEQ ID NO: 35855 - DNA, 16 bp, H. sapiens
agatgggtttcctgag

SEQ ID NO: 35856 - DNA, 16 bp, H. sapiens
agatggtagatgatgg

SEQ ID NO: 35857 - DNA, 16 bp, H. sapiens
agatggtatcccattg

SEQ ID NO: 35858 - DNA, 16 bp, H. sapiens
agatggtccccaactt

SEQ ID NO: 35859 - DNA, 16 bp, H. sapiens
agatggtgaaacccag

SEQ ID NO: 35860 - DNA, 16 bp, H. sapiens
agatggtgacactgca

SEQ ID NO: 35861 - DNA, 16 bp, H. sapiens
agatggtgctgctgca

SEQ ID NO: 35862 - DNA, 16 bp, H. sapiens
agatggtggcctgccc

SEQ ID NO: 35863 - DNA, 16 bp, H. sapiens
agatggtggggaaaaa

SEQ ID NO: 35864 - DNA, 17 bp, H. sapiens
agatggttgtagatgtg

SEQ ID NO: 35865 - DNA, 16 bp, H. sapiens
agatggttgtagttgt

SEQ ID NO: 35866 - DNA, 16 bp, H. sapiens
agatggtttgagccca

SEQ ID NO: 35867 - DNA, 16 bp, H. sapiens
agatggtttggctgtg

SEQ ID NO: 35868 - DNA, 16 bp, H. sapiens
agatgtacaaaaagga

SEQ ID NO: 35869 - DNA, 16 bp, H. sapiens
agatgtacaaagaaga

SEQ ID NO: 35870 - DNA, 16 bp, H. sapiens
agatgtacttattttc

SEQ ID NO: 35871 - DNA, 16 bp, H. sapiens
agatgtagatgtagat

SEQ ID NO: 35872 - DNA, 16 bp, H. sapiens
agatgtataaagcaaa

SEQ ID NO: 35873 - DNA, 16 bp, H. sapiens
agatgtatgaaaatgc

SEQ ID NO: 35874 - DNA, 16 bp, H. sapiens
agatgtatgccaccat

SEQ ID NO: 35875 - DNA, 16 bp, H. sapiens
agatgtattctggaga

SEQ ID NO: 35876 - DNA, 16 bp, H. sapiens
agatgtcaaaacatca

SEQ ID NO: 35877 - DNA, 16 bp, H. sapiens
agatgtcacaaacaaa

SEQ ID NO: 35878 - DNA, 16 bp, H. sapiens
agatgtcaccactgca

SEQ ID NO: 35879 - DNA, 16 bp, H. sapiens
agatgtcacttcttcc

SEQ ID NO: 35880 - DNA, 16 bp, H. sapiens
agatgtcatgctactg

SEQ ID NO: 35881 - DNA, 16 bp, H. sapiens
agatgtcattgccaca

SEQ ID NO: 35882 - DNA, 16 bp, H. sapiens
agatgtcctacagggt

SEQ ID NO: 35883 - DNA, 16 bp, H. sapiens
agatgtcctttgaaac

SEQ ID NO: 35884 - DNA, 16 bp, H. sapiens
agatgtctgcactcct

SEQ ID NO: 35885 - DNA, 16 bp, H. sapiens
agatgtgaaaagagag

SEQ ID NO: 35886 - DNA, 16 bp, H. sapiens
agatgtgacaaccaaa

SEQ ID NO: 35887 - DNA, 16 bp, H. sapiens
agatgtgactggattg

SEQ ID NO: 35888 - DNA, 16 bp, H. sapiens
agatgtgagacatgga

SEQ ID NO: 35889 - DNA, 19 bp, H. sapiens
agatgtgagccaccgcgcc

SEQ ID NO: 35890 - DNA, 16 bp, H. sapiens
agatgtgattacatta

SEQ ID NO: 35891 - DNA, 16 bp, H. sapiens
agatgtgccttttgcc

SEQ ID NO: 35892 - DNA, 16 bp, H. sapiens
agatgtggaaactgaa

SEQ ID NO: 35893 - DNA, 16 bp, H. sapiens
agatgtggaaactgag

SEQ ID NO: 35894 - DNA, 16 bp, H. sapiens
agatgtggaaattgag

SEQ ID NO: 35895 - DNA, 16 bp, H. sapiens
agatgtggagactgag

SEQ ID NO: 35896 - DNA, 16 bp, H. sapiens
agatgtggtcttgcta

SEQ ID NO: 35897 - DNA, 16 bp, H. sapiens
agatgtggtggctcat

SEQ ID NO: 35898 - DNA, 16 bp, H. sapiens
agatgtggtggtgcat

SEQ ID NO: 35899 - DNA, 16 bp, H. sapiens
agatgtggtgtttggt

SEQ ID NO: 35900 - DNA, 16 bp, H. sapiens
agatgtggtttcactg

SEQ ID NO: 35901 - DNA, 16 bp, H. sapiens
agatgtgtccagtttc

SEQ ID NO: 35902 - DNA, 16 bp, H. sapiens
agatgtgtgccactat

SEQ ID NO: 35903 - DNA, 16 bp, H. sapiens
agatgtgtttcctgaa

SEQ ID NO: 35904 - DNA, 16 bp, H. sapiens
agatgttccacatcat

SEQ ID NO: 35905 - DNA, 16 bp, H. sapiens
agatgttctttggtgt

SEQ ID NO: 35906 - DNA, 16 bp, H. sapiens
agatgttgctcaaaag

SEQ ID NO: 35907 - DNA, 16 bp, H. sapiens
agatgttggaattagc

SEQ ID NO: 35908 - DNA, 16 bp, H. sapiens
agatgttggagaggat

SEQ ID NO: 35909 - DNA, 16 bp, H. sapiens
agatgttggcaagaat

SEQ ID NO: 35910 - DNA, 16 bp, H. sapiens
agatgttggcatagat

SEQ ID NO: 35911 - DNA, 16 bp, H. sapiens
agatgttgtttgaaac

SEQ ID NO: 35912 - DNA, 16 bp, H. sapiens
agatgtttcaggctca

SEQ ID NO: 35913 - DNA, 16 bp, H. sapiens
agatgtttgatattat

SEQ ID NO: 35914 - DNA, 16 bp, H. sapiens
agatgtttgtagatgt

SEQ ID NO: 35915 - DNA, 16 bp, H. sapiens
agatgtttgtctttct

SEQ ID NO: 35916 - DNA, 16 bp, H. sapiens
agattaaaaccacaat

SEQ ID NO: 35917 - DNA, 16 bp, H. sapiens
agattaaaagagactt

SEQ ID NO: 35918 - DNA, 16 bp, H. sapiens
agattaaatcaggaag

SEQ ID NO: 35919 - DNA, 16 bp, H. sapiens
agattaaatgaggtca

SEQ ID NO: 35920 - DNA, 16 bp, H. sapiens
agattaacagaagaaa

SEQ ID NO: 35921 - DNA, 16 bp, H. sapiens
agattaacatttaagt

SEQ ID NO: 35922 - DNA, 16 bp, H. sapiens
agattaagaaaatgtg

SEQ ID NO: 35923 - DNA, 16 bp, H. sapiens
agattaattttgggag

SEQ ID NO: 35924 - DNA, 16 bp, H. sapiens
agattaatttttacaa

SEQ ID NO: 35925 - DNA, 17 bp, H. sapiens
agattacagcctctgcc

SEQ ID NO: 35926 - DNA, 16 bp, H. sapiens
agattacaggaatgaa

SEQ ID NO: 35927 - DNA, 16 bp, H. sapiens
agattacatttttaaa

SEQ ID NO: 35928 - DNA, 16 bp, H. sapiens
agattacttttaaaaa

SEQ ID NO: 35929 - DNA, 16 bp, H. sapiens
agattagaaattatgg

SEQ ID NO: 35930 - DNA, 16 bp, H. sapiens
agattagaacagaaat

SEQ ID NO: 35931 - DNA, 16 bp, H. sapiens
agattagacttttaaa

SEQ ID NO: 35932 - DNA, 16 bp, H. sapiens
agattaggaaattgag

SEQ ID NO: 35933 - DNA, 16 bp, H. sapiens
agattagggatactca

SEQ ID NO: 35934 - DNA, 16 bp, H. sapiens
agattaggttataaaa

SEQ ID NO: 35935 - DNA, 16 bp, H. sapiens
agattagtggttgcca

SEQ ID NO: 35936 - DNA, 16 bp, H. sapiens
agattataaatcattt

SEQ ID NO: 35937 - DNA, 16 bp, H. sapiens
agattataacaaactg

SEQ ID NO: 35938 - DNA, 16 bp, H. sapiens
agattataccattgca

SEQ ID NO: 35939 - DNA, 16 bp, H. sapiens
agattatatcatcagc

SEQ ID NO: 35940 - DNA, 16 bp, H. sapiens
agattatcctggagta

SEQ ID NO: 35941 - DNA, 16 bp, H. sapiens
agattatctgaaactg

SEQ ID NO: 35942 - DNA, 16 bp, H. sapiens
agattattaaaaatgt

SEQ ID NO: 35943 - DNA, 16 bp, H. sapiens
agattatttaatatga

SEQ ID NO: 35944 - DNA, 16 bp, H. sapiens
agattatttagtcacc

SEQ ID NO: 35945 - DNA, 16 bp, H. sapiens
agattatttcttaatt

SEQ ID NO: 35946 - DNA, 16 bp, H. sapiens
agattattttaaagca

SEQ ID NO: 35947 - DNA, 16 bp, H. sapiens
agattattttagctat

SEQ ID NO: 35948 - DNA, 16 bp, H. sapiens
agattattttatcact

SEQ ID NO: 35949 - DNA, 16 bp, H. sapiens
agattattttgtgggt

SEQ ID NO: 35950 - DNA, 16 bp, H. sapiens
agattcaaaattgaca

SEQ ID NO: 35951 - DNA, 16 bp, H. sapiens
agattcaaacccaggc

SEQ ID NO: 35952 - DNA, 16 bp, H. sapiens
agattcaaactcagat

SEQ ID NO: 35953 - DNA, 16 bp, H. sapiens
agattcaaattcttcc

SEQ ID NO: 35954 - DNA, 16 bp, H. sapiens
agattcaagtgattct

SEQ ID NO: 35955 - DNA, 16 bp, H. sapiens
agattcaatgcaatct

SEQ ID NO: 35956 - DNA, 33 bp, H. sapiens
agattcaatgccatccccatcaagctaccaatg

SEQ ID NO: 35957 - DNA, 31 bp, H. sapiens
agattcaatgccatccgcatcaagctaccaa

SEQ ID NO: 35958 - DNA, 18 bp, H. sapiens
agattcaatgccatcgcc

SEQ ID NO: 35959 - DNA, 16 bp, H. sapiens
agattcaatgccatgc

SEQ ID NO: 35960 - DNA, 16 bp, H. sapiens
agattcaatgctattc

SEQ ID NO: 35961 - DNA, 16 bp, H. sapiens
agattcacagagactc

SEQ ID NO: 35962 - DNA, 19 bp, H. sapiens
agattcaccaaggtggaaa

SEQ ID NO: 35963 - DNA, 16 bp, H. sapiens
agattcactcatgttg

SEQ ID NO: 35964 - DNA, 16 bp, H. sapiens
agattcactgacagct

SEQ ID NO: 35965 - DNA, 16 bp, H. sapiens
agattcagaagaaagt

SEQ ID NO: 35966 - DNA, 16 bp, H. sapiens
agattcagatgaggaa

SEQ ID NO: 35967 - DNA, 16 bp, H. sapiens
agattcagtgtctggt

SEQ ID NO: 35968 - DNA, 16 bp, H. sapiens
agattcatccacgttg

SEQ ID NO: 35969 - DNA, 16 bp, H. sapiens
agattcatccatattg

SEQ ID NO: 35970 - DNA, 16 bp, H. sapiens
agattcatccattttg

SEQ ID NO: 35971 - DNA, 16 bp, H. sapiens
agattcattcatgttg

SEQ ID NO: 35972 - DNA, 16 bp, H. sapiens
agattcattctttcca

SEQ ID NO: 35973 - DNA, 16 bp, H. sapiens
agattccacatacaag

SEQ ID NO: 35974 - DNA, 16 bp, H. sapiens
agattccagaaataaa

SEQ ID NO: 35975 - DNA, 16 bp, H. sapiens
agattccatctcagga

SEQ ID NO: 35976 - DNA, 16 bp, H. sapiens
agattcccatctctac

SEQ ID NO: 35977 - DNA, 16 bp, H. sapiens
agattcctgggccctg

SEQ ID NO: 35978 - DNA, 16 bp, H. sapiens
agattctacatttcta

SEQ ID NO: 35979 - DNA, 16 bp, H. sapiens
agattctattccattg

SEQ ID NO: 35980 - DNA, 16 bp, H. sapiens
agattctcaaaggagc

SEQ ID NO: 35981 - DNA, 16 bp, H. sapiens
agattctcccctagag

SEQ ID NO: 35982 - DNA, 16 bp, H. sapiens
agattctccctcagag

SEQ ID NO: 35983 - DNA, 16 bp, H. sapiens
agattctgaattcctt

SEQ ID NO: 35984 - DNA, 16 bp, H. sapiens
agattctgactcagta

SEQ ID NO: 35985 - DNA, 16 bp, H. sapiens
agattctgcaaaggga

SEQ ID NO: 35986 - DNA, 16 bp, H. sapiens
agattctgcaagtgga

SEQ ID NO: 35987 - DNA, 16 bp, H. sapiens
agattctgctatgttg

SEQ ID NO: 35988 - DNA, 16 bp, H. sapiens
agattctggagtcaga

SEQ ID NO: 35989 - DNA, 16 bp, H. sapiens
agattctggatattgg

SEQ ID NO: 35990 - DNA, 16 bp, H. sapiens
agattctggtatattg

SEQ ID NO: 35991 - DNA, 16 bp, H. sapiens
agattcttactctgtc

SEQ ID NO: 35992 - DNA, 16 bp, H. sapiens
agattcttcctcagag

SEQ ID NO: 35993 - DNA, 16 bp, H. sapiens
agattctttccagttt

SEQ ID NO: 35994 - DNA, 16 bp, H. sapiens
agattcttttttatta

SEQ ID NO: 35995 - DNA, 16 bp, H. sapiens
agattgaaaaatattt

SEQ ID NO: 35996 - DNA, 16 bp, H. sapiens
agattgaaggatgcaa

SEQ ID NO: 35997 - DNA, 16 bp, H. sapiens
agattgaatcccaggt

SEQ ID NO: 35998 - DNA, 16 bp, H. sapiens
agattgaatttttaaa

SEQ ID NO: 35999 - DNA, 16 bp, H. sapiens
agattgaggaagttct

SEQ ID NO: 36000 - DNA, 17 bp, H. sapiens
agattgaggccatcctg

SEQ ID NO: 36001 - DNA, 16 bp, H. sapiens
agattgcactgctgca

SEQ ID NO: 36002 - DNA, 16 bp, H. sapiens
agattgcagagaaaag

SEQ ID NO: 36003 - DNA, 16 bp, H. sapiens
agattgcagtgagcta

SEQ ID NO: 36004 - DNA, 16 bp, H. sapiens
agattgcagtgagtgg

SEQ ID NO: 36005 - DNA, 16 bp, H. sapiens
agattgcctctctaga

SEQ ID NO: 36006 - DNA, 16 bp, H. sapiens
agattgctgtgaatgc

SEQ ID NO: 36007 - DNA, 16 bp, H. sapiens
agattgcttgaaccca

SEQ ID NO: 36008 - DNA, 16 bp, H. sapiens
agattgcttgagcctg

SEQ ID NO: 36009 - DNA, 16 bp, H. sapiens
agattgcttgagtcca

SEQ ID NO: 36010 - DNA, 16 bp, H. sapiens
agattggaaaaatttt

SEQ ID NO: 36011 - DNA, 16 bp, H. sapiens
agattggaaacacttt

SEQ ID NO: 36012 - DNA, 16 bp, H. sapiens
agattgggaaggaaaa

SEQ ID NO: 36013 - DNA, 16 bp, H. sapiens
agattgggcaatttat

SEQ ID NO: 36014 - DNA, 16 bp, H. sapiens
agattgtcttccaggg

SEQ ID NO: 36015 - DNA, 16 bp, H. sapiens
agattgtgaatatttt

SEQ ID NO: 36016 - DNA, 16 bp, H. sapiens
agattgtgacactgca

SEQ ID NO: 36017 - DNA, 16 bp, H. sapiens
agattgtgcagtccaa

SEQ ID NO: 36018 - DNA, 16 bp, H. sapiens
agattgtggagaaaaa

SEQ ID NO: 36019 - DNA, 16 bp, H. sapiens
agattgtggagaccaa

SEQ ID NO: 36020 - DNA, 16 bp, H. sapiens
agattgttcactgctg

SEQ ID NO: 36021 - DNA, 16 bp, H. sapiens
agattgtttaaaatat

SEQ ID NO: 36022 - DNA, 16 bp, H. sapiens
agattgtttctaattt

SEQ ID NO: 36023 - DNA, 16 bp, H. sapiens
agatttaaaactttct

SEQ ID NO: 36024 - DNA, 16 bp, H. sapiens
agatttaaccattcca

SEQ ID NO: 36025 - DNA, 16 bp, H. sapiens
agatttaactcaaaga

SEQ ID NO: 36026 - DNA, 16 bp, H. sapiens
agatttaatgctatcc

SEQ ID NO: 36027 - DNA, 16 bp, H. sapiens
agatttaattgactca

SEQ ID NO: 36028 - DNA, 16 bp, H. sapiens
agatttacagaaaagt

SEQ ID NO: 36029 - DNA, 16 bp, H. sapiens
agatttacatgcaagg

SEQ ID NO: 36030 - DNA, 16 bp, H. sapiens
agatttacattggttt

SEQ ID NO: 36031 - DNA, 16 bp, H. sapiens
agatttactgaaaatg

SEQ ID NO: 36032 - DNA, 16 bp, H. sapiens
agatttagcataattt

SEQ ID NO: 36033 - DNA, 16 bp, H. sapiens
agatttaggggataca

SEQ ID NO: 36034 - DNA, 16 bp, H. sapiens
agatttagtttaaaaa

SEQ ID NO: 36035 - DNA, 16 bp, H. sapiens
agatttatctatgttg

SEQ ID NO: 36036 - DNA, 16 bp, H. sapiens
agatttatgtctttaa

SEQ ID NO: 36037 - DNA, 16 bp, H. sapiens
agatttattacaaaga

SEQ ID NO: 36038 - DNA, 16 bp, H. sapiens
agatttattcatgttg

SEQ ID NO: 36039 - DNA, 16 bp, H. sapiens
agatttattctttttg

SEQ ID NO: 36040 - DNA, 16 bp, H. sapiens
agatttattgaaaatg

SEQ ID NO: 36041 - DNA, 16 bp, H. sapiens
agatttatttgagaaa

SEQ ID NO: 36042 - DNA, 16 bp, H. sapiens
agatttcagacttgca

SEQ ID NO: 36043 - DNA, 16 bp, H. sapiens
agatttcagagaatgt

SEQ ID NO: 36044 - DNA, 16 bp, H. sapiens
agatttcagaggaagt

SEQ ID NO: 36045 - DNA, 16 bp, H. sapiens
agatttcagatttcag

SEQ ID NO: 36046 - DNA, 16 bp, H. sapiens
agatttcatgaagaaa

SEQ ID NO: 36047 - DNA, 16 bp, H. sapiens
agatttcatgacaaaa

SEQ ID NO: 36048 - DNA, 16 bp, H. sapiens
agatttcattattttt

SEQ ID NO: 36049 - DNA, 17 bp, H. sapiens
agatttcctgattggca

SEQ ID NO: 36050 - DNA, 16 bp, H. sapiens
agatttccttgttttt

SEQ ID NO: 36051 - DNA, 16 bp, H. sapiens
agatttctaaaatatt

SEQ ID NO: 36052 - DNA, 16 bp, H. sapiens
agatttctaaggtttt

SEQ ID NO: 36053 - DNA, 16 bp, H. sapiens
agatttctagtttatt

SEQ ID NO: 36054 - DNA, 16 bp, H. sapiens
agatttctataatttt

SEQ ID NO: 36055 - DNA, 16 bp, H. sapiens
agatttctattttaaa

SEQ ID NO: 36056 - DNA, 16 bp, H. sapiens
agatttctcattagaa

SEQ ID NO: 36057 - DNA, 16 bp, H. sapiens
agatttctgtgaccaa

SEQ ID NO: 36058 - DNA, 16 bp, H. sapiens
agatttctttcttcct

SEQ ID NO: 36059 - DNA, 16 bp, H. sapiens
agatttcttttcttgt

SEQ ID NO: 36060 - DNA, 16 bp, H. sapiens
agatttctttttaaaa

SEQ ID NO: 36061 - DNA, 16 bp, H. sapiens
agatttgaaagcaacc

SEQ ID NO: 36062 - DNA, 16 bp, H. sapiens
agatttgaagacaaaa

SEQ ID NO: 36063 - DNA, 16 bp, H. sapiens
agatttgcaggagaaa

SEQ ID NO: 36064 - DNA, 16 bp, H. sapiens
agatttgcctattttg

SEQ ID NO: 36065 - DNA, 16 bp, H. sapiens
agatttgccttttcta

SEQ ID NO: 36066 - DNA, 16 bp, H. sapiens
agatttggaaaattct

SEQ ID NO: 36067 - DNA, 16 bp, H. sapiens
agatttggaaggcaga

SEQ ID NO: 36068 - DNA, 16 bp, H. sapiens
agatttggaatcaacc

SEQ ID NO: 36069 - DNA, 16 bp, H. sapiens
agatttggaggaaaca

SEQ ID NO: 36070 - DNA, 16 bp, H. sapiens
agatttggaggggaca

SEQ ID NO: 36071 - DNA, 16 bp, H. sapiens
agatttggcctgcagg

SEQ ID NO: 36072 - DNA, 16 bp, H. sapiens
agatttgggcaaggac

SEQ ID NO: 36073 - DNA, 16 bp, H. sapiens
agatttgggtagaagc

SEQ ID NO: 36074 - DNA, 16 bp, H. sapiens
agatttggtttgccag

SEQ ID NO: 36075 - DNA, 16 bp, H. sapiens
agatttgtcttttcta

SEQ ID NO: 36076 - DNA, 16 bp, H. sapiens
agatttgttcttttca

SEQ ID NO: 36077 - DNA, 16 bp, H. sapiens
agatttgttgattttg

SEQ ID NO: 36078 - DNA, 16 bp, H. sapiens
agattttaaaaatgca

SEQ ID NO: 36079 - DNA, 16 bp, H. sapiens
agattttaaaagtata

SEQ ID NO: 36080 - DNA, 16 bp, H. sapiens
agattttaaaatgttt

SEQ ID NO: 36081 - DNA, 16 bp, H. sapiens
agattttaagacaaaa

SEQ ID NO: 36082 - DNA, 16 bp, H. sapiens
agattttaattattca

SEQ ID NO: 36083 - DNA, 16 bp, H. sapiens
agattttacatataag

SEQ ID NO: 36084 - DNA, 16 bp, H. sapiens
agattttacattgctt

SEQ ID NO: 36085 - DNA, 16 bp, H. sapiens
agattttatatttctt

SEQ ID NO: 36086 - DNA, 16 bp, H. sapiens
agattttattctaagt

SEQ ID NO: 36087 - DNA, 16 bp, H. sapiens
agattttcaaaaataa

SEQ ID NO: 36088 - DNA, 16 bp, H. sapiens
agattttcaaagaaaa

SEQ ID NO: 36089 - DNA, 16 bp, H. sapiens
agattttcaaataaaa

SEQ ID NO: 36090 - DNA, 16 bp, H. sapiens
agattttcaatgcaga

SEQ ID NO: 36091 - DNA, 16 bp, H. sapiens
agattttcatgctaaa

SEQ ID NO: 36092 - DNA, 16 bp, H. sapiens
agattttcatttaatt

SEQ ID NO: 36093 - DNA, 16 bp, H. sapiens
agattttcccttttga

SEQ ID NO: 36094 - DNA, 16 bp, H. sapiens
agattttctattttgt

SEQ ID NO: 36095 - DNA, 16 bp, H. sapiens
agattttctctcattc

SEQ ID NO: 36096 - DNA, 16 bp, H. sapiens
agattttctgcataga

SEQ ID NO: 36097 - DNA, 16 bp, H. sapiens
agattttcttctcttt

SEQ ID NO: 36098 - DNA, 16 bp, H. sapiens
agattttcttgtttat

SEQ ID NO: 36099 - DNA, 16 bp, H. sapiens
agattttctttaaaaa

SEQ ID NO: 36100 - DNA, 16 bp, H. sapiens
agattttgaaggaaaa

SEQ ID NO: 36101 - DNA, 16 bp, H. sapiens
agattttgaggaaaac

SEQ ID NO: 36102 - DNA, 16 bp, H. sapiens
agattttgcagatgtg

SEQ ID NO: 36103 - DNA, 16 bp, H. sapiens
agattttgcatttttt

SEQ ID NO: 36104 - DNA, 16 bp, H. sapiens
agattttggacttgct

SEQ ID NO: 36105 - DNA, 16 bp, H. sapiens
agattttggattttca

SEQ ID NO: 36106 - DNA, 16 bp, H. sapiens
agattttggccaggca

SEQ ID NO: 36107 - DNA, 16 bp, H. sapiens
agattttgtgtggaca

SEQ ID NO: 36108 - DNA, 16 bp, H. sapiens
agattttgttcatttt

SEQ ID NO: 36109 - DNA, 16 bp, H. sapiens
agattttgtttaaaaa

SEQ ID NO: 36110 - DNA, 16 bp, H. sapiens
agatttttaaaaaatg

SEQ ID NO: 36111 - DNA, 16 bp, H. sapiens
agatttttaaaaatca

SEQ ID NO: 36112 - DNA, 16 bp, H. sapiens
agatttttaaaagtat

SEQ ID NO: 36113 - DNA, 16 bp, H. sapiens
agatttttaaaatttg

SEQ ID NO: 36114 - DNA, 16 bp, H. sapiens
agatttttaaacaaat

SEQ ID NO: 36115 - DNA, 16 bp, H. sapiens
agatttttaacaaaaa

SEQ ID NO: 36116 - DNA, 16 bp, H. sapiens
agatttttattatgaa

SEQ ID NO: 36117 - DNA, 16 bp, H. sapiens
agatttttcaaagaat

SEQ ID NO: 36118 - DNA, 16 bp, H. sapiens
agatttttcagttttt

SEQ ID NO: 36119 - DNA, 16 bp, H. sapiens
agatttttctcattta

SEQ ID NO: 36120 - DNA, 16 bp, H. sapiens
agatttttctttcatt

SEQ ID NO: 36121 - DNA, 16 bp, H. sapiens
agatttttgaggaatc

SEQ ID NO: 36122 - DNA, 16 bp, H. sapiens
agatttttgttttcat

SEQ ID NO: 36123 - DNA, 16 bp, H. sapiens
agattttttaaaaaga

SEQ ID NO: 36124 - DNA, 16 bp, H. sapiens
agattttttaaaatgc

SEQ ID NO: 36125 - DNA, 16 bp, H. sapiens
agattttttaatgtaa

SEQ ID NO: 36126 - DNA, 16 bp, H. sapiens
agatttttttccagtt

SEQ ID NO: 36127 - DNA, 16 bp, H. sapiens
agatttttttccccag

SEQ ID NO: 36128 - DNA, 16 bp, H. sapiens
agatttttttctatag

SEQ ID NO: 36129 - DNA, 16 bp, H. sapiens
agatttttttgaaaaa

SEQ ID NO: 36130 - DNA, 16 bp, H. sapiens
agattttttttcccta

SEQ ID NO: 36131 - DNA, 16 bp, H. sapiens
agattttttttcctct

SEQ ID NO: 36132 - DNA, 16 bp, H. sapiens
agatttttttttcccc

SEQ ID NO: 36133 - DNA, 16 bp, H. sapiens
agcaaaaaagtttgga

SEQ ID NO: 36134 - DNA, 16 bp, H. sapiens
agcaaaaaattagcca

SEQ ID NO: 36135 - DNA, 16 bp, H. sapiens
agcaaaaaattggaaa

SEQ ID NO: 36136 - DNA, 16 bp, H. sapiens
agcaaaaactgacaaa

SEQ ID NO: 36137 - DNA, 16 bp, H. sapiens
agcaaaaactgaggaa

SEQ ID NO: 36138 - DNA, 16 bp, H. sapiens
agcaaaaagaaaactg

SEQ ID NO: 36139 - DNA, 16 bp, H. sapiens
agcaaaaagaaaatct

SEQ ID NO: 36140 - DNA, 16 bp, H. sapiens
agcaaaaatgggaaaa

SEQ ID NO: 36141 - DNA, 16 bp, H. sapiens
agcaaaaatgtatttt

SEQ ID NO: 36142 - DNA, 16 bp, H. sapiens
agcaaaaatgtccttc

SEQ ID NO: 36143 - DNA, 16 bp, H. sapiens
agcaaaaattgatgaa

SEQ ID NO: 36144 - DNA, 16 bp, H. sapiens
agcaaaaattttgcta

SEQ ID NO: 36145 - DNA, 16 bp, H. sapiens
agcaaaaatttttaaa

SEQ ID NO: 36146 - DNA, 16 bp, H. sapiens
agcaaaacaaagaatt

SEQ ID NO: 36147 - DNA, 16 bp, H. sapiens
agcaaaacaaattcaa

SEQ ID NO: 36148 - DNA, 16 bp, H. sapiens
agcaaaacaagatcca

SEQ ID NO: 36149 - DNA, 16 bp, H. sapiens
agcaaaacagagatat

SEQ ID NO: 36150 - DNA, 16 bp, H. sapiens
agcaaaacatcacatt

SEQ ID NO: 36151 - DNA, 16 bp, H. sapiens
agcaaaacattcaaga

SEQ ID NO: 36152 - DNA, 16 bp, H. sapiens
agcaaaaccccatctc

SEQ ID NO: 36153 - DNA, 16 bp, H. sapiens
agcaaaaccttgtctc

SEQ ID NO: 36154 - DNA, 16 bp, H. sapiens
agcaaaacgccatctc

SEQ ID NO: 36155 - DNA, 16 bp, H. sapiens
agcaaaactaaatgaa

SEQ ID NO: 36156 - DNA, 16 bp, H. sapiens
agcaaaactattcttc

SEQ ID NO: 36157 - DNA, 16 bp, H. sapiens
agcaaaactccgcctc

SEQ ID NO: 36158 - DNA, 16 bp, H. sapiens
agcaaaactcgggcaa

SEQ ID NO: 36159 - DNA, 16 bp, H. sapiens
agcaaaactgacagaa

SEQ ID NO: 36160 - DNA, 16 bp, H. sapiens
agcaaaagaaaatgga

SEQ ID NO: 36161 - DNA, 16 bp, H. sapiens
agcaaaagaaattatc

SEQ ID NO: 36162 - DNA, 16 bp, H. sapiens
agcaaaagattagaaa

SEQ ID NO: 36163 - DNA, 16 bp, H. sapiens
agcaaaagctgacaga

SEQ ID NO: 36164 - DNA, 16 bp, H. sapiens
agcaaaaggcacttct

SEQ ID NO: 36165 - DNA, 16 bp, H. sapiens
agcaaaagtaaatgaa

SEQ ID NO: 36166 - DNA, 16 bp, H. sapiens
agcaaaataaataatc

SEQ ID NO: 36167 - DNA, 16 bp, H. sapiens
agcaaaataatatttt

SEQ ID NO: 36168 - DNA, 16 bp, H. sapiens
agcaaaatatatattt

SEQ ID NO: 36169 - DNA, 16 bp, H. sapiens
agcaaaatcaccaaca

SEQ ID NO: 36170 - DNA, 16 bp, H. sapiens
agcaaaatcatctaac

SEQ ID NO: 36171 - DNA, 16 bp, H. sapiens
agcaaaatcatggaat

SEQ ID NO: 36172 - DNA, 16 bp, H. sapiens
agcaaaatgaaaatta

SEQ ID NO: 36173 - DNA, 16 bp, H. sapiens
agcaaaatgaccagct

SEQ ID NO: 36174 - DNA, 16 bp, H. sapiens
agcaaaattaatttta

SEQ ID NO: 36175 - DNA, 16 bp, H. sapiens
agcaaaatttttaaaa

SEQ ID NO: 36176 - DNA, 16 bp, H. sapiens
agcaaaattttttaaa

SEQ ID NO: 36177 - DNA, 16 bp, H. sapiens
agcaaacaaatgcaaa

SEQ ID NO: 36178 - DNA, 16 bp, H. sapiens
agcaaacaaattccaa

SEQ ID NO: 36179 - DNA, 16 bp, H. sapiens
agcaaacaccagaagc

SEQ ID NO: 36180 - DNA, 16 bp, H. sapiens
agcaaacatttactga

SEQ ID NO: 36181 - DNA, 16 bp, H. sapiens
agcaaacatttgttga

SEQ ID NO: 36182 - DNA, 16 bp, H. sapiens
agcaaaccaactccaa

SEQ ID NO: 36183 - DNA, 24 bp, H. sapiens
agcaaaccgaatccagcagcacat

SEQ ID NO: 36184 - DNA, 17 bp, H. sapiens
agcaaactaacacaaga

SEQ ID NO: 36185 - DNA, 17 bp, H. sapiens
agcaaactaacacagga

SEQ ID NO: 36186 - DNA, 16 bp, H. sapiens
agcaaactaacagaaa

SEQ ID NO: 36187 - DNA, 16 bp, H. sapiens
agcaaactatcacaag

SEQ ID NO: 36188 - DNA, 16 bp, H. sapiens
agcaaactccagcaga

SEQ ID NO: 36189 - DNA, 16 bp, H. sapiens
agcaaactttttttta

SEQ ID NO: 36190 - DNA, 16 bp, H. sapiens
agcaaagaaaatggaa

SEQ ID NO: 36191 - DNA, 16 bp, H. sapiens
agcaaagaattcaaga

SEQ ID NO: 36192 - DNA, 16 bp, H. sapiens
agcaaagaccctaagt

SEQ ID NO: 36193 - DNA, 17 bp, H. sapiens
agcaaagactgctgcct

SEQ ID NO: 36194 - DNA, 16 bp, H. sapiens
agcaaagagaaaacta

SEQ ID NO: 36195 - DNA, 17 bp, H. sapiens
agcaaagagcaggagga

SEQ ID NO: 36196 - DNA, 16 bp, H. sapiens
agcaaagagtagaatg

SEQ ID NO: 36197 - DNA, 16 bp, H. sapiens
agcaaagatatggaaa

SEQ ID NO: 36198 - DNA, 16 bp, H. sapiens
agcaaagatcacctgg

SEQ ID NO: 36199 - DNA, 16 bp, H. sapiens
agcaaagcaaaaatgg

SEQ ID NO: 36200 - DNA, 16 bp, H. sapiens
agcaaagctgaaagag

SEQ ID NO: 36201 - DNA, 16 bp, H. sapiens
agcaaagctgaaggca

SEQ ID NO: 36202 - DNA, 16 bp, H. sapiens
agcaaaggaaacagca

SEQ ID NO: 36203 - DNA, 16 bp, H. sapiens
agcaaaggaactagaa

SEQ ID NO: 36204 - DNA, 16 bp, H. sapiens
agcaaaggaagaaaat

SEQ ID NO: 36205 - DNA, 16 bp, H. sapiens
agcaaaggagactgag

SEQ ID NO: 36206 - DNA, 16 bp, H. sapiens
agcaaaggaggaagtg

SEQ ID NO: 36207 - DNA, 16 bp, H. sapiens
agcaaaggctgagaga

SEQ ID NO: 36208 - DNA, 16 bp, H. sapiens
agcaaagggaagccat

SEQ ID NO: 36209 - DNA, 16 bp, H. sapiens
agcaaaggtgactctt

SEQ ID NO: 36210 - DNA, 16 bp, H. sapiens
agcaaagtaaataaat

SEQ ID NO: 36211 - DNA, 16 bp, H. sapiens
agcaaagtcatgtctt

SEQ ID NO: 36212 - DNA, 16 bp, H. sapiens
agcaaagtcattatat

SEQ ID NO: 36213 - DNA, 16 bp, H. sapiens
agcaaagttgtggcca

SEQ ID NO: 36214 - DNA, 16 bp, H. sapiens
agcaaataaatgactt

SEQ ID NO: 36215 - DNA, 16 bp, H. sapiens
agcaaatagtgacagt

SEQ ID NO: 36216 - DNA, 16 bp, H. sapiens
agcaaatatatggaaa

SEQ ID NO: 36217 - DNA, 16 bp, H. sapiens
agcaaatatcatactg

SEQ ID NO: 36218 - DNA, 16 bp, H. sapiens
agcaaatatgataaaa

SEQ ID NO: 36219 - DNA, 16 bp, H. sapiens
agcaaatatggcaaaa

SEQ ID NO: 36220 - DNA, 16 bp, H. sapiens
agcaaatatttgtttt

SEQ ID NO: 36221 - DNA, 16 bp, H. sapiens
agcaaatcaccatgac

SEQ ID NO: 36222 - DNA, 16 bp, H. sapiens
agcaaatccagcagca

SEQ ID NO: 36223 - DNA, 16 bp, H. sapiens
agcaaatcctcttccc

SEQ ID NO: 36224 - DNA, 16 bp, H. sapiens
agcaaatgaagaaaca

SEQ ID NO: 36225 - DNA, 16 bp, H. sapiens
agcaaatgcaaaagaa

SEQ ID NO: 36226 - DNA, 16 bp, H. sapiens
agcaaatgcaacaaaa

SEQ ID NO: 36227 - DNA, 16 bp, H. sapiens
agcaaatgcagtaaaa

SEQ ID NO: 36228 - DNA, 16 bp, H. sapiens
agcaaatgctgaagga

SEQ ID NO: 36229 - DNA, 16 bp, H. sapiens
agcaaatgctgaggaa

SEQ ID NO: 36230 - DNA, 16 bp, H. sapiens
agcaaatggaaaacca

SEQ ID NO: 36231 - DNA, 16 bp, H. sapiens
agcaaatggaaagaaa

SEQ ID NO: 36232 - DNA, 16 bp, H. sapiens
agcaaatggaaagcca

SEQ ID NO: 36233 - DNA, 16 bp, H. sapiens
agcaaatggaagaaca

SEQ ID NO: 36234 - DNA, 16 bp, H. sapiens
agcaaatgtaaagcaa

SEQ ID NO: 36235 - DNA, 16 bp, H. sapiens
agcaaatgtggtaaaa

SEQ ID NO: 36236 - DNA, 16 bp, H. sapiens
agcaaattaattttaa

SEQ ID NO: 36237 - DNA, 16 bp, H. sapiens
agcaaattgaattcaa

SEQ ID NO: 36238 - DNA, 16 bp, H. sapiens
agcaaattggaaaaca

SEQ ID NO: 36239 - DNA, 16 bp, H. sapiens
agcaaattttttttaa

SEQ ID NO: 36240 - DNA, 16 bp, H. sapiens
agcaacaacaacatca

SEQ ID NO: 36241 - DNA, 16 bp, H. sapiens
agcaacaacaatgaaa

SEQ ID NO: 36242 - DNA, 16 bp, H. sapiens
agcaacaacagcagca

SEQ ID NO: 36243 - DNA, 16 bp, H. sapiens
agcaacaacagcatca

SEQ ID NO: 36244 - DNA, 16 bp, H. sapiens
agcaacaagaaatcat

SEQ ID NO: 36245 - DNA, 16 bp, H. sapiens
agcaacaagaactctc

SEQ ID NO: 36246 - DNA, 16 bp, H. sapiens
agcaacacaaaatgaa

SEQ ID NO: 36247 - DNA, 16 bp, H. sapiens
agcaacagagagagac

SEQ ID NO: 36248 - DNA, 18 bp, H. sapiens
agcaacagagcgagaccc

SEQ ID NO: 36249 - DNA, 16 bp, H. sapiens
agcaacagagtaagac

SEQ ID NO: 36250 - DNA, 16 bp, H. sapiens
agcaacaggaactccc

SEQ ID NO: 36251 - DNA, 16 bp, H. sapiens
agcaacaggaactctc

SEQ ID NO: 36252 - DNA, 16 bp, H. sapiens
agcaacaggacctaga

SEQ ID NO: 36253 - DNA, 16 bp, H. sapiens
agcaacagtgcctttt

SEQ ID NO: 36254 - DNA, 16 bp, H. sapiens
agcaacataaatttat

SEQ ID NO: 36255 - DNA, 16 bp, H. sapiens
agcaacatataaaaat

SEQ ID NO: 36256 - DNA, 16 bp, H. sapiens
agcaacatcagcaaag

SEQ ID NO: 36257 - DNA, 16 bp, H. sapiens
agcaacatcagcatca

SEQ ID NO: 36258 - DNA, 16 bp, H. sapiens
agcaacatggatgcag

SEQ ID NO: 36259 - DNA, 16 bp, H. sapiens
agcaacatggcaagac

SEQ ID NO: 36260 - DNA, 19 bp, H. sapiens
agcaacatggtgaaacccc

SEQ ID NO: 36261 - DNA, 16 bp, H. sapiens
agcaacattggcatca

SEQ ID NO: 36262 - DNA, 16 bp, H. sapiens
agcaaccaagatgccc

SEQ ID NO: 36263 - DNA, 16 bp, H. sapiens
agcaaccatgcctggc

SEQ ID NO: 36264 - DNA, 16 bp, H. sapiens
agcaacgtctcaggat

SEQ ID NO: 36265 - DNA, 16 bp, H. sapiens
agcaacgtgagaatgg

SEQ ID NO: 36266 - DNA, 16 bp, H. sapiens
agcaactcagaaggct

SEQ ID NO: 36267 - DNA, 16 bp, H. sapiens
agcaactgctgagaga

SEQ ID NO: 36268 - DNA, 16 bp, H. sapiens
agcaacttatccttca

SEQ ID NO: 36269 - DNA, 16 bp, H. sapiens
agcaacttcagccaag

SEQ ID NO: 36270 - DNA, 16 bp, H. sapiens
agcaacttccagtcct

SEQ ID NO: 36271 - DNA, 16 bp, H. sapiens
agcaagaaaatgggga

SEQ ID NO: 36272 - DNA, 16 bp, H. sapiens
agcaagaaagccagtc

SEQ ID NO: 36273 - DNA, 16 bp, H. sapiens
agcaagaagaaatcaa

SEQ ID NO: 36274 - DNA, 16 bp, H. sapiens
agcaagaaggaattct

SEQ ID NO: 36275 - DNA, 16 bp, H. sapiens
agcaagaaggcagcca

SEQ ID NO: 36276 - DNA, 16 bp, H. sapiens
agcaagaagtagcaac

SEQ ID NO: 36277 - DNA, 16 bp, H. sapiens
agcaagaagtgccaag

SEQ ID NO: 36278 - DNA, 16 bp, H. sapiens
agcaagaatctgtctc

SEQ ID NO: 36279 - DNA, 16 bp, H. sapiens
agcaagacaccatctc

SEQ ID NO: 36280 - DNA, 16 bp, H. sapiens
agcaagacactgtctc

SEQ ID NO: 36281 - DNA, 16 bp, H. sapiens
agcaagaccaaccctt

SEQ ID NO: 36282 - DNA, 16 bp, H. sapiens
agcaagaccaagaacc

SEQ ID NO: 36283 - DNA, 16 bp, H. sapiens
agcaagaccacgaacc

SEQ ID NO: 36284 - DNA, 16 bp, H. sapiens
agcaagaccacgtctc

SEQ ID NO: 36285 - DNA, 16 bp, H. sapiens
agcaagacccagtctc

SEQ ID NO: 36286 - DNA, 16 bp, H. sapiens
agcaagacccatctct

SEQ ID NO: 36287 - DNA, 16 bp, H. sapiens
agcaagaccccacctc

SEQ ID NO: 36288 - DNA, 16 bp, H. sapiens
agcaagaccccatctt

SEQ ID NO: 36289 - DNA, 16 bp, H. sapiens
agcaagaccccatttc

SEQ ID NO: 36290 - DNA, 16 bp, H. sapiens
agcaagaccccctctc

SEQ ID NO: 36291 - DNA, 16 bp, H. sapiens
agcaagaccctatctc

SEQ ID NO: 36292 - DNA, 16 bp, H. sapiens
agcaagaccctgcctc

SEQ ID NO: 36293 - DNA, 16 bp, H. sapiens
agcaagaccctgcttc

SEQ ID NO: 36294 - DNA, 16 bp, H. sapiens
agcaagaccctgtccc

SEQ ID NO: 36295 - DNA, 16 bp, H. sapiens
agcaagaccctgtcta

SEQ ID NO: 36296 - DNA, 16 bp, H. sapiens
agcaagaccctgtctc

SEQ ID NO: 36297 - DNA, 17 bp, H. sapiens
agcaagaccctgtcttg

SEQ ID NO: 36298 - DNA, 16 bp, H. sapiens
agcaagaccctgtgtc

SEQ ID NO: 36299 - DNA, 16 bp, H. sapiens
agcaagaccctttctc

SEQ ID NO: 36300 - DNA, 16 bp, H. sapiens
agcaagacctcatctg

SEQ ID NO: 36301 - DNA, 16 bp, H. sapiens
agcaagacctcatttc

SEQ ID NO: 36302 - DNA, 16 bp, H. sapiens
agcaagacctcgtctc

SEQ ID NO: 36303 - DNA, 16 bp, H. sapiens
agcaagacgctgtctc

SEQ ID NO: 36304 - DNA, 16 bp, H. sapiens
agcaagactaataaaa

SEQ ID NO: 36305 - DNA, 16 bp, H. sapiens
agcaagactcagtctc

SEQ ID NO: 36306 - DNA, 16 bp, H. sapiens
agcaagactccacctc

SEQ ID NO: 36307 - DNA, 16 bp, H. sapiens
agcaagactccatctc

SEQ ID NO: 36308 - DNA, 17 bp, H. sapiens
agcaagactccatctcc

SEQ ID NO: 36309 - DNA, 16 bp, H. sapiens
agcaagactctgcttc

SEQ ID NO: 36310 - DNA, 16 bp, H. sapiens
agcaagactctgtcca

SEQ ID NO: 36311 - DNA, 17 bp, H. sapiens
agcaagactctgtcttg

SEQ ID NO: 36312 - DNA, 16 bp, H. sapiens
agcaagactgcatctc

SEQ ID NO: 36313 - DNA, 16 bp, H. sapiens
agcaagacttcatctc

SEQ ID NO: 36314 - DNA, 16 bp, H. sapiens
agcaagagaactggaa

SEQ ID NO: 36315 - DNA, 16 bp, H. sapiens
agcaagagaagtagaa

SEQ ID NO: 36316 - DNA, 16 bp, H. sapiens
agcaagagagagaggc

SEQ ID NO: 36317 - DNA, 16 bp, H. sapiens
agcaagagagagtgag

SEQ ID NO: 36318 - DNA, 16 bp, H. sapiens
agcaagagcgaaactc

SEQ ID NO: 36319 - DNA, 16 bp, H. sapiens
agcaagagctcactca

SEQ ID NO: 36320 - DNA, 16 bp, H. sapiens
agcaagagtcaccttt

SEQ ID NO: 36321 - DNA, 16 bp, H. sapiens
agcaagatagtcttca

SEQ ID NO: 36322 - DNA, 16 bp, H. sapiens
agcaagatccccatct

SEQ ID NO: 36323 - DNA, 16 bp, H. sapiens
agcaagatcctgtctc

SEQ ID NO: 36324 - DNA, 16 bp, H. sapiens
agcaagatcttgtctc

SEQ ID NO: 36325 - DNA, 16 bp, H. sapiens
agcaagatgaagagga

SEQ ID NO: 36326 - DNA, 16 bp, H. sapiens
agcaagatgaagtcag

SEQ ID NO: 36327 - DNA, 16 bp, H. sapiens
agcaagatgccatttt

SEQ ID NO: 36328 - DNA, 16 bp, H. sapiens
agcaagatggagttgg

SEQ ID NO: 36329 - DNA, 16 bp, H. sapiens
agcaagattccatctc

SEQ ID NO: 36330 - DNA, 16 bp, H. sapiens
agcaagattctgtctc

SEQ ID NO: 36331 - DNA, 16 bp, H. sapiens
agcaagattctgtttc

SEQ ID NO: 36332 - DNA, 16 bp, H. sapiens
agcaagattgtgccac

SEQ ID NO: 36333 - DNA, 16 bp, H. sapiens
agcaagatttcatctc

SEQ ID NO: 36334 - DNA, 16 bp, H. sapiens
agcaagatttttaaaa

SEQ ID NO: 36335 - DNA, 16 bp, H. sapiens
agcaagcaagcaagca

SEQ ID NO: 36336 - DNA, 16 bp, H. sapiens
agcaagcacatcttca

SEQ ID NO: 36337 - DNA, 16 bp, H. sapiens
agcaagcagcaggacc

SEQ ID NO: 36338 - DNA, 16 bp, H. sapiens
agcaagccaagatcat

SEQ ID NO: 36339 - DNA, 16 bp, H. sapiens
agcaagccctgggccc

SEQ ID NO: 36340 - DNA, 16 bp, H. sapiens
agcaagcctctgtctc

SEQ ID NO: 36341 - DNA, 16 bp, H. sapiens
agcaagctcccaggtg

SEQ ID NO: 36342 - DNA, 16 bp, H. sapiens
agcaagctcctgggga

SEQ ID NO: 36343 - DNA, 17 bp, H. sapiens
agcaagctgagagccac

SEQ ID NO: 36344 - DNA, 16 bp, H. sapiens
agcaagctgagatcat

SEQ ID NO: 36345 - DNA, 16 bp, H. sapiens
agcaagctgcactttt

SEQ ID NO: 36346 - DNA, 16 bp, H. sapiens
agcaagctggataaag

SEQ ID NO: 36347 - DNA, 16 bp, H. sapiens
agcaaggaagccagtg

SEQ ID NO: 36348 - DNA, 16 bp, H. sapiens
agcaaggaagctaaaa

SEQ ID NO: 36349 - DNA, 17 bp, H. sapiens
agcaaggaatattaata

SEQ ID NO: 36350 - DNA, 16 bp, H. sapiens
agcaaggagaaccagt

SEQ ID NO: 36351 - DNA, 16 bp, H. sapiens
agcaaggagaccagtg

SEQ ID NO: 36352 - DNA, 20 bp, H. sapiens
agcaaggagccagcaagtct

SEQ ID NO: 36353 - DNA, 16 bp, H. sapiens
agcaaggagcctaatg

SEQ ID NO: 36354 - DNA, 16 bp, H. sapiens
agcaaggaggcaggag

SEQ ID NO: 36355 - DNA, 16 bp, H. sapiens
agcaaggatatggaga

SEQ ID NO: 36356 - DNA, 16 bp, H. sapiens
agcaaggcagagaaga

SEQ ID NO: 36357 - DNA, 16 bp, H. sapiens
agcaaggctctgcctc

SEQ ID NO: 36358 - DNA, 16 bp, H. sapiens
agcaagggctgccagc

SEQ ID NO: 36359 - DNA, 16 bp, H. sapiens
agcaaggtggcagaat

SEQ ID NO: 36360 - DNA, 16 bp, H. sapiens
agcaagtatttactga

SEQ ID NO: 36361 - DNA, 16 bp, H. sapiens
agcaagtcacaaggcc

SEQ ID NO: 36362 - DNA, 16 bp, H. sapiens
agcaagtcataatctt

SEQ ID NO: 36363 - DNA, 16 bp, H. sapiens
agcaagtccttggaga

SEQ ID NO: 36364 - DNA, 16 bp, H. sapiens
agcaagtctacctggc

SEQ ID NO: 36365 - DNA, 16 bp, H. sapiens
agcaagtcttaacaaa

SEQ ID NO: 36366 - DNA, 16 bp, H. sapiens
agcaagttatctagaa

SEQ ID NO: 36367 - DNA, 16 bp, H. sapiens
agcaagttgttcaatt

SEQ ID NO: 36368 - DNA, 16 bp, H. sapiens
agcaataaaacatttt

SEQ ID NO: 36369 - DNA, 16 bp, H. sapiens
agcaataaaagaaatg

SEQ ID NO: 36370 - DNA, 16 bp, H. sapiens
agcaataaaatatttt

SEQ ID NO: 36371 - DNA, 16 bp, H. sapiens
agcaataaagctgttt

SEQ ID NO: 36372 - DNA, 16 bp, H. sapiens
agcaataaatttctat

SEQ ID NO: 36373 - DNA, 16 bp, H. sapiens
agcaataacaacagca

SEQ ID NO: 36374 - DNA, 16 bp, H. sapiens
agcaataacttaagca

SEQ ID NO: 36375 - DNA, 16 bp, H. sapiens
agcaataatttttaaa

SEQ ID NO: 36376 - DNA, 16 bp, H. sapiens
agcaataatttttttt

SEQ ID NO: 36377 - DNA, 16 bp, H. sapiens
agcaatacaaagaaat

SEQ ID NO: 36378 - DNA, 16 bp, H. sapiens
agcaatactccgtctc

SEQ ID NO: 36379 - DNA, 16 bp, H. sapiens
agcaatagaaaactaa

SEQ ID NO: 36380 - DNA, 16 bp, H. sapiens
agcaatagcaaacaaa

SEQ ID NO: 36381 - DNA, 16 bp, H. sapiens
agcaatagcaacaaaa

SEQ ID NO: 36382 - DNA, 16 bp, H. sapiens
agcaatagcagcagca

SEQ ID NO: 36383 - DNA, 16 bp, H. sapiens
agcaatagggaaagga

SEQ ID NO: 36384 - DNA, 16 bp, H. sapiens
agcaatatatgaaaat

SEQ ID NO: 36385 - DNA, 16 bp, H. sapiens
agcaatattcactgtt

SEQ ID NO: 36386 - DNA, 16 bp, H. sapiens
agcaatatttattttt

SEQ ID NO: 36387 - DNA, 16 bp, H. sapiens
agcaatatttctcaaa

SEQ ID NO: 36388 - DNA, 16 bp, H. sapiens
agcaatcagacaacag

SEQ ID NO: 36389 - DNA, 16 bp, H. sapiens
agcaatccaggaaatg

SEQ ID NO: 36390 - DNA, 16 bp, H. sapiens
agcaatccccaacctt

SEQ ID NO: 36391 - DNA, 17 bp, H. sapiens
agcaatcctaagcaaaa

SEQ ID NO: 36392 - DNA, 17 bp, H. sapiens
agcaatcctcctgcctt

SEQ ID NO: 36393 - DNA, 16 bp, H. sapiens
agcaatcctctgcttc

SEQ ID NO: 36394 - DNA, 16 bp, H. sapiens
agcaatcctgccacct

SEQ ID NO: 36395 - DNA, 16 bp, H. sapiens
agcaatccttctgctt

SEQ ID NO: 36396 - DNA, 16 bp, H. sapiens
agcaatcttcccaccc

SEQ ID NO: 36397 - DNA, 16 bp, H. sapiens
agcaatgaaagaaaag

SEQ ID NO: 36398 - DNA, 16 bp, H. sapiens
agcaatgaagaaaata

SEQ ID NO: 36399 - DNA, 16 bp, H. sapiens
agcaatgcagaagaca

SEQ ID NO: 36400 - DNA, 16 bp, H. sapiens
agcaatgcagaagatg

SEQ ID NO: 36401 - DNA, 16 bp, H. sapiens
agcaatgccccactcc

SEQ ID NO: 36402 - DNA, 16 bp, H. sapiens
agcaatgccttcaaaa

SEQ ID NO: 36403 - DNA, 16 bp, H. sapiens
agcaatggaaaactaa

SEQ ID NO: 36404 - DNA, 16 bp, H. sapiens
agcaatggatccaaac

SEQ ID NO: 36405 - DNA, 16 bp, H. sapiens
agcaatggatccaagc

SEQ ID NO: 36406 - DNA, 16 bp, H. sapiens
agcaatggcaacaaag

SEQ ID NO: 36407 - DNA, 16 bp, H. sapiens
agcaatggggaaaggg

SEQ ID NO: 36408 - DNA, 16 bp, H. sapiens
agcaatggtgtgatct

SEQ ID NO: 36409 - DNA, 16 bp, H. sapiens
agcaatgtggcaaaac

SEQ ID NO: 36410 - DNA, 16 bp, H. sapiens
agcaatgtgtgagaat

SEQ ID NO: 36411 - DNA, 16 bp, H. sapiens
agcaatgttgaatttt

SEQ ID NO: 36412 - DNA, 16 bp, H. sapiens
agcaattacattaaat

SEQ ID NO: 36413 - DNA, 16 bp, H. sapiens
agcaattagacaagaa

SEQ ID NO: 36414 - DNA, 16 bp, H. sapiens
agcaattattttcttt

SEQ ID NO: 36415 - DNA, 16 bp, H. sapiens
agcaattatttttaaa

SEQ ID NO: 36416 - DNA, 16 bp, H. sapiens
agcaattcaagtcaag

SEQ ID NO: 36417 - DNA, 16 bp, H. sapiens
agcaattcacctgcct

SEQ ID NO: 36418 - DNA, 16 bp, H. sapiens
agcaattctactccta

SEQ ID NO: 36419 - DNA, 16 bp, H. sapiens
agcaattctcattcct

SEQ ID NO: 36420 - DNA, 16 bp, H. sapiens
agcaattctccctgcc

SEQ ID NO: 36421 - DNA, 16 bp, H. sapiens
agcaattcttcctgcc

SEQ ID NO: 36422 - DNA, 16 bp, H. sapiens
agcaattgccacaaaa

SEQ ID NO: 36423 - DNA, 16 bp, H. sapiens
agcaattgtttaaagt

SEQ ID NO: 36424 - DNA, 16 bp, H. sapiens
agcaatttcagcaaag

SEQ ID NO: 36425 - DNA, 16 bp, H. sapiens
agcaatttgggaggcc

SEQ ID NO: 36426 - DNA, 16 bp, H. sapiens
agcaattttttttttc

SEQ ID NO: 36427 - DNA, 16 bp, H. sapiens
agcacaaaacacagat

SEQ ID NO: 36428 - DNA, 16 bp, H. sapiens
agcacaaagcagtttc

SEQ ID NO: 36429 - DNA, 16 bp, H. sapiens
agcacaaagcctggca

SEQ ID NO: 36430 - DNA, 16 bp, H. sapiens
agcacaaaggagattc

SEQ ID NO: 36431 - DNA, 16 bp, H. sapiens
agcacaacaaaaagct

SEQ ID NO: 36432 - DNA, 16 bp, H. sapiens
agcacaacaacatggc

SEQ ID NO: 36433 - DNA, 16 bp, H. sapiens
agcacaagcaataaaa

SEQ ID NO: 36434 - DNA, 16 bp, H. sapiens
agcacaatgcccagca

SEQ ID NO: 36435 - DNA, 16 bp, H. sapiens
agcacaatgggaggcc

SEQ ID NO: 36436 - DNA, 16 bp, H. sapiens
agcacaatgtctggca

SEQ ID NO: 36437 - DNA, 16 bp, H. sapiens
agcacaattcctggca

SEQ ID NO: 36438 - DNA, 16 bp, H. sapiens
agcacacaggcacaca

SEQ ID NO: 36439 - DNA, 16 bp, H. sapiens
agcacacagtaggtgc

SEQ ID NO: 36440 - DNA, 16 bp, H. sapiens
agcacacatgtgcaca

SEQ ID NO: 36441 - DNA, 16 bp, H. sapiens
agcacaccaaggacct

SEQ ID NO: 36442 - DNA, 16 bp, H. sapiens
agcacactaaacaaaa

SEQ ID NO: 36443 - DNA, 16 bp, H. sapiens
agcacactgaacaaag

SEQ ID NO: 36444 - DNA, 16 bp, H. sapiens
agcacagaacctggca

SEQ ID NO: 36445 - DNA, 16 bp, H. sapiens
agcacagagaggttaa

SEQ ID NO: 36446 - DNA, 16 bp, H. sapiens
agcacagagcccagca

SEQ ID NO: 36447 - DNA, 16 bp, H. sapiens
agcacagcaagacccc

SEQ ID NO: 36448 - DNA, 16 bp, H. sapiens
agcacagcaagcagca

SEQ ID NO: 36449 - DNA, 16 bp, H. sapiens
agcacagcacagctgc

SEQ ID NO: 36450 - DNA, 16 bp, H. sapiens
agcacagcagctgctg

SEQ ID NO: 36451 - DNA, 16 bp, H. sapiens
agcacagcctggagct

SEQ ID NO: 36452 - DNA, 16 bp, H. sapiens
agcacagtccctggca

SEQ ID NO: 36453 - DNA, 16 bp, H. sapiens
agcacagtgccaggaa

SEQ ID NO: 36454 - DNA, 16 bp, H. sapiens
agcacagtgcctggca

SEQ ID NO: 36455 - DNA, 16 bp, H. sapiens
agcacagtgccttgca

SEQ ID NO: 36456 - DNA, 16 bp, H. sapiens
agcacagtggtgcaat

SEQ ID NO: 36457 - DNA, 16 bp, H. sapiens
agcacagtgtcaggca

SEQ ID NO: 36458 - DNA, 16 bp, H. sapiens
agcacagtgtgtggca

SEQ ID NO: 36459 - DNA, 16 bp, H. sapiens
agcacatatactaaaa

SEQ ID NO: 36460 - DNA, 16 bp, H. sapiens
agcacatcaaaaagat

SEQ ID NO: 36461 - DNA, 16 bp, H. sapiens
agcacatcaaaaatat

SEQ ID NO: 36462 - DNA, 16 bp, H. sapiens
agcacatctttttttt

SEQ ID NO: 36463 - DNA, 16 bp, H. sapiens
agcacatgaaaagagg

SEQ ID NO: 36464 - DNA, 16 bp, H. sapiens
agcacatgaagaaatg

SEQ ID NO: 36465 - DNA, 16 bp, H. sapiens
agcacatggaaagatg

SEQ ID NO: 36466 - DNA, 16 bp, H. sapiens
agcacatgtatcccag

SEQ ID NO: 36467 - DNA, 16 bp, H. sapiens
agcacattaaaaagat

SEQ ID NO: 36468 - DNA, 16 bp, H. sapiens
agcacattatatttat

SEQ ID NO: 36469 - DNA, 17 bp, H. sapiens
agcacattcctttccct

SEQ ID NO: 36470 - DNA, 16 bp, H. sapiens
agcacattttatttta

SEQ ID NO: 36471 - DNA, 16 bp, H. sapiens
agcacattttttaaaa

SEQ ID NO: 36472 - DNA, 16 bp, H. sapiens
agcaccaaatgctggt

SEQ ID NO: 36473 - DNA, 16 bp, H. sapiens
agcaccaacctgctct

SEQ ID NO: 36474 - DNA, 16 bp, H. sapiens
agcaccaacttgccag

SEQ ID NO: 36475 - DNA, 16 bp, H. sapiens
agcaccaagcaggctc

SEQ ID NO: 36476 - DNA, 16 bp, H. sapiens
agcaccacactgtctt

SEQ ID NO: 36477 - DNA, 16 bp, H. sapiens
agcaccacagggcagg

SEQ ID NO: 36478 - DNA, 16 bp, H. sapiens
agcaccaccaccatca

SEQ ID NO: 36479 - DNA, 16 bp, H. sapiens
agcaccaccagacttt

SEQ ID NO: 36480 - DNA, 16 bp, H. sapiens
agcaccagctgcagta

SEQ ID NO: 36481 - DNA, 16 bp, H. sapiens
agcaccaggaggtatc

SEQ ID NO: 36482 - DNA, 16 bp, H. sapiens
agcaccagggcagaca

SEQ ID NO: 36483 - DNA, 16 bp, H. sapiens
agcaccagtccctcaa

SEQ ID NO: 36484 - DNA, 16 bp, H. sapiens
agcaccatcaccatca

SEQ ID NO: 36485 - DNA, 16 bp, H. sapiens
agcaccatgagaacag

SEQ ID NO: 36486 - DNA, 16 bp, H. sapiens
agcaccatgctgtttt

SEQ ID NO: 36487 - DNA, 16 bp, H. sapiens
agcaccatttgttgaa

SEQ ID NO: 36488 - DNA, 16 bp, H. sapiens
agcacccaagtcacct

SEQ ID NO: 36489 - DNA, 16 bp, H. sapiens
agcacccagattcaca

SEQ ID NO: 36490 - DNA, 16 bp, H. sapiens
agcacccagcacccag

SEQ ID NO: 36491 - DNA, 16 bp, H. sapiens
agcaccccctccagag

SEQ ID NO: 36492 - DNA, 16 bp, H. sapiens
agcacccctgtgacca

SEQ ID NO: 36493 - DNA, 16 bp, H. sapiens
agcacccgccaccacg

SEQ ID NO: 36494 - DNA, 17 bp, H. sapiens
agcaccctgtcaaaatg

SEQ ID NO: 36495 - DNA, 16 bp, H. sapiens
agcacctaaaacagtg

SEQ ID NO: 36496 - DNA, 16 bp, H. sapiens
agcacctactatgtgt

SEQ ID NO: 36497 - DNA, 16 bp, H. sapiens
agcacctactatttgc

SEQ ID NO: 36498 - DNA, 16 bp, H. sapiens
agcacctactctgtgc

SEQ ID NO: 36499 - DNA, 16 bp, H. sapiens
agcacctactgcatgc

SEQ ID NO: 36500 - DNA, 16 bp, H. sapiens
agcacctactgtgtgc

SEQ ID NO: 36501 - DNA, 16 bp, H. sapiens
agcacctactgtgttc

SEQ ID NO: 36502 - DNA, 16 bp, H. sapiens
agcacctcctcagcct

SEQ ID NO: 36503 - DNA, 16 bp, H. sapiens
agcacctctcccctct

SEQ ID NO: 36504 - DNA, 16 bp, H. sapiens
agcacctgcctcacag

SEQ ID NO: 36505 - DNA, 16 bp, H. sapiens
agcacctgctacatgc

SEQ ID NO: 36506 - DNA, 16 bp, H. sapiens
agcacctgctctggag

SEQ ID NO: 36507 - DNA, 16 bp, H. sapiens
agcacctgctgtgtgt

SEQ ID NO: 36508 - DNA, 16 bp, H. sapiens
agcacctgggagaagg

SEQ ID NO: 36509 - DNA, 20 bp, H. sapiens
agcacctgggccagcggctg

SEQ ID NO: 36510 - DNA, 16 bp, H. sapiens
agcacctgggcttggc

SEQ ID NO: 36511 - DNA, 16 bp, H. sapiens
agcacctgttattttt

SEQ ID NO: 36512 - DNA, 16 bp, H. sapiens
agcaccttcatgagaa

SEQ ID NO: 36513 - DNA, 16 bp, H. sapiens
agcacgaccctgtctc

SEQ ID NO: 36514 - DNA, 16 bp, H. sapiens
agcacgactccatctc

SEQ ID NO: 36515 - DNA, 16 bp, H. sapiens
agcacgactctgtctc

SEQ ID NO: 36516 - DNA, 19 bp, H. sapiens
agcacgttgtcacctctca

SEQ ID NO: 36517 - DNA, 16 bp, H. sapiens
agcactaacctgctct

SEQ ID NO: 36518 - DNA, 16 bp, H. sapiens
agcactattaacattt

SEQ ID NO: 36519 - DNA, 16 bp, H. sapiens
agcactattctaagca

SEQ ID NO: 36520 - DNA, 16 bp, H. sapiens
agcactcaaaaagttt

SEQ ID NO: 36521 - DNA, 16 bp, H. sapiens
agcactcagatatata

SEQ ID NO: 36522 - DNA, 16 bp, H. sapiens
agcactcatctccatc

SEQ ID NO: 36523 - DNA, 17 bp, H. sapiens
agcactccagcctgggc

SEQ ID NO: 36524 - DNA, 16 bp, H. sapiens
agcactcccagcagct

SEQ ID NO: 36525 - DNA, 16 bp, H. sapiens
agcactctgaaaggcc

SEQ ID NO: 36526 - DNA, 16 bp, H. sapiens
agcactctgcaaaatg

SEQ ID NO: 36527 - DNA, 16 bp, H. sapiens
agcactgcacatatga

SEQ ID NO: 36528 - DNA, 16 bp, H. sapiens
agcactggctttggag

SEQ ID NO: 36529 - DNA, 16 bp, H. sapiens
agcactgggaccacag

SEQ ID NO: 36530 - DNA, 16 bp, H. sapiens
agcactgggcctggca

SEQ ID NO: 36531 - DNA, 16 bp, H. sapiens
agcactgggtttacag

SEQ ID NO: 36532 - DNA, 16 bp, H. sapiens
agcactgtgctgggag

SEQ ID NO: 36533 - DNA, 16 bp, H. sapiens
agcactgtgggaagcc

SEQ ID NO: 36534 - DNA, 16 bp, H. sapiens
agcactgttctggaat

SEQ ID NO: 36535 - DNA, 16 bp, H. sapiens
agcactgttttttttt

SEQ ID NO: 36536 - DNA, 16 bp, H. sapiens
agcacttaagttttta

SEQ ID NO: 36537 - DNA, 16 bp, H. sapiens
agcacttaataaatgt

SEQ ID NO: 36538 - DNA, 16 bp, H. sapiens
agcacttactgagcac

SEQ ID NO: 36539 - DNA, 16 bp, H. sapiens
agcacttcaaatatgt

SEQ ID NO: 36540 - DNA, 16 bp, H. sapiens
agcacttccagtacta

SEQ ID NO: 36541 - DNA, 16 bp, H. sapiens
agcacttctctgtgtt

SEQ ID NO: 36542 - DNA, 16 bp, H. sapiens
agcacttgaaatgtga

SEQ ID NO: 36543 - DNA, 16 bp, H. sapiens
agcacttgctcagctc

SEQ ID NO: 36544 - DNA, 16 bp, H. sapiens
agcacttgtggaggcc

SEQ ID NO: 36545 - DNA, 16 bp, H. sapiens
agcactttaaagatgt

SEQ ID NO: 36546 - DNA, 16 bp, H. sapiens
agcactttattttatt

SEQ ID NO: 36547 - DNA, 16 bp, H. sapiens
agcactttcagaagct

SEQ ID NO: 36548 - DNA, 16 bp, H. sapiens
agcactttgaaaatat

SEQ ID NO: 36549 - DNA, 16 bp, H. sapiens
agcactttgaaagacc

SEQ ID NO: 36550 - DNA, 16 bp, H. sapiens
agcactttgaagccta

SEQ ID NO: 36551 - DNA, 16 bp, H. sapiens
agcactttgaatacat

SEQ ID NO: 36552 - DNA, 16 bp, H. sapiens
agcactttgagaggcc

SEQ ID NO: 36553 - DNA, 16 bp, H. sapiens
agcactttggaaggct

SEQ ID NO: 36554 - DNA, 16 bp, H. sapiens
agcactttgggaagac

SEQ ID NO: 36555 - DNA, 16 bp, H. sapiens
agcactttgggaagtt

SEQ ID NO: 36556 - DNA, 16 bp, H. sapiens
agcactttgggagctg

SEQ ID NO: 36557 - DNA, 16 bp, H. sapiens
agcactttgggggacc

SEQ ID NO: 36558 - DNA, 16 bp, H. sapiens
agcactttgtatatat

SEQ ID NO: 36559 - DNA, 16 bp, H. sapiens
agcactttgtgaggtc

SEQ ID NO: 36560 - DNA, 16 bp, H. sapiens
agcacttttagaggcc

SEQ ID NO: 36561 - DNA, 16 bp, H. sapiens
agcagaaaataattta

SEQ ID NO: 36562 - DNA, 16 bp, H. sapiens
agcagaaaatgaaaat

SEQ ID NO: 36563 - DNA, 16 bp, H. sapiens
agcagaaacaaatgaa

SEQ ID NO: 36564 - DNA, 16 bp, H. sapiens
agcagaaacatggaat

SEQ ID NO: 36565 - DNA, 16 bp, H. sapiens
agcagaaaccttacag

SEQ ID NO: 36566 - DNA, 16 bp, H. sapiens
agcagaaactttacaa

SEQ ID NO: 36567 - DNA, 16 bp, H. sapiens
agcagaaagaaaaatg

SEQ ID NO: 36568 - DNA, 16 bp, H. sapiens
agcagaaagaaatgct

SEQ ID NO: 36569 - DNA, 16 bp, H. sapiens
agcagaaaggaaaacc

SEQ ID NO: 36570 - DNA, 16 bp, H. sapiens
agcagaaagtacagag

SEQ ID NO: 36571 - DNA, 16 bp, H. sapiens
agcagaaataaaatgg

SEQ ID NO: 36572 - DNA, 16 bp, H. sapiens
agcagaaataagtgaa

SEQ ID NO: 36573 - DNA, 16 bp, H. sapiens
agcagaaatattttga

SEQ ID NO: 36574 - DNA, 16 bp, H. sapiens
agcagaaatcaataaa

SEQ ID NO: 36575 - DNA, 16 bp, H. sapiens
agcagaaatgaatgaa

SEQ ID NO: 36576 - DNA, 16 bp, H. sapiens
agcagaaatgatcaag

SEQ ID NO: 36577 - DNA, 16 bp, H. sapiens
agcagaaatggacaaa

SEQ ID NO: 36578 - DNA, 16 bp, H. sapiens
agcagaaatgtattct

SEQ ID NO: 36579 - DNA, 16 bp, H. sapiens
agcagaaattctggag

SEQ ID NO: 36580 - DNA, 16 bp, H. sapiens
agcagaacaaaatgaa

SEQ ID NO: 36581 - DNA, 16 bp, H. sapiens
agcagaacaatttttc

SEQ ID NO: 36582 - DNA, 16 bp, H. sapiens
agcagaactcaaggag

SEQ ID NO: 36583 - DNA, 16 bp, H. sapiens
agcagaactgaagaaa

SEQ ID NO: 36584 - DNA, 16 bp, H. sapiens
agcagaactgaaggaa

SEQ ID NO: 36585 - DNA, 16 bp, H. sapiens
agcagaactgaagggg

SEQ ID NO: 36586 - DNA, 16 bp, H. sapiens
agcagaactgatggag

SEQ ID NO: 36587 - DNA, 16 bp, H. sapiens
agcagaagaaaaaagt

SEQ ID NO: 36588 - DNA, 16 bp, H. sapiens
agcagaagaaaaatta

SEQ ID NO: 36589 - DNA, 16 bp, H. sapiens
agcagaagaaagaacc

SEQ ID NO: 36590 - DNA, 16 bp, H. sapiens
agcagaagaaagaagt

SEQ ID NO: 36591 - DNA, 16 bp, H. sapiens
agcagaagaaagaatg

SEQ ID NO: 36592 - DNA, 16 bp, H. sapiens
agcagaagaaagattt

SEQ ID NO: 36593 - DNA, 16 bp, H. sapiens
agcagaagaaatagaa

SEQ ID NO: 36594 - DNA, 16 bp, H. sapiens
agcagaagagagtgaa

SEQ ID NO: 36595 - DNA, 16 bp, H. sapiens
agcagaagagtgacat

SEQ ID NO: 36596 - DNA, 16 bp, H. sapiens
agcagaagcagcagca

SEQ ID NO: 36597 - DNA, 16 bp, H. sapiens
agcagaagcaggaaga

SEQ ID NO: 36598 - DNA, 16 bp, H. sapiens
agcagaagcagggtgg

SEQ ID NO: 36599 - DNA, 16 bp, H. sapiens
agcagaaggaaaaaat

SEQ ID NO: 36600 - DNA, 16 bp, H. sapiens
agcagaaggaaaggca

SEQ ID NO: 36601 - DNA, 16 bp, H. sapiens
agcagaaggaacagca

SEQ ID NO: 36602 - DNA, 16 bp, H. sapiens
agcagaagggcctgac

SEQ ID NO: 36603 - DNA, 16 bp, H. sapiens
agcagaagtaaagaaa

SEQ ID NO: 36604 - DNA, 16 bp, H. sapiens
agcagaatagaccaag

SEQ ID NO: 36605 - DNA, 16 bp, H. sapiens
agcagaatgaataaaa

SEQ ID NO: 36606 - DNA, 16 bp, H. sapiens
agcagaattaaataaa

SEQ ID NO: 36607 - DNA, 16 bp, H. sapiens
agcagaattacttgaa

SEQ ID NO: 36608 - DNA, 16 bp, H. sapiens
agcagaattgctggat

SEQ ID NO: 36609 - DNA, 16 bp, H. sapiens
agcagacaacctacag

SEQ ID NO: 36610 - DNA, 16 bp, H. sapiens
agcagacacacagacc

SEQ ID NO: 36611 - DNA, 16 bp, H. sapiens
agcagacaccctgctg

SEQ ID NO: 36612 - DNA, 16 bp, H. sapiens
agcagacagagctagg

SEQ ID NO: 36613 - DNA, 16 bp, H. sapiens
agcagacagtaaaaca

SEQ ID NO: 36614 - DNA, 16 bp, H. sapiens
agcagacatgtcacat

SEQ ID NO: 36615 - DNA, 16 bp, H. sapiens
agcagaccctgaagga

SEQ ID NO: 36616 - DNA, 16 bp, H. sapiens
agcagactctgtctca

SEQ ID NO: 36617 - DNA, 16 bp, H. sapiens
agcagactgcctcctc

SEQ ID NO: 36618 - DNA, 16 bp, H. sapiens
agcagacttgatcaag

SEQ ID NO: 36619 - DNA, 16 bp, H. sapiens
agcagagaaaaaaagt

SEQ ID NO: 36620 - DNA, 16 bp, H. sapiens
agcagagaaaacagca

SEQ ID NO: 36621 - DNA, 16 bp, H. sapiens
agcagagaaactggaa

SEQ ID NO: 36622 - DNA, 16 bp, H. sapiens
agcagagaagaaaaat

SEQ ID NO: 36623 - DNA, 16 bp, H. sapiens
agcagagaagaaatgt

SEQ ID NO: 36624 - DNA, 16 bp, H. sapiens
agcagagaagcagaga

SEQ ID NO: 36625 - DNA, 16 bp, H. sapiens
agcagagaataaaata

SEQ ID NO: 36626 - DNA, 16 bp, H. sapiens
agcagagaccatgcca

SEQ ID NO: 36627 - DNA, 16 bp, H. sapiens
agcagagagaacagca

SEQ ID NO: 36628 - DNA, 16 bp, H. sapiens
agcagagagaagccag

SEQ ID NO: 36629 - DNA, 16 bp, H. sapiens
agcagagagccaaatc

SEQ ID NO: 36630 - DNA, 16 bp, H. sapiens
agcagagaggaggccc

SEQ ID NO: 36631 - DNA, 16 bp, H. sapiens
agcagagatcaggcca

SEQ ID NO: 36632 - DNA, 16 bp, H. sapiens
agcagagatcatgcca

SEQ ID NO: 36633 - DNA, 16 bp, H. sapiens
agcagagatggcacca

SEQ ID NO: 36634 - DNA, 16 bp, H. sapiens
agcagagattgcacca

SEQ ID NO: 36635 - DNA, 16 bp, H. sapiens
agcagagcagctgctc

SEQ ID NO: 36636 - DNA, 16 bp, H. sapiens
agcagagcagtctgag

SEQ ID NO: 36637 - DNA, 16 bp, H. sapiens
agcagagcataaaaga

SEQ ID NO: 36638 - DNA, 16 bp, H. sapiens
agcagagcataaaagc

SEQ ID NO: 36639 - DNA, 16 bp, H. sapiens
agcagagccaggagag

SEQ ID NO: 36640 - DNA, 16 bp, H. sapiens
agcagagctaaaagag

SEQ ID NO: 36641 - DNA, 16 bp, H. sapiens
agcagagcttgtagct

SEQ ID NO: 36642 - DNA, 16 bp, H. sapiens
agcagaggaaacactt

SEQ ID NO: 36643 - DNA, 16 bp, H. sapiens
agcagaggaaataaaa

SEQ ID NO: 36644 - DNA, 16 bp, H. sapiens
agcagaggaaatggca

SEQ ID NO: 36645 - DNA, 16 bp, H. sapiens
agcagaggaatgacat

SEQ ID NO: 36646 - DNA, 16 bp, H. sapiens
agcagaggaggctggg

SEQ ID NO: 36647 - DNA, 16 bp, H. sapiens
agcagaggagtgactt

SEQ ID NO: 36648 - DNA, 16 bp, H. sapiens
agcagaggcacaggtg

SEQ ID NO: 36649 - DNA, 16 bp, H. sapiens
agcagaggcagccata

SEQ ID NO: 36650 - DNA, 16 bp, H. sapiens
agcagaggcagctgtg

SEQ ID NO: 36651 - DNA, 16 bp, H. sapiens
agcagaggcaggaaga

SEQ ID NO: 36652 - DNA, 16 bp, H. sapiens
agcagaggcaggagaa

SEQ ID NO: 36653 - DNA, 16 bp, H. sapiens
agcagaggcaggagga

SEQ ID NO: 36654 - DNA, 16 bp, H. sapiens
agcagaggcaggtgga

SEQ ID NO: 36655 - DNA, 16 bp, H. sapiens
agcagaggccagagag

SEQ ID NO: 36656 - DNA, 16 bp, H. sapiens
agcagaggcctgagga

SEQ ID NO: 36657 - DNA, 16 bp, H. sapiens
agcagaggctacagaa

SEQ ID NO: 36658 - DNA, 16 bp, H. sapiens
agcagaggctgaagaa

SEQ ID NO: 36659 - DNA, 16 bp, H. sapiens
agcagaggctgcagtg

SEQ ID NO: 36660 - DNA, 16 bp, H. sapiens
agcagaggctggagtg

SEQ ID NO: 36661 - DNA, 16 bp, H. sapiens
agcagaggcttcagaa

SEQ ID NO: 36662 - DNA, 16 bp, H. sapiens
agcagagggaagagca

SEQ ID NO: 36663 - DNA, 16 bp, H. sapiens
agcagagggaggtggg

SEQ ID NO: 36664 - DNA, 16 bp, H. sapiens
agcagaggggcctgac

SEQ ID NO: 36665 - DNA, 16 bp, H. sapiens
agcagaggtcagagag

SEQ ID NO: 36666 - DNA, 16 bp, H. sapiens
agcagagtttccaggg

SEQ ID NO: 36667 - DNA, 16 bp, H. sapiens
agcagatacaagaaaa

SEQ ID NO: 36668 - DNA, 16 bp, H. sapiens
agcagataccagcacc

SEQ ID NO: 36669 - DNA, 16 bp, H. sapiens
agcagatactggtgcc

SEQ ID NO: 36670 - DNA, 16 bp, H. sapiens
agcagatatttaagaa

SEQ ID NO: 36671 - DNA, 16 bp, H. sapiens
agcagatcatgaggtc

SEQ ID NO: 36672 - DNA, 16 bp, H. sapiens
agcagatctttcagca

SEQ ID NO: 36673 - DNA, 16 bp, H. sapiens
agcagatgccaagatg

SEQ ID NO: 36674 - DNA, 16 bp, H. sapiens
agcagatgccggcacc

SEQ ID NO: 36675 - DNA, 16 bp, H. sapiens
agcagatgcctgaaac

SEQ ID NO: 36676 - DNA, 16 bp, H. sapiens
agcagatgctggcaag

SEQ ID NO: 36677 - DNA, 16 bp, H. sapiens
agcagatgtgtggtgg

SEQ ID NO: 36678 - DNA, 16 bp, H. sapiens
agcagcaacagcatca

SEQ ID NO: 36679 - DNA, 16 bp, H. sapiens
agcagcaagactgaaa

SEQ ID NO: 36680 - DNA, 16 bp, H. sapiens
agcagcaaggccctgg

SEQ ID NO: 36681 - DNA, 16 bp, H. sapiens
agcagcaatagcagca

SEQ ID NO: 36682 - DNA, 16 bp, H. sapiens
agcagcacaaaacaga

SEQ ID NO: 36683 - DNA, 16 bp, H. sapiens
agcagcacaaacagac

SEQ ID NO: 36684 - DNA, 16 bp, H. sapiens
agcagcacagttcaca

SEQ ID NO: 36685 - DNA, 18 bp, H. sapiens
agcagcacatcaaaaaga

SEQ ID NO: 36686 - DNA, 16 bp, H. sapiens
agcagcacatcaagaa

SEQ ID NO: 36687 - DNA, 16 bp, H. sapiens
agcagcaccagcagca

SEQ ID NO: 36688 - DNA, 16 bp, H. sapiens
agcagcacccctggcc

SEQ ID NO: 36689 - DNA, 16 bp, H. sapiens
agcagcacttcaaaaa

SEQ ID NO: 36690 - DNA, 16 bp, H. sapiens
agcagcagaaaatgaa

SEQ ID NO: 36691 - DNA, 16 bp, H. sapiens
agcagcagaagcagga

SEQ ID NO: 36692 - DNA, 16 bp, H. sapiens
agcagcagaatataca

SEQ ID NO: 36693 - DNA, 16 bp, H. sapiens
agcagcagacaccagc

SEQ ID NO: 36694 - DNA, 16 bp, H. sapiens
agcagcagacttttca

SEQ ID NO: 36695 - DNA, 16 bp, H. sapiens
agcagcagagaaggag

SEQ ID NO: 36696 - DNA, 16 bp, H. sapiens
agcagcagagacagaa

SEQ ID NO: 36697 - DNA, 16 bp, H. sapiens
agcagcagagagattt

SEQ ID NO: 36698 - DNA, 16 bp, H. sapiens
agcagcagagcagcag

SEQ ID NO: 36699 - DNA, 16 bp, H. sapiens
agcagcagagccagga

SEQ ID NO: 36700 - DNA, 16 bp, H. sapiens
agcagcagagctagga

SEQ ID NO: 36701 - DNA, 16 bp, H. sapiens
agcagcagagctggga

SEQ ID NO: 36702 - DNA, 16 bp, H. sapiens
agcagcagaggcagga

SEQ ID NO: 36703 - DNA, 16 bp, H. sapiens
agcagcagcaacaata

SEQ ID NO: 36704 - DNA, 17 bp, H. sapiens
agcagcagcaagattta

SEQ ID NO: 36705 - DNA, 16 bp, H. sapiens
agcagcagcaccagca

SEQ ID NO: 36706 - DNA, 16 bp, H. sapiens
agcagcagcagaagaa

SEQ ID NO: 36707 - DNA, 16 bp, H. sapiens
agcagcagcagcaaag

SEQ ID NO: 36708 - DNA, 16 bp, H. sapiens
agcagcagcagcaact

SEQ ID NO: 36709 - DNA, 16 bp, H. sapiens
agcagcagcagcaatg

SEQ ID NO: 36710 - DNA, 16 bp, H. sapiens
agcagcagcagcagaa

SEQ ID NO: 36711 - DNA, 16 bp, H. sapiens
agcagcagcagcagca

SEQ ID NO: 36712 - DNA, 16 bp, H. sapiens
agcagcagcagcaggc

SEQ ID NO: 36713 - DNA, 16 bp, H. sapiens
agcagcagcagcagta

SEQ ID NO: 36714 - DNA, 16 bp, H. sapiens
agcagcagcagcagtg

SEQ ID NO: 36715 - DNA, 16 bp, H. sapiens
agcagcagcagcatct

SEQ ID NO: 36716 - DNA, 16 bp, H. sapiens
agcagcagcagccact

SEQ ID NO: 36717 - DNA, 16 bp, H. sapiens
agcagcagcagccagg

SEQ ID NO: 36718 - DNA, 16 bp, H. sapiens
agcagcagcagcccct

SEQ ID NO: 36719 - DNA, 17 bp, H. sapiens
agcagcagcagcggcag

SEQ ID NO: 36720 - DNA, 17 bp, H. sapiens
agcagcagcagctgctg

SEQ ID NO: 36721 - DNA, 16 bp, H. sapiens
agcagcagcagctggg

SEQ ID NO: 36722 - DNA, 16 bp, H. sapiens
agcagcagcagctgtg

SEQ ID NO: 36723 - DNA, 16 bp, H. sapiens
agcagcagcaggaaga

SEQ ID NO: 36724 - DNA, 16 bp, H. sapiens
agcagcagcaggagca

SEQ ID NO: 36725 - DNA, 16 bp, H. sapiens
agcagcagcaggattt

SEQ ID NO: 36726 - DNA, 16 bp, H. sapiens
agcagcagcaggcagg

SEQ ID NO: 36727 - DNA, 16 bp, H. sapiens
agcagcagcagtagca

SEQ ID NO: 36728 - DNA, 16 bp, H. sapiens
agcagcagcagtagct

SEQ ID NO: 36729 - DNA, 16 bp, H. sapiens
agcagcagcagtagta

SEQ ID NO: 36730 - DNA, 16 bp, H. sapiens
agcagcagcatctcct

SEQ ID NO: 36731 - DNA, 16 bp, H. sapiens
agcagcagccacagcc

SEQ ID NO: 36732 - DNA, 16 bp, H. sapiens
agcagcagccactgca

SEQ ID NO: 36733 - DNA, 16 bp, H. sapiens
agcagcagccagagat

SEQ ID NO: 36734 - DNA, 16 bp, H. sapiens
agcagcagcccaagct

SEQ ID NO: 36735 - DNA, 16 bp, H. sapiens
agcagcagcccctccc

SEQ ID NO: 36736 - DNA, 16 bp, H. sapiens
agcagcagcctcagaa

SEQ ID NO: 36737 - DNA, 16 bp, H. sapiens
agcagcagcttgggct

SEQ ID NO: 36738 - DNA, 16 bp, H. sapiens
agcagcaggaggagga

SEQ ID NO: 36739 - DNA, 16 bp, H. sapiens
agcagcaggaggcaga

SEQ ID NO: 36740 - DNA, 16 bp, H. sapiens
agcagcaggctcagga

SEQ ID NO: 36741 - DNA, 16 bp, H. sapiens
agcagcagggaagctc

SEQ ID NO: 36742 - DNA, 16 bp, H. sapiens
agcagcagggccctgg

SEQ ID NO: 36743 - DNA, 16 bp, H. sapiens
agcagcagtaacagca

SEQ ID NO: 36744 - DNA, 16 bp, H. sapiens
agcagcagtggcagtg

SEQ ID NO: 36745 - DNA, 16 bp, H. sapiens
agcagcagtggctgca

SEQ ID NO: 36746 - DNA, 16 bp, H. sapiens
agcagcagttctcaaa

SEQ ID NO: 36747 - DNA, 16 bp, H. sapiens
agcagcatcaacaaca

SEQ ID NO: 36748 - DNA, 16 bp, H. sapiens
agcagcatcaacatca

SEQ ID NO: 36749 - DNA, 16 bp, H. sapiens
agcagcatcagcttca

SEQ ID NO: 36750 - DNA, 16 bp, H. sapiens
agcagcatccacatca

SEQ ID NO: 36751 - DNA, 16 bp, H. sapiens
agcagcatccctagcc

SEQ ID NO: 36752 - DNA, 16 bp, H. sapiens
agcagcatccttggcc

SEQ ID NO: 36753 - DNA, 16 bp, H. sapiens
agcagcatgatcatgg

SEQ ID NO: 36754 - DNA, 16 bp, H. sapiens
agcagcatgcagaggc

SEQ ID NO: 36755 - DNA, 16 bp, H. sapiens
agcagcattccttcct

SEQ ID NO: 36756 - DNA, 16 bp, H. sapiens
agcagcatttttcaca

SEQ ID NO: 36757 - DNA, 16 bp, H. sapiens
agcagccacagaaaac

SEQ ID NO: 36758 - DNA, 16 bp, H. sapiens
agcagccacagcagca

SEQ ID NO: 36759 - DNA, 16 bp, H. sapiens
agcagccaccagaagc

SEQ ID NO: 36760 - DNA, 16 bp, H. sapiens
agcagccagaaagctc

SEQ ID NO: 36761 - DNA, 16 bp, H. sapiens
agcagccagaggaaaa

SEQ ID NO: 36762 - DNA, 16 bp, H. sapiens
agcagccagagtgacc

SEQ ID NO: 36763 - DNA, 16 bp, H. sapiens
agcagccagagtgatc

SEQ ID NO: 36764 - DNA, 16 bp, H. sapiens
agcagccagatgaaga

SEQ ID NO: 36765 - DNA, 16 bp, H. sapiens
agcagccagcactggg

SEQ ID NO: 36766 - DNA, 16 bp, H. sapiens
agcagccagcatgtct

SEQ ID NO: 36767 - DNA, 16 bp, H. sapiens
agcagccaggaggaag

SEQ ID NO: 36768 - DNA, 16 bp, H. sapiens
agcagccaggaggagg

SEQ ID NO: 36769 - DNA, 16 bp, H. sapiens
agcagccaggaggggg

SEQ ID NO: 36770 - DNA, 16 bp, H. sapiens
agcagcccacgggcac

SEQ ID NO: 36771 - DNA, 16 bp, H. sapiens
agcagcccagcctggg

SEQ ID NO: 36772 - DNA, 16 bp, H. sapiens
agcagcccctgccatc

SEQ ID NO: 36773 - DNA, 16 bp, H. sapiens
agcagccctcctgcct

SEQ ID NO: 36774 - DNA, 16 bp, H. sapiens
agcagccctgcagaag

SEQ ID NO: 36775 - DNA, 16 bp, H. sapiens
agcagccgggaagctc

SEQ ID NO: 36776 - DNA, 16 bp, H. sapiens
agcagcctaggcaaca

SEQ ID NO: 36777 - DNA, 16 bp, H. sapiens
agcagcctcctccctg

SEQ ID NO: 36778 - DNA, 16 bp, H. sapiens
agcagcctgaaaaatc

SEQ ID NO: 36779 - DNA, 16 bp, H. sapiens
agcagcctggacctgt

SEQ ID NO: 36780 - DNA, 16 bp, H. sapiens
agcagcctggccatca

SEQ ID NO: 36781 - DNA, 16 bp, H. sapiens
agcagcctgggcaaca

SEQ ID NO: 36782 - DNA, 16 bp, H. sapiens
agcagcctgggcaata

SEQ ID NO: 36783 - DNA, 16 bp, H. sapiens
agcagcctgggtgcca

SEQ ID NO: 36784 - DNA, 16 bp, H. sapiens
agcagcctgtgcaaca

SEQ ID NO: 36785 - DNA, 16 bp, H. sapiens
agcagctaggactaca

SEQ ID NO: 36786 - DNA, 16 bp, H. sapiens
agcagctcagaggcag

SEQ ID NO: 36787 - DNA, 16 bp, H. sapiens
agcagctccagcttct

SEQ ID NO: 36788 - DNA, 16 bp, H. sapiens
agcagctctcaccaga

SEQ ID NO: 36789 - DNA, 16 bp, H. sapiens
agcagctctcctccca

SEQ ID NO: 36790 - DNA, 16 bp, H. sapiens
agcagctgatcctgac

SEQ ID NO: 36791 - DNA, 16 bp, H. sapiens
agcagctgcaattgga

SEQ ID NO: 36792 - DNA, 16 bp, H. sapiens
agcagctgcacagata

SEQ ID NO: 36793 - DNA, 16 bp, H. sapiens
agcagctgcactattt

SEQ ID NO: 36794 - DNA, 16 bp, H. sapiens
agcagctgcagagggt

SEQ ID NO: 36795 - DNA, 16 bp, H. sapiens
agcagctgctcaggca

SEQ ID NO: 36796 - DNA, 16 bp, H. sapiens
agcagctgctgtgctg

SEQ ID NO: 36797 - DNA, 16 bp, H. sapiens
agcagctggaacacag

SEQ ID NO: 36798 - DNA, 16 bp, H. sapiens
agcagctggcacacag

SEQ ID NO: 36799 - DNA, 16 bp, H. sapiens
agcagctggcagaggc

SEQ ID NO: 36800 - DNA, 16 bp, H. sapiens
agcagctgggaagctc

SEQ ID NO: 36801 - DNA, 16 bp, H. sapiens
agcagctgggaccaca

SEQ ID NO: 36802 - DNA, 16 bp, H. sapiens
agcagctgggacgcag

SEQ ID NO: 36803 - DNA, 17 bp, H. sapiens
agcagctgggactacag

SEQ ID NO: 36804 - DNA, 16 bp, H. sapiens
agcagctgggagaggg

SEQ ID NO: 36805 - DNA, 16 bp, H. sapiens
agcagctgggaggaag

SEQ ID NO: 36806 - DNA, 16 bp, H. sapiens
agcagctgggaggagg

SEQ ID NO: 36807 - DNA, 16 bp, H. sapiens
agcagctgggatgaca

SEQ ID NO: 36808 - DNA, 17 bp, H. sapiens
agcagctgggattacaa

SEQ ID NO: 36809 - DNA, 16 bp, H. sapiens
agcagctgggcgtggt

SEQ ID NO: 36810 - DNA, 16 bp, H. sapiens
agcagctggggcagcc

SEQ ID NO: 36811 - DNA, 16 bp, H. sapiens
agcagctggggctaca

SEQ ID NO: 36812 - DNA, 16 bp, H. sapiens
agcagctgtgctgtgt

SEQ ID NO: 36813 - DNA, 16 bp, H. sapiens
agcagcttaaacaaca

SEQ ID NO: 36814 - DNA, 16 bp, H. sapiens
agcagcttaaggagat

SEQ ID NO: 36815 - DNA, 16 bp, H. sapiens
agcagcttccacatgg

SEQ ID NO: 36816 - DNA, 16 bp, H. sapiens
agcagcttctgtttct

SEQ ID NO: 36817 - DNA, 16 bp, H. sapiens
agcagcttgggctgct

SEQ ID NO: 36818 - DNA, 16 bp, H. sapiens
agcagctttgtttgta

SEQ ID NO: 36819 - DNA, 16 bp, H. sapiens
agcaggaacaagagag

SEQ ID NO: 36820 - DNA, 16 bp, H. sapiens
agcaggaagcagccag

SEQ ID NO: 36821 - DNA, 16 bp, H. sapiens
agcaggaaggcagcca

SEQ ID NO: 36822 - DNA, 16 bp, H. sapiens
agcaggaagtaaaggc

SEQ ID NO: 36823 - DNA, 16 bp, H. sapiens
agcaggaccctgtctc

SEQ ID NO: 36824 - DNA, 16 bp, H. sapiens
agcaggacgtggtggt

SEQ ID NO: 36825 - DNA, 16 bp, H. sapiens
agcaggactccatctc

SEQ ID NO: 36826 - DNA, 16 bp, H. sapiens
agcaggactgggcaga

SEQ ID NO: 36827 - DNA, 16 bp, H. sapiens
agcaggagaaggaaat

SEQ ID NO: 36828 - DNA, 16 bp, H. sapiens
agcaggagaattgttt

SEQ ID NO: 36829 - DNA, 16 bp, H. sapiens
agcaggagagaaagca

SEQ ID NO: 36830 - DNA, 16 bp, H. sapiens
agcaggagagacagag

SEQ ID NO: 36831 - DNA, 16 bp, H. sapiens
agcaggagcaagagaa

SEQ ID NO: 36832 - DNA, 16 bp, H. sapiens
agcaggagcaagagag

SEQ ID NO: 36833 - DNA, 16 bp, H. sapiens
agcaggagcaagagat

SEQ ID NO: 36834 - DNA, 16 bp, H. sapiens
agcaggagcaagtgag

SEQ ID NO: 36835 - DNA, 16 bp, H. sapiens
agcaggagcaggagag

SEQ ID NO: 36836 - DNA, 16 bp, H. sapiens
agcaggagcaggcatc

SEQ ID NO: 36837 - DNA, 16 bp, H. sapiens
agcaggagcgagagag

SEQ ID NO: 36838 - DNA, 16 bp, H. sapiens
agcaggaggaagagac

SEQ ID NO: 36839 - DNA, 16 bp, H. sapiens
agcaggaggaaggtgg

SEQ ID NO: 36840 - DNA, 16 bp, H. sapiens
agcaggaggagcagat

SEQ ID NO: 36841 - DNA, 16 bp, H. sapiens
agcaggaggcaagaaa

SEQ ID NO: 36842 - DNA, 16 bp, H. sapiens
agcaggaggccccgga

SEQ ID NO: 36843 - DNA, 16 bp, H. sapiens
agcaggaggcctgggt

SEQ ID NO: 36844 - DNA, 16 bp, H. sapiens
agcaggagggacaatg

SEQ ID NO: 36845 - DNA, 16 bp, H. sapiens
agcaggagggtgtcct

SEQ ID NO: 36846 - DNA, 16 bp, H. sapiens
agcaggaggtgagcga

SEQ ID NO: 36847 - DNA, 16 bp, H. sapiens
agcaggagtgaaagtt

SEQ ID NO: 36848 - DNA, 26 bp, H. sapiens
agcaggatgtgggtggggccagataa

SEQ ID NO: 36849 - DNA, 16 bp, H. sapiens
agcaggatttctcaac

SEQ ID NO: 36850 - DNA, 16 bp, H. sapiens
agcaggcacaagccct

SEQ ID NO: 36851 - DNA, 16 bp, H. sapiens
agcaggcacagcacag

SEQ ID NO: 36852 - DNA, 16 bp, H. sapiens
agcaggcacatcttca

SEQ ID NO: 36853 - DNA, 16 bp, H. sapiens
agcaggcactcaataa

SEQ ID NO: 36854 - DNA, 16 bp, H. sapiens
agcaggcagcaggcag

SEQ ID NO: 36855 - DNA, 16 bp, H. sapiens
agcaggcagccatctt

SEQ ID NO: 36856 - DNA, 16 bp, H. sapiens
agcaggcagggccagg

SEQ ID NO: 36857 - DNA, 16 bp, H. sapiens
agcaggcagggctggg

SEQ ID NO: 36858 - DNA, 16 bp, H. sapiens
agcaggcatgaaagca

SEQ ID NO: 36859 - DNA, 16 bp, H. sapiens
agcaggcatggtggtg

SEQ ID NO: 36860 - DNA, 16 bp, H. sapiens
agcaggccccagtgtg

SEQ ID NO: 36861 - DNA, 16 bp, H. sapiens
agcaggccctcaccag

SEQ ID NO: 36862 - DNA, 16 bp, H. sapiens
agcaggccctgaaggc

SEQ ID NO: 36863 - DNA, 16 bp, H. sapiens
agcaggccttggccag

SEQ ID NO: 36864 - DNA, 16 bp, H. sapiens
agcaggctctcaccag

SEQ ID NO: 36865 - DNA, 16 bp, H. sapiens
agcaggctgaggagga

SEQ ID NO: 36866 - DNA, 16 bp, H. sapiens
agcaggctgaggcaga

SEQ ID NO: 36867 - DNA, 16 bp, H. sapiens
agcaggctgtggagca

SEQ ID NO: 36868 - DNA, 16 bp, H. sapiens
agcaggcttctgccta

SEQ ID NO: 36869 - DNA, 16 bp, H. sapiens
agcagggactacagac

SEQ ID NO: 36870 - DNA, 16 bp, H. sapiens
agcagggagaagccag

SEQ ID NO: 36871 - DNA, 16 bp, H. sapiens
agcagggcagtcaaat

SEQ ID NO: 36872 - DNA, 16 bp, H. sapiens
agcagggcatgtatga

SEQ ID NO: 36873 - DNA, 16 bp, H. sapiens
agcagggccaggcaca

SEQ ID NO: 36874 - DNA, 16 bp, H. sapiens
agcagggcccaggcag

SEQ ID NO: 36875 - DNA, 16 bp, H. sapiens
agcagggccctgggcc

SEQ ID NO: 36876 - DNA, 16 bp, H. sapiens
agcagggccctgggct

SEQ ID NO: 36877 - DNA, 16 bp, H. sapiens
agcagggcctggtggc

SEQ ID NO: 36878 - DNA, 16 bp, H. sapiens
agcagggcgtggtggc

SEQ ID NO: 36879 - DNA, 16 bp, H. sapiens
agcagggctaccccat

SEQ ID NO: 36880 - DNA, 16 bp, H. sapiens
agcagggctgtgctct

SEQ ID NO: 36881 - DNA, 16 bp, H. sapiens
agcagggctttcaggc

SEQ ID NO: 36882 - DNA, 16 bp, H. sapiens
agcaggggcttccagg

SEQ ID NO: 36883 - DNA, 16 bp, H. sapiens
agcagggggcggtgct

SEQ ID NO: 36884 - DNA, 16 bp, H. sapiens
agcagggggctggtgt

SEQ ID NO: 36885 - DNA, 16 bp, H. sapiens
agcaggggggccctgg

SEQ ID NO: 36886 - DNA, 16 bp, H. sapiens
agcagggtgcggtggc

SEQ ID NO: 36887 - DNA, 16 bp, H. sapiens
agcagggttttttttt

SEQ ID NO: 36888 - DNA, 16 bp, H. sapiens
agcaggtcccaccccc

SEQ ID NO: 36889 - DNA, 16 bp, H. sapiens
agcaggtccctgatcc

SEQ ID NO: 36890 - DNA, 16 bp, H. sapiens
agcaggtctgggtggg

SEQ ID NO: 36891 - DNA, 16 bp, H. sapiens
agcaggtgcaggagct

SEQ ID NO: 36892 - DNA, 16 bp, H. sapiens
agcaggtggaggctgc

SEQ ID NO: 36893 - DNA, 18 bp, H. sapiens
agcaggtggatcacttga

SEQ ID NO: 36894 - DNA, 16 bp, H. sapiens
agcaggttgctcagtt

SEQ ID NO: 36895 - DNA, 16 bp, H. sapiens
agcaggtttttaaagg

SEQ ID NO: 36896 - DNA, 16 bp, H. sapiens
agcagtaaataaaaca

SEQ ID NO: 36897 - DNA, 16 bp, H. sapiens
agcagtaaatgcctac

SEQ ID NO: 36898 - DNA, 16 bp, H. sapiens
agcagtaagtctcaac

SEQ ID NO: 36899 - DNA, 16 bp, H. sapiens
agcagtaataacaaca

SEQ ID NO: 36900 - DNA, 16 bp, H. sapiens
agcagtaatattttaa

SEQ ID NO: 36901 - DNA, 16 bp, H. sapiens
agcagtagcagtagca

SEQ ID NO: 36902 - DNA, 16 bp, H. sapiens
agcagtatctcattgt

SEQ ID NO: 36903 - DNA, 16 bp, H. sapiens
agcagtatgaaaatgg

SEQ ID NO: 36904 - DNA, 16 bp, H. sapiens
agcagtatggacattt

SEQ ID NO: 36905 - DNA, 16 bp, H. sapiens
agcagtcagggaaggc

SEQ ID NO: 36906 - DNA, 16 bp, H. sapiens
agcagtcatcccacct

SEQ ID NO: 36907 - DNA, 16 bp, H. sapiens
agcagtccacttcctt

SEQ ID NO: 36908 - DNA, 16 bp, H. sapiens
agcagtcccactactg

SEQ ID NO: 36909 - DNA, 16 bp, H. sapiens
agcagtcccatcagct

SEQ ID NO: 36910 - DNA, 16 bp, H. sapiens
agcagtccttggcatt

SEQ ID NO: 36911 - DNA, 16 bp, H. sapiens
agcagtctgcttcctt

SEQ ID NO: 36912 - DNA, 16 bp, H. sapiens
agcagtcttgaataat

SEQ ID NO: 36913 - DNA, 16 bp, H. sapiens
agcagtgaacaaaaca

SEQ ID NO: 36914 - DNA, 16 bp, H. sapiens
agcagtgaacaaaata

SEQ ID NO: 36915 - DNA, 16 bp, H. sapiens
agcagtgagccatgat

SEQ ID NO: 36916 - DNA, 16 bp, H. sapiens
agcagtgagtgaggct

SEQ ID NO: 36917 - DNA, 16 bp, H. sapiens
agcagtgatgatgagc

SEQ ID NO: 36918 - DNA, 16 bp, H. sapiens
agcagtgatggttgca

SEQ ID NO: 36919 - DNA, 16 bp, H. sapiens
agcagtgccagaaaac

SEQ ID NO: 36920 - DNA, 16 bp, H. sapiens
agcagtgcttctcaaa

SEQ ID NO: 36921 - DNA, 16 bp, H. sapiens
agcagtgcttttcaaa

SEQ ID NO: 36922 - DNA, 16 bp, H. sapiens
agcagtggagctggga

SEQ ID NO: 36923 - DNA, 16 bp, H. sapiens
agcagtggcagccact

SEQ ID NO: 36924 - DNA, 16 bp, H. sapiens
agcagtggctcaagcc

SEQ ID NO: 36925 - DNA, 17 bp, H. sapiens
agcagtggctcacacct

SEQ ID NO: 36926 - DNA, 16 bp, H. sapiens
agcagtggctcacccc

SEQ ID NO: 36927 - DNA, 16 bp, H. sapiens
agcagtgggaaaagcc

SEQ ID NO: 36928 - DNA, 16 bp, H. sapiens
agcagtgggaaaagga

SEQ ID NO: 36929 - DNA, 16 bp, H. sapiens
agcagtgggaaaatgg

SEQ ID NO: 36930 - DNA, 16 bp, H. sapiens
agcagtgggaagtaca

SEQ ID NO: 36931 - DNA, 16 bp, H. sapiens
agcagtggggaaaaga

SEQ ID NO: 36932 - DNA, 16 bp, H. sapiens
agcagtgggtctcaac

SEQ ID NO: 36933 - DNA, 16 bp, H. sapiens
agcagtggttctccta

SEQ ID NO: 36934 - DNA, 16 bp, H. sapiens
agcagtgtcagcatca

SEQ ID NO: 36935 - DNA, 16 bp, H. sapiens
agcagtgtgaaaacac

SEQ ID NO: 36936 - DNA, 16 bp, H. sapiens
agcagtgtgaaaatgg

SEQ ID NO: 36937 - DNA, 16 bp, H. sapiens
agcagtgtgagaaaag

SEQ ID NO: 36938 - DNA, 16 bp, H. sapiens
agcagtgtgagaagag

SEQ ID NO: 36939 - DNA, 16 bp, H. sapiens
agcagtgtgagaaggg

SEQ ID NO: 36940 - DNA, 16 bp, H. sapiens
agcagtgtggaaacac

SEQ ID NO: 36941 - DNA, 16 bp, H. sapiens
agcagtgtggagattt

SEQ ID NO: 36942 - DNA, 16 bp, H. sapiens
agcagtgtgggaatgg

SEQ ID NO: 36943 - DNA, 18 bp, H. sapiens
agcagtgtgtagagagaa

SEQ ID NO: 36944 - DNA, 16 bp, H. sapiens
agcagtgtgtggaggg

SEQ ID NO: 36945 - DNA, 16 bp, H. sapiens
agcagtgttctggaaa

SEQ ID NO: 36946 - DNA, 16 bp, H. sapiens
agcagtgttctggaat

SEQ ID NO: 36947 - DNA, 16 bp, H. sapiens
agcagtgttctggagt

SEQ ID NO: 36948 - DNA, 16 bp, H. sapiens
agcagtgttgtggaat

SEQ ID NO: 36949 - DNA, 16 bp, H. sapiens
agcagtgtttctcaaa

SEQ ID NO: 36950 - DNA, 16 bp, H. sapiens
agcagttacaagtgga

SEQ ID NO: 36951 - DNA, 16 bp, H. sapiens
agcagttacagaagaa

SEQ ID NO: 36952 - DNA, 16 bp, H. sapiens
agcagttcaagactag

SEQ ID NO: 36953 - DNA, 16 bp, H. sapiens
agcagttcaaggctgc

SEQ ID NO: 36954 - DNA, 16 bp, H. sapiens
agcagttcccctgcct

SEQ ID NO: 36955 - DNA, 16 bp, H. sapiens
agcagttctccctgcc

SEQ ID NO: 36956 - DNA, 16 bp, H. sapiens
agcagttcttccacct

SEQ ID NO: 36957 - DNA, 16 bp, H. sapiens
agcagtttgattatga

SEQ ID NO: 36958 - DNA, 16 bp, H. sapiens
agcagtttggaaacac

SEQ ID NO: 36959 - DNA, 16 bp, H. sapiens
agcagtttggaaacat

SEQ ID NO: 36960 - DNA, 16 bp, H. sapiens
agcagtttgggagact

SEQ ID NO: 36961 - DNA, 16 bp, H. sapiens
agcagtttgggatgcc

SEQ ID NO: 36962 - DNA, 16 bp, H. sapiens
agcagttttaggttta

SEQ ID NO: 36963 - DNA, 16 bp, H. sapiens
agcagttttataaacc

SEQ ID NO: 36964 - DNA, 16 bp, H. sapiens
agcagttttgaaaaac

SEQ ID NO: 36965 - DNA, 16 bp, H. sapiens
agcagttttgaaatat

SEQ ID NO: 36966 - DNA, 16 bp, H. sapiens
agcagttttggagagt

SEQ ID NO: 36967 - DNA, 16 bp, H. sapiens
agcagttttggaggcc

SEQ ID NO: 36968 - DNA, 16 bp, H. sapiens
agcataaaaatataca

SEQ ID NO: 36969 - DNA, 16 bp, H. sapiens
agcataaaaattcaga

SEQ ID NO: 36970 - DNA, 16 bp, H. sapiens
agcataaacatttgga

SEQ ID NO: 36971 - DNA, 16 bp, H. sapiens
agcataaatgacctga

SEQ ID NO: 36972 - DNA, 16 bp, H. sapiens
agcataaggagatttt

SEQ ID NO: 36973 - DNA, 16 bp, H. sapiens
agcataatgagaaagt

SEQ ID NO: 36974 - DNA, 16 bp, H. sapiens
agcataatgattttga

SEQ ID NO: 36975 - DNA, 16 bp, H. sapiens
agcataatgttttgaa

SEQ ID NO: 36976 - DNA, 16 bp, H. sapiens
agcatacaaaaagaca

SEQ ID NO: 36977 - DNA, 16 bp, H. sapiens
agcatacaaaatcaat

SEQ ID NO: 36978 - DNA, 16 bp, H. sapiens
agcatacacacacaca

SEQ ID NO: 36979 - DNA, 16 bp, H. sapiens
agcatacagttcagtg

SEQ ID NO: 36980 - DNA, 19 bp, H. sapiens
agcataccaaggacctgca

SEQ ID NO: 36981 - DNA, 16 bp, H. sapiens
agcataccaccatggc

SEQ ID NO: 36982 - DNA, 20 bp, H. sapiens
agcatactgaatgggcaaaa

SEQ ID NO: 36983 - DNA, 16 bp, H. sapiens
agcatagtacccaata

SEQ ID NO: 36984 - DNA, 16 bp, H. sapiens
agcatagtgcctgaca

SEQ ID NO: 36985 - DNA, 16 bp, H. sapiens
agcatatacagcatgg

SEQ ID NO: 36986 - DNA, 16 bp, H. sapiens
agcatatcaaaaagat

SEQ ID NO: 36987 - DNA, 16 bp, H. sapiens
agcatatggaaagatg

SEQ ID NO: 36988 - DNA, 16 bp, H. sapiens
agcatattcttttttt

SEQ ID NO: 36989 - DNA, 16 bp, H. sapiens
agcatatttttatgtt

SEQ ID NO: 36990 - DNA, 16 bp, H. sapiens
agcatcacacactggg

SEQ ID NO: 36991 - DNA, 16 bp, H. sapiens
agcatcaccatcttgg

SEQ ID NO: 36992 - DNA, 16 bp, H. sapiens
agcatcagaaagaata

SEQ ID NO: 36993 - DNA, 16 bp, H. sapiens
agcatcagaaccagag

SEQ ID NO: 36994 - DNA, 16 bp, H. sapiens
agcatcatcaccacca

SEQ ID NO: 36995 - DNA, 16 bp, H. sapiens
agcatcatcaccatca

SEQ ID NO: 36996 - DNA, 16 bp, H. sapiens
agcatcatcatcatca

SEQ ID NO: 36997 - DNA, 16 bp, H. sapiens
agcatcattttggcaa

SEQ ID NO: 36998 - DNA, 16 bp, H. sapiens
agcatccagcacagtg

SEQ ID NO: 36999 - DNA, 16 bp, H. sapiens
agcatcccatttccca

SEQ ID NO: 37000 - DNA, 16 bp, H. sapiens
agcatccccagcctct

SEQ ID NO: 37001 - DNA, 16 bp, H. sapiens
agcatccctggcttct

SEQ ID NO: 37002 - DNA, 16 bp, H. sapiens
agcatccttaaagaaa

SEQ ID NO: 37003 - DNA, 16 bp, H. sapiens
agcatcgacatcaaca

SEQ ID NO: 37004 - DNA, 16 bp, H. sapiens
agcatctacagaaacc

SEQ ID NO: 37005 - DNA, 16 bp, H. sapiens
agcatctccagatgag

SEQ ID NO: 37006 - DNA, 16 bp, H. sapiens
agcatctgaggatttt

SEQ ID NO: 37007 - DNA, 16 bp, H. sapiens
agcatctgcacagcaa

SEQ ID NO: 37008 - DNA, 16 bp, H. sapiens
agcatctgctgtttct

SEQ ID NO: 37009 - DNA, 16 bp, H. sapiens
agcatctgtagatttt

SEQ ID NO: 37010 - DNA, 16 bp, H. sapiens
agcatctgttattttt

SEQ ID NO: 37011 - DNA, 16 bp, H. sapiens
agcatctgttgcttct

SEQ ID NO: 37012 - DNA, 16 bp, H. sapiens
agcatcttcaaatttc

SEQ ID NO: 37013 - DNA, 16 bp, H. sapiens
agcatcttttcatatg

SEQ ID NO: 37014 - DNA, 16 bp, H. sapiens
agcatgaaatatcttt

SEQ ID NO: 37015 - DNA, 16 bp, H. sapiens
agcatgaacagcctgg

SEQ ID NO: 37016 - DNA, 16 bp, H. sapiens
agcatgaatttctttt

SEQ ID NO: 37017 - DNA, 16 bp, H. sapiens
agcatgacactggcat

SEQ ID NO: 37018 - DNA, 16 bp, H. sapiens
agcatgagaaagacca

SEQ ID NO: 37019 - DNA, 16 bp, H. sapiens
agcatgagaaagaccc

SEQ ID NO: 37020 - DNA, 16 bp, H. sapiens
agcatgagaacagact

SEQ ID NO: 37021 - DNA, 16 bp, H. sapiens
agcatgagaacagcat

SEQ ID NO: 37022 - DNA, 16 bp, H. sapiens
agcatgagctaccatg

SEQ ID NO: 37023 - DNA, 16 bp, H. sapiens
agcatgagctttggag

SEQ ID NO: 37024 - DNA, 16 bp, H. sapiens
agcatgatgcctccac

SEQ ID NO: 37025 - DNA, 16 bp, H. sapiens
agcatgatgcctccat

SEQ ID NO: 37026 - DNA, 16 bp, H. sapiens
agcatgcaagaacaga

SEQ ID NO: 37027 - DNA, 16 bp, H. sapiens
agcatgcaccaccatg

SEQ ID NO: 37028 - DNA, 16 bp, H. sapiens
agcatgcagtgctgtt

SEQ ID NO: 37029 - DNA, 16 bp, H. sapiens
agcatgccctctctca

SEQ ID NO: 37030 - DNA, 16 bp, H. sapiens
agcatgccctggatgt

SEQ ID NO: 37031 - DNA, 16 bp, H. sapiens
agcatgcctggatggg

SEQ ID NO: 37032 - DNA, 60 bp, H. sapiens
agcatgctgccttcaagcatctgtttaacaaagcacatcttgcaccacccttaatccatt

SEQ ID NO: 37033 - DNA, 16 bp, H. sapiens
agcatgcttgatgatt

SEQ ID NO: 37034 - DNA, 16 bp, H. sapiens
agcatggaaagttttt

SEQ ID NO: 37035 - DNA, 16 bp, H. sapiens
agcatggaatgctctt

SEQ ID NO: 37036 - DNA, 16 bp, H. sapiens
agcatggaatgttttc

SEQ ID NO: 37037 - DNA, 16 bp, H. sapiens
agcatggactcatgga

SEQ ID NO: 37038 - DNA, 16 bp, H. sapiens
agcatggaggaaactg

SEQ ID NO: 37039 - DNA, 16 bp, H. sapiens
agcatggagtgtttct

SEQ ID NO: 37040 - DNA, 16 bp, H. sapiens
agcatggcaccagcat

SEQ ID NO: 37041 - DNA, 16 bp, H. sapiens
agcatgggaaagactt

SEQ ID NO: 37042 - DNA, 16 bp, H. sapiens
agcatgggagggaggc

SEQ ID NO: 37043 - DNA, 16 bp, H. sapiens
agcatgggctcccaga

SEQ ID NO: 37044 - DNA, 16 bp, H. sapiens
agcatggtactggtgc

SEQ ID NO: 37045 - DNA, 16 bp, H. sapiens
agcatggtatgttttt

SEQ ID NO: 37046 - DNA, 17 bp, H. sapiens
agcatggtgaaaccccg

SEQ ID NO: 37047 - DNA, 16 bp, H. sapiens
agcatggtgctggcat

SEQ ID NO: 37048 - DNA, 16 bp, H. sapiens
agcatggtgctggtac

SEQ ID NO: 37049 - DNA, 16 bp, H. sapiens
agcatggtggcacatg

SEQ ID NO: 37050 - DNA, 16 bp, H. sapiens
agcatggtggcacgtg

SEQ ID NO: 37051 - DNA, 16 bp, H. sapiens
agcatggtggctcaca

SEQ ID NO: 37052 - DNA, 16 bp, H. sapiens
agcatggtggctcatg

SEQ ID NO: 37053 - DNA, 16 bp, H. sapiens
agcatggtggcttatg

SEQ ID NO: 37054 - DNA, 16 bp, H. sapiens
agcatggtggtgtatg

SEQ ID NO: 37055 - DNA, 16 bp, H. sapiens
agcatggtggtgtgca

SEQ ID NO: 37056 - DNA, 16 bp, H. sapiens
agcatggtgtggtggc

SEQ ID NO: 37057 - DNA, 16 bp, H. sapiens
agcatgtagatggggg

SEQ ID NO: 37058 - DNA, 16 bp, H. sapiens
agcatgtatcagtact

SEQ ID NO: 37059 - DNA, 16 bp, H. sapiens
agcatgtatgtgtgtg

SEQ ID NO: 37060 - DNA, 16 bp, H. sapiens
agcatgtattactttt

SEQ ID NO: 37061 - DNA, 16 bp, H. sapiens
agcatgtattattttt

SEQ ID NO: 37062 - DNA, 16 bp, H. sapiens
agcatgtccatcacct

SEQ ID NO: 37063 - DNA, 16 bp, H. sapiens
agcatgtcccacctcc

SEQ ID NO: 37064 - DNA, 16 bp, H. sapiens
agcatgtgaaaaaatg

SEQ ID NO: 37065 - DNA, 16 bp, H. sapiens
agcatgtgctcatttt

SEQ ID NO: 37066 - DNA, 16 bp, H. sapiens
agcatgtggcagaatt

SEQ ID NO: 37067 - DNA, 16 bp, H. sapiens
agcatgtggtgtttgg

SEQ ID NO: 37068 - DNA, 16 bp, H. sapiens
agcatgtgtcagaaat

SEQ ID NO: 37069 - DNA, 16 bp, H. sapiens
agcatgtgttggaaac

SEQ ID NO: 37070 - DNA, 16 bp, H. sapiens
agcatgttgttcagtt

SEQ ID NO: 37071 - DNA, 16 bp, H. sapiens
agcatgtttttctttt

SEQ ID NO: 37072 - DNA, 16 bp, H. sapiens
agcattagatatatct

SEQ ID NO: 37073 - DNA, 16 bp, H. sapiens
agcattattcataaaa

SEQ ID NO: 37074 - DNA, 16 bp, H. sapiens
agcattattcataata

SEQ ID NO: 37075 - DNA, 16 bp, H. sapiens
agcattattgtggcaa

SEQ ID NO: 37076 - DNA, 16 bp, H. sapiens
agcattatttacagta

SEQ ID NO: 37077 - DNA, 16 bp, H. sapiens
agcattatttattgaa

SEQ ID NO: 37078 - DNA, 16 bp, H. sapiens
agcattatttcatatg

SEQ ID NO: 37079 - DNA, 16 bp, H. sapiens
agcattatttctatag

SEQ ID NO: 37080 - DNA, 16 bp, H. sapiens
agcattcaagaggaaa

SEQ ID NO: 37081 - DNA, 16 bp, H. sapiens
agcattcaagatgtga

SEQ ID NO: 37082 - DNA, 16 bp, H. sapiens
agcattcagttccttg

SEQ ID NO: 37083 - DNA, 16 bp, H. sapiens
agcattcatcatctgc

SEQ ID NO: 37084 - DNA, 16 bp, H. sapiens
agcattccctttaaaa

SEQ ID NO: 37085 - DNA, 16 bp, H. sapiens
agcattcctttatgat

SEQ ID NO: 37086 - DNA, 16 bp, H. sapiens
agcattcgacaaaatc

SEQ ID NO: 37087 - DNA, 16 bp, H. sapiens
agcattctcagaaagt

SEQ ID NO: 37088 - DNA, 16 bp, H. sapiens
agcattctctctgaga

SEQ ID NO: 37089 - DNA, 16 bp, H. sapiens
agcattctgcctgcct

SEQ ID NO: 37090 - DNA, 16 bp, H. sapiens
agcattctgttcttaa

SEQ ID NO: 37091 - DNA, 16 bp, H. sapiens
agcattgaacagatct

SEQ ID NO: 37092 - DNA, 16 bp, H. sapiens
agcattgaatctgtac

SEQ ID NO: 37093 - DNA, 16 bp, H. sapiens
agcattgcagaagaaa

SEQ ID NO: 37094 - DNA, 16 bp, H. sapiens
agcattgctatttctc

SEQ ID NO: 37095 - DNA, 16 bp, H. sapiens
agcattgctttatgat

SEQ ID NO: 37096 - DNA, 16 bp, H. sapiens
agcattgttctggaat

SEQ ID NO: 37097 - DNA, 16 bp, H. sapiens
agcatttaaaatatgt

SEQ ID NO: 37098 - DNA, 16 bp, H. sapiens
agcatttaaattttta

SEQ ID NO: 37099 - DNA, 16 bp, H. sapiens
agcatttaataaaatt

SEQ ID NO: 37100 - DNA, 16 bp, H. sapiens
agcatttaataaatgt

SEQ ID NO: 37101 - DNA, 16 bp, H. sapiens
agcatttactatgtat

SEQ ID NO: 37102 - DNA, 16 bp, H. sapiens
agcatttactgaaatg

SEQ ID NO: 37103 - DNA, 16 bp, H. sapiens
agcatttactttaaaa

SEQ ID NO: 37104 - DNA, 16 bp, H. sapiens
agcatttagcaaacct

SEQ ID NO: 37105 - DNA, 16 bp, H. sapiens
agcatttaggccattt

SEQ ID NO: 37106 - DNA, 16 bp, H. sapiens
agcatttagggaggca

SEQ ID NO: 37107 - DNA, 16 bp, H. sapiens
agcatttatcctttga

SEQ ID NO: 37108 - DNA, 16 bp, H. sapiens
agcatttattttattt

SEQ ID NO: 37109 - DNA, 16 bp, H. sapiens
agcatttcaaatttca

SEQ ID NO: 37110 - DNA, 16 bp, H. sapiens
agcatttcagatttta

SEQ ID NO: 37111 - DNA, 16 bp, H. sapiens
agcatttcattccttt

SEQ ID NO: 37112 - DNA, 16 bp, H. sapiens
agcatttctacacacc

SEQ ID NO: 37113 - DNA, 16 bp, H. sapiens
agcatttcttttttct

SEQ ID NO: 37114 - DNA, 16 bp, H. sapiens
agcatttgacaaattt

SEQ ID NO: 37115 - DNA, 16 bp, H. sapiens
agcatttgccagtttc

SEQ ID NO: 37116 - DNA, 16 bp, H. sapiens
agcatttgctattttt

SEQ ID NO: 37117 - DNA, 16 bp, H. sapiens
agcatttgcttctctg

SEQ ID NO: 37118 - DNA, 16 bp, H. sapiens
agcatttgttactttt

SEQ ID NO: 37119 - DNA, 16 bp, H. sapiens
agcattttacccagag

SEQ ID NO: 37120 - DNA, 16 bp, H. sapiens
agcattttataatttt

SEQ ID NO: 37121 - DNA, 16 bp, H. sapiens
agcattttcacagaaa

SEQ ID NO: 37122 - DNA, 16 bp, H. sapiens
agcattttcagaaact

SEQ ID NO: 37123 - DNA, 16 bp, H. sapiens
agcattttcattttgt

SEQ ID NO: 37124 - DNA, 16 bp, H. sapiens
agcattttccattttt

SEQ ID NO: 37125 - DNA, 16 bp, H. sapiens
agcattttctattttt

SEQ ID NO: 37126 - DNA, 16 bp, H. sapiens
agcattttctgcatct

SEQ ID NO: 37127 - DNA, 16 bp, H. sapiens
agcattttgagaggcc

SEQ ID NO: 37128 - DNA, 16 bp, H. sapiens
agcattttgcatttct

SEQ ID NO: 37129 - DNA, 16 bp, H. sapiens
agcattttgccatgtt

SEQ ID NO: 37130 - DNA, 16 bp, H. sapiens
agcattttggaaggcc

SEQ ID NO: 37131 - DNA, 16 bp, H. sapiens
agcattttggagattt

SEQ ID NO: 37132 - DNA, 16 bp, H. sapiens
agcattttggattttg

SEQ ID NO: 37133 - DNA, 16 bp, H. sapiens
agcattttgttttatt

SEQ ID NO: 37134 - DNA, 16 bp, H. sapiens
agcatttttaaaactt

SEQ ID NO: 37135 - DNA, 16 bp, H. sapiens
agcatttttggaggcc

SEQ ID NO: 37136 - DNA, 16 bp, H. sapiens
agcattttttaaaata

SEQ ID NO: 37137 - DNA, 16 bp, H. sapiens
agcattttttaaattt

SEQ ID NO: 37138 - DNA, 16 bp, H. sapiens
agcattttttagcagt

SEQ ID NO: 37139 - DNA, 16 bp, H. sapiens
agcattttttcatgca

SEQ ID NO: 37140 - DNA, 16 bp, H. sapiens
agcatttttttttcat

SEQ ID NO: 37141 - DNA, 16 bp, H. sapiens
agcatttttttttcct

SEQ ID NO: 37142 - DNA, 16 bp, H. sapiens
agccaaaaagtgggaa

SEQ ID NO: 37143 - DNA, 16 bp, H. sapiens
agccaaaaatatttat

SEQ ID NO: 37144 - DNA, 16 bp, H. sapiens
agccaaaagaccaaga

SEQ ID NO: 37145 - DNA, 16 bp, H. sapiens
agccaaaagagcaaag

SEQ ID NO: 37146 - DNA, 16 bp, H. sapiens
agccaaaaggcagaag

SEQ ID NO: 37147 - DNA, 16 bp, H. sapiens
agccaaaataatcttg

SEQ ID NO: 37148 - DNA, 16 bp, H. sapiens
agccaaaataatcttt

SEQ ID NO: 37149 - DNA, 16 bp, H. sapiens
agccaaaatattttta

SEQ ID NO: 37150 - DNA, 16 bp, H. sapiens
agccaaaatttacaaa

SEQ ID NO: 37151 - DNA, 16 bp, H. sapiens
agccaaaatttggaaa

SEQ ID NO: 37152 - DNA, 16 bp, H. sapiens
agccaaacatgagtga

SEQ ID NO: 37153 - DNA, 17 bp, H. sapiens
agccaaaccatatcact

SEQ ID NO: 37154 - DNA, 16 bp, H. sapiens
agccaaaccatatcag

SEQ ID NO: 37155 - DNA, 18 bp, H. sapiens
agccaaaccatgagtgaa

SEQ ID NO: 37156 - DNA, 16 bp, H. sapiens
agccaaactctgtctc

SEQ ID NO: 37157 - DNA, 16 bp, H. sapiens
agccaaagacaaaggt

SEQ ID NO: 37158 - DNA, 16 bp, H. sapiens
agccaaagagaaaggt

SEQ ID NO: 37159 - DNA, 16 bp, H. sapiens
agccaaaggaaaataa

SEQ ID NO: 37160 - DNA, 16 bp, H. sapiens
agccaaataagggaat

SEQ ID NO: 37161 - DNA, 16 bp, H. sapiens
agccaaatcatgagta

SEQ ID NO: 37162 - DNA, 16 bp, H. sapiens
agccaaatcattagtg

SEQ ID NO: 37163 - DNA, 16 bp, H. sapiens
agccaaatgatgagaa

SEQ ID NO: 37164 - DNA, 16 bp, H. sapiens
agccaaatgtgaggac

SEQ ID NO: 37165 - DNA, 17 bp, H. sapiens
agccaacacacccggcc

SEQ ID NO: 37166 - DNA, 16 bp, H. sapiens
agccaacatggcaaaa

SEQ ID NO: 37167 - DNA, 16 bp, H. sapiens
agccaacatggcgaaa

SEQ ID NO: 37168 - DNA, 20 bp, H. sapiens
agccaacatggtgaaaccct

SEQ ID NO: 37169 - DNA, 16 bp, H. sapiens
agccaacctgaaaagg

SEQ ID NO: 37170 - DNA, 16 bp, H. sapiens
agccaacgtggtgaaa

SEQ ID NO: 37171 - DNA, 16 bp, H. sapiens
agccaactccagaaac

SEQ ID NO: 37172 - DNA, 16 bp, H. sapiens
agccaagaaccctcct

SEQ ID NO: 37173 - DNA, 16 bp, H. sapiens
agccaagaaggagtca

SEQ ID NO: 37174 - DNA, 16 bp, H. sapiens
agccaagaagtggaag

SEQ ID NO: 37175 - DNA, 16 bp, H. sapiens
agccaagaatgcacca

SEQ ID NO: 37176 - DNA, 16 bp, H. sapiens
agccaagacatggaaa

SEQ ID NO: 37177 - DNA, 16 bp, H. sapiens
agccaagaggtgaaag

SEQ ID NO: 37178 - DNA, 16 bp, H. sapiens
agccaagataacacca

SEQ ID NO: 37179 - DNA, 16 bp, H. sapiens
agccaagatcacagca

SEQ ID NO: 37180 - DNA, 16 bp, H. sapiens
agccaagatcctacca

SEQ ID NO: 37181 - DNA, 16 bp, H. sapiens
agccaagatcgcccca

SEQ ID NO: 37182 - DNA, 16 bp, H. sapiens
agccaagatcgcgccg

SEQ ID NO: 37183 - DNA, 16 bp, H. sapiens
agccaagatcgtgcca

SEQ ID NO: 37184 - DNA, 16 bp, H. sapiens
agccaagatgatgcca

SEQ ID NO: 37185 - DNA, 16 bp, H. sapiens
agccaagatggtgtca

SEQ ID NO: 37186 - DNA, 16 bp, H. sapiens
agccaagattcaaacc

SEQ ID NO: 37187 - DNA, 16 bp, H. sapiens
agccaagattctgcca

SEQ ID NO: 37188 - DNA, 16 bp, H. sapiens
agccaagcacagtggt

SEQ ID NO: 37189 - DNA, 16 bp, H. sapiens
agccaagcagatgctg

SEQ ID NO: 37190 - DNA, 16 bp, H. sapiens
agccaagccagtcaag

SEQ ID NO: 37191 - DNA, 17 bp, H. sapiens
agccaagcgtggtggca

SEQ ID NO: 37192 - DNA, 16 bp, H. sapiens
agccaagctggtctca

SEQ ID NO: 37193 - DNA, 16 bp, H. sapiens
agccaaggaaagccaa

SEQ ID NO: 37194 - DNA, 16 bp, H. sapiens
agccaaggaactccaa

SEQ ID NO: 37195 - DNA, 16 bp, H. sapiens
agccaaggagacaggc

SEQ ID NO: 37196 - DNA, 16 bp, H. sapiens
agccaaggagaggcct

SEQ ID NO: 37197 - DNA, 16 bp, H. sapiens
agccaaggagggcaga

SEQ ID NO: 37198 - DNA, 16 bp, H. sapiens
agccaaggaggtcaag

SEQ ID NO: 37199 - DNA, 16 bp, H. sapiens
agccaaggagttggag

SEQ ID NO: 37200 - DNA, 16 bp, H. sapiens
agccaaggcaggagga

SEQ ID NO: 37201 - DNA, 17 bp, H. sapiens
agccaaggccaaaggaa

SEQ ID NO: 37202 - DNA, 16 bp, H. sapiens
agccaaggctcagaga

SEQ ID NO: 37203 - DNA, 16 bp, H. sapiens
agccaaggctgagaac

SEQ ID NO: 37204 - DNA, 16 bp, H. sapiens
agccaaggctggactg

SEQ ID NO: 37205 - DNA, 16 bp, H. sapiens
agccaaggttgagaac

SEQ ID NO: 37206 - DNA, 16 bp, H. sapiens
agccaaggttgtgcca

SEQ ID NO: 37207 - DNA, 16 bp, H. sapiens
agccaagtacagaaag

SEQ ID NO: 37208 - DNA, 16 bp, H. sapiens
agccaagtgcagtggc

SEQ ID NO: 37209 - DNA, 16 bp, H. sapiens
agccaagtgtggcagc

SEQ ID NO: 37210 - DNA, 16 bp, H. sapiens
agccaagtgtggtggt

SEQ ID NO: 37211 - DNA, 16 bp, H. sapiens
agccaagttctttgcc

SEQ ID NO: 37212 - DNA, 16 bp, H. sapiens
agccaagttgacacaa

SEQ ID NO: 37213 - DNA, 16 bp, H. sapiens
agccaataaaagcccc

SEQ ID NO: 37214 - DNA, 16 bp, H. sapiens
agccaatatggtgaaa

SEQ ID NO: 37215 - DNA, 16 bp, H. sapiens
agccaatggtagcttg

SEQ ID NO: 37216 - DNA, 16 bp, H. sapiens
agccaattaaatattt

SEQ ID NO: 37217 - DNA, 16 bp, H. sapiens
agccaatttacattta

SEQ ID NO: 37218 - DNA, 16 bp, H. sapiens
agccaattttgagctt

SEQ ID NO: 37219 - DNA, 16 bp, H. sapiens
agccacaaaaccagca

SEQ ID NO: 37220 - DNA, 16 bp, H. sapiens
agccacaaaagaccca

SEQ ID NO: 37221 - DNA, 16 bp, H. sapiens
agccacaacacccagc

SEQ ID NO: 37222 - DNA, 16 bp, H. sapiens
agccacaacacccggc

SEQ ID NO: 37223 - DNA, 16 bp, H. sapiens
agccacaacgcccagc

SEQ ID NO: 37224 - DNA, 16 bp, H. sapiens
agccacaatcatgcca

SEQ ID NO: 37225 - DNA, 16 bp, H. sapiens
agccacacaggcctcc

SEQ ID NO: 37226 - DNA, 16 bp, H. sapiens
agccacacatggctat

SEQ ID NO: 37227 - DNA, 16 bp, H. sapiens
agccacacccattcat

SEQ ID NO: 37228 - DNA, 16 bp, H. sapiens
agccacactcattcat

SEQ ID NO: 37229 - DNA, 16 bp, H. sapiens
agccacagaaaatgaa

SEQ ID NO: 37230 - DNA, 16 bp, H. sapiens
agccacagacaatatg

SEQ ID NO: 37231 - DNA, 16 bp, H. sapiens
agccacagaccctcac

SEQ ID NO: 37232 - DNA, 16 bp, H. sapiens
agccacagagatggag

SEQ ID NO: 37233 - DNA, 16 bp, H. sapiens
agccacagagcctggc

SEQ ID NO: 37234 - DNA, 16 bp, H. sapiens
agccacagaggcagag

SEQ ID NO: 37235 - DNA, 16 bp, H. sapiens
agccacagataataca

SEQ ID NO: 37236 - DNA, 16 bp, H. sapiens
agccacagcaatcagg

SEQ ID NO: 37237 - DNA, 16 bp, H. sapiens
agccacagcacccggc

SEQ ID NO: 37238 - DNA, 16 bp, H. sapiens
agccacagccacagcc

SEQ ID NO: 37239 - DNA, 16 bp, H. sapiens
agccacagcctcacag

SEQ ID NO: 37240 - DNA, 16 bp, H. sapiens
agccacagcctgagct

SEQ ID NO: 37241 - DNA, 19 bp, H. sapiens
agccacagcgcctggcctt

SEQ ID NO: 37242 - DNA, 16 bp, H. sapiens
agccacagctgggatg

SEQ ID NO: 37243 - DNA, 16 bp, H. sapiens
agccacagggcccagc

SEQ ID NO: 37244 - DNA, 16 bp, H. sapiens
agccacaggggcaggg

SEQ ID NO: 37245 - DNA, 16 bp, H. sapiens
agccacaggtagaaga

SEQ ID NO: 37246 - DNA, 16 bp, H. sapiens
agccacagtacctggc

SEQ ID NO: 37247 - DNA, 17 bp, H. sapiens
agccacagtgcccagcc

SEQ ID NO: 37248 - DNA, 16 bp, H. sapiens
agccacagtgcccggc

SEQ ID NO: 37249 - DNA, 16 bp, H. sapiens
agccacagtgccctgc

SEQ ID NO: 37250 - DNA, 16 bp, H. sapiens
agccacatattgtatg

SEQ ID NO: 37251 - DNA, 16 bp, H. sapiens
agccacatgcagaaag

SEQ ID NO: 37252 - DNA, 16 bp, H. sapiens
agccaccaaagaagga

SEQ ID NO: 37253 - DNA, 16 bp, H. sapiens
agccaccaagccaggc

SEQ ID NO: 37254 - DNA, 16 bp, H. sapiens
agccaccaagcccgac

SEQ ID NO: 37255 - DNA, 16 bp, H. sapiens
agccaccaagtccagc

SEQ ID NO: 37256 - DNA, 16 bp, H. sapiens
agccaccacaccaagc

SEQ ID NO: 37257 - DNA, 16 bp, H. sapiens
agccaccacacccaga

SEQ ID NO: 37258 - DNA, 17 bp, H. sapiens
agccaccacacccggct

SEQ ID NO: 37259 - DNA, 16 bp, H. sapiens
agccaccacacctggc

SEQ ID NO: 37260 - DNA, 18 bp, H. sapiens
agccaccacacctggctt

SEQ ID NO: 37261 - DNA, 16 bp, H. sapiens
agccaccacagccagc

SEQ ID NO: 37262 - DNA, 16 bp, H. sapiens
agccaccacagctggt

SEQ ID NO: 37263 - DNA, 16 bp, H. sapiens
agccaccacccctgac

SEQ ID NO: 37264 - DNA, 16 bp, H. sapiens
agccaccacgactggc

SEQ ID NO: 37265 - DNA, 18 bp, H. sapiens
agccaccacgcctggccc

SEQ ID NO: 37266 - DNA, 18 bp, H. sapiens
agccaccacgcctggcct

SEQ ID NO: 37267 - DNA, 16 bp, H. sapiens
agccaccacgcctggt

SEQ ID NO: 37268 - DNA, 16 bp, H. sapiens
agccaccacgctggcc

SEQ ID NO: 37269 - DNA, 16 bp, H. sapiens
agccaccacgtccagc

SEQ ID NO: 37270 - DNA, 16 bp, H. sapiens
agccaccacgtctggc

SEQ ID NO: 37271 - DNA, 16 bp, H. sapiens
agccaccactctcagc

SEQ ID NO: 37272 - DNA, 16 bp, H. sapiens
agccaccaggagctgg

SEQ ID NO: 37273 - DNA, 16 bp, H. sapiens
agccaccaggcccggc

SEQ ID NO: 37274 - DNA, 27 bp, H. sapiens
agccaccaggtttcagtggaaagtgtt

SEQ ID NO: 37275 - DNA, 16 bp, H. sapiens
agccaccatacctggc

SEQ ID NO: 37276 - DNA, 16 bp, H. sapiens
agccaccatcatctct

SEQ ID NO: 37277 - DNA, 16 bp, H. sapiens
agccaccatgcacagc

SEQ ID NO: 37278 - DNA, 16 bp, H. sapiens
agccaccatgccaagc

SEQ ID NO: 37279 - DNA, 17 bp, H. sapiens
agccaccatgccaggct

SEQ ID NO: 37280 - DNA, 16 bp, H. sapiens
agccaccatgccccag

SEQ ID NO: 37281 - DNA, 18 bp, H. sapiens
agccaccatgcccggccg

SEQ ID NO: 37282 - DNA, 18 bp, H. sapiens
agccaccatgcccggctc

SEQ ID NO: 37283 - DNA, 16 bp, H. sapiens
agccaccatgccggcc

SEQ ID NO: 37284 - DNA, 16 bp, H. sapiens
agccaccatgcctgac

SEQ ID NO: 37285 - DNA, 16 bp, H. sapiens
agccaccatgcctgtc

SEQ ID NO: 37286 - DNA, 16 bp, H. sapiens
agccaccatggctggc

SEQ ID NO: 37287 - DNA, 16 bp, H. sapiens
agccaccattcccagc

SEQ ID NO: 37288 - DNA, 16 bp, H. sapiens
agccacccaaactgca

SEQ ID NO: 37289 - DNA, 16 bp, H. sapiens
agccacccagcagagc

SEQ ID NO: 37290 - DNA, 16 bp, H. sapiens
agccacccagcccagc

SEQ ID NO: 37291 - DNA, 16 bp, H. sapiens
agccacccagcctatg

SEQ ID NO: 37292 - DNA, 16 bp, H. sapiens
agccacccagtctttg

SEQ ID NO: 37293 - DNA, 16 bp, H. sapiens
agccaccccgcctggc

SEQ ID NO: 37294 - DNA, 16 bp, H. sapiens
agccaccctcagcccc

SEQ ID NO: 37295 - DNA, 16 bp, H. sapiens
agccaccctcccacct

SEQ ID NO: 37296 - DNA, 16 bp, H. sapiens
agccaccctgcccggc

SEQ ID NO: 37297 - DNA, 16 bp, H. sapiens
agccaccctgcctggc

SEQ ID NO: 37298 - DNA, 16 bp, H. sapiens
agccaccctgctcagc

SEQ ID NO: 37299 - DNA, 16 bp, H. sapiens
agccaccctgtctatg

SEQ ID NO: 37300 - DNA, 16 bp, H. sapiens
agccaccctgtctgtg

SEQ ID NO: 37301 - DNA, 16 bp, H. sapiens
agccaccgagccaggc

SEQ ID NO: 37302 - DNA, 16 bp, H. sapiens
agccaccgcaactggc

SEQ ID NO: 37303 - DNA, 19 bp, H. sapiens
agccaccgcacctggcccc

SEQ ID NO: 37304 - DNA, 19 bp, H. sapiens
agccaccgcacctggcctc

SEQ ID NO: 37305 - DNA, 16 bp, H. sapiens
agccaccgcagccggc

SEQ ID NO: 37306 - DNA, 16 bp, H. sapiens
agccaccgcgcctagc

SEQ ID NO: 37307 - DNA, 16 bp, H. sapiens
agccaccggacctggc

SEQ ID NO: 37308 - DNA, 16 bp, H. sapiens
agccaccgtccccagc

SEQ ID NO: 37309 - DNA, 16 bp, H. sapiens
agccaccgtgcccagc

SEQ ID NO: 37310 - DNA, 20 bp, H. sapiens
agccaccgtgcccagcctaa

SEQ ID NO: 37311 - DNA, 16 bp, H. sapiens
agccaccgtgctgggc

SEQ ID NO: 37312 - DNA, 16 bp, H. sapiens
agccaccgtggccggc

SEQ ID NO: 37313 - DNA, 16 bp, H. sapiens
agccaccgtggctggc

SEQ ID NO: 37314 - DNA, 16 bp, H. sapiens
agccacctcacctagc

SEQ ID NO: 37315 - DNA, 16 bp, H. sapiens
agccacctcccccagc

SEQ ID NO: 37316 - DNA, 16 bp, H. sapiens
agccacctcctacagg

SEQ ID NO: 37317 - DNA, 16 bp, H. sapiens
agccacctcctccagg

SEQ ID NO: 37318 - DNA, 16 bp, H. sapiens
agccacctctcccagc

SEQ ID NO: 37319 - DNA, 16 bp, H. sapiens
agccacctgagcagct

SEQ ID NO: 37320 - DNA, 16 bp, H. sapiens
agccacctgcccagcc

SEQ ID NO: 37321 - DNA, 16 bp, H. sapiens
agccacctggaggccc

SEQ ID NO: 37322 - DNA, 16 bp, H. sapiens
agccacctggtggcag

SEQ ID NO: 37323 - DNA, 16 bp, H. sapiens
agccacctgtggctat

SEQ ID NO: 37324 - DNA, 16 bp, H. sapiens
agccaccttcatcagt

SEQ ID NO: 37325 - DNA, 16 bp, H. sapiens
agccacgcgcccagcc

SEQ ID NO: 37326 - DNA, 16 bp, H. sapiens
agccacggcgcctggc

SEQ ID NO: 37327 - DNA, 16 bp, H. sapiens
agccacggctcctggc

SEQ ID NO: 37328 - DNA, 16 bp, H. sapiens
agccacgtggaactgt

SEQ ID NO: 37329 - DNA, 16 bp, H. sapiens
agccactaaccacatg

SEQ ID NO: 37330 - DNA, 16 bp, H. sapiens
agccactacaaaaaca

SEQ ID NO: 37331 - DNA, 16 bp, H. sapiens
agccactaggcctggc

SEQ ID NO: 37332 - DNA, 16 bp, H. sapiens
agccactatcctcagc

SEQ ID NO: 37333 - DNA, 16 bp, H. sapiens
agccactatgtccagc

SEQ ID NO: 37334 - DNA, 16 bp, H. sapiens
agccactccgcccggc

SEQ ID NO: 37335 - DNA, 16 bp, H. sapiens
agccactctgcccagc

SEQ ID NO: 37336 - DNA, 16 bp, H. sapiens
agccactctgcctggc

SEQ ID NO: 37337 - DNA, 16 bp, H. sapiens
agccactctggaggct

SEQ ID NO: 37338 - DNA, 16 bp, H. sapiens
agccactgagcccagt

SEQ ID NO: 37339 - DNA, 16 bp, H. sapiens
agccactgagctggtc

SEQ ID NO: 37340 - DNA, 16 bp, H. sapiens
agccactgaggctggc

SEQ ID NO: 37341 - DNA, 16 bp, H. sapiens
agccactgagtccagc

SEQ ID NO: 37342 - DNA, 16 bp, H. sapiens
agccactgcacacaga

SEQ ID NO: 37343 - DNA, 16 bp, H. sapiens
agccactgcacccact

SEQ ID NO: 37344 - DNA, 16 bp, H. sapiens
agccactgcacccagc

SEQ ID NO: 37345 - DNA, 16 bp, H. sapiens
agccactgcacccgga

SEQ ID NO: 37346 - DNA, 18 bp, H. sapiens
agccactgcacctggccc

SEQ ID NO: 37347 - DNA, 19 bp, H. sapiens
agccactgcacctggctaa

SEQ ID NO: 37348 - DNA, 16 bp, H. sapiens
agccactgcagccagc

SEQ ID NO: 37349 - DNA, 16 bp, H. sapiens
agccactgccccaggc

SEQ ID NO: 37350 - DNA, 16 bp, H. sapiens
agccactgcccccagc

SEQ ID NO: 37351 - DNA, 16 bp, H. sapiens
agccactgccctggcc

SEQ ID NO: 37352 - DNA, 16 bp, H. sapiens
agccactgcctggcca

SEQ ID NO: 37353 - DNA, 19 bp, H. sapiens
agccactgcgcccagcctc

SEQ ID NO: 37354 - DNA, 20 bp, H. sapiens
agccactgcgcccggcccag

SEQ ID NO: 37355 - DNA, 19 bp, H. sapiens
agccactgcgcccggcccc

SEQ ID NO: 37356 - DNA, 19 bp, H. sapiens
agccactgcgcccggccct

SEQ ID NO: 37357 - DNA, 19 bp, H. sapiens
agccactgcgcccggcctt

SEQ ID NO: 37358 - DNA, 16 bp, H. sapiens
agccactgcgcctgcc

SEQ ID NO: 37359 - DNA, 19 bp, H. sapiens
agccactgcgcctggctgg

SEQ ID NO: 37360 - DNA, 16 bp, H. sapiens
agccactgcgctcagc

SEQ ID NO: 37361 - DNA, 16 bp, H. sapiens
agccactgctcccagt

SEQ ID NO: 37362 - DNA, 16 bp, H. sapiens
agccactgctcccggc

SEQ ID NO: 37363 - DNA, 16 bp, H. sapiens
agccactgctctcagc

SEQ ID NO: 37364 - DNA, 16 bp, H. sapiens
agccactgggccaggc

SEQ ID NO: 37365 - DNA, 16 bp, H. sapiens
agccactgggcttggc

SEQ ID NO: 37366 - DNA, 16 bp, H. sapiens
agccactgtacccgac

SEQ ID NO: 37367 - DNA, 16 bp, H. sapiens
agccactgtgactggt

SEQ ID NO: 37368 - DNA, 16 bp, H. sapiens
agccactgtgccagcc

SEQ ID NO: 37369 - DNA, 16 bp, H. sapiens
agccactgtgccaggc

SEQ ID NO: 37370 - DNA, 18 bp, H. sapiens
agccactgtgcccggccg

SEQ ID NO: 37371 - DNA, 16 bp, H. sapiens
agccactgtgccctgg

SEQ ID NO: 37372 - DNA, 16 bp, H. sapiens
agccactgtgccctgt

SEQ ID NO: 37373 - DNA, 18 bp, H. sapiens
agccactgtgcctgaccc

SEQ ID NO: 37374 - DNA, 17 bp, H. sapiens
agccactgtgcctggcc

SEQ ID NO: 37375 - DNA, 16 bp, H. sapiens
agccactgtgcctggt

SEQ ID NO: 37376 - DNA, 16 bp, H. sapiens
agccactgtgcttggc

SEQ ID NO: 37377 - DNA, 16 bp, H. sapiens
agccacttctcccagc

SEQ ID NO: 37378 - DNA, 16 bp, H. sapiens
agccacttctctctga

SEQ ID NO: 37379 - DNA, 16 bp, H. sapiens
agccacttgagaggct

SEQ ID NO: 37380 - DNA, 16 bp, H. sapiens
agccactttggaaaag

SEQ ID NO: 37381 - DNA, 16 bp, H. sapiens
agccactttgttttgg

SEQ ID NO: 37382 - DNA, 16 bp, H. sapiens
agccacttttcccagc

SEQ ID NO: 37383 - DNA, 16 bp, H. sapiens
agccagaaaattagct

SEQ ID NO: 37384 - DNA, 16 bp, H. sapiens
agccagaaacctggga

SEQ ID NO: 37385 - DNA, 16 bp, H. sapiens
agccagaaagtggaaa

SEQ ID NO: 37386 - DNA, 16 bp, H. sapiens
agccagaaccactcag

SEQ ID NO: 37387 - DNA, 16 bp, H. sapiens
agccagaagaaattgg

SEQ ID NO: 37388 - DNA, 16 bp, H. sapiens
agccagaagaacaaag

SEQ ID NO: 37389 - DNA, 16 bp, H. sapiens
agccagaagacagtgg

SEQ ID NO: 37390 - DNA, 16 bp, H. sapiens
agccagaagagaagtt

SEQ ID NO: 37391 - DNA, 16 bp, H. sapiens
agccagaagtggaatt

SEQ ID NO: 37392 - DNA, 16 bp, H. sapiens
agccagaagttcgaga

SEQ ID NO: 37393 - DNA, 16 bp, H. sapiens
agccagaatccatctc

SEQ ID NO: 37394 - DNA, 16 bp, H. sapiens
agccagacaaaggcat

SEQ ID NO: 37395 - DNA, 16 bp, H. sapiens
agccagacactgtctc

SEQ ID NO: 37396 - DNA, 16 bp, H. sapiens
agccagacagccagcc

SEQ ID NO: 37397 - DNA, 16 bp, H. sapiens
agccagacagcctggg

SEQ ID NO: 37398 - DNA, 17 bp, H. sapiens
agccagacatggtggtg

SEQ ID NO: 37399 - DNA, 16 bp, H. sapiens
agccagaccacgaacc

SEQ ID NO: 37400 - DNA, 16 bp, H. sapiens
agccagaccctgactc

SEQ ID NO: 37401 - DNA, 16 bp, H. sapiens
agccagacctcatctc

SEQ ID NO: 37402 - DNA, 16 bp, H. sapiens
agccagacctggtggt

SEQ ID NO: 37403 - DNA, 18 bp, H. sapiens
agccagacgtggtggcac

SEQ ID NO: 37404 - DNA, 16 bp, H. sapiens
agccagactcacacag

SEQ ID NO: 37405 - DNA, 16 bp, H. sapiens
agccagactggtctca

SEQ ID NO: 37406 - DNA, 16 bp, H. sapiens
agccagacttcctggg

SEQ ID NO: 37407 - DNA, 16 bp, H. sapiens
agccagacttggtggt

SEQ ID NO: 37408 - DNA, 16 bp, H. sapiens
agccagagaaaaaggt

SEQ ID NO: 37409 - DNA, 16 bp, H. sapiens
agccagagaaagagag

SEQ ID NO: 37410 - DNA, 16 bp, H. sapiens
agccagagaaagttct

SEQ ID NO: 37411 - DNA, 16 bp, H. sapiens
agccagagaagtgaca

SEQ ID NO: 37412 - DNA, 16 bp, H. sapiens
agccagagagaaagct

SEQ ID NO: 37413 - DNA, 16 bp, H. sapiens
agccagagagaaagtt

SEQ ID NO: 37414 - DNA, 16 bp, H. sapiens
agccagagagaaatgt

SEQ ID NO: 37415 - DNA, 16 bp, H. sapiens
agccagagagagaaag

SEQ ID NO: 37416 - DNA, 16 bp, H. sapiens
agccagagaggcagag

SEQ ID NO: 37417 - DNA, 16 bp, H. sapiens
agccagagcaacatgg

SEQ ID NO: 37418 - DNA, 16 bp, H. sapiens
agccagaggagcaggg

SEQ ID NO: 37419 - DNA, 16 bp, H. sapiens
agccagaggcaggagg

SEQ ID NO: 37420 - DNA, 16 bp, H. sapiens
agccagaggccattat

SEQ ID NO: 37421 - DNA, 16 bp, H. sapiens
agccagagggatcttt

SEQ ID NO: 37422 - DNA, 16 bp, H. sapiens
agccagaggtggtggt

SEQ ID NO: 37423 - DNA, 16 bp, H. sapiens
agccagatgcagtggc

SEQ ID NO: 37424 - DNA, 16 bp, H. sapiens
agccagatgcggtggc

SEQ ID NO: 37425 - DNA, 16 bp, H. sapiens
agccagatgtggtagt

SEQ ID NO: 37426 - DNA, 16 bp, H. sapiens
agccagattctgtctc

SEQ ID NO: 37427 - DNA, 16 bp, H. sapiens
agccagcaaaggagac

SEQ ID NO: 37428 - DNA, 16 bp, H. sapiens
agccagcaacccagaa

SEQ ID NO: 37429 - DNA, 16 bp, H. sapiens
agccagcaaggaactg

SEQ ID NO: 37430 - DNA, 16 bp, H. sapiens
agccagcaaggccagt

SEQ ID NO: 37431 - DNA, 16 bp, H. sapiens
agccagcaatggcaac

SEQ ID NO: 37432 - DNA, 16 bp, H. sapiens
agccagcacgcctggc

SEQ ID NO: 37433 - DNA, 16 bp, H. sapiens
agccagcagaagcagg

SEQ ID NO: 37434 - DNA, 16 bp, H. sapiens
agccagcagcagcaac

SEQ ID NO: 37435 - DNA, 16 bp, H. sapiens
agccagcagccccagg

SEQ ID NO: 37436 - DNA, 16 bp, H. sapiens
agccagcaggcaggga

SEQ ID NO: 37437 - DNA, 16 bp, H. sapiens
agccagcagtgacaac

SEQ ID NO: 37438 - DNA, 16 bp, H. sapiens
agccagcagtggtggc

SEQ ID NO: 37439 - DNA, 16 bp, H. sapiens
agccagcatcaccctg

SEQ ID NO: 37440 - DNA, 16 bp, H. sapiens
agccagcatcatgatg

SEQ ID NO: 37441 - DNA, 16 bp, H. sapiens
agccagcattggcaac

SEQ ID NO: 37442 - DNA, 16 bp, H. sapiens
agccagccaaaccagc

SEQ ID NO: 37443 - DNA, 16 bp, H. sapiens
agccagccaagcaagc

SEQ ID NO: 37444 - DNA, 16 bp, H. sapiens
agccagccaagcctgc

SEQ ID NO: 37445 - DNA, 16 bp, H. sapiens
agccagccacaaaaga

SEQ ID NO: 37446 - DNA, 16 bp, H. sapiens
agccagccagccagcc

SEQ ID NO: 37447 - DNA, 16 bp, H. sapiens
agccagccagccctgc

SEQ ID NO: 37448 - DNA, 16 bp, H. sapiens
agccagccaggcctgt

SEQ ID NO: 37449 - DNA, 16 bp, H. sapiens
agccagcccagagagg

SEQ ID NO: 37450 - DNA, 16 bp, H. sapiens
agccagcccagcccag

SEQ ID NO: 37451 - DNA, 16 bp, H. sapiens
agccagcccctctccc

SEQ ID NO: 37452 - DNA, 16 bp, H. sapiens
agccagccgtggtggc

SEQ ID NO: 37453 - DNA, 16 bp, H. sapiens
agccagcctgaagaaa

SEQ ID NO: 37454 - DNA, 16 bp, H. sapiens
agccagctccagcctc

SEQ ID NO: 37455 - DNA, 18 bp, H. sapiens
agccagctccctcagctt

SEQ ID NO: 37456 - DNA, 16 bp, H. sapiens
agccaggaacagaaag

SEQ ID NO: 37457 - DNA, 16 bp, H. sapiens
agccaggaactgtgga

SEQ ID NO: 37458 - DNA, 16 bp, H. sapiens
agccaggaagaaggcc

SEQ ID NO: 37459 - DNA, 16 bp, H. sapiens
agccaggacaacacag

SEQ ID NO: 37460 - DNA, 16 bp, H. sapiens
agccaggaccctcagc

SEQ ID NO: 37461 - DNA, 16 bp, H. sapiens
agccaggagcagtggc

SEQ ID NO: 37462 - DNA, 16 bp, H. sapiens
agccaggagccaagga

SEQ ID NO: 37463 - DNA, 16 bp, H. sapiens
agccaggagcccagcc

SEQ ID NO: 37464 - DNA, 16 bp, H. sapiens
agccaggagctcaaga

SEQ ID NO: 37465 - DNA, 16 bp, H. sapiens
agccaggaggattgct

SEQ ID NO: 37466 - DNA, 16 bp, H. sapiens
agccaggaggcagaag

SEQ ID NO: 37467 - DNA, 16 bp, H. sapiens
agccaggaggcagaga

SEQ ID NO: 37468 - DNA, 16 bp, H. sapiens
agccaggaggcagagg

SEQ ID NO: 37469 - DNA, 16 bp, H. sapiens
agccaggaggcggagg

SEQ ID NO: 37470 - DNA, 16 bp, H. sapiens
agccaggaggggggct

SEQ ID NO: 37471 - DNA, 16 bp, H. sapiens
agccaggaggtcaagg

SEQ ID NO: 37472 - DNA, 16 bp, H. sapiens
agccaggaggtgaagg

SEQ ID NO: 37473 - DNA, 16 bp, H. sapiens
agccaggatcacgcca

SEQ ID NO: 37474 - DNA, 16 bp, H. sapiens
agccaggatgggctca

SEQ ID NO: 37475 - DNA, 16 bp, H. sapiens
agccaggattagaacc

SEQ ID NO: 37476 - DNA, 16 bp, H. sapiens
agccaggattcaaacc

SEQ ID NO: 37477 - DNA, 16 bp, H. sapiens
agccaggattcaaatt

SEQ ID NO: 37478 - DNA, 16 bp, H. sapiens
agccaggcacagaagg

SEQ ID NO: 37479 - DNA, 16 bp, H. sapiens
agccaggcacagtggc

SEQ ID NO: 37480 - DNA, 16 bp, H. sapiens
agccaggcaccctttt

SEQ ID NO: 37481 - DNA, 16 bp, H. sapiens
agccaggcactgtgct

SEQ ID NO: 37482 - DNA, 16 bp, H. sapiens
agccaggcagcctggg

SEQ ID NO: 37483 - DNA, 16 bp, H. sapiens
agccaggcagggtggc

SEQ ID NO: 37484 - DNA, 16 bp, H. sapiens
agccaggcagtggtca

SEQ ID NO: 37485 - DNA, 16 bp, H. sapiens
agccaggcatagtagc

SEQ ID NO: 37486 - DNA, 16 bp, H. sapiens
agccaggcatggagca

SEQ ID NO: 37487 - DNA, 16 bp, H. sapiens
agccaggcatgggggc

SEQ ID NO: 37488 - DNA, 17 bp, H. sapiens
agccaggcatggtgacg

SEQ ID NO: 37489 - DNA, 16 bp, H. sapiens
agccaggcatggtgct

SEQ ID NO: 37490 - DNA, 16 bp, H. sapiens
agccaggcatggtggc

SEQ ID NO: 37491 - DNA, 16 bp, H. sapiens
agccaggcattggtgg

SEQ ID NO: 37492 - DNA, 16 bp, H. sapiens
agccaggccatagaga

SEQ ID NO: 37493 - DNA, 16 bp, H. sapiens
agccaggcccagaaag

SEQ ID NO: 37494 - DNA, 16 bp, H. sapiens
agccaggcccagggtc

SEQ ID NO: 37495 - DNA, 16 bp, H. sapiens
agccaggcctggtgac

SEQ ID NO: 37496 - DNA, 16 bp, H. sapiens
agccaggcgctgtggc

SEQ ID NO: 37497 - DNA, 16 bp, H. sapiens
agccaggcgtggtgca

SEQ ID NO: 37498 - DNA, 16 bp, H. sapiens
agccaggcgtggtgcc

SEQ ID NO: 37499 - DNA, 16 bp, H. sapiens
agccaggcgtggtgga

SEQ ID NO: 37500 - DNA, 19 bp, H. sapiens
agccaggcgtggtggtgcg

SEQ ID NO: 37501 - DNA, 16 bp, H. sapiens
agccaggcgtggttgt

SEQ ID NO: 37502 - DNA, 16 bp, H. sapiens
agccaggctgcctggg

SEQ ID NO: 37503 - DNA, 16 bp, H. sapiens
agccaggctgggcagg

SEQ ID NO: 37504 - DNA, 16 bp, H. sapiens
agccaggctggtctca

SEQ ID NO: 37505 - DNA, 16 bp, H. sapiens
agccaggctggtctcc

SEQ ID NO: 37506 - DNA, 16 bp, H. sapiens
agccaggctggtctgg

SEQ ID NO: 37507 - DNA, 16 bp, H. sapiens
agccaggctgtggtgg

SEQ ID NO: 37508 - DNA, 16 bp, H. sapiens
agccagggacagcctg

SEQ ID NO: 37509 - DNA, 16 bp, H. sapiens
agccagggagattgag

SEQ ID NO: 37510 - DNA, 16 bp, H. sapiens
agccagggagggcctg

SEQ ID NO: 37511 - DNA, 16 bp, H. sapiens
agccagggcaacacag

SEQ ID NO: 37512 - DNA, 16 bp, H. sapiens
agccagggcaacatag

SEQ ID NO: 37513 - DNA, 16 bp, H. sapiens
agccagggcacagcca

SEQ ID NO: 37514 - DNA, 16 bp, H. sapiens
agccagggccacagag

SEQ ID NO: 37515 - DNA, 16 bp, H. sapiens
agccaggggctcaggg

SEQ ID NO: 37516 - DNA, 16 bp, H. sapiens
agccagggtggtggtg

SEQ ID NO: 37517 - DNA, 16 bp, H. sapiens
agccagggttttgcca

SEQ ID NO: 37518 - DNA, 16 bp, H. sapiens
agccaggtgcagaggc

SEQ ID NO: 37519 - DNA, 16 bp, H. sapiens
agccaggtggatcact

SEQ ID NO: 37520 - DNA, 16 bp, H. sapiens
agccaggtgtcatggt

SEQ ID NO: 37521 - DNA, 16 bp, H. sapiens
agccaggtgtggcagt

SEQ ID NO: 37522 - DNA, 17 bp, H. sapiens
agccaggtgtggcggca

SEQ ID NO: 37523 - DNA, 16 bp, H. sapiens
agccaggtgtggcggt

SEQ ID NO: 37524 - DNA, 16 bp, H. sapiens
agccaggtgtggctgg

SEQ ID NO: 37525 - DNA, 18 bp, H. sapiens
agccaggtgtggtagcac

SEQ ID NO: 37526 - DNA, 17 bp, H. sapiens
agccaggtgtggtggca

SEQ ID NO: 37527 - DNA, 16 bp, H. sapiens
agccaggtgtgttggt

SEQ ID NO: 37528 - DNA, 16 bp, H. sapiens
agccaggtgttcaaga

SEQ ID NO: 37529 - DNA, 16 bp, H. sapiens
agccaggttcagtggc

SEQ ID NO: 37530 - DNA, 16 bp, H. sapiens
agccagtatcactcta

SEQ ID NO: 37531 - DNA, 16 bp, H. sapiens
agccagtccctccatt

SEQ ID NO: 37532 - DNA, 16 bp, H. sapiens
agccagtgatgatgag

SEQ ID NO: 37533 - DNA, 16 bp, H. sapiens
agccagtgcacccagc

SEQ ID NO: 37534 - DNA, 16 bp, H. sapiens
agccagtgtgtgcaga

SEQ ID NO: 37535 - DNA, 16 bp, H. sapiens
agccagttcacagacc

SEQ ID NO: 37536 - DNA, 16 bp, H. sapiens
agccagttttttgaaa

SEQ ID NO: 37537 - DNA, 16 bp, H. sapiens
agccataaaaaagaac

SEQ ID NO: 37538 - DNA, 16 bp, H. sapiens
agccataaaaaagaag

SEQ ID NO: 37539 - DNA, 16 bp, H. sapiens
agccataaaaaggaaa

SEQ ID NO: 37540 - DNA, 16 bp, H. sapiens
agccataaaaaggaac

SEQ ID NO: 37541 - DNA, 16 bp, H. sapiens
agccataaaaggaaat

SEQ ID NO: 37542 - DNA, 16 bp, H. sapiens
agccataaacaggaat

SEQ ID NO: 37543 - DNA, 16 bp, H. sapiens
agccataaagaaagaa

SEQ ID NO: 37544 - DNA, 16 bp, H. sapiens
agccataagaagaaat

SEQ ID NO: 37545 - DNA, 16 bp, H. sapiens
agccataataaagaaa

SEQ ID NO: 37546 - DNA, 16 bp, H. sapiens
agccataatcacgcca

SEQ ID NO: 37547 - DNA, 16 bp, H. sapiens
agccataatccccctg

SEQ ID NO: 37548 - DNA, 16 bp, H. sapiens
agccatacatctgata

SEQ ID NO: 37549 - DNA, 16 bp, H. sapiens
agccatagaaaagaat

SEQ ID NO: 37550 - DNA, 16 bp, H. sapiens
agccatagcgcccagc

SEQ ID NO: 37551 - DNA, 16 bp, H. sapiens
agccatagtaaccaaa

SEQ ID NO: 37552 - DNA, 16 bp, H. sapiens
agccatatatgataaa

SEQ ID NO: 37553 - DNA, 16 bp, H. sapiens
agccatcacacctggc

SEQ ID NO: 37554 - DNA, 16 bp, H. sapiens
agccatcaccctcagc

SEQ ID NO: 37555 - DNA, 16 bp, H. sapiens
agccatcacgcccagc

SEQ ID NO: 37556 - DNA, 16 bp, H. sapiens
agccatcatgcccagc

SEQ ID NO: 37557 - DNA, 16 bp, H. sapiens
agccatcatgcctgac

SEQ ID NO: 37558 - DNA, 16 bp, H. sapiens
agccatcatgcctggt

SEQ ID NO: 37559 - DNA, 23 bp, H. sapiens
agccatcccattactgggtatat

SEQ ID NO: 37560 - DNA, 16 bp, H. sapiens
agccatccccactgcc

SEQ ID NO: 37561 - DNA, 16 bp, H. sapiens
agccatcctcccgcct

SEQ ID NO: 37562 - DNA, 16 bp, H. sapiens
agccatcctcccgctt

SEQ ID NO: 37563 - DNA, 16 bp, H. sapiens
agccatcctcctgccc

SEQ ID NO: 37564 - DNA, 16 bp, H. sapiens
agccatcctcttgcct

SEQ ID NO: 37565 - DNA, 16 bp, H. sapiens
agccatcgcacccagc

SEQ ID NO: 37566 - DNA, 16 bp, H. sapiens
agccatcgtgcccagt

SEQ ID NO: 37567 - DNA, 16 bp, H. sapiens
agccatctataacaaa

SEQ ID NO: 37568 - DNA, 16 bp, H. sapiens
agccatcttggaagca

SEQ ID NO: 37569 - DNA, 16 bp, H. sapiens
agccatctttggaaaa

SEQ ID NO: 37570 - DNA, 16 bp, H. sapiens
agccatgaactgggct

SEQ ID NO: 37571 - DNA, 16 bp, H. sapiens
agccatgagcatgcca

SEQ ID NO: 37572 - DNA, 16 bp, H. sapiens
agccatgatcacacca

SEQ ID NO: 37573 - DNA, 16 bp, H. sapiens
agccatgatcatacca

SEQ ID NO: 37574 - DNA, 16 bp, H. sapiens
agccatgatggtgcca

SEQ ID NO: 37575 - DNA, 16 bp, H. sapiens
agccatgctgaactct

SEQ ID NO: 37576 - DNA, 16 bp, H. sapiens
agccatgctgaattgt

SEQ ID NO: 37577 - DNA, 16 bp, H. sapiens
agccatggcagaagaa

SEQ ID NO: 37578 - DNA, 16 bp, H. sapiens
agccatggctcactgc

SEQ ID NO: 37579 - DNA, 16 bp, H. sapiens
agccatggctgggcag

SEQ ID NO: 37580 - DNA, 16 bp, H. sapiens
agccatggtgcccagt

SEQ ID NO: 37581 - DNA, 16 bp, H. sapiens
agccatggtggcacat

SEQ ID NO: 37582 - DNA, 16 bp, H. sapiens
agccatgtgactttgg

SEQ ID NO: 37583 - DNA, 16 bp, H. sapiens
agccatgtggaactgt

SEQ ID NO: 37584 - DNA, 16 bp, H. sapiens
agccatgtggaattgt

SEQ ID NO: 37585 - DNA, 16 bp, H. sapiens
agccattaaaaggaaa

SEQ ID NO: 37586 - DNA, 16 bp, H. sapiens
agccattacataatgg

SEQ ID NO: 37587 - DNA, 16 bp, H. sapiens
agccattatgcccagc

SEQ ID NO: 37588 - DNA, 16 bp, H. sapiens
agccattcattcattc

SEQ ID NO: 37589 - DNA, 16 bp, H. sapiens
agccattccacaatgt

SEQ ID NO: 37590 - DNA, 16 bp, H. sapiens
agccattctgactcat

SEQ ID NO: 37591 - DNA, 16 bp, H. sapiens
agccattgaaaagaat

SEQ ID NO: 37592 - DNA, 16 bp, H. sapiens
agccattgaagagttt

SEQ ID NO: 37593 - DNA, 16 bp, H. sapiens
agccattgcacccagc

SEQ ID NO: 37594 - DNA, 17 bp, H. sapiens
agccattgtgcccggcc

SEQ ID NO: 37595 - DNA, 16 bp, H. sapiens
agccatttctccaaag

SEQ ID NO: 37596 - DNA, 16 bp, H. sapiens
agccatttctccaagg

SEQ ID NO: 37597 - DNA, 16 bp, H. sapiens
agccatttcttcaaga

SEQ ID NO: 37598 - DNA, 16 bp, H. sapiens
agccatttgtagaaag

SEQ ID NO: 37599 - DNA, 16 bp, H. sapiens
agccatttttaaatgt

SEQ ID NO: 37600 - DNA, 16 bp, H. sapiens
agcccaaaatatttac

SEQ ID NO: 37601 - DNA, 16 bp, H. sapiens
agcccaaatagccaag

SEQ ID NO: 37602 - DNA, 16 bp, H. sapiens
agcccaacatcactga

SEQ ID NO: 37603 - DNA, 16 bp, H. sapiens
agcccaagaggcagag

SEQ ID NO: 37604 - DNA, 16 bp, H. sapiens
agcccaagaggtcaag

SEQ ID NO: 37605 - DNA, 16 bp, H. sapiens
agcccaagctctacat

SEQ ID NO: 37606 - DNA, 16 bp, H. sapiens
agcccaattaaacctc

SEQ ID NO: 37607 - DNA, 16 bp, H. sapiens
agcccacagaaataca

SEQ ID NO: 37608 - DNA, 16 bp, H. sapiens
agcccacagagggtga

SEQ ID NO: 37609 - DNA, 16 bp, H. sapiens
agcccacagctctcaa

SEQ ID NO: 37610 - DNA, 16 bp, H. sapiens
agcccacagggctttt

SEQ ID NO: 37611 - DNA, 27 bp, H. sapiens
agcccacatcaccaagtcaatcctaag

SEQ ID NO: 37612 - DNA, 16 bp, H. sapiens
agcccaccacagctct

SEQ ID NO: 37613 - DNA, 16 bp, H. sapiens
agcccaccctactcca

SEQ ID NO: 37614 - DNA, 16 bp, H. sapiens
agcccaccctgtgtgc

SEQ ID NO: 37615 - DNA, 16 bp, H. sapiens
agcccacctcttgcat

SEQ ID NO: 37616 - DNA, 16 bp, H. sapiens
agcccacgttgccaag

SEQ ID NO: 37617 - DNA, 16 bp, H. sapiens
agcccactgccctgaa

SEQ ID NO: 37618 - DNA, 16 bp, H. sapiens
agcccagaagacagag

SEQ ID NO: 37619 - DNA, 16 bp, H. sapiens
agcccagaagctggag

SEQ ID NO: 37620 - DNA, 16 bp, H. sapiens
agcccagaaggcagag

SEQ ID NO: 37621 - DNA, 16 bp, H. sapiens
agcccagaagttccag

SEQ ID NO: 37622 - DNA, 16 bp, H. sapiens
agcccagaccctccag

SEQ ID NO: 37623 - DNA, 16 bp, H. sapiens
agcccagacctctccc

SEQ ID NO: 37624 - DNA, 16 bp, H. sapiens
agcccagacttcacca

SEQ ID NO: 37625 - DNA, 16 bp, H. sapiens
agcccagagcctggca

SEQ ID NO: 37626 - DNA, 16 bp, H. sapiens
agcccagaggtcgagg

SEQ ID NO: 37627 - DNA, 16 bp, H. sapiens
agcccagatggcctga

SEQ ID NO: 37628 - DNA, 16 bp, H. sapiens
agcccagcaaagccat

SEQ ID NO: 37629 - DNA, 17 bp, H. sapiens
agcccagcaagctaaga

SEQ ID NO: 37630 - DNA, 16 bp, H. sapiens
agcccagcagtctgag

SEQ ID NO: 37631 - DNA, 16 bp, H. sapiens
agcccagcagttccag

SEQ ID NO: 37632 - DNA, 16 bp, H. sapiens
agcccagcagttggag

SEQ ID NO: 37633 - DNA, 16 bp, H. sapiens
agcccagcatccatca

SEQ ID NO: 37634 - DNA, 16 bp, H. sapiens
agcccagcatccatta

SEQ ID NO: 37635 - DNA, 16 bp, H. sapiens
agcccagcatggtggt

SEQ ID NO: 37636 - DNA, 16 bp, H. sapiens
agcccagccaggtgtg

SEQ ID NO: 37637 - DNA, 16 bp, H. sapiens
agcccagcccagcctc

SEQ ID NO: 37638 - DNA, 16 bp, H. sapiens
agcccagcccatgagg

SEQ ID NO: 37639 - DNA, 16 bp, H. sapiens
agcccagccccagctc

SEQ ID NO: 37640 - DNA, 16 bp, H. sapiens
agcccagccctgggga

SEQ ID NO: 37641 - DNA, 16 bp, H. sapiens
agcccagcctccctcc

SEQ ID NO: 37642 - DNA, 16 bp, H. sapiens
agcccagcctcctccc

SEQ ID NO: 37643 - DNA, 16 bp, H. sapiens
agcccagctaattttt

SEQ ID NO: 37644 - DNA, 16 bp, H. sapiens
agcccagctcagccca

SEQ ID NO: 37645 - DNA, 16 bp, H. sapiens
agcccagctccccact

SEQ ID NO: 37646 - DNA, 16 bp, H. sapiens
agcccagctcctgcct

SEQ ID NO: 37647 - DNA, 16 bp, H. sapiens
agcccagctctgccac

SEQ ID NO: 37648 - DNA, 16 bp, H. sapiens
agcccagctggcacct

SEQ ID NO: 37649 - DNA, 16 bp, H. sapiens
agcccaggaaatggag

SEQ ID NO: 37650 - DNA, 16 bp, H. sapiens
agcccaggaatccaag

SEQ ID NO: 37651 - DNA, 16 bp, H. sapiens
agcccaggaattcaaa

SEQ ID NO: 37652 - DNA, 16 bp, H. sapiens
agcccaggaattcaag

SEQ ID NO: 37653 - DNA, 16 bp, H. sapiens
agcccaggacacagag

SEQ ID NO: 37654 - DNA, 16 bp, H. sapiens
agcccaggaccagaga

SEQ ID NO: 37655 - DNA, 16 bp, H. sapiens
agcccaggacccagtg

SEQ ID NO: 37656 - DNA, 16 bp, H. sapiens
agcccaggagactgag

SEQ ID NO: 37657 - DNA, 16 bp, H. sapiens
agcccaggagatagag

SEQ ID NO: 37658 - DNA, 16 bp, H. sapiens
agcccaggagatggag

SEQ ID NO: 37659 - DNA, 16 bp, H. sapiens
agcccaggagctccag

SEQ ID NO: 37660 - DNA, 16 bp, H. sapiens
agcccaggagctggag

SEQ ID NO: 37661 - DNA, 16 bp, H. sapiens
agcccaggaggaagag

SEQ ID NO: 37662 - DNA, 16 bp, H. sapiens
agcccaggaggcagga

SEQ ID NO: 37663 - DNA, 16 bp, H. sapiens
agcccaggaggcagtg

SEQ ID NO: 37664 - DNA, 16 bp, H. sapiens
agcccaggagggagag

SEQ ID NO: 37665 - DNA, 16 bp, H. sapiens
agcccaggaggggcag

SEQ ID NO: 37666 - DNA, 16 bp, H. sapiens
agcccaggaggtaaag

SEQ ID NO: 37667 - DNA, 16 bp, H. sapiens
agcccaggaggtagaa

SEQ ID NO: 37668 - DNA, 16 bp, H. sapiens
agcccaggaggtcaat

SEQ ID NO: 37669 - DNA, 16 bp, H. sapiens
agcccaggaggtggaa

SEQ ID NO: 37670 - DNA, 16 bp, H. sapiens
agcccaggaggtggtg

SEQ ID NO: 37671 - DNA, 17 bp, H. sapiens
agcccaggaggttgaga

SEQ ID NO: 37672 - DNA, 16 bp, H. sapiens
agcccaggagtccagg

SEQ ID NO: 37673 - DNA, 16 bp, H. sapiens
agcccaggagtgcgag

SEQ ID NO: 37674 - DNA, 16 bp, H. sapiens
agcccaggagttaaag

SEQ ID NO: 37675 - DNA, 16 bp, H. sapiens
agcccaggagttagaa

SEQ ID NO: 37676 - DNA, 17 bp, H. sapiens
agcccaggagttcaagg

SEQ ID NO: 37677 - DNA, 17 bp, H. sapiens
agcccaggagtttgaag

SEQ ID NO: 37678 - DNA, 16 bp, H. sapiens
agcccaggcaacaaag

SEQ ID NO: 37679 - DNA, 16 bp, H. sapiens
agcccaggcagaagag

SEQ ID NO: 37680 - DNA, 16 bp, H. sapiens
agcccaggcaggatac

SEQ ID NO: 37681 - DNA, 16 bp, H. sapiens
agcccaggcaggcaga

SEQ ID NO: 37682 - DNA, 16 bp, H. sapiens
agcccaggcagttgag

SEQ ID NO: 37683 - DNA, 16 bp, H. sapiens
agcccaggccacatgg

SEQ ID NO: 37684 - DNA, 16 bp, H. sapiens
agcccaggccccagcc

SEQ ID NO: 37685 - DNA, 16 bp, H. sapiens
agcccaggcgggtgga

SEQ ID NO: 37686 - DNA, 16 bp, H. sapiens
agcccaggctggagtg

SEQ ID NO: 37687 - DNA, 16 bp, H. sapiens
agcccaggctggcctc

SEQ ID NO: 37688 - DNA, 16 bp, H. sapiens
agcccagggaggttga

SEQ ID NO: 37689 - DNA, 16 bp, H. sapiens
agcccagggcaggcag

SEQ ID NO: 37690 - DNA, 16 bp, H. sapiens
agcccaggtgcagtgg

SEQ ID NO: 37691 - DNA, 16 bp, H. sapiens
agcccaggtggtcaag

SEQ ID NO: 37692 - DNA, 16 bp, H. sapiens
agcccaggtgttcaag

SEQ ID NO: 37693 - DNA, 16 bp, H. sapiens
agcccaggtgtttgaa

SEQ ID NO: 37694 - DNA, 16 bp, H. sapiens
agcccagtagttggag

SEQ ID NO: 37695 - DNA, 16 bp, H. sapiens
agcccagtgcctgcca

SEQ ID NO: 37696 - DNA, 16 bp, H. sapiens
agcccagtggctcaca

SEQ ID NO: 37697 - DNA, 16 bp, H. sapiens
agcccatgagagcagc

SEQ ID NO: 37698 - DNA, 16 bp, H. sapiens
agcccatgcccacctg

SEQ ID NO: 37699 - DNA, 16 bp, H. sapiens
agcccatggagcaggg

SEQ ID NO: 37700 - DNA, 16 bp, H. sapiens
agcccattgtggccta

SEQ ID NO: 37701 - DNA, 16 bp, H. sapiens
agcccattttcaggag

SEQ ID NO: 37702 - DNA, 16 bp, H. sapiens
agcccattttctgggg

SEQ ID NO: 37703 - DNA, 16 bp, H. sapiens
agccccaaaccttggt

SEQ ID NO: 37704 - DNA, 16 bp, H. sapiens
agccccaaactggaaa

SEQ ID NO: 37705 - DNA, 16 bp, H. sapiens
agccccaaagtggaaa

SEQ ID NO: 37706 - DNA, 16 bp, H. sapiens
agccccaagccttggc

SEQ ID NO: 37707 - DNA, 16 bp, H. sapiens
agccccacctctggag

SEQ ID NO: 37708 - DNA, 16 bp, H. sapiens
agccccagacccagcc

SEQ ID NO: 37709 - DNA, 16 bp, H. sapiens
agccccagagggagtg

SEQ ID NO: 37710 - DNA, 16 bp, H. sapiens
agccccagccccactg

SEQ ID NO: 37711 - DNA, 16 bp, H. sapiens
agccccagccccagct

SEQ ID NO: 37712 - DNA, 16 bp, H. sapiens
agccccagcccctggc

SEQ ID NO: 37713 - DNA, 16 bp, H. sapiens
agccccagcctcagcc

SEQ ID NO: 37714 - DNA, 16 bp, H. sapiens
agccccagcctcctgg

SEQ ID NO: 37715 - DNA, 16 bp, H. sapiens
agccccagctccagcc

SEQ ID NO: 37716 - DNA, 16 bp, H. sapiens
agccccagctctgcag

SEQ ID NO: 37717 - DNA, 16 bp, H. sapiens
agccccagctgctcag

SEQ ID NO: 37718 - DNA, 16 bp, H. sapiens
agccccagctgctggg

SEQ ID NO: 37719 - DNA, 16 bp, H. sapiens
agccccaggagctgag

SEQ ID NO: 37720 - DNA, 16 bp, H. sapiens
agccccaggcccactt

SEQ ID NO: 37721 - DNA, 16 bp, H. sapiens
agccccaggccttggc

SEQ ID NO: 37722 - DNA, 16 bp, H. sapiens
agccccaggctccagg

SEQ ID NO: 37723 - DNA, 16 bp, H. sapiens
agccccaggctttgga

SEQ ID NO: 37724 - DNA, 16 bp, H. sapiens
agccccagggcctggg

SEQ ID NO: 37725 - DNA, 18 bp, H. sapiens
agccccagtcaggggctt

SEQ ID NO: 37726 - DNA, 16 bp, H. sapiens
agccccagttcccacc

SEQ ID NO: 37727 - DNA, 16 bp, H. sapiens
agccccatcccagacc

SEQ ID NO: 37728 - DNA, 16 bp, H. sapiens
agccccatgagggcag

SEQ ID NO: 37729 - DNA, 16 bp, H. sapiens
agccccattaaaaagt

SEQ ID NO: 37730 - DNA, 16 bp, H. sapiens
agcccccaaagtgctg

SEQ ID NO: 37731 - DNA, 16 bp, H. sapiens
agcccccaccccctga

SEQ ID NO: 37732 - DNA, 16 bp, H. sapiens
agcccccagaactatg

SEQ ID NO: 37733 - DNA, 16 bp, H. sapiens
agcccccagaagctgg

SEQ ID NO: 37734 - DNA, 16 bp, H. sapiens
agcccccagccctgcc

SEQ ID NO: 37735 - DNA, 16 bp, H. sapiens
agcccccagccctgct

SEQ ID NO: 37736 - DNA, 16 bp, H. sapiens
agcccccagggtcccc

SEQ ID NO: 37737 - DNA, 16 bp, H. sapiens
agcccccatgcccagc

SEQ ID NO: 37738 - DNA, 16 bp, H. sapiens
agccccccaagcagct

SEQ ID NO: 37739 - DNA, 16 bp, H. sapiens
agccccccaccctctg

SEQ ID NO: 37740 - DNA, 16 bp, H. sapiens
agccccccgagcagct

SEQ ID NO: 37741 - DNA, 16 bp, H. sapiens
agcccccgcacctggc

SEQ ID NO: 37742 - DNA, 16 bp, H. sapiens
agccccctgacccctt

SEQ ID NO: 37743 - DNA, 16 bp, H. sapiens
agccccctgcctgcca

SEQ ID NO: 37744 - DNA, 16 bp, H. sapiens
agccccctgctgcctc

SEQ ID NO: 37745 - DNA, 16 bp, H. sapiens
agcccccttttcaggg

SEQ ID NO: 37746 - DNA, 16 bp, H. sapiens
agccccggaggtcaag

SEQ ID NO: 37747 - DNA, 16 bp, H. sapiens
agccccggcctcccaa

SEQ ID NO: 37748 - DNA, 16 bp, H. sapiens
agcccctactgctgtg

SEQ ID NO: 37749 - DNA, 16 bp, H. sapiens
agcccctcccatcaca

SEQ ID NO: 37750 - DNA, 16 bp, H. sapiens
agcccctcccatcata

SEQ ID NO: 37751 - DNA, 16 bp, H. sapiens
agcccctcctatcaca

SEQ ID NO: 37752 - DNA, 16 bp, H. sapiens
agcccctcctgcacct

SEQ ID NO: 37753 - DNA, 16 bp, H. sapiens
agcccctctctccagg

SEQ ID NO: 37754 - DNA, 16 bp, H. sapiens
agcccctctgcccagc

SEQ ID NO: 37755 - DNA, 39 bp, H. sapiens
agcccctctgcctggctgcccagtctggaaagtgaggag

SEQ ID NO: 37756 - DNA, 16 bp, H. sapiens
agcccctgaaggaagc

SEQ ID NO: 37757 - DNA, 16 bp, H. sapiens
agcccctgactgaggc

SEQ ID NO: 37758 - DNA, 16 bp, H. sapiens
agcccctgagtagctg

SEQ ID NO: 37759 - DNA, 16 bp, H. sapiens
agcccctgcacccagc

SEQ ID NO: 37760 - DNA, 16 bp, H. sapiens
agcccctgcatctcca

SEQ ID NO: 37761 - DNA, 16 bp, H. sapiens
agcccctgccatcaca

SEQ ID NO: 37762 - DNA, 16 bp, H. sapiens
agcccctgccccagcc

SEQ ID NO: 37763 - DNA, 16 bp, H. sapiens
agcccctgctcccagc

SEQ ID NO: 37764 - DNA, 16 bp, H. sapiens
agcccctgctctgtgc

SEQ ID NO: 37765 - DNA, 16 bp, H. sapiens
agcccctgctgtgtgc

SEQ ID NO: 37766 - DNA, 16 bp, H. sapiens
agcccctggaaaacca

SEQ ID NO: 37767 - DNA, 16 bp, H. sapiens
agcccctggaacttct

SEQ ID NO: 37768 - DNA, 16 bp, H. sapiens
agcccctggcaactac

SEQ ID NO: 37769 - DNA, 16 bp, H. sapiens
agcccctggcagccac

SEQ ID NO: 37770 - DNA, 16 bp, H. sapiens
agcccctgtgcccagc

SEQ ID NO: 37771 - DNA, 16 bp, H. sapiens
agcccctgtgcccggc

SEQ ID NO: 37772 - DNA, 16 bp, H. sapiens
agcccctgtggctgct

SEQ ID NO: 37773 - DNA, 16 bp, H. sapiens
agcccgaggcgggtgg

SEQ ID NO: 37774 - DNA, 16 bp, H. sapiens
agcccgccatgcccaa

SEQ ID NO: 37775 - DNA, 16 bp, H. sapiens
agcccggccaacatga

SEQ ID NO: 37776 - DNA, 16 bp, H. sapiens
agcccgggagatggag

SEQ ID NO: 37777 - DNA, 16 bp, H. sapiens
agcccgggaggcagaa

SEQ ID NO: 37778 - DNA, 16 bp, H. sapiens
agcccgggaggcggag

SEQ ID NO: 37779 - DNA, 16 bp, H. sapiens
agcccgggaggtcgag

SEQ ID NO: 37780 - DNA, 16 bp, H. sapiens
agcccgggagttccag

SEQ ID NO: 37781 - DNA, 16 bp, H. sapiens
agcccggggctcccat

SEQ ID NO: 37782 - DNA, 16 bp, H. sapiens
agccctaatccaatat

SEQ ID NO: 37783 - DNA, 16 bp, H. sapiens
agccctacaatctgcc

SEQ ID NO: 37784 - DNA, 16 bp, H. sapiens
agccctaggcagccac

SEQ ID NO: 37785 - DNA, 16 bp, H. sapiens
agccctattttacaga

SEQ ID NO: 37786 - DNA, 16 bp, H. sapiens
agccctcaaaccccac

SEQ ID NO: 37787 - DNA, 16 bp, H. sapiens
agccctcaacctgtgg

SEQ ID NO: 37788 - DNA, 16 bp, H. sapiens
agccctcacagccctc

SEQ ID NO: 37789 - DNA, 16 bp, H. sapiens
agccctcactccacag

SEQ ID NO: 37790 - DNA, 16 bp, H. sapiens
agccctcagaaacaac

SEQ ID NO: 37791 - DNA, 32 bp, H. sapiens
agccctcagaaataacaccgcatatctacaac

SEQ ID NO: 37792 - DNA, 16 bp, H. sapiens
agccctcaggaagctt

SEQ ID NO: 37793 - DNA, 16 bp, H. sapiens
agccctcatcagaaac

SEQ ID NO: 37794 - DNA, 16 bp, H. sapiens
agccctcatcctgaag

SEQ ID NO: 37795 - DNA, 16 bp, H. sapiens
agccctccacacccct

SEQ ID NO: 37796 - DNA, 16 bp, H. sapiens
agccctccctgacccc

SEQ ID NO: 37797 - DNA, 16 bp, H. sapiens
agccctcctcctcctc

SEQ ID NO: 37798 - DNA, 16 bp, H. sapiens
agccctcctcctgcct

SEQ ID NO: 37799 - DNA, 16 bp, H. sapiens
agccctcgcttgctct

SEQ ID NO: 37800 - DNA, 16 bp, H. sapiens
agccctctgcctccct

SEQ ID NO: 37801 - DNA, 16 bp, H. sapiens
agccctcttctcacag

SEQ ID NO: 37802 - DNA, 16 bp, H. sapiens
agccctcttgcctgcc

SEQ ID NO: 37803 - DNA, 16 bp, H. sapiens
agccctctttccaggg

SEQ ID NO: 37804 - DNA, 16 bp, H. sapiens
agccctgacctcctgg

SEQ ID NO: 37805 - DNA, 16 bp, H. sapiens
agccctgacttcctgg

SEQ ID NO: 37806 - DNA, 16 bp, H. sapiens
agccctgagaaacatt

SEQ ID NO: 37807 - DNA, 16 bp, H. sapiens
agccctgattgtgcca

SEQ ID NO: 37808 - DNA, 16 bp, H. sapiens
agccctgcactccagc

SEQ ID NO: 37809 - DNA, 16 bp, H. sapiens
agccctgcatcccagg

SEQ ID NO: 37810 - DNA, 16 bp, H. sapiens
agccctgccaacacct

SEQ ID NO: 37811 - DNA, 17 bp, H. sapiens
agccctgcccaaggaga

SEQ ID NO: 37812 - DNA, 16 bp, H. sapiens
agccctgcccccacct

SEQ ID NO: 37813 - DNA, 16 bp, H. sapiens
agccctgccctcatgg

SEQ ID NO: 37814 - DNA, 16 bp, H. sapiens
agccctgccctcctgg

SEQ ID NO: 37815 - DNA, 16 bp, H. sapiens
agccctgccctgccca

SEQ ID NO: 37816 - DNA, 16 bp, H. sapiens
agccctgccctgtggg

SEQ ID NO: 37817 - DNA, 16 bp, H. sapiens
agccctgcctccagag

SEQ ID NO: 37818 - DNA, 16 bp, H. sapiens
agccctgcctctgccc

SEQ ID NO: 37819 - DNA, 16 bp, H. sapiens
agccctgcgtggtggc

SEQ ID NO: 37820 - DNA, 16 bp, H. sapiens
agccctggaagacaac

SEQ ID NO: 37821 - DNA, 16 bp, H. sapiens
agccctggaccagatg

SEQ ID NO: 37822 - DNA, 16 bp, H. sapiens
agccctggagacagag

SEQ ID NO: 37823 - DNA, 16 bp, H. sapiens
agccctggagccctgg

SEQ ID NO: 37824 - DNA, 16 bp, H. sapiens
agccctggagggaggg

SEQ ID NO: 37825 - DNA, 16 bp, H. sapiens
agccctggccagaact

SEQ ID NO: 37826 - DNA, 16 bp, H. sapiens
agccctggccaggccc

SEQ ID NO: 37827 - DNA, 16 bp, H. sapiens
agccctggccctggcc

SEQ ID NO: 37828 - DNA, 16 bp, H. sapiens
agccctggctctgcca

SEQ ID NO: 37829 - DNA, 16 bp, H. sapiens
agccctggctgcctcc

SEQ ID NO: 37830 - DNA, 16 bp, H. sapiens
agccctgggaggctgg

SEQ ID NO: 37831 - DNA, 16 bp, H. sapiens
agccctgggcccagcc

SEQ ID NO: 37832 - DNA, 16 bp, H. sapiens
agccctgggcctggca

SEQ ID NO: 37833 - DNA, 16 bp, H. sapiens
agccctggggacagag

SEQ ID NO: 37834 - DNA, 16 bp, H. sapiens
agccctggtctcctgc

SEQ ID NO: 37835 - DNA, 16 bp, H. sapiens
agccctggtttctttt

SEQ ID NO: 37836 - DNA, 16 bp, H. sapiens
agccctgtggacacct

SEQ ID NO: 37837 - DNA, 16 bp, H. sapiens
agccctgtttgtgtta

SEQ ID NO: 37838 - DNA, 18 bp, H. sapiens
agcccttaaaagggacag

SEQ ID NO: 37839 - DNA, 16 bp, H. sapiens
agcccttaacatatta

SEQ ID NO: 37840 - DNA, 16 bp, H. sapiens
agcccttcatcagatg

SEQ ID NO: 37841 - DNA, 16 bp, H. sapiens
agcccttgatgtcctg

SEQ ID NO: 37842 - DNA, 16 bp, H. sapiens
agcccttggtcagatg

SEQ ID NO: 37843 - DNA, 16 bp, H. sapiens
agccctttctggtttg

SEQ ID NO: 37844 - DNA, 17 bp, H. sapiens
agccgaatccagcagca

SEQ ID NO: 37845 - DNA, 16 bp, H. sapiens
agccgagaagatctgg

SEQ ID NO: 37846 - DNA, 19 bp, H. sapiens
agccgagaccacgccactg

SEQ ID NO: 37847 - DNA, 16 bp, H. sapiens
agccgagaccgcgcca

SEQ ID NO: 37848 - DNA, 16 bp, H. sapiens
agccgagatcacgcca

SEQ ID NO: 37849 - DNA, 16 bp, H. sapiens
agccgagatcggacca

SEQ ID NO: 37850 - DNA, 18 bp, H. sapiens
agccgagattgcaccacg

SEQ ID NO: 37851 - DNA, 16 bp, H. sapiens
agccgagctccccaag

SEQ ID NO: 37852 - DNA, 17 bp, H. sapiens
agccgaggcaggcagat

SEQ ID NO: 37853 - DNA, 16 bp, H. sapiens
agccgaggtggatgga

SEQ ID NO: 37854 - DNA, 17 bp, H. sapiens
agccgaggtgggcagat

SEQ ID NO: 37855 - DNA, 17 bp, H. sapiens
agccgaggtgggtggat

SEQ ID NO: 37856 - DNA, 16 bp, H. sapiens
agccgccacacacagc

SEQ ID NO: 37857 - DNA, 16 bp, H. sapiens
agccgccgcgcctggc

SEQ ID NO: 37858 - DNA, 16 bp, H. sapiens
agccggaagtggtggc

SEQ ID NO: 37859 - DNA, 16 bp, H. sapiens
agccggccgtggtggc

SEQ ID NO: 37860 - DNA, 16 bp, H. sapiens
agccggcggcgggctg

SEQ ID NO: 37861 - DNA, 17 bp, H. sapiens
agccggctccctctgct

SEQ ID NO: 37862 - DNA, 16 bp, H. sapiens
agccgggaggcagagg

SEQ ID NO: 37863 - DNA, 16 bp, H. sapiens
agccgggagttcaaga

SEQ ID NO: 37864 - DNA, 16 bp, H. sapiens
agccgggcacagtggc

SEQ ID NO: 37865 - DNA, 16 bp, H. sapiens
agccgggcacggcggc

SEQ ID NO: 37866 - DNA, 16 bp, H. sapiens
agccgggcatggcagc

SEQ ID NO: 37867 - DNA, 16 bp, H. sapiens
agccgggcatggtagc

SEQ ID NO: 37868 - DNA, 18 bp, H. sapiens
agccgggcatggtggcat

SEQ ID NO: 37869 - DNA, 16 bp, H. sapiens
agccgggcatggttgc

SEQ ID NO: 37870 - DNA, 16 bp, H. sapiens
agccgggcccggtggc

SEQ ID NO: 37871 - DNA, 16 bp, H. sapiens
agccgggcctgatggc

SEQ ID NO: 37872 - DNA, 16 bp, H. sapiens
agccgggcgtggaggc

SEQ ID NO: 37873 - DNA, 16 bp, H. sapiens
agccgggcttggtgac

SEQ ID NO: 37874 - DNA, 16 bp, H. sapiens
agccggggaggtggag

SEQ ID NO: 37875 - DNA, 16 bp, H. sapiens
agccggggatggtggt

SEQ ID NO: 37876 - DNA, 17 bp, H. sapiens
agccgggtacctcagtt

SEQ ID NO: 37877 - DNA, 16 bp, H. sapiens
agccgggtgaggtggc

SEQ ID NO: 37878 - DNA, 17 bp, H. sapiens
agccgggtgtggtggca

SEQ ID NO: 37879 - DNA, 16 bp, H. sapiens
agccgggtgtggtggt

SEQ ID NO: 37880 - DNA, 16 bp, H. sapiens
agccgggtgtggtgtt

SEQ ID NO: 37881 - DNA, 16 bp, H. sapiens
agccggtcgtggtggc

SEQ ID NO: 37882 - DNA, 16 bp, H. sapiens
agccggttgtggtggc

SEQ ID NO: 37883 - DNA, 16 bp, H. sapiens
agccgtgtgaccttgg

SEQ ID NO: 37884 - DNA, 16 bp, H. sapiens
agcctaaaatattgac

SEQ ID NO: 37885 - DNA, 16 bp, H. sapiens
agcctaaaattatttt

SEQ ID NO: 37886 - DNA, 17 bp, H. sapiens
agcctaactgggaggca

SEQ ID NO: 37887 - DNA, 16 bp, H. sapiens
agcctaataaagaaga

SEQ ID NO: 37888 - DNA, 16 bp, H. sapiens
agcctacagtgagctg

SEQ ID NO: 37889 - DNA, 16 bp, H. sapiens
agcctacatctttctc

SEQ ID NO: 37890 - DNA, 16 bp, H. sapiens
agcctaccaaccagaa

SEQ ID NO: 37891 - DNA, 16 bp, H. sapiens
agcctaccaggtagct

SEQ ID NO: 37892 - DNA, 16 bp, H. sapiens
agcctaccttaaatgt

SEQ ID NO: 37893 - DNA, 16 bp, H. sapiens
agcctactacacacct

SEQ ID NO: 37894 - DNA, 16 bp, H. sapiens
agcctactgagtagct

SEQ ID NO: 37895 - DNA, 16 bp, H. sapiens
agcctagagaaaagag

SEQ ID NO: 37896 - DNA, 16 bp, H. sapiens
agcctagcccagccca

SEQ ID NO: 37897 - DNA, 17 bp, H. sapiens
agcctaggcaacacagt

SEQ ID NO: 37898 - DNA, 16 bp, H. sapiens
agcctaggcgacacag

SEQ ID NO: 37899 - DNA, 16 bp, H. sapiens
agcctaggctacagag

SEQ ID NO: 37900 - DNA, 17 bp, H. sapiens
agcctagtggagctgtg

SEQ ID NO: 37901 - DNA, 16 bp, H. sapiens
agcctataatcccagc

SEQ ID NO: 37902 - DNA, 16 bp, H. sapiens
agcctataatctcagc

SEQ ID NO: 37903 - DNA, 16 bp, H. sapiens
agcctcaaaatcctgg

SEQ ID NO: 37904 - DNA, 16 bp, H. sapiens
agcctcaaactccagg

SEQ ID NO: 37905 - DNA, 16 bp, H. sapiens
agcctcaacctcctgt

SEQ ID NO: 37906 - DNA, 16 bp, H. sapiens
agcctcaacctctagg

SEQ ID NO: 37907 - DNA, 16 bp, H. sapiens
agcctcaaccttctgg

SEQ ID NO: 37908 - DNA, 16 bp, H. sapiens
agcctcaacttctcag

SEQ ID NO: 37909 - DNA, 16 bp, H. sapiens
agcctcaccagcagag

SEQ ID NO: 37910 - DNA, 16 bp, H. sapiens
agcctcaccctcccaa

SEQ ID NO: 37911 - DNA, 16 bp, H. sapiens
agcctcactgccacct

SEQ ID NO: 37912 - DNA, 16 bp, H. sapiens
agcctcagaggcagag

SEQ ID NO: 37913 - DNA, 17 bp, H. sapiens
agcctcagcaatggcgg

SEQ ID NO: 37914 - DNA, 16 bp, H. sapiens
agcctcagcctccaaa

SEQ ID NO: 37915 - DNA, 16 bp, H. sapiens
agcctcagccttctgg

SEQ ID NO: 37916 - DNA, 16 bp, H. sapiens
agcctcagctcaaagg

SEQ ID NO: 37917 - DNA, 16 bp, H. sapiens
agcctcagcttctcaa

SEQ ID NO: 37918 - DNA, 16 bp, H. sapiens
agcctcaggaaactca

SEQ ID NO: 37919 - DNA, 16 bp, H. sapiens
agcctcaggaagcttc

SEQ ID NO: 37920 - DNA, 18 bp, H. sapiens
agcctcaggagccgatgt

SEQ ID NO: 37921 - DNA, 16 bp, H. sapiens
agcctcagtcttccca

SEQ ID NO: 37922 - DNA, 16 bp, H. sapiens
agcctcagtgacacag

SEQ ID NO: 37923 - DNA, 16 bp, H. sapiens
agcctcagtgtcaagg

SEQ ID NO: 37924 - DNA, 16 bp, H. sapiens
agcctcagtgtcctca

SEQ ID NO: 37925 - DNA, 16 bp, H. sapiens
agcctcagtttcccca

SEQ ID NO: 37926 - DNA, 16 bp, H. sapiens
agcctcagtttccccc

SEQ ID NO: 37927 - DNA, 16 bp, H. sapiens
agcctcagtttcctct

SEQ ID NO: 37928 - DNA, 16 bp, H. sapiens
agcctcagtttctttt

SEQ ID NO: 37929 - DNA, 16 bp, H. sapiens
agcctcagtttttcca

SEQ ID NO: 37930 - DNA, 16 bp, H. sapiens
agcctcatcaacatgg

SEQ ID NO: 37931 - DNA, 16 bp, H. sapiens
agcctcatgccagcag

SEQ ID NO: 37932 - DNA, 16 bp, H. sapiens
agcctcattttatttt

SEQ ID NO: 37933 - DNA, 16 bp, H. sapiens
agcctcattttcctag

SEQ ID NO: 37934 - DNA, 16 bp, H. sapiens
agcctcattttcttca

SEQ ID NO: 37935 - DNA, 16 bp, H. sapiens
agcctccaaaattgtg

SEQ ID NO: 37936 - DNA, 16 bp, H. sapiens
agcctccaactcccgg

SEQ ID NO: 37937 - DNA, 16 bp, H. sapiens
agcctccaactcctag

SEQ ID NO: 37938 - DNA, 16 bp, H. sapiens
agcctccaattcctgg

SEQ ID NO: 37939 - DNA, 16 bp, H. sapiens
agcctccacctcccaa

SEQ ID NO: 37940 - DNA, 16 bp, H. sapiens
agcctccacctcccga

SEQ ID NO: 37941 - DNA, 16 bp, H. sapiens
agcctccacctctggg

SEQ ID NO: 37942 - DNA, 16 bp, H. sapiens
agcctccagaaaaaaa

SEQ ID NO: 37943 - DNA, 16 bp, H. sapiens
agcctccagaaaagaa

SEQ ID NO: 37944 - DNA, 16 bp, H. sapiens
agcctccagaagaaac

SEQ ID NO: 37945 - DNA, 16 bp, H. sapiens
agcctccagaatcaca

SEQ ID NO: 37946 - DNA, 16 bp, H. sapiens
agcctccagagggaac

SEQ ID NO: 37947 - DNA, 16 bp, H. sapiens
agcctccagagggagt

SEQ ID NO: 37948 - DNA, 16 bp, H. sapiens
agcctccagataagag

SEQ ID NO: 37949 - DNA, 16 bp, H. sapiens
agcctccagccaacag

SEQ ID NO: 37950 - DNA, 16 bp, H. sapiens
agcctccagctccacc

SEQ ID NO: 37951 - DNA, 16 bp, H. sapiens
agcctccagctccatc

SEQ ID NO: 37952 - DNA, 16 bp, H. sapiens
agcctccagctgcagg

SEQ ID NO: 37953 - DNA, 16 bp, H. sapiens
agcctccataaccatg

SEQ ID NO: 37954 - DNA, 16 bp, H. sapiens
agcctccatgcccagc

SEQ ID NO: 37955 - DNA, 16 bp, H. sapiens
agcctccatttcccag

SEQ ID NO: 37956 - DNA, 16 bp, H. sapiens
agcctccattttctca

SEQ ID NO: 37957 - DNA, 16 bp, H. sapiens
agcctcccaaaatgct

SEQ ID NO: 37958 - DNA, 16 bp, H. sapiens
agcctcccaaagcact

SEQ ID NO: 37959 - DNA, 16 bp, H. sapiens
agcctcccaaaggtct

SEQ ID NO: 37960 - DNA, 20 bp, H. sapiens
agcctcccaaagtgctgggg

SEQ ID NO: 37961 - DNA, 18 bp, H. sapiens
agcctcccaaagtgttga

SEQ ID NO: 37962 - DNA, 16 bp, H. sapiens
agcctcccaagagctg

SEQ ID NO: 37963 - DNA, 17 bp, H. sapiens
agcctcccaagcagcta

SEQ ID NO: 37964 - DNA, 16 bp, H. sapiens
agcctcccaagcatct

SEQ ID NO: 37965 - DNA, 16 bp, H. sapiens
agcctcccaagtagtc

SEQ ID NO: 37966 - DNA, 16 bp, H. sapiens
agcctcccaagtattt

SEQ ID NO: 37967 - DNA, 16 bp, H. sapiens
agcctcccagcctcca

SEQ ID NO: 37968 - DNA, 16 bp, H. sapiens
agcctcccagcctctc

SEQ ID NO: 37969 - DNA, 16 bp, H. sapiens
agcctcccagcctgca

SEQ ID NO: 37970 - DNA, 16 bp, H. sapiens
agcctcccagctggga

SEQ ID NO: 37971 - DNA, 16 bp, H. sapiens
agcctcccaggtacct

SEQ ID NO: 37972 - DNA, 17 bp, H. sapiens
agcctcccaggtagcta

SEQ ID NO: 37973 - DNA, 16 bp, H. sapiens
agcctcccaggtggct

SEQ ID NO: 37974 - DNA, 16 bp, H. sapiens
agcctccccaacgagc

SEQ ID NO: 37975 - DNA, 16 bp, H. sapiens
agcctccccaaggagc

SEQ ID NO: 37976 - DNA, 16 bp, H. sapiens
agcctccccagcagcc

SEQ ID NO: 37977 - DNA, 16 bp, H. sapiens
agcctccccagccacg

SEQ ID NO: 37978 - DNA, 16 bp, H. sapiens
agcctccccagcctcc

SEQ ID NO: 37979 - DNA, 16 bp, H. sapiens
agcctccccgacgagc

SEQ ID NO: 37980 - DNA, 16 bp, H. sapiens
agcctccccgatgagc

SEQ ID NO: 37981 - DNA, 16 bp, H. sapiens
agcctcccgggtggct

SEQ ID NO: 37982 - DNA, 16 bp, H. sapiens
agcctccctgacgagc

SEQ ID NO: 37983 - DNA, 16 bp, H. sapiens
agcctccctgagtgct

SEQ ID NO: 37984 - DNA, 16 bp, H. sapiens
agcctcctcagtagtt

SEQ ID NO: 37985 - DNA, 16 bp, H. sapiens
agcctcctcctcctcc

SEQ ID NO: 37986 - DNA, 16 bp, H. sapiens
agcctcctcctgcctc

SEQ ID NO: 37987 - DNA, 16 bp, H. sapiens
agcctcctgaggagcc

SEQ ID NO: 37988 - DNA, 16 bp, H. sapiens
agcctcctgcacagct

SEQ ID NO: 37989 - DNA, 16 bp, H. sapiens
agcctcctgcccacca

SEQ ID NO: 37990 - DNA, 16 bp, H. sapiens
agcctcctgggctcag

SEQ ID NO: 37991 - DNA, 16 bp, H. sapiens
agcctcctgggtagct

SEQ ID NO: 37992 - DNA, 16 bp, H. sapiens
agcctccttacatgct

SEQ ID NO: 37993 - DNA, 16 bp, H. sapiens
agcctccttcccagct

SEQ ID NO: 37994 - DNA, 16 bp, H. sapiens
agcctcggcttcctgg

SEQ ID NO: 37995 - DNA, 17 bp, H. sapiens
agcctcggtgacagagt

SEQ ID NO: 37996 - DNA, 16 bp, H. sapiens
agcctctacctcccag

SEQ ID NO: 37997 - DNA, 16 bp, H. sapiens
agcctctcaagaagct

SEQ ID NO: 37998 - DNA, 16 bp, H. sapiens
agcctctcaaggagct

SEQ ID NO: 37999 - DNA, 16 bp, H. sapiens
agcctctcagagtgct

SEQ ID NO: 38000 - DNA, 16 bp, H. sapiens
agcctctccaaaggag

SEQ ID NO: 38001 - DNA, 16 bp, H. sapiens
agcctctcctccctca

SEQ ID NO: 38002 - DNA, 16 bp, H. sapiens
agcctctgccccccag

SEQ ID NO: 38003 - DNA, 16 bp, H. sapiens
agcctctgcctcccgc

SEQ ID NO: 38004 - DNA, 16 bp, H. sapiens
agcctctgcctctgca

SEQ ID NO: 38005 - DNA, 16 bp, H. sapiens
agcctctgcttcctca

SEQ ID NO: 38006 - DNA, 16 bp, H. sapiens
agcctctgcttgcatc

SEQ ID NO: 38007 - DNA, 16 bp, H. sapiens
agcctctggaaaactc

SEQ ID NO: 38008 - DNA, 16 bp, H. sapiens
agcctctggaactgtg

SEQ ID NO: 38009 - DNA, 16 bp, H. sapiens
agcctctggccagaag

SEQ ID NO: 38010 - DNA, 16 bp, H. sapiens
agcctctgtcacagcc

SEQ ID NO: 38011 - DNA, 16 bp, H. sapiens
agcctcttgccagttt

SEQ ID NO: 38012 - DNA, 16 bp, H. sapiens
agcctgaaaaccaagc

SEQ ID NO: 38013 - DNA, 16 bp, H. sapiens
agcctgaaaatattaa

SEQ ID NO: 38014 - DNA, 16 bp, H. sapiens
agcctgaaagtaattt

SEQ ID NO: 38015 - DNA, 16 bp, H. sapiens
agcctgaaatcccagc

SEQ ID NO: 38016 - DNA, 16 bp, H. sapiens
agcctgaacaacaaga

SEQ ID NO: 38017 - DNA, 16 bp, H. sapiens
agcctgaacaacatgg

SEQ ID NO: 38018 - DNA, 16 bp, H. sapiens
agcctgaacctggagg

SEQ ID NO: 38019 - DNA, 16 bp, H. sapiens
agcctgaagaaacatc

SEQ ID NO: 38020 - DNA, 16 bp, H. sapiens
agcctgaagaactgtg

SEQ ID NO: 38021 - DNA, 16 bp, H. sapiens
agcctgaagatgtaac

SEQ ID NO: 38022 - DNA, 16 bp, H. sapiens
agcctgaagcaggagg

SEQ ID NO: 38023 - DNA, 16 bp, H. sapiens
agcctgaagcctgggg

SEQ ID NO: 38024 - DNA, 16 bp, H. sapiens
agcctgacacctgtgt

SEQ ID NO: 38025 - DNA, 21 bp, H. sapiens
agcctgaccaatatgatgaaa

SEQ ID NO: 38026 - DNA, 16 bp, H. sapiens
agcctgaccgacatgg

SEQ ID NO: 38027 - DNA, 16 bp, H. sapiens
agcctgacgtggtggt

SEQ ID NO: 38028 - DNA, 16 bp, H. sapiens
agcctgagaaacaaag

SEQ ID NO: 38029 - DNA, 16 bp, H. sapiens
agcctgagacacagag

SEQ ID NO: 38030 - DNA, 16 bp, H. sapiens
agcctgagagacagag

SEQ ID NO: 38031 - DNA, 16 bp, H. sapiens
agcctgagaggtggag

SEQ ID NO: 38032 - DNA, 16 bp, H. sapiens
agcctgagagtttgag

SEQ ID NO: 38033 - DNA, 17 bp, H. sapiens
agcctgagatatggcct

SEQ ID NO: 38034 - DNA, 16 bp, H. sapiens
agcctgagcaaaaaga

SEQ ID NO: 38035 - DNA, 16 bp, H. sapiens
agcctgagcaacagaa

SEQ ID NO: 38036 - DNA, 16 bp, H. sapiens
agcctgagcaacgtgg

SEQ ID NO: 38037 - DNA, 16 bp, H. sapiens
agcctgagcaatgtag

SEQ ID NO: 38038 - DNA, 16 bp, H. sapiens
agcctgagcaatgtgg

SEQ ID NO: 38039 - DNA, 16 bp, H. sapiens
agcctgagcagcagag

SEQ ID NO: 38040 - DNA, 16 bp, H. sapiens
agcctgagcccaggag

SEQ ID NO: 38041 - DNA, 16 bp, H. sapiens
agcctgagctgctgga

SEQ ID NO: 38042 - DNA, 16 bp, H. sapiens
agcctgaggcagaaga

SEQ ID NO: 38043 - DNA, 16 bp, H. sapiens
agcctgaggcgggtgg

SEQ ID NO: 38044 - DNA, 16 bp, H. sapiens
agcctgagggacagag

SEQ ID NO: 38045 - DNA, 16 bp, H. sapiens
agcctgaggtgggcag

SEQ ID NO: 38046 - DNA, 17 bp, H. sapiens
agcctgaggtgggtgga

SEQ ID NO: 38047 - DNA, 16 bp, H. sapiens
agcctgagtgacagaa

SEQ ID NO: 38048 - DNA, 16 bp, H. sapiens
agcctgagtgacagtg

SEQ ID NO: 38049 - DNA, 16 bp, H. sapiens
agcctgcacctcccag

SEQ ID NO: 38050 - DNA, 16 bp, H. sapiens
agcctgcagaaccatg

SEQ ID NO: 38051 - DNA, 17 bp, H. sapiens
agcctgcagaaccgtga

SEQ ID NO: 38052 - DNA, 16 bp, H. sapiens
agcctgcagaactggg

SEQ ID NO: 38053 - DNA, 16 bp, H. sapiens
agcctgcagagccatg

SEQ ID NO: 38054 - DNA, 16 bp, H. sapiens
agcctgcaggaccatg

SEQ ID NO: 38055 - DNA, 16 bp, H. sapiens
agcctgcaggctttgg

SEQ ID NO: 38056 - DNA, 16 bp, H. sapiens
agcctgcagggagagg

SEQ ID NO: 38057 - DNA, 16 bp, H. sapiens
agcctgcccaacacag

SEQ ID NO: 38058 - DNA, 19 bp, H. sapiens
agcctgccgctgcactgtg

SEQ ID NO: 38059 - DNA, 16 bp, H. sapiens
agcctgcctaaaggcc

SEQ ID NO: 38060 - DNA, 16 bp, H. sapiens
agcctgcctcccacag

SEQ ID NO: 38061 - DNA, 16 bp, H. sapiens
agcctgcctgcctctg

SEQ ID NO: 38062 - DNA, 16 bp, H. sapiens
agcctgctcctccaaa

SEQ ID NO: 38063 - DNA, 16 bp, H. sapiens
agcctgctgcaggggc

SEQ ID NO: 38064 - DNA, 16 bp, H. sapiens
agcctgctggcctgcc

SEQ ID NO: 38065 - DNA, 16 bp, H. sapiens
agcctgcttctgtcaa

SEQ ID NO: 38066 - DNA, 16 bp, H. sapiens
agcctggaaagcagag

SEQ ID NO: 38067 - DNA, 16 bp, H. sapiens
agcctggacaacaaaa

SEQ ID NO: 38068 - DNA, 17 bp, H. sapiens
agcctggacaacatggc

SEQ ID NO: 38069 - DNA, 16 bp, H. sapiens
agcctggacaagagag

SEQ ID NO: 38070 - DNA, 16 bp, H. sapiens
agcctggacagagcaa

SEQ ID NO: 38071 - DNA, 16 bp, H. sapiens
agcctggaccacaaga

SEQ ID NO: 38072 - DNA, 16 bp, H. sapiens
agcctggacctccctg

SEQ ID NO: 38073 - DNA, 16 bp, H. sapiens
agcctggacctcctgg

SEQ ID NO: 38074 - DNA, 16 bp, H. sapiens
agcctggacctgttgc

SEQ ID NO: 38075 - DNA, 16 bp, H. sapiens
agcctggagaactgtg

SEQ ID NO: 38076 - DNA, 16 bp, H. sapiens
agcctggagaagagag

SEQ ID NO: 38077 - DNA, 16 bp, H. sapiens
agcctggagaagtggg

SEQ ID NO: 38078 - DNA, 16 bp, H. sapiens
agcctggagacagagg

SEQ ID NO: 38079 - DNA, 16 bp, H. sapiens
agcctggagacccagg

SEQ ID NO: 38080 - DNA, 16 bp, H. sapiens
agcctggaggtggagg

SEQ ID NO: 38081 - DNA, 16 bp, H. sapiens
agcctggagtgcaatg

SEQ ID NO: 38082 - DNA, 16 bp, H. sapiens
agcctggagtttgaga

SEQ ID NO: 38083 - DNA, 16 bp, H. sapiens
agcctggatccctgag

SEQ ID NO: 38084 - DNA, 16 bp, H. sapiens
agcctggatgacacag

SEQ ID NO: 38085 - DNA, 19 bp, H. sapiens
agcctggatgacagagcaa

SEQ ID NO: 38086 - DNA, 16 bp, H. sapiens
agcctggatgacagca

SEQ ID NO: 38087 - DNA, 16 bp, H. sapiens
agcctggatgacatgg

SEQ ID NO: 38088 - DNA, 16 bp, H. sapiens
agcctggatttgaacc

SEQ ID NO: 38089 - DNA, 16 bp, H. sapiens
agcctggcaaaagagt

SEQ ID NO: 38090 - DNA, 16 bp, H. sapiens
agcctggcacacagca

SEQ ID NO: 38091 - DNA, 16 bp, H. sapiens
agcctggcacatagta

SEQ ID NO: 38092 - DNA, 16 bp, H. sapiens
agcctggcagagagac

SEQ ID NO: 38093 - DNA, 16 bp, H. sapiens
agcctggcatcccagg

SEQ ID NO: 38094 - DNA, 16 bp, H. sapiens
agcctggccaaactgg

SEQ ID NO: 38095 - DNA, 16 bp, H. sapiens
agcctggccaagaagg

SEQ ID NO: 38096 - DNA, 16 bp, H. sapiens
agcctggccaagctgg

SEQ ID NO: 38097 - DNA, 21 bp, H. sapiens
agcctggccaatatagtgaaa

SEQ ID NO: 38098 - DNA, 16 bp, H. sapiens
agcctggccaatatgc

SEQ ID NO: 38099 - DNA, 16 bp, H. sapiens
agcctggccaatgtag

SEQ ID NO: 38100 - DNA, 16 bp, H. sapiens
agcctggccagcagca

SEQ ID NO: 38101 - DNA, 16 bp, H. sapiens
agcctggccagcaggg

SEQ ID NO: 38102 - DNA, 16 bp, H. sapiens
agcctggccagcctgg

SEQ ID NO: 38103 - DNA, 16 bp, H. sapiens
agcctggccagtgtgg

SEQ ID NO: 38104 - DNA, 16 bp, H. sapiens
agcctggcccccagcc

SEQ ID NO: 38105 - DNA, 16 bp, H. sapiens
agcctggcccctgccc

SEQ ID NO: 38106 - DNA, 16 bp, H. sapiens
agcctggccctggccc

SEQ ID NO: 38107 - DNA, 16 bp, H. sapiens
agcctggcctacatgg

SEQ ID NO: 38108 - DNA, 16 bp, H. sapiens
agcctggcctccagcc

SEQ ID NO: 38109 - DNA, 16 bp, H. sapiens
agcctggcctctcctg

SEQ ID NO: 38110 - DNA, 16 bp, H. sapiens
agcctggcctggccaa

SEQ ID NO: 38111 - DNA, 24 bp, H. sapiens
agcctggctaacatggtgaaaccc

SEQ ID NO: 38112 - DNA, 16 bp, H. sapiens
agcctggctaattgtt

SEQ ID NO: 38113 - DNA, 16 bp, H. sapiens
agcctggctgacacag

SEQ ID NO: 38114 - DNA, 16 bp, H. sapiens
agcctggctggcagag

SEQ ID NO: 38115 - DNA, 16 bp, H. sapiens
agcctggctggctttg

SEQ ID NO: 38116 - DNA, 16 bp, H. sapiens
agcctggctggggagg

SEQ ID NO: 38117 - DNA, 16 bp, H. sapiens
agcctgggaaacaaag

SEQ ID NO: 38118 - DNA, 16 bp, H. sapiens
agcctgggaaacacag

SEQ ID NO: 38119 - DNA, 16 bp, H. sapiens
agcctgggaaacataa

SEQ ID NO: 38120 - DNA, 16 bp, H. sapiens
agcctgggaagcatag

SEQ ID NO: 38121 - DNA, 16 bp, H. sapiens
agcctgggaaggaccc

SEQ ID NO: 38122 - DNA, 16 bp, H. sapiens
agcctgggaagtcaag

SEQ ID NO: 38123 - DNA, 16 bp, H. sapiens
agcctgggagacagca

SEQ ID NO: 38124 - DNA, 16 bp, H. sapiens
agcctgggagcctggg

SEQ ID NO: 38125 - DNA, 16 bp, H. sapiens
agcctgggaggcaggg

SEQ ID NO: 38126 - DNA, 16 bp, H. sapiens
agcctgggaggcggag

SEQ ID NO: 38127 - DNA, 16 bp, H. sapiens
agcctgggaggtggag

SEQ ID NO: 38128 - DNA, 16 bp, H. sapiens
agcctgggcaaaaaaa

SEQ ID NO: 38129 - DNA, 19 bp, H. sapiens
agcctgggcaacaaagcga

SEQ ID NO: 38130 - DNA, 16 bp, H. sapiens
agcctgggcaacaaga

SEQ ID NO: 38131 - DNA, 16 bp, H. sapiens
agcctgggcaacaatg

SEQ ID NO: 38132 - DNA, 16 bp, H. sapiens
agcctgggcaacacag

SEQ ID NO: 38133 - DNA, 16 bp, H. sapiens
agcctgggcaacacat

SEQ ID NO: 38134 - DNA, 17 bp, H. sapiens
agcctgggcaacagacc

SEQ ID NO: 38135 - DNA, 22 bp, H. sapiens
agcctgggcaacagagcgagat

SEQ ID NO: 38136 - DNA, 16 bp, H. sapiens
agcctgggcaacaggc

SEQ ID NO: 38137 - DNA, 17 bp, H. sapiens
agcctgggcaacataag

SEQ ID NO: 38138 - DNA, 16 bp, H. sapiens
agcctgggcaacatgt

SEQ ID NO: 38139 - DNA, 16 bp, H. sapiens
agcctgggcaacgcag

SEQ ID NO: 38140 - DNA, 16 bp, H. sapiens
agcctgggcaataaga

SEQ ID NO: 38141 - DNA, 16 bp, H. sapiens
agcctgggcaataagt

SEQ ID NO: 38142 - DNA, 16 bp, H. sapiens
agcctgggcactccag

SEQ ID NO: 38143 - DNA, 16 bp, H. sapiens
agcctgggcactgtgg

SEQ ID NO: 38144 - DNA, 16 bp, H. sapiens
agcctgggcagcctgg

SEQ ID NO: 38145 - DNA, 16 bp, H. sapiens
agcctgggcagtagag

SEQ ID NO: 38146 - DNA, 16 bp, H. sapiens
agcctgggcatcaaag

SEQ ID NO: 38147 - DNA, 16 bp, H. sapiens
agcctgggccatggag

SEQ ID NO: 38148 - DNA, 16 bp, H. sapiens
agcctgggccttcccc

SEQ ID NO: 38149 - DNA, 20 bp, H. sapiens
agcctgggcgacagagagac

SEQ ID NO: 38150 - DNA, 16 bp, H. sapiens
agcctgggcgacgaag

SEQ ID NO: 38151 - DNA, 16 bp, H. sapiens
agcctgggcgagaaga

SEQ ID NO: 38152 - DNA, 16 bp, H. sapiens
agcctgggcgcagtgg

SEQ ID NO: 38153 - DNA, 16 bp, H. sapiens
agcctgggcggaagag

SEQ ID NO: 38154 - DNA, 16 bp, H. sapiens
agcctgggcggcacag

SEQ ID NO: 38155 - DNA, 16 bp, H. sapiens
agcctgggcggcaggg

SEQ ID NO: 38156 - DNA, 16 bp, H. sapiens
agcctgggctacacag

SEQ ID NO: 38157 - DNA, 16 bp, H. sapiens
agcctgggctcagagg

SEQ ID NO: 38158 - DNA, 16 bp, H. sapiens
agcctggggaagagag

SEQ ID NO: 38159 - DNA, 16 bp, H. sapiens
agcctggggcaagttc

SEQ ID NO: 38160 - DNA, 16 bp, H. sapiens
agcctggggcaggagg

SEQ ID NO: 38161 - DNA, 16 bp, H. sapiens
agcctggggcccagcc

SEQ ID NO: 38162 - DNA, 16 bp, H. sapiens
agcctgggggacacag

SEQ ID NO: 38163 - DNA, 16 bp, H. sapiens
agcctgggggacagag

SEQ ID NO: 38164 - DNA, 16 bp, H. sapiens
agcctgggtaacacgg

SEQ ID NO: 38165 - DNA, 17 bp, H. sapiens
agcctgggtgacaaagg

SEQ ID NO: 38166 - DNA, 17 bp, H. sapiens
agcctgggtgacagagc

SEQ ID NO: 38167 - DNA, 16 bp, H. sapiens
agcctgggtgccacag

SEQ ID NO: 38168 - DNA, 16 bp, H. sapiens
agcctgggtggcagat

SEQ ID NO: 38169 - DNA, 17 bp, H. sapiens
agcctgggttacagagt

SEQ ID NO: 38170 - DNA, 16 bp, H. sapiens
agcctggtagccctgc

SEQ ID NO: 38171 - DNA, 17 bp, H. sapiens
agcctggtcaacatagc

SEQ ID NO: 38172 - DNA, 16 bp, H. sapiens
agcctggtcaatgtag

SEQ ID NO: 38173 - DNA, 16 bp, H. sapiens
agcctggtcagcagag

SEQ ID NO: 38174 - DNA, 16 bp, H. sapiens
agcctggtgaaagagt

SEQ ID NO: 38175 - DNA, 17 bp, H. sapiens
agcctggtgacacagtg

SEQ ID NO: 38176 - DNA, 16 bp, H. sapiens
agcctggtgacagagc

SEQ ID NO: 38177 - DNA, 16 bp, H. sapiens
agcctggtggctcaca

SEQ ID NO: 38178 - DNA, 16 bp, H. sapiens
agcctggtgtggtggc

SEQ ID NO: 38179 - DNA, 16 bp, H. sapiens
agcctgtaaaataaaa

SEQ ID NO: 38180 - DNA, 17 bp, H. sapiens
agcctgtaaaatcaaaa

SEQ ID NO: 38181 - DNA, 16 bp, H. sapiens
agcctgtagtgcagtg

SEQ ID NO: 38182 - DNA, 16 bp, H. sapiens
agcctgtattcccagc

SEQ ID NO: 38183 - DNA, 16 bp, H. sapiens
agcctgtatttttttt

SEQ ID NO: 38184 - DNA, 16 bp, H. sapiens
agcctgtctctactaa

SEQ ID NO: 38185 - DNA, 16 bp, H. sapiens
agcctgtgaaaacagc

SEQ ID NO: 38186 - DNA, 16 bp, H. sapiens
agcctgtgaaagcagc

SEQ ID NO: 38187 - DNA, 16 bp, H. sapiens
agcctgtgatcccagc

SEQ ID NO: 38188 - DNA, 16 bp, H. sapiens
agcctgtgcaacatag

SEQ ID NO: 38189 - DNA, 16 bp, H. sapiens
agcctgtgcagcagag

SEQ ID NO: 38190 - DNA, 16 bp, H. sapiens
agcctgtgcctcccag

SEQ ID NO: 38191 - DNA, 16 bp, H. sapiens
agcctgtgcctctgga

SEQ ID NO: 38192 - DNA, 16 bp, H. sapiens
agcctgtggaactgtg

SEQ ID NO: 38193 - DNA, 16 bp, H. sapiens
agcctgtggtattttg

SEQ ID NO: 38194 - DNA, 16 bp, H. sapiens
agcctgttcctcttcc

SEQ ID NO: 38195 - DNA, 16 bp, H. sapiens
agcctgttgcccaggc

SEQ ID NO: 38196 - DNA, 16 bp, H. sapiens
agcctgttggtggact

SEQ ID NO: 38197 - DNA, 16 bp, H. sapiens
agccttaaaaaagaag

SEQ ID NO: 38198 - DNA, 16 bp, H. sapiens
agccttaaaaaaggat

SEQ ID NO: 38199 - DNA, 16 bp, H. sapiens
agccttaaaaagaaga

SEQ ID NO: 38200 - DNA, 16 bp, H. sapiens
agccttaacttcccag

SEQ ID NO: 38201 - DNA, 16 bp, H. sapiens
agccttaccaataata

SEQ ID NO: 38202 - DNA, 16 bp, H. sapiens
agccttactgaggact

SEQ ID NO: 38203 - DNA, 16 bp, H. sapiens
agccttagcctcctga

SEQ ID NO: 38204 - DNA, 16 bp, H. sapiens
agccttaggtattcct

SEQ ID NO: 38205 - DNA, 16 bp, H. sapiens
agccttattattatta

SEQ ID NO: 38206 - DNA, 16 bp, H. sapiens
agccttcaaaaagaag

SEQ ID NO: 38207 - DNA, 16 bp, H. sapiens
agccttcaaaaatgaa

SEQ ID NO: 38208 - DNA, 16 bp, H. sapiens
agccttcaagctctga

SEQ ID NO: 38209 - DNA, 16 bp, H. sapiens
agccttcagaaatgaa

SEQ ID NO: 38210 - DNA, 16 bp, H. sapiens
agccttcagaaggaac

SEQ ID NO: 38211 - DNA, 16 bp, H. sapiens
agccttcagagctgag

SEQ ID NO: 38212 - DNA, 16 bp, H. sapiens
agccttcagagctgtg

SEQ ID NO: 38213 - DNA, 16 bp, H. sapiens
agccttcagtctgtgg

SEQ ID NO: 38214 - DNA, 16 bp, H. sapiens
agccttcatctttctc

SEQ ID NO: 38215 - DNA, 16 bp, H. sapiens
agccttccaagtagca

SEQ ID NO: 38216 - DNA, 16 bp, H. sapiens
agccttccactgaata

SEQ ID NO: 38217 - DNA, 16 bp, H. sapiens
agccttccaggcagag

SEQ ID NO: 38218 - DNA, 16 bp, H. sapiens
agccttcctggaggag

SEQ ID NO: 38219 - DNA, 16 bp, H. sapiens
agccttctgaagtgct

SEQ ID NO: 38220 - DNA, 16 bp, H. sapiens
agccttgacctcccag

SEQ ID NO: 38221 - DNA, 16 bp, H. sapiens
agccttgattgtgcca

SEQ ID NO: 38222 - DNA, 16 bp, H. sapiens
agccttgcagaactgt

SEQ ID NO: 38223 - DNA, 16 bp, H. sapiens
agccttgcatccaagg

SEQ ID NO: 38224 - DNA, 16 bp, H. sapiens
agccttgctcactgct

SEQ ID NO: 38225 - DNA, 16 bp, H. sapiens
agccttgctctgtccc

SEQ ID NO: 38226 - DNA, 17 bp, H. sapiens
agccttgctgctgcctt

SEQ ID NO: 38227 - DNA, 16 bp, H. sapiens
agccttggcagcctcc

SEQ ID NO: 38228 - DNA, 16 bp, H. sapiens
agccttggccaacatg

SEQ ID NO: 38229 - DNA, 16 bp, H. sapiens
agccttgggagggtgt

SEQ ID NO: 38230 - DNA, 16 bp, H. sapiens
agccttgggccagagt

SEQ ID NO: 38231 - DNA, 16 bp, H. sapiens
agcctttaaaatcaaa

SEQ ID NO: 38232 - DNA, 16 bp, H. sapiens
agcctttatttccttc

SEQ ID NO: 38233 - DNA, 16 bp, H. sapiens
agcctttcaaactgtt

SEQ ID NO: 38234 - DNA, 16 bp, H. sapiens
agcctttgcctcccaa

SEQ ID NO: 38235 - DNA, 16 bp, H. sapiens
agcctttggaaacccc

SEQ ID NO: 38236 - DNA, 16 bp, H. sapiens
agccttttatccctca

SEQ ID NO: 38237 - DNA, 16 bp, H. sapiens
agccttttcagcttct

SEQ ID NO: 38238 - DNA, 16 bp, H. sapiens
agccttttgagtctgg

SEQ ID NO: 38239 - DNA, 16 bp, H. sapiens
agcgaaaccccatctc

SEQ ID NO: 38240 - DNA, 16 bp, H. sapiens
agcgaaacctcatctc

SEQ ID NO: 38241 - DNA, 16 bp, H. sapiens
agcgaaataagccaga

SEQ ID NO: 38242 - DNA, 16 bp, H. sapiens
agcgaaggagaaataa

SEQ ID NO: 38243 - DNA, 19 bp, H. sapiens
agcgacactccatctcaaa

SEQ ID NO: 38244 - DNA, 16 bp, H. sapiens
agcgactccatcttga

SEQ ID NO: 38245 - DNA, 16 bp, H. sapiens
agcgagaacatgcagt

SEQ ID NO: 38246 - DNA, 16 bp, H. sapiens
agcgagaagacaagat

SEQ ID NO: 38247 - DNA, 16 bp, H. sapiens
agcgagaccaggaacc

SEQ ID NO: 38248 - DNA, 16 bp, H. sapiens
agcgagaccatgtctc

SEQ ID NO: 38249 - DNA, 17 bp, H. sapiens
agcgagaccccatctct

SEQ ID NO: 38250 - DNA, 16 bp, H. sapiens
agcgagacccccatct

SEQ ID NO: 38251 - DNA, 16 bp, H. sapiens
agcgagaccccgtctc

SEQ ID NO: 38252 - DNA, 16 bp, H. sapiens
agcgagaccctcatct

SEQ ID NO: 38253 - DNA, 16 bp, H. sapiens
agcgagaccctgcctc

SEQ ID NO: 38254 - DNA, 16 bp, H. sapiens
agcgagaccctgtatc

SEQ ID NO: 38255 - DNA, 16 bp, H. sapiens
agcgagaccctgtctc

SEQ ID NO: 38256 - DNA, 16 bp, H. sapiens
agcgagaccgtgtctc

SEQ ID NO: 38257 - DNA, 16 bp, H. sapiens
agcgagactccatctc

SEQ ID NO: 38258 - DNA, 23 bp, H. sapiens
agcgagactccgtctcaaaaaaa

SEQ ID NO: 38259 - DNA, 18 bp, H. sapiens
agcgagactccgtctcat

SEQ ID NO: 38260 - DNA, 16 bp, H. sapiens
agcgagactctgcctc

SEQ ID NO: 38261 - DNA, 17 bp, H. sapiens
agcgagactctggctca

SEQ ID NO: 38262 - DNA, 16 bp, H. sapiens
agcgagactctgtctc

SEQ ID NO: 38263 - DNA, 16 bp, H. sapiens
agcgagactctgtctt

SEQ ID NO: 38264 - DNA, 16 bp, H. sapiens
agcgagactgcatctc

SEQ ID NO: 38265 - DNA, 16 bp, H. sapiens
agcgagacttcatctc

SEQ ID NO: 38266 - DNA, 16 bp, H. sapiens
agcgagactttgtctc

SEQ ID NO: 38267 - DNA, 16 bp, H. sapiens
agcgagatcgcaccac

SEQ ID NO: 38268 - DNA, 16 bp, H. sapiens
agcgagatgccatctc

SEQ ID NO: 38269 - DNA, 16 bp, H. sapiens
agcgagattccatctc

SEQ ID NO: 38270 - DNA, 16 bp, H. sapiens
agcgagattctgtctc

SEQ ID NO: 38271 - DNA, 16 bp, H. sapiens
agcgagcgagagagag

SEQ ID NO: 38272 - DNA, 17 bp, H. sapiens
agcgagggctgctagca

SEQ ID NO: 38273 - DNA, 16 bp, H. sapiens
agcgatcctcctgttt

SEQ ID NO: 38274 - DNA, 20 bp, H. sapiens
agcgatcttggctcactgca

SEQ ID NO: 38275 - DNA, 16 bp, H. sapiens
agcgattcccccacct

SEQ ID NO: 38276 - DNA, 18 bp, H. sapiens
agcgcaatggcgcgatct

SEQ ID NO: 38277 - DNA, 16 bp, H. sapiens
agcgcagccagagaga

SEQ ID NO: 38278 - DNA, 16 bp, H. sapiens
agcgcagtggcaccat

SEQ ID NO: 38279 - DNA, 16 bp, H. sapiens
agcgcagtggctcaca

SEQ ID NO: 38280 - DNA, 16 bp, H. sapiens
agcgccgcctgctggc

SEQ ID NO: 38281 - DNA, 16 bp, H. sapiens
agcgcctctgccccac

SEQ ID NO: 38282 - DNA, 16 bp, H. sapiens
agcgcctctgccctgc

SEQ ID NO: 38283 - DNA, 16 bp, H. sapiens
agcgcctcttcctggc

SEQ ID NO: 38284 - DNA, 16 bp, H. sapiens
agcgcgactccatctc

SEQ ID NO: 38285 - DNA, 17 bp, H. sapiens
agcgcggtggctcacgc

SEQ ID NO: 38286 - DNA, 16 bp, H. sapiens
agcgcgtgccaccatg

SEQ ID NO: 38287 - DNA, 16 bp, H. sapiens
agcggaggctgaggaa

SEQ ID NO: 38288 - DNA, 16 bp, H. sapiens
agcggaggctggactg

SEQ ID NO: 38289 - DNA, 17 bp, H. sapiens
agcggatcacctgaggt

SEQ ID NO: 38290 - DNA, 16 bp, H. sapiens
agcggatcatttgagg

SEQ ID NO: 38291 - DNA, 16 bp, H. sapiens
agcggatctcccagca

SEQ ID NO: 38292 - DNA, 16 bp, H. sapiens
agcggcagctgctgca

SEQ ID NO: 38293 - DNA, 16 bp, H. sapiens
agcggcccccgcagac

SEQ ID NO: 38294 - DNA, 16 bp, H. sapiens
agcggcgggcgcctgt

SEQ ID NO: 38295 - DNA, 19 bp, H. sapiens
agcggctcacacctgtaat

SEQ ID NO: 38296 - DNA, 16 bp, H. sapiens
agcggctgctgctgct

SEQ ID NO: 38297 - DNA, 16 bp, H. sapiens
agcggctggcagaggc

SEQ ID NO: 38298 - DNA, 22 bp, H. sapiens
agcggtggctcacgcctgtaat

SEQ ID NO: 38299 - DNA, 17 bp, H. sapiens
agcgtgaacccgggagg

SEQ ID NO: 38300 - DNA, 18 bp, H. sapiens
agcgtgagccaccgcgcc

SEQ ID NO: 38301 - DNA, 18 bp, H. sapiens
agcgtgatctcggctcac

SEQ ID NO: 38302 - DNA, 16 bp, H. sapiens
agcgtgcagtgagctg

SEQ ID NO: 38303 - DNA, 16 bp, H. sapiens
agcgtggccaatatgg

SEQ ID NO: 38304 - DNA, 16 bp, H. sapiens
agcgtggtgcctccag

SEQ ID NO: 38305 - DNA, 17 bp, H. sapiens
agcgtggtggcacgcac

SEQ ID NO: 38306 - DNA, 16 bp, H. sapiens
agcgtggtggctcacg

SEQ ID NO: 38307 - DNA, 16 bp, H. sapiens
agctaaaagagcactg

SEQ ID NO: 38308 - DNA, 16 bp, H. sapiens
agctaaaatttttaat

SEQ ID NO: 38309 - DNA, 16 bp, H. sapiens
agctaaacatgagttt

SEQ ID NO: 38310 - DNA, 16 bp, H. sapiens
agctaaacattgagta

SEQ ID NO: 38311 - DNA, 16 bp, H. sapiens
agctaaacattggata

SEQ ID NO: 38312 - DNA, 16 bp, H. sapiens
agctaaagaaagagat

SEQ ID NO: 38313 - DNA, 16 bp, H. sapiens
agctaaagaagcagct

SEQ ID NO: 38314 - DNA, 16 bp, H. sapiens
agctaaagcaatgttt

SEQ ID NO: 38315 - DNA, 16 bp, H. sapiens
agctaaagcagcaaag

SEQ ID NO: 38316 - DNA, 16 bp, H. sapiens
agctaaagcagtgttt

SEQ ID NO: 38317 - DNA, 16 bp, H. sapiens
agctaaaggaaaaagt

SEQ ID NO: 38318 - DNA, 16 bp, H. sapiens
agctaaaggaacatgt

SEQ ID NO: 38319 - DNA, 16 bp, H. sapiens
agctaaaggagaatgt

SEQ ID NO: 38320 - DNA, 21 bp, H. sapiens
agctaaaggagcatgtcctaa

SEQ ID NO: 38321 - DNA, 17 bp, H. sapiens
agctaaaggagcatgtt

SEQ ID NO: 38322 - DNA, 17 bp, H. sapiens
agctaaaggaggatgtt

SEQ ID NO: 38323 - DNA, 17 bp, H. sapiens
agctaaaggagtatgtt

SEQ ID NO: 38324 - DNA, 16 bp, H. sapiens
agctaaaggtttgcca

SEQ ID NO: 38325 - DNA, 19 bp, H. sapiens
agctaacacggtgaaaccc

SEQ ID NO: 38326 - DNA, 16 bp, H. sapiens
agctaacatgtattga

SEQ ID NO: 38327 - DNA, 16 bp, H. sapiens
agctaacattacactt

SEQ ID NO: 38328 - DNA, 16 bp, H. sapiens
agctaacatttcttga

SEQ ID NO: 38329 - DNA, 16 bp, H. sapiens
agctaaccagagaggt

SEQ ID NO: 38330 - DNA, 16 bp, H. sapiens
agctaactttaaaaaa

SEQ ID NO: 38331 - DNA, 16 bp, H. sapiens
agctaactttttattt

SEQ ID NO: 38332 - DNA, 16 bp, H. sapiens
agctaagaatcttgaa

SEQ ID NO: 38333 - DNA, 16 bp, H. sapiens
agctaagaatggtttt

SEQ ID NO: 38334 - DNA, 16 bp, H. sapiens
agctaagactacaggt

SEQ ID NO: 38335 - DNA, 16 bp, H. sapiens
agctaagatcctgcca

SEQ ID NO: 38336 - DNA, 16 bp, H. sapiens
agctaagatgaggtca

SEQ ID NO: 38337 - DNA, 16 bp, H. sapiens
agctaagctacaagga

SEQ ID NO: 38338 - DNA, 16 bp, H. sapiens
agctaagctctgagga

SEQ ID NO: 38339 - DNA, 16 bp, H. sapiens
agctaaggcaggcaga

SEQ ID NO: 38340 - DNA, 16 bp, H. sapiens
agctaaggttaatttg

SEQ ID NO: 38341 - DNA, 16 bp, H. sapiens
agctaagtcacccaaa

SEQ ID NO: 38342 - DNA, 16 bp, H. sapiens
agctaataagtgacag

SEQ ID NO: 38343 - DNA, 22 bp, H. sapiens
agctaatatccagaatctacaa

SEQ ID NO: 38344 - DNA, 16 bp, H. sapiens
agctaatatttattga

SEQ ID NO: 38345 - DNA, 16 bp, H. sapiens
agctaatgctgaaatg

SEQ ID NO: 38346 - DNA, 16 bp, H. sapiens
agctaatttatgtatt

SEQ ID NO: 38347 - DNA, 16 bp, H. sapiens
agctaatttatttttt

SEQ ID NO: 38348 - DNA, 16 bp, H. sapiens
agctaattttaaaaaa

SEQ ID NO: 38349 - DNA, 16 bp, H. sapiens
agctaattttatattt

SEQ ID NO: 38350 - DNA, 16 bp, H. sapiens
agctaattttcaaaat

SEQ ID NO: 38351 - DNA, 16 bp, H. sapiens
agctaattttctttct

SEQ ID NO: 38352 - DNA, 16 bp, H. sapiens
agctaatttttaaaaa

SEQ ID NO: 38353 - DNA, 16 bp, H. sapiens
agctaatttttaaaag

SEQ ID NO: 38354 - DNA, 16 bp, H. sapiens
agctaatttttagatt

SEQ ID NO: 38355 - DNA, 16 bp, H. sapiens
agctaatttttgagtt

SEQ ID NO: 38356 - DNA, 16 bp, H. sapiens
agctaattttttgggt

SEQ ID NO: 38357 - DNA, 16 bp, H. sapiens
agctacaaccacatga

SEQ ID NO: 38358 - DNA, 16 bp, H. sapiens
agctacaatcatgcca

SEQ ID NO: 38359 - DNA, 16 bp, H. sapiens
agctacagaaatcaag

SEQ ID NO: 38360 - DNA, 16 bp, H. sapiens
agctacagaattaaaa

SEQ ID NO: 38361 - DNA, 16 bp, H. sapiens
agctacagaccaatat

SEQ ID NO: 38362 - DNA, 25 bp, H. sapiens
agctacaggaggaaattcaaaccaa

SEQ ID NO: 38363 - DNA, 16 bp, H. sapiens
agctacaggagttttt

SEQ ID NO: 38364 - DNA, 16 bp, H. sapiens
agctacatttttctct

SEQ ID NO: 38365 - DNA, 16 bp, H. sapiens
agctaccacacccagc

SEQ ID NO: 38366 - DNA, 17 bp, H. sapiens
agctaccacgcctggcc

SEQ ID NO: 38367 - DNA, 16 bp, H. sapiens
agctaccagaagctgg

SEQ ID NO: 38368 - DNA, 16 bp, H. sapiens
agctaccaggaggctg

SEQ ID NO: 38369 - DNA, 16 bp, H. sapiens
agctaccaggcctggc

SEQ ID NO: 38370 - DNA, 16 bp, H. sapiens
agctacccaagaggct

SEQ ID NO: 38371 - DNA, 16 bp, H. sapiens
agctacccagaggctg

SEQ ID NO: 38372 - DNA, 16 bp, H. sapiens
agctaccggggaggct

SEQ ID NO: 38373 - DNA, 17 bp, H. sapiens
agctacctatgacaaac

SEQ ID NO: 38374 - DNA, 16 bp, H. sapiens
agctacctgggaggtg

SEQ ID NO: 38375 - DNA, 16 bp, H. sapiens
agctacgattacaggc

SEQ ID NO: 38376 - DNA, 16 bp, H. sapiens
agctacgggggaggct

SEQ ID NO: 38377 - DNA, 16 bp, H. sapiens
agctactagaaaggct

SEQ ID NO: 38378 - DNA, 16 bp, H. sapiens
agctactcaggaaggt

SEQ ID NO: 38379 - DNA, 16 bp, H. sapiens
agctactcaggagacc

SEQ ID NO: 38380 - DNA, 16 bp, H. sapiens
agctactcaggagctt

SEQ ID NO: 38381 - DNA, 16 bp, H. sapiens
agctactcaggaggcc

SEQ ID NO: 38382 - DNA, 16 bp, H. sapiens
agctactcagggaggc

SEQ ID NO: 38383 - DNA, 16 bp, H. sapiens
agctactcatgaagct

SEQ ID NO: 38384 - DNA, 16 bp, H. sapiens
agctactcgggaggcg

SEQ ID NO: 38385 - DNA, 19 bp, H. sapiens
agctactcgggagtctgag

SEQ ID NO: 38386 - DNA, 16 bp, H. sapiens
agctactgagcacttg

SEQ ID NO: 38387 - DNA, 16 bp, H. sapiens
agctactgaggcttgt

SEQ ID NO: 38388 - DNA, 16 bp, H. sapiens
agctactgggaagact

SEQ ID NO: 38389 - DNA, 16 bp, H. sapiens
agctactgggggaggc

SEQ ID NO: 38390 - DNA, 16 bp, H. sapiens
agctactgtggaaagc

SEQ ID NO: 38391 - DNA, 16 bp, H. sapiens
agctacttcagaggct

SEQ ID NO: 38392 - DNA, 16 bp, H. sapiens
agctacttcgggggct

SEQ ID NO: 38393 - DNA, 16 bp, H. sapiens
agctacttgcaaggct

SEQ ID NO: 38394 - DNA, 16 bp, H. sapiens
agctacttggaaggat

SEQ ID NO: 38395 - DNA, 18 bp, H. sapiens
agctacttggaaggctga

SEQ ID NO: 38396 - DNA, 18 bp, H. sapiens
agctacttgggagactga

SEQ ID NO: 38397 - DNA, 17 bp, H. sapiens
agctacttgggagggtg

SEQ ID NO: 38398 - DNA, 17 bp, H. sapiens
agctacttgggaggtta

SEQ ID NO: 38399 - DNA, 16 bp, H. sapiens
agctacttggtggcag

SEQ ID NO: 38400 - DNA, 16 bp, H. sapiens
agctactttgggggct

SEQ ID NO: 38401 - DNA, 16 bp, H. sapiens
agctacttttttgtat

SEQ ID NO: 38402 - DNA, 16 bp, H. sapiens
agctagaagagaaaaa

SEQ ID NO: 38403 - DNA, 16 bp, H. sapiens
agctagaagcatcaca

SEQ ID NO: 38404 - DNA, 16 bp, H. sapiens
agctagagaaagaaaa

SEQ ID NO: 38405 - DNA, 16 bp, H. sapiens
agctagagaaatcaga

SEQ ID NO: 38406 - DNA, 16 bp, H. sapiens
agctagaggaaagaaa

SEQ ID NO: 38407 - DNA, 17 bp, H. sapiens
agctagaggattgtaaa

SEQ ID NO: 38408 - DNA, 18 bp, H. sapiens
agctagaggcatggagcc

SEQ ID NO: 38409 - DNA, 16 bp, H. sapiens
agctagatacagagtg

SEQ ID NO: 38410 - DNA, 17 bp, H. sapiens
agctagatctttttctt

SEQ ID NO: 38411 - DNA, 16 bp, H. sapiens
agctaggaccacaggc

SEQ ID NO: 38412 - DNA, 16 bp, H. sapiens
agctaggactacaggt

SEQ ID NO: 38413 - DNA, 19 bp, H. sapiens
agctaggattacaggtgcc

SEQ ID NO: 38414 - DNA, 16 bp, H. sapiens
agctaggatttgaaca

SEQ ID NO: 38415 - DNA, 17 bp, H. sapiens
agctaggcatggtggca

SEQ ID NO: 38416 - DNA, 16 bp, H. sapiens
agctaggcatggtggt

SEQ ID NO: 38417 - DNA, 16 bp, H. sapiens
agctagtaagtggcag

SEQ ID NO: 38418 - DNA, 16 bp, H. sapiens
agctagtcagacatga

SEQ ID NO: 38419 - DNA, 16 bp, H. sapiens
agctagtcttgaactc

SEQ ID NO: 38420 - DNA, 16 bp, H. sapiens
agctagttaacatatt

SEQ ID NO: 38421 - DNA, 16 bp, H. sapiens
agctataaaaaatgat

SEQ ID NO: 38422 - DNA, 16 bp, H. sapiens
agctataaataaaata

SEQ ID NO: 38423 - DNA, 16 bp, H. sapiens
agctataattattatt

SEQ ID NO: 38424 - DNA, 16 bp, H. sapiens
agctatagaactttga

SEQ ID NO: 38425 - DNA, 16 bp, H. sapiens
agctatatctgcttta

SEQ ID NO: 38426 - DNA, 16 bp, H. sapiens
agctatatttttaaat

SEQ ID NO: 38427 - DNA, 16 bp, H. sapiens
agctatcaagtcatga

SEQ ID NO: 38428 - DNA, 16 bp, H. sapiens
agctatcagcagagag

SEQ ID NO: 38429 - DNA, 16 bp, H. sapiens
agctatctgagaaaat

SEQ ID NO: 38430 - DNA, 16 bp, H. sapiens
agctatgaccacacca

SEQ ID NO: 38431 - DNA, 16 bp, H. sapiens
agctatgactgcatca

SEQ ID NO: 38432 - DNA, 16 bp, H. sapiens
agctatgatcactcca

SEQ ID NO: 38433 - DNA, 16 bp, H. sapiens
agctatgatcaggcca

SEQ ID NO: 38434 - DNA, 17 bp, H. sapiens
agctatgatcgtgccac

SEQ ID NO: 38435 - DNA, 16 bp, H. sapiens
agctatgatggtgcca

SEQ ID NO: 38436 - DNA, 16 bp, H. sapiens
agctatgattgctcca

SEQ ID NO: 38437 - DNA, 16 bp, H. sapiens
agctatgattgtacca

SEQ ID NO: 38438 - DNA, 16 bp, H. sapiens
agctatggggaaagga

SEQ ID NO: 38439 - DNA, 16 bp, H. sapiens
agctatgtggaaggct

SEQ ID NO: 38440 - DNA, 16 bp, H. sapiens
agctattcaggaagct

SEQ ID NO: 38441 - DNA, 16 bp, H. sapiens
agctattccagcacca

SEQ ID NO: 38442 - DNA, 16 bp, H. sapiens
agctatttcagaggct

SEQ ID NO: 38443 - DNA, 16 bp, H. sapiens
agctatttctttatag

SEQ ID NO: 38444 - DNA, 16 bp, H. sapiens
agctattttgaaatat

SEQ ID NO: 38445 - DNA, 16 bp, H. sapiens
agctattttgaagtat

SEQ ID NO: 38446 - DNA, 16 bp, H. sapiens
agctatttttaaaaat

SEQ ID NO: 38447 - DNA, 16 bp, H. sapiens
agctatttttaaaatt

SEQ ID NO: 38448 - DNA, 16 bp, H. sapiens
agctatttttttatat

SEQ ID NO: 38449 - DNA, 16 bp, H. sapiens
agctatttttttctgt

SEQ ID NO: 38450 - DNA, 16 bp, H. sapiens
agctattttttttcct

SEQ ID NO: 38451 - DNA, 16 bp, H. sapiens
agctcaaagaggagca

SEQ ID NO: 38452 - DNA, 16 bp, H. sapiens
agctcaaagggcttag

SEQ ID NO: 38453 - DNA, 16 bp, H. sapiens
agctcaaatgtcactt

SEQ ID NO: 38454 - DNA, 16 bp, H. sapiens
agctcaacaacaacaa

SEQ ID NO: 38455 - DNA, 16 bp, H. sapiens
agctcaacatcactgg

SEQ ID NO: 38456 - DNA, 16 bp, H. sapiens
agctcaagcagtaatg

SEQ ID NO: 38457 - DNA, 16 bp, H. sapiens
agctcaaggaggcctt

SEQ ID NO: 38458 - DNA, 16 bp, H. sapiens
agctcaagtgagcctc

SEQ ID NO: 38459 - DNA, 16 bp, H. sapiens
agctcaagtgattctc

SEQ ID NO: 38460 - DNA, 16 bp, H. sapiens
agctcaataaatgttt

SEQ ID NO: 38461 - DNA, 16 bp, H. sapiens
agctcacacctgtaat

SEQ ID NO: 38462 - DNA, 16 bp, H. sapiens
agctcacagaattcag

SEQ ID NO: 38463 - DNA, 16 bp, H. sapiens
agctcaccagcaatgg

SEQ ID NO: 38464 - DNA, 16 bp, H. sapiens
agctcaccgcagcctc

SEQ ID NO: 38465 - DNA, 16 bp, H. sapiens
agctcacgcctgtaat

SEQ ID NO: 38466 - DNA, 25 bp, H. sapiens
agctcacgcctgtaatcccagcact

SEQ ID NO: 38467 - DNA, 16 bp, H. sapiens
agctcacggcagcctc

SEQ ID NO: 38468 - DNA, 16 bp, H. sapiens
agctcactaaagcctt

SEQ ID NO: 38469 - DNA, 16 bp, H. sapiens
agctcactacaacctc

SEQ ID NO: 38470 - DNA, 16 bp, H. sapiens
agctcactacagcctc

SEQ ID NO: 38471 - DNA, 16 bp, H. sapiens
agctcactgaaacctc

SEQ ID NO: 38472 - DNA, 24 bp, H. sapiens
agctcactgcaacctccacctccc

SEQ ID NO: 38473 - DNA, 16 bp, H. sapiens
agctcactgcaacctt

SEQ ID NO: 38474 - DNA, 16 bp, H. sapiens
agctcactgcagactc

SEQ ID NO: 38475 - DNA, 17 bp, H. sapiens
agctcactgcagccacc

SEQ ID NO: 38476 - DNA, 20 bp, H. sapiens
agctcactgcagcctcaact

SEQ ID NO: 38477 - DNA, 16 bp, H. sapiens
agctcactgcagcttc

SEQ ID NO: 38478 - DNA, 16 bp, H. sapiens
agctcactgcagtctc

SEQ ID NO: 38479 - DNA, 16 bp, H. sapiens
agctcactgcatcctc

SEQ ID NO: 38480 - DNA, 16 bp, H. sapiens
agctcactgccgcctc

SEQ ID NO: 38481 - DNA, 16 bp, H. sapiens
agctcactgtaacctc

SEQ ID NO: 38482 - DNA, 16 bp, H. sapiens
agctcactgtagcctc

SEQ ID NO: 38483 - DNA, 16 bp, H. sapiens
agctcactgtagtctc

SEQ ID NO: 38484 - DNA, 16 bp, H. sapiens
agctcactgtgacctt

SEQ ID NO: 38485 - DNA, 16 bp, H. sapiens
agctcactgtggtttt

SEQ ID NO: 38486 - DNA, 16 bp, H. sapiens
agctcactgttgcctc

SEQ ID NO: 38487 - DNA, 16 bp, H. sapiens
agctcacttcaagctc

SEQ ID NO: 38488 - DNA, 16 bp, H. sapiens
agctcacttcagcctc

SEQ ID NO: 38489 - DNA, 16 bp, H. sapiens
agctcagaagacagga

SEQ ID NO: 38490 - DNA, 16 bp, H. sapiens
agctcagaagagtttg

SEQ ID NO: 38491 - DNA, 16 bp, H. sapiens
agctcagaggagaccc

SEQ ID NO: 38492 - DNA, 16 bp, H. sapiens
agctcagaggagtttg

SEQ ID NO: 38493 - DNA, 16 bp, H. sapiens
agctcagccattgtaa

SEQ ID NO: 38494 - DNA, 16 bp, H. sapiens
agctcagcgtggtggc

SEQ ID NO: 38495 - DNA, 16 bp, H. sapiens
agctcagctaattttt

SEQ ID NO: 38496 - DNA, 16 bp, H. sapiens
agctcagctcagctca

SEQ ID NO: 38497 - DNA, 16 bp, H. sapiens
agctcagctctcagga

SEQ ID NO: 38498 - DNA, 16 bp, H. sapiens
agctcaggaagttgag

SEQ ID NO: 38499 - DNA, 16 bp, H. sapiens
agctcaggagtatgag

SEQ ID NO: 38500 - DNA, 16 bp, H. sapiens
agctcaggagttcaaa

SEQ ID NO: 38501 - DNA, 16 bp, H. sapiens
agctcaggcacagagg

SEQ ID NO: 38502 - DNA, 16 bp, H. sapiens
agctcaggcaggagga

SEQ ID NO: 38503 - DNA, 16 bp, H. sapiens
agctcaggcagtaata

SEQ ID NO: 38504 - DNA, 16 bp, H. sapiens
agctcaggccatggct

SEQ ID NO: 38505 - DNA, 16 bp, H. sapiens
agctcaggcgataatg

SEQ ID NO: 38506 - DNA, 16 bp, H. sapiens
agctcaggctgctgct

SEQ ID NO: 38507 - DNA, 17 bp, H. sapiens
agctcaggctgtggctt

SEQ ID NO: 38508 - DNA, 16 bp, H. sapiens
agctcaggctgttgct

SEQ ID NO: 38509 - DNA, 16 bp, H. sapiens
agctcagggctcccag

SEQ ID NO: 38510 - DNA, 16 bp, H. sapiens
agctcaggtctctctt

SEQ ID NO: 38511 - DNA, 16 bp, H. sapiens
agctcagtctcaaatc

SEQ ID NO: 38512 - DNA, 16 bp, H. sapiens
agctcagtctcctgag

SEQ ID NO: 38513 - DNA, 16 bp, H. sapiens
agctcagtgcagcctc

SEQ ID NO: 38514 - DNA, 16 bp, H. sapiens
agctcagtggttctca

SEQ ID NO: 38515 - DNA, 16 bp, H. sapiens
agctcagttgttggag

SEQ ID NO: 38516 - DNA, 16 bp, H. sapiens
agctcatcagctatca

SEQ ID NO: 38517 - DNA, 16 bp, H. sapiens
agctcatgcctgcaat

SEQ ID NO: 38518 - DNA, 17 bp, H. sapiens
agctcatgcctgtaatt

SEQ ID NO: 38519 - DNA, 16 bp, H. sapiens
agctcatggttctgga

SEQ ID NO: 38520 - DNA, 16 bp, H. sapiens
agctcatgttgaaatt

SEQ ID NO: 38521 - DNA, 16 bp, H. sapiens
agctcattgcaacctc

SEQ ID NO: 38522 - DNA, 16 bp, H. sapiens
agctcattgcagcctc

SEQ ID NO: 38523 - DNA, 16 bp, H. sapiens
agctcatttcagcatt

SEQ ID NO: 38524 - DNA, 16 bp, H. sapiens
agctcatttcttttta

SEQ ID NO: 38525 - DNA, 16 bp, H. sapiens
agctcatttgggtaaa

SEQ ID NO: 38526 - DNA, 16 bp, H. sapiens
agctcatttttaaaaa

SEQ ID NO: 38527 - DNA, 16 bp, H. sapiens
agctcatttttgtatt

SEQ ID NO: 38528 - DNA, 16 bp, H. sapiens
agctccaaaagagacc

SEQ ID NO: 38529 - DNA, 16 bp, H. sapiens
agctccaaaagagact

SEQ ID NO: 38530 - DNA, 16 bp, H. sapiens
agctccaaactggaaa

SEQ ID NO: 38531 - DNA, 16 bp, H. sapiens
agctccaaccatgtcc

SEQ ID NO: 38532 - DNA, 16 bp, H. sapiens
agctccacatcactga

SEQ ID NO: 38533 - DNA, 16 bp, H. sapiens
agctccacatcctggg

SEQ ID NO: 38534 - DNA, 16 bp, H. sapiens
agctccaccacttcct

SEQ ID NO: 38535 - DNA, 16 bp, H. sapiens
agctccacccatgtcc

SEQ ID NO: 38536 - DNA, 16 bp, H. sapiens
agctccaccccctggg

SEQ ID NO: 38537 - DNA, 16 bp, H. sapiens
agctccacctccccag

SEQ ID NO: 38538 - DNA, 16 bp, H. sapiens
agctccacctcctagg

SEQ ID NO: 38539 - DNA, 16 bp, H. sapiens
agctccacctctgggg

SEQ ID NO: 38540 - DNA, 16 bp, H. sapiens
agctccacctgcggcc

SEQ ID NO: 38541 - DNA, 16 bp, H. sapiens
agctccacctgctggg

SEQ ID NO: 38542 - DNA, 16 bp, H. sapiens
agctccactcctgtgg

SEQ ID NO: 38543 - DNA, 16 bp, H. sapiens
agctccagaataatct

SEQ ID NO: 38544 - DNA, 16 bp, H. sapiens
agctccagacatcaca

SEQ ID NO: 38545 - DNA, 16 bp, H. sapiens
agctccagccaccttt

SEQ ID NO: 38546 - DNA, 16 bp, H. sapiens
agctccagcctcctgg

SEQ ID NO: 38547 - DNA, 16 bp, H. sapiens
agctccagcctgggca

SEQ ID NO: 38548 - DNA, 16 bp, H. sapiens
agctccaggagagact

SEQ ID NO: 38549 - DNA, 16 bp, H. sapiens
agctccaggaggcctg

SEQ ID NO: 38550 - DNA, 16 bp, H. sapiens
agctccaggattcatt

SEQ ID NO: 38551 - DNA, 16 bp, H. sapiens
agctccaggcagctca

SEQ ID NO: 38552 - DNA, 16 bp, H. sapiens
agctccaggctgtgct

SEQ ID NO: 38553 - DNA, 16 bp, H. sapiens
agctccagggcagggc

SEQ ID NO: 38554 - DNA, 16 bp, H. sapiens
agctccagggcttggg

SEQ ID NO: 38555 - DNA, 16 bp, H. sapiens
agctccaggtgctggc

SEQ ID NO: 38556 - DNA, 16 bp, H. sapiens
agctccagtgatccac

SEQ ID NO: 38557 - DNA, 16 bp, H. sapiens
agctccagtttcctca

SEQ ID NO: 38558 - DNA, 16 bp, H. sapiens
agctccatattacaga

SEQ ID NO: 38559 - DNA, 16 bp, H. sapiens
agctccatccatgtct

SEQ ID NO: 38560 - DNA, 16 bp, H. sapiens
agctccatctcctgtc

SEQ ID NO: 38561 - DNA, 16 bp, H. sapiens
agctccatgaaggcag

SEQ ID NO: 38562 - DNA, 16 bp, H. sapiens
agctccatgagggcag

SEQ ID NO: 38563 - DNA, 16 bp, H. sapiens
agctcccacaattcct

SEQ ID NO: 38564 - DNA, 16 bp, H. sapiens
agctcccacccccagc

SEQ ID NO: 38565 - DNA, 16 bp, H. sapiens
agctcccacttgcaag

SEQ ID NO: 38566 - DNA, 16 bp, H. sapiens
agctcccagaggaagg

SEQ ID NO: 38567 - DNA, 16 bp, H. sapiens
agctcccagagggaga

SEQ ID NO: 38568 - DNA, 16 bp, H. sapiens
agctcccagagggagg

SEQ ID NO: 38569 - DNA, 16 bp, H. sapiens
agctcccagcctgagt

SEQ ID NO: 38570 - DNA, 16 bp, H. sapiens
agctcccagctcccag

SEQ ID NO: 38571 - DNA, 16 bp, H. sapiens
agctcccaggagatgc

SEQ ID NO: 38572 - DNA, 16 bp, H. sapiens
agctcccaggaggagg

SEQ ID NO: 38573 - DNA, 16 bp, H. sapiens
agctcccaggggctcc

SEQ ID NO: 38574 - DNA, 16 bp, H. sapiens
agctcccagggggagg

SEQ ID NO: 38575 - DNA, 16 bp, H. sapiens
agctcccagtggccaa

SEQ ID NO: 38576 - DNA, 16 bp, H. sapiens
agctcccatctccttg

SEQ ID NO: 38577 - DNA, 16 bp, H. sapiens
agctccccaccccctg

SEQ ID NO: 38578 - DNA, 16 bp, H. sapiens
agctcccgaagcccca

SEQ ID NO: 38579 - DNA, 16 bp, H. sapiens
agctccctcaggcctc

SEQ ID NO: 38580 - DNA, 16 bp, H. sapiens
agctccctctgcttgc

SEQ ID NO: 38581 - DNA, 16 bp, H. sapiens
agctccctgagggcag

SEQ ID NO: 38582 - DNA, 16 bp, H. sapiens
agctccctgcagcctc

SEQ ID NO: 38583 - DNA, 16 bp, H. sapiens
agctccctgcagcctg

SEQ ID NO: 38584 - DNA, 16 bp, H. sapiens
agctccctgcagcctt

SEQ ID NO: 38585 - DNA, 16 bp, H. sapiens
agctccctgctcagcc

SEQ ID NO: 38586 - DNA, 16 bp, H. sapiens
agctccctgctgcctc

SEQ ID NO: 38587 - DNA, 16 bp, H. sapiens
agctccctgtagcctc

SEQ ID NO: 38588 - DNA, 16 bp, H. sapiens
agctccgcctccaggg

SEQ ID NO: 38589 - DNA, 20 bp, H. sapiens
agctccgcctcccaagttca

SEQ ID NO: 38590 - DNA, 16 bp, H. sapiens
agctccgcctcccatg

SEQ ID NO: 38591 - DNA, 16 bp, H. sapiens
agctccgtgagggcag

SEQ ID NO: 38592 - DNA, 16 bp, H. sapiens
agctcctaaaaccctt

SEQ ID NO: 38593 - DNA, 16 bp, H. sapiens
agctcctaacctcaag

SEQ ID NO: 38594 - DNA, 16 bp, H. sapiens
agctcctagaacagtg

SEQ ID NO: 38595 - DNA, 16 bp, H. sapiens
agctcctagcagagag

SEQ ID NO: 38596 - DNA, 16 bp, H. sapiens
agctcctcaggaggct

SEQ ID NO: 38597 - DNA, 16 bp, H. sapiens
agctcctcccatcaca

SEQ ID NO: 38598 - DNA, 16 bp, H. sapiens
agctcctcctcctggg

SEQ ID NO: 38599 - DNA, 16 bp, H. sapiens
agctcctgaaggaaac

SEQ ID NO: 38600 - DNA, 16 bp, H. sapiens
agctcctgaaggaggc

SEQ ID NO: 38601 - DNA, 16 bp, H. sapiens
agctcctgaagggagc

SEQ ID NO: 38602 - DNA, 22 bp, H. sapiens
agctcctgacaaaattcagact

SEQ ID NO: 38603 - DNA, 16 bp, H. sapiens
agctcctgacaaccac

SEQ ID NO: 38604 - DNA, 16 bp, H. sapiens
agctcctgacctcaag

SEQ ID NO: 38605 - DNA, 20 bp, H. sapiens
agctcctgacctcaggtgat

SEQ ID NO: 38606 - DNA, 23 bp, H. sapiens
agctcctgacctcaggtgatcta

SEQ ID NO: 38607 - DNA, 16 bp, H. sapiens
agctcctgcaggaagc

SEQ ID NO: 38608 - DNA, 16 bp, H. sapiens
agctcctgccctcagg

SEQ ID NO: 38609 - DNA, 16 bp, H. sapiens
agctcctgccctccga

SEQ ID NO: 38610 - DNA, 16 bp, H. sapiens
agctcctgcctcccag

SEQ ID NO: 38611 - DNA, 16 bp, H. sapiens
agctcctgcctgccag

SEQ ID NO: 38612 - DNA, 16 bp, H. sapiens
agctcctgctcccaca

SEQ ID NO: 38613 - DNA, 16 bp, H. sapiens
agctcctggaaggcag

SEQ ID NO: 38614 - DNA, 16 bp, H. sapiens
agctcctggagagcag

SEQ ID NO: 38615 - DNA, 16 bp, H. sapiens
agctcctggcctcagg

SEQ ID NO: 38616 - DNA, 16 bp, H. sapiens
agctcctgggctcaag

SEQ ID NO: 38617 - DNA, 16 bp, H. sapiens
agctcctgtcctcagg

SEQ ID NO: 38618 - DNA, 16 bp, H. sapiens
agctccttgagagcag

SEQ ID NO: 38619 - DNA, 16 bp, H. sapiens
agctccttgagggcag

SEQ ID NO: 38620 - DNA, 16 bp, H. sapiens
agctccttgggaggcc

SEQ ID NO: 38621 - DNA, 16 bp, H. sapiens
agctccttggggacag

SEQ ID NO: 38622 - DNA, 17 bp, H. sapiens
agctccttttagcagtt

SEQ ID NO: 38623 - DNA, 16 bp, H. sapiens
agctcctttttggttc

SEQ ID NO: 38624 - DNA, 16 bp, H. sapiens
agctcgctgcagcctc

SEQ ID NO: 38625 - DNA, 16 bp, H. sapiens
agctcgctgcagcttc

SEQ ID NO: 38626 - DNA, 19 bp, H. sapiens
agctctactaaaaatacaa

SEQ ID NO: 38627 - DNA, 16 bp, H. sapiens
agctctcaataaatat

SEQ ID NO: 38628 - DNA, 16 bp, H. sapiens
agctctcagcagatgg

SEQ ID NO: 38629 - DNA, 16 bp, H. sapiens
agctctcaggagacct

SEQ ID NO: 38630 - DNA, 16 bp, H. sapiens
agctctcatactgtaa

SEQ ID NO: 38631 - DNA, 16 bp, H. sapiens
agctctccagcctggg

SEQ ID NO: 38632 - DNA, 23 bp, H. sapiens
agctctccctgactcatcccaac

SEQ ID NO: 38633 - DNA, 16 bp, H. sapiens
agctctcctgtgaggt

SEQ ID NO: 38634 - DNA, 16 bp, H. sapiens
agctctctgaacctca

SEQ ID NO: 38635 - DNA, 16 bp, H. sapiens
agctctctgcaacctc

SEQ ID NO: 38636 - DNA, 16 bp, H. sapiens
agctctctgccctccc

SEQ ID NO: 38637 - DNA, 16 bp, H. sapiens
agctctctgggacctc

SEQ ID NO: 38638 - DNA, 16 bp, H. sapiens
agctctcttcctggct

SEQ ID NO: 38639 - DNA, 16 bp, H. sapiens
agctctcttgtctgcc

SEQ ID NO: 38640 - DNA, 16 bp, H. sapiens
agctctgaagaaagca

SEQ ID NO: 38641 - DNA, 16 bp, H. sapiens
agctctgagaacagac

SEQ ID NO: 38642 - DNA, 16 bp, H. sapiens
agctctgattttttat

SEQ ID NO: 38643 - DNA, 16 bp, H. sapiens
agctctgcaccaagcc

SEQ ID NO: 38644 - DNA, 16 bp, H. sapiens
agctctgcaccaggca

SEQ ID NO: 38645 - DNA, 16 bp, H. sapiens
agctctgccactaact

SEQ ID NO: 38646 - DNA, 16 bp, H. sapiens
agctctgccacttacc

SEQ ID NO: 38647 - DNA, 16 bp, H. sapiens
agctctgccctcatga

SEQ ID NO: 38648 - DNA, 16 bp, H. sapiens
agctctgcctcacagg

SEQ ID NO: 38649 - DNA, 16 bp, H. sapiens
agctctgcctcagcct

SEQ ID NO: 38650 - DNA, 16 bp, H. sapiens
agctctgcctcctctc

SEQ ID NO: 38651 - DNA, 16 bp, H. sapiens
agctctgcctcctgct

SEQ ID NO: 38652 - DNA, 16 bp, H. sapiens
agctctgccttccagg

SEQ ID NO: 38653 - DNA, 16 bp, H. sapiens
agctctgctctgctct

SEQ ID NO: 38654 - DNA, 16 bp, H. sapiens
agctctggagatggat

SEQ ID NO: 38655 - DNA, 16 bp, H. sapiens
agctctggaggctggg

SEQ ID NO: 38656 - DNA, 16 bp, H. sapiens
agctctggctgagccc

SEQ ID NO: 38657 - DNA, 16 bp, H. sapiens
agctctgggcaacaga

SEQ ID NO: 38658 - DNA, 16 bp, H. sapiens
agctctgtccactgaa

SEQ ID NO: 38659 - DNA, 16 bp, H. sapiens
agctctgtccctgtgg

SEQ ID NO: 38660 - DNA, 16 bp, H. sapiens
agctctgtgaccttgg

SEQ ID NO: 38661 - DNA, 16 bp, H. sapiens
agctctgtgactttgg

SEQ ID NO: 38662 - DNA, 16 bp, H. sapiens
agctctgtttttagct

SEQ ID NO: 38663 - DNA, 16 bp, H. sapiens
agctcttataaggcag

SEQ ID NO: 38664 - DNA, 16 bp, H. sapiens
agctcttcaaccagtt

SEQ ID NO: 38665 - DNA, 16 bp, H. sapiens
agctcttcaattcctt

SEQ ID NO: 38666 - DNA, 16 bp, H. sapiens
agctcttcatttattt

SEQ ID NO: 38667 - DNA, 16 bp, H. sapiens
agctcttctctcctct

SEQ ID NO: 38668 - DNA, 16 bp, H. sapiens
agctcttctctccttc

SEQ ID NO: 38669 - DNA, 16 bp, H. sapiens
agctcttgcccagtgt

SEQ ID NO: 38670 - DNA, 16 bp, H. sapiens
agctctttaaaaaaaa

SEQ ID NO: 38671 - DNA, 16 bp, H. sapiens
agctctttacagaaaa

SEQ ID NO: 38672 - DNA, 16 bp, H. sapiens
agctctttgagggcag

SEQ ID NO: 38673 - DNA, 16 bp, H. sapiens
agctctttgggaagct

SEQ ID NO: 38674 - DNA, 16 bp, H. sapiens
agctctttgggatgcc

SEQ ID NO: 38675 - DNA, 16 bp, H. sapiens
agctctttgtatatta

SEQ ID NO: 38676 - DNA, 16 bp, H. sapiens
agctcttttttgtttg

SEQ ID NO: 38677 - DNA, 20 bp, H. sapiens
agctgaaaaacacagcatga

SEQ ID NO: 38678 - DNA, 16 bp, H. sapiens
agctgaaaaatacagt

SEQ ID NO: 38679 - DNA, 16 bp, H. sapiens
agctgaaaaatgtaat

SEQ ID NO: 38680 - DNA, 16 bp, H. sapiens
agctgaaaaccatggc

SEQ ID NO: 38681 - DNA, 16 bp, H. sapiens
agctgaaaaccttgaa

SEQ ID NO: 38682 - DNA, 16 bp, H. sapiens
agctgaaaatgcattt

SEQ ID NO: 38683 - DNA, 16 bp, H. sapiens
agctgaaacaagaaag

SEQ ID NO: 38684 - DNA, 16 bp, H. sapiens
agctgaaactacaggc

SEQ ID NO: 38685 - DNA, 16 bp, H. sapiens
agctgaaactataaaa

SEQ ID NO: 38686 - DNA, 16 bp, H. sapiens
agctgaaactggatct

SEQ ID NO: 38687 - DNA, 16 bp, H. sapiens
agctgaaagcctttcc

SEQ ID NO: 38688 - DNA, 16 bp, H. sapiens
agctgaaatcttgcca

SEQ ID NO: 38689 - DNA, 16 bp, H. sapiens
agctgaaatgaaggaa

SEQ ID NO: 38690 - DNA, 16 bp, H. sapiens
agctgaaattcaaacc

SEQ ID NO: 38691 - DNA, 16 bp, H. sapiens
agctgaacaaggagaa

SEQ ID NO: 38692 - DNA, 16 bp, H. sapiens
agctgaacaatgaaaa

SEQ ID NO: 38693 - DNA, 17 bp, H. sapiens
agctgaacatagtgtgg

SEQ ID NO: 38694 - DNA, 16 bp, H. sapiens
agctgaactgaaggag

SEQ ID NO: 38695 - DNA, 16 bp, H. sapiens
agctgaagaaagaatt

SEQ ID NO: 38696 - DNA, 16 bp, H. sapiens
agctgaagaacttgaa

SEQ ID NO: 38697 - DNA, 16 bp, H. sapiens
agctgaagaacttgga

SEQ ID NO: 38698 - DNA, 16 bp, H. sapiens
agctgaagaatttaat

SEQ ID NO: 38699 - DNA, 16 bp, H. sapiens
agctgaagacccagga

SEQ ID NO: 38700 - DNA, 16 bp, H. sapiens
agctgaagcaagagaa

SEQ ID NO: 38701 - DNA, 16 bp, H. sapiens
agctgaagcacaagaa

SEQ ID NO: 38702 - DNA, 16 bp, H. sapiens
agctgaagcacagaga

SEQ ID NO: 38703 - DNA, 16 bp, H. sapiens
agctgaagcaggagga

SEQ ID NO: 38704 - DNA, 16 bp, H. sapiens
agctgaaggaaataga

SEQ ID NO: 38705 - DNA, 16 bp, H. sapiens
agctgaaggaatttga

SEQ ID NO: 38706 - DNA, 16 bp, H. sapiens
agctgaagtgggagaa

SEQ ID NO: 38707 - DNA, 16 bp, H. sapiens
agctgaatgaaaatga

SEQ ID NO: 38708 - DNA, 16 bp, H. sapiens
agctgaattcaattcc

SEQ ID NO: 38709 - DNA, 16 bp, H. sapiens
agctgacaaaaacaaa

SEQ ID NO: 38710 - DNA, 16 bp, H. sapiens
agctgacagccaaaat

SEQ ID NO: 38711 - DNA, 16 bp, H. sapiens
agctgacattgattcc

SEQ ID NO: 38712 - DNA, 16 bp, H. sapiens
agctgactgaagagcc

SEQ ID NO: 38713 - DNA, 16 bp, H. sapiens
agctgagaaagcaagc

SEQ ID NO: 38714 - DNA, 16 bp, H. sapiens
agctgagaagctgaga

SEQ ID NO: 38715 - DNA, 16 bp, H. sapiens
agctgagaagttcaag

SEQ ID NO: 38716 - DNA, 16 bp, H. sapiens
agctgagaatcaaacc

SEQ ID NO: 38717 - DNA, 16 bp, H. sapiens
agctgagaattttcca

SEQ ID NO: 38718 - DNA, 16 bp, H. sapiens
agctgagacagcacca

SEQ ID NO: 38719 - DNA, 17 bp, H. sapiens
agctgagacaggagaat

SEQ ID NO: 38720 - DNA, 16 bp, H. sapiens
agctgagaccacaggt

SEQ ID NO: 38721 - DNA, 16 bp, H. sapiens
agctgagactgtacca

SEQ ID NO: 38722 - DNA, 19 bp, H. sapiens
agctgagagatgtcattgc

SEQ ID NO: 38723 - DNA, 16 bp, H. sapiens
agctgagagggaggct

SEQ ID NO: 38724 - DNA, 16 bp, H. sapiens
agctgagagtggtggc

SEQ ID NO: 38725 - DNA, 16 bp, H. sapiens
agctgagatcacacga

SEQ ID NO: 38726 - DNA, 16 bp, H. sapiens
agctgagatccagcca

SEQ ID NO: 38727 - DNA, 16 bp, H. sapiens
agctgagatgctgaga

SEQ ID NO: 38728 - DNA, 16 bp, H. sapiens
agctgagatggatgaa

SEQ ID NO: 38729 - DNA, 16 bp, H. sapiens
agctgagatgggtgga

SEQ ID NO: 38730 - DNA, 16 bp, H. sapiens
agctgagattaagcca

SEQ ID NO: 38731 - DNA, 16 bp, H. sapiens
agctgagattacagat

SEQ ID NO: 38732 - DNA, 16 bp, H. sapiens
agctgagattgtgcct

SEQ ID NO: 38733 - DNA, 16 bp, H. sapiens
agctgagatttgaacc

SEQ ID NO: 38734 - DNA, 16 bp, H. sapiens
agctgagcaaggtggc

SEQ ID NO: 38735 - DNA, 16 bp, H. sapiens
agctgagcacggtggc

SEQ ID NO: 38736 - DNA, 16 bp, H. sapiens
agctgagcagatgctg

SEQ ID NO: 38737 - DNA, 16 bp, H. sapiens
agctgagcatgctggc

SEQ ID NO: 38738 - DNA, 16 bp, H. sapiens
agctgagccaggagaa

SEQ ID NO: 38739 - DNA, 16 bp, H. sapiens
agctgagcctggtggc

SEQ ID NO: 38740 - DNA, 16 bp, H. sapiens
agctgagcgtggtggt

SEQ ID NO: 38741 - DNA, 16 bp, H. sapiens
agctgagctgggagga

SEQ ID NO: 38742 - DNA, 16 bp, H. sapiens
agctgaggaagaaaga

SEQ ID NO: 38743 - DNA, 16 bp, H. sapiens
agctgaggaggatgta

SEQ ID NO: 38744 - DNA, 16 bp, H. sapiens
agctgaggagtttgag

SEQ ID NO: 38745 - DNA, 16 bp, H. sapiens
agctgaggcaagaaga

SEQ ID NO: 38746 - DNA, 16 bp, H. sapiens
agctgaggcacagaga

SEQ ID NO: 38747 - DNA, 16 bp, H. sapiens
agctgaggcagagagg

SEQ ID NO: 38748 - DNA, 16 bp, H. sapiens
agctgaggcaggaaga

SEQ ID NO: 38749 - DNA, 17 bp, H. sapiens
agctgaggcaggagaat

SEQ ID NO: 38750 - DNA, 18 bp, H. sapiens
agctgaggcaggagaatc

SEQ ID NO: 38751 - DNA, 17 bp, H. sapiens
agctgaggcaggtggat

SEQ ID NO: 38752 - DNA, 16 bp, H. sapiens
agctgaggcaggtggg

SEQ ID NO: 38753 - DNA, 16 bp, H. sapiens
agctgaggcatgagaa

SEQ ID NO: 38754 - DNA, 16 bp, H. sapiens
agctgaggccagagaa

SEQ ID NO: 38755 - DNA, 16 bp, H. sapiens
agctgaggcccagcaa

SEQ ID NO: 38756 - DNA, 16 bp, H. sapiens
agctgaggccggagaa

SEQ ID NO: 38757 - DNA, 16 bp, H. sapiens
agctgaggcctggaga

SEQ ID NO: 38758 - DNA, 16 bp, H. sapiens
agctgaggcgggcgga

SEQ ID NO: 38759 - DNA, 16 bp, H. sapiens
agctgaggctctgaga

SEQ ID NO: 38760 - DNA, 16 bp, H. sapiens
agctgaggctgaggcc

SEQ ID NO: 38761 - DNA, 16 bp, H. sapiens
agctgaggctggagaa

SEQ ID NO: 38762 - DNA, 16 bp, H. sapiens
agctgaggctggagga

SEQ ID NO: 38763 - DNA, 16 bp, H. sapiens
agctgaggggcaagga

SEQ ID NO: 38764 - DNA, 16 bp, H. sapiens
agctgaggtaggagaa

SEQ ID NO: 38765 - DNA, 18 bp, H. sapiens
agctgaggtgggcagatc

SEQ ID NO: 38766 - DNA, 17 bp, H. sapiens
agctgaggtgggtggat

SEQ ID NO: 38767 - DNA, 16 bp, H. sapiens
agctgaggttggagga

SEQ ID NO: 38768 - DNA, 17 bp, H. sapiens
agctgagttacaagccc

SEQ ID NO: 38769 - DNA, 16 bp, H. sapiens
agctgagttcaattcc

SEQ ID NO: 38770 - DNA, 19 bp, H. sapiens
agctgatatgcaacttcag

SEQ ID NO: 38771 - DNA, 16 bp, H. sapiens
agctgatggttttaaa

SEQ ID NO: 38772 - DNA, 16 bp, H. sapiens
agctgattggatgagg

SEQ ID NO: 38773 - DNA, 16 bp, H. sapiens
agctgattgtggtggc

SEQ ID NO: 38774 - DNA, 16 bp, H. sapiens
agctgattttgtattt

SEQ ID NO: 38775 - DNA, 16 bp, H. sapiens
agctgcaacatcaact

SEQ ID NO: 38776 - DNA, 16 bp, H. sapiens
agctgcaagggagact

SEQ ID NO: 38777 - DNA, 16 bp, H. sapiens
agctgcaagggagcct

SEQ ID NO: 38778 - DNA, 16 bp, H. sapiens
agctgcacagcaaaag

SEQ ID NO: 38779 - DNA, 16 bp, H. sapiens
agctgcaccattttcc

SEQ ID NO: 38780 - DNA, 16 bp, H. sapiens
agctgcacgaccctca

SEQ ID NO: 38781 - DNA, 16 bp, H. sapiens
agctgcactggcagct

SEQ ID NO: 38782 - DNA, 16 bp, H. sapiens
agctgcagaaagatgt

SEQ ID NO: 38783 - DNA, 16 bp, H. sapiens
agctgcagaagaaaaa

SEQ ID NO: 38784 - DNA, 16 bp, H. sapiens
agctgcagaagaaaca

SEQ ID NO: 38785 - DNA, 16 bp, H. sapiens
agctgcagacactcag

SEQ ID NO: 38786 - DNA, 16 bp, H. sapiens
agctgcagacctcaat

SEQ ID NO: 38787 - DNA, 16 bp, H. sapiens
agctgcagaccttcat

SEQ ID NO: 38788 - DNA, 16 bp, H. sapiens
agctgcagaccttctc

SEQ ID NO: 38789 - DNA, 16 bp, H. sapiens
agctgcagaccttggc

SEQ ID NO: 38790 - DNA, 16 bp, H. sapiens
agctgcagattggagc

SEQ ID NO: 38791 - DNA, 16 bp, H. sapiens
agctgcagcaagacct

SEQ ID NO: 38792 - DNA, 16 bp, H. sapiens
agctgcagcagctgca

SEQ ID NO: 38793 - DNA, 16 bp, H. sapiens
agctgcagcagggagg

SEQ ID NO: 38794 - DNA, 16 bp, H. sapiens
agctgcagccacccaa

SEQ ID NO: 38795 - DNA, 16 bp, H. sapiens
agctgcagctcccagt

SEQ ID NO: 38796 - DNA, 16 bp, H. sapiens
agctgcagctgcagac

SEQ ID NO: 38797 - DNA, 16 bp, H. sapiens
agctgcagctgccacc

SEQ ID NO: 38798 - DNA, 16 bp, H. sapiens
agctgcagctgcccag

SEQ ID NO: 38799 - DNA, 16 bp, H. sapiens
agctgcagctgtggtg

SEQ ID NO: 38800 - DNA, 16 bp, H. sapiens
agctgcaggaagatgt

SEQ ID NO: 38801 - DNA, 16 bp, H. sapiens
agctgcaggagacccc

SEQ ID NO: 38802 - DNA, 16 bp, H. sapiens
agctgcagtagtatag

SEQ ID NO: 38803 - DNA, 17 bp, H. sapiens
agctgcagttgacccaa

SEQ ID NO: 38804 - DNA, 16 bp, H. sapiens
agctgcatcccagaaa

SEQ ID NO: 38805 - DNA, 16 bp, H. sapiens
agctgcatctggtggc

SEQ ID NO: 38806 - DNA, 16 bp, H. sapiens
agctgcatgctgggag

SEQ ID NO: 38807 - DNA, 16 bp, H. sapiens
agctgcattccttctg

SEQ ID NO: 38808 - DNA, 16 bp, H. sapiens
agctgccaccatgcct

SEQ ID NO: 38809 - DNA, 16 bp, H. sapiens
agctgccatgttgtga

SEQ ID NO: 38810 - DNA, 16 bp, H. sapiens
agctgccattgacttt

SEQ ID NO: 38811 - DNA, 16 bp, H. sapiens
agctgcccaaaaccat

SEQ ID NO: 38812 - DNA, 16 bp, H. sapiens
agctgcccaaggccat

SEQ ID NO: 38813 - DNA, 16 bp, H. sapiens
agctgcccacattcct

SEQ ID NO: 38814 - DNA, 16 bp, H. sapiens
agctgcccaccctgcc

SEQ ID NO: 38815 - DNA, 16 bp, H. sapiens
agctgccccatctggg

SEQ ID NO: 38816 - DNA, 16 bp, H. sapiens
agctgccccgtccagg

SEQ ID NO: 38817 - DNA, 16 bp, H. sapiens
agctgccccttcccca

SEQ ID NO: 38818 - DNA, 16 bp, H. sapiens
agctgccccttccctc

SEQ ID NO: 38819 - DNA, 16 bp, H. sapiens
agctgccctctgccag

SEQ ID NO: 38820 - DNA, 16 bp, H. sapiens
agctgccgcacccggc

SEQ ID NO: 38821 - DNA, 16 bp, H. sapiens
agctgcctgccctgcc

SEQ ID NO: 38822 - DNA, 16 bp, H. sapiens
agctgcctgggaggct

SEQ ID NO: 38823 - DNA, 16 bp, H. sapiens
agctgcggaccctcac

SEQ ID NO: 38824 - DNA, 16 bp, H. sapiens
agctgcggagggtgca

SEQ ID NO: 38825 - DNA, 17 bp, H. sapiens
agctgcgtgtggtggcg

SEQ ID NO: 38826 - DNA, 16 bp, H. sapiens
agctgctacagctgca

SEQ ID NO: 38827 - DNA, 16 bp, H. sapiens
agctgctaccattcct

SEQ ID NO: 38828 - DNA, 16 bp, H. sapiens
agctgctcaaggcctt

SEQ ID NO: 38829 - DNA, 16 bp, H. sapiens
agctgctcagaggctg

SEQ ID NO: 38830 - DNA, 16 bp, H. sapiens
agctgctccagctgtg

SEQ ID NO: 38831 - DNA, 16 bp, H. sapiens
agctgctccaggaaca

SEQ ID NO: 38832 - DNA, 16 bp, H. sapiens
agctgctgaaggaagc

SEQ ID NO: 38833 - DNA, 16 bp, H. sapiens
agctgctgatcaccaa

SEQ ID NO: 38834 - DNA, 16 bp, H. sapiens
agctgctgatcagttt

SEQ ID NO: 38835 - DNA, 16 bp, H. sapiens
agctgctgcacagcaa

SEQ ID NO: 38836 - DNA, 16 bp, H. sapiens
agctgctgcacccagc

SEQ ID NO: 38837 - DNA, 16 bp, H. sapiens
agctgctgcacctggc

SEQ ID NO: 38838 - DNA, 16 bp, H. sapiens
agctgctgcacgcaga

SEQ ID NO: 38839 - DNA, 16 bp, H. sapiens
agctgctgctgctgct

SEQ ID NO: 38840 - DNA, 17 bp, H. sapiens
agctgctgctgctgctt

SEQ ID NO: 38841 - DNA, 16 bp, H. sapiens
agctgctgctgcttct

SEQ ID NO: 38842 - DNA, 16 bp, H. sapiens
agctgctggatgagaa

SEQ ID NO: 38843 - DNA, 16 bp, H. sapiens
agctgctgggaggctg

SEQ ID NO: 38844 - DNA, 16 bp, H. sapiens
agctgctggggaagct

SEQ ID NO: 38845 - DNA, 16 bp, H. sapiens
agctgctggggaggct

SEQ ID NO: 38846 - DNA, 16 bp, H. sapiens
agctgctgtggaaaat

SEQ ID NO: 38847 - DNA, 16 bp, H. sapiens
agctgcttcagaggct

SEQ ID NO: 38848 - DNA, 16 bp, H. sapiens
agctgcttcctctgcc

SEQ ID NO: 38849 - DNA, 16 bp, H. sapiens
agctgcttctcctctt

SEQ ID NO: 38850 - DNA, 16 bp, H. sapiens
agctgcttctgcttca

SEQ ID NO: 38851 - DNA, 16 bp, H. sapiens
agctgcttgggagtct

SEQ ID NO: 38852 - DNA, 16 bp, H. sapiens
agctgctttctttctt

SEQ ID NO: 38853 - DNA, 16 bp, H. sapiens
agctgctttttgaaaa

SEQ ID NO: 38854 - DNA, 16 bp, H. sapiens
agctgctttttgtatt

SEQ ID NO: 38855 - DNA, 16 bp, H. sapiens
agctggaaaaagaaaa

SEQ ID NO: 38856 - DNA, 16 bp, H. sapiens
agctggaaaagacaag

SEQ ID NO: 38857 - DNA, 16 bp, H. sapiens
agctggaaaaggccag

SEQ ID NO: 38858 - DNA, 16 bp, H. sapiens
agctggaaaattccta

SEQ ID NO: 38859 - DNA, 16 bp, H. sapiens
agctggaaactatcat

SEQ ID NO: 38860 - DNA, 16 bp, H. sapiens
agctggaaagcagatg

SEQ ID NO: 38861 - DNA, 16 bp, H. sapiens
agctggaaccacaggc

SEQ ID NO: 38862 - DNA, 16 bp, H. sapiens
agctggaacccaggag

SEQ ID NO: 38863 - DNA, 16 bp, H. sapiens
agctggaactactggc

SEQ ID NO: 38864 - DNA, 16 bp, H. sapiens
agctggaagaagaaag

SEQ ID NO: 38865 - DNA, 16 bp, H. sapiens
agctggaagacatcat

SEQ ID NO: 38866 - DNA, 16 bp, H. sapiens
agctggaagagaagat

SEQ ID NO: 38867 - DNA, 16 bp, H. sapiens
agctggaagaggaaag

SEQ ID NO: 38868 - DNA, 16 bp, H. sapiens
agctggaagggatctt

SEQ ID NO: 38869 - DNA, 16 bp, H. sapiens
agctggaagtggtggt

SEQ ID NO: 38870 - DNA, 16 bp, H. sapiens
agctggaataacaggt

SEQ ID NO: 38871 - DNA, 16 bp, H. sapiens
agctggaattcaaact

SEQ ID NO: 38872 - DNA, 16 bp, H. sapiens
agctggacatagtggc

SEQ ID NO: 38873 - DNA, 16 bp, H. sapiens
agctggacatgctggc

SEQ ID NO: 38874 - DNA, 16 bp, H. sapiens
agctggacatggcggc

SEQ ID NO: 38875 - DNA, 17 bp, H. sapiens
agctggacatggtggct

SEQ ID NO: 38876 - DNA, 16 bp, H. sapiens
agctggaccagatgta

SEQ ID NO: 38877 - DNA, 16 bp, H. sapiens
agctggacctggtggt

SEQ ID NO: 38878 - DNA, 16 bp, H. sapiens
agctggactctgtctc

SEQ ID NO: 38879 - DNA, 16 bp, H. sapiens
agctggactgcagtgg

SEQ ID NO: 38880 - DNA, 16 bp, H. sapiens
agctggacttctgggt

SEQ ID NO: 38881 - DNA, 16 bp, H. sapiens
agctggagaaactgag

SEQ ID NO: 38882 - DNA, 16 bp, H. sapiens
agctggagaatttaat

SEQ ID NO: 38883 - DNA, 16 bp, H. sapiens
agctggagaggagaag

SEQ ID NO: 38884 - DNA, 16 bp, H. sapiens
agctggagatcagcct

SEQ ID NO: 38885 - DNA, 16 bp, H. sapiens
agctggagcacagtgg

SEQ ID NO: 38886 - DNA, 16 bp, H. sapiens
agctggagcagctgag

SEQ ID NO: 38887 - DNA, 16 bp, H. sapiens
agctggagcagctggg

SEQ ID NO: 38888 - DNA, 16 bp, H. sapiens
agctggagctgaagca

SEQ ID NO: 38889 - DNA, 16 bp, H. sapiens
agctggagctgcagca

SEQ ID NO: 38890 - DNA, 16 bp, H. sapiens
agctggaggaatcaca

SEQ ID NO: 38891 - DNA, 16 bp, H. sapiens
agctggaggcagcatg

SEQ ID NO: 38892 - DNA, 16 bp, H. sapiens
agctggaggccatcat

SEQ ID NO: 38893 - DNA, 16 bp, H. sapiens
agctggaggccatgat

SEQ ID NO: 38894 - DNA, 16 bp, H. sapiens
agctggaggccattat

SEQ ID NO: 38895 - DNA, 16 bp, H. sapiens
agctggaggccattct

SEQ ID NO: 38896 - DNA, 16 bp, H. sapiens
agctggaggccatttt

SEQ ID NO: 38897 - DNA, 16 bp, H. sapiens
agctggaggcctttat

SEQ ID NO: 38898 - DNA, 16 bp, H. sapiens
agctggaggctgcaag

SEQ ID NO: 38899 - DNA, 16 bp, H. sapiens
agctggagggcaatgg

SEQ ID NO: 38900 - DNA, 16 bp, H. sapiens
agctggagtacagtgg

SEQ ID NO: 38901 - DNA, 16 bp, H. sapiens
agctggagtccagtgg

SEQ ID NO: 38902 - DNA, 16 bp, H. sapiens
agctggagtgcagtag

SEQ ID NO: 38903 - DNA, 16 bp, H. sapiens
agctggagtgcagtgg

SEQ ID NO: 38904 - DNA, 20 bp, H. sapiens
agctggagtgcagtggtgca

SEQ ID NO: 38905 - DNA, 16 bp, H. sapiens
agctggagtgccatgg

SEQ ID NO: 38906 - DNA, 16 bp, H. sapiens
agctggagtggcaggg

SEQ ID NO: 38907 - DNA, 16 bp, H. sapiens
agctggatgtggtggt

SEQ ID NO: 38908 - DNA, 16 bp, H. sapiens
agctggattgcagagt

SEQ ID NO: 38909 - DNA, 16 bp, H. sapiens
agctggcaagatggcc

SEQ ID NO: 38910 - DNA, 16 bp, H. sapiens
agctggcaagctctga

SEQ ID NO: 38911 - DNA, 16 bp, H. sapiens
agctggcagaagaaaa

SEQ ID NO: 38912 - DNA, 16 bp, H. sapiens
agctggcagggctggg

SEQ ID NO: 38913 - DNA, 18 bp, H. sapiens
agctggcattacaggcgt

SEQ ID NO: 38914 - DNA, 16 bp, H. sapiens
agctggccaatatggt

SEQ ID NO: 38915 - DNA, 16 bp, H. sapiens
agctggccgtggtggc

SEQ ID NO: 38916 - DNA, 16 bp, H. sapiens
agctggccgtggtggt

SEQ ID NO: 38917 - DNA, 16 bp, H. sapiens
agctggctccttctca

SEQ ID NO: 38918 - DNA, 16 bp, H. sapiens
agctggctgggcacag

SEQ ID NO: 38919 - DNA, 16 bp, H. sapiens
agctggctgtggtggc

SEQ ID NO: 38920 - DNA, 16 bp, H. sapiens
agctggcttctcccag

SEQ ID NO: 38921 - DNA, 16 bp, H. sapiens
agctgggaaaactgag

SEQ ID NO: 38922 - DNA, 16 bp, H. sapiens
agctgggaaccctgca

SEQ ID NO: 38923 - DNA, 16 bp, H. sapiens
agctgggaaggaggct

SEQ ID NO: 38924 - DNA, 16 bp, H. sapiens
agctgggaaggggaaa

SEQ ID NO: 38925 - DNA, 16 bp, H. sapiens
agctgggacatgcctg

SEQ ID NO: 38926 - DNA, 16 bp, H. sapiens
agctgggaccacagat

SEQ ID NO: 38927 - DNA, 16 bp, H. sapiens
agctgggaccacagcc

SEQ ID NO: 38928 - DNA, 16 bp, H. sapiens
agctgggaccagaggc

SEQ ID NO: 38929 - DNA, 16 bp, H. sapiens
agctgggactaaagga

SEQ ID NO: 38930 - DNA, 16 bp, H. sapiens
agctgggactacaagt

SEQ ID NO: 38931 - DNA, 16 bp, H. sapiens
agctgggactgcaagt

SEQ ID NO: 38932 - DNA, 16 bp, H. sapiens
agctgggactgctggt

SEQ ID NO: 38933 - DNA, 16 bp, H. sapiens
agctgggactgtgggc

SEQ ID NO: 38934 - DNA, 16 bp, H. sapiens
agctgggagcacaggc

SEQ ID NO: 38935 - DNA, 16 bp, H. sapiens
agctgggagcacaggt

SEQ ID NO: 38936 - DNA, 16 bp, H. sapiens
agctgggagcccagcc

SEQ ID NO: 38937 - DNA, 16 bp, H. sapiens
agctgggaggccaagg

SEQ ID NO: 38938 - DNA, 16 bp, H. sapiens
agctgggagtggggct

SEQ ID NO: 38939 - DNA, 16 bp, H. sapiens
agctgggagtggtggt

SEQ ID NO: 38940 - DNA, 16 bp, H. sapiens
agctgggatcacaggc

SEQ ID NO: 38941 - DNA, 18 bp, H. sapiens
agctgggatcacaggcgc

SEQ ID NO: 38942 - DNA, 16 bp, H. sapiens
agctgggatgtgaacc

SEQ ID NO: 38943 - DNA, 16 bp, H. sapiens
agctgggattacagat

SEQ ID NO: 38944 - DNA, 29 bp, H. sapiens
agctgggattacaggcatgtgccaccaca

SEQ ID NO: 38945 - DNA, 16 bp, H. sapiens
agctgggattgcaagt

SEQ ID NO: 38946 - DNA, 17 bp, H. sapiens
agctgggattgcaggtg

SEQ ID NO: 38947 - DNA, 16 bp, H. sapiens
agctgggattggaacc

SEQ ID NO: 38948 - DNA, 16 bp, H. sapiens
agctgggcaaggtggt

SEQ ID NO: 38949 - DNA, 20 bp, H. sapiens
agctgggcacagtggctcac

SEQ ID NO: 38950 - DNA, 16 bp, H. sapiens
agctgggcacggcggc

SEQ ID NO: 38951 - DNA, 16 bp, H. sapiens
agctgggcagtggtgg

SEQ ID NO: 38952 - DNA, 16 bp, H. sapiens
agctgggcatctgggg

SEQ ID NO: 38953 - DNA, 16 bp, H. sapiens
agctgggcatgctggt

SEQ ID NO: 38954 - DNA, 16 bp, H. sapiens
agctgggcatggaggt

SEQ ID NO: 38955 - DNA, 16 bp, H. sapiens
agctgggcatggcggt

SEQ ID NO: 38956 - DNA, 16 bp, H. sapiens
agctgggcattgtggt

SEQ ID NO: 38957 - DNA, 16 bp, H. sapiens
agctgggccgccaggg

SEQ ID NO: 38958 - DNA, 16 bp, H. sapiens
agctgggccgggcgcg

SEQ ID NO: 38959 - DNA, 16 bp, H. sapiens
agctgggcctagtggc

SEQ ID NO: 38960 - DNA, 16 bp, H. sapiens
agctgggcctctgggg

SEQ ID NO: 38961 - DNA, 16 bp, H. sapiens
agctgggcctgatggt

SEQ ID NO: 38962 - DNA, 16 bp, H. sapiens
agctgggcctggagac

SEQ ID NO: 38963 - DNA, 16 bp, H. sapiens
agctgggcctggggag

SEQ ID NO: 38964 - DNA, 16 bp, H. sapiens
agctgggcctggggga

SEQ ID NO: 38965 - DNA, 16 bp, H. sapiens
agctgggcgccgtggc

SEQ ID NO: 38966 - DNA, 16 bp, H. sapiens
agctgggcgtggtagc

SEQ ID NO: 38967 - DNA, 16 bp, H. sapiens
agctgggcgtggtcat

SEQ ID NO: 38968 - DNA, 16 bp, H. sapiens
agctgggcgtggtgat

SEQ ID NO: 38969 - DNA, 18 bp, H. sapiens
agctgggcgtggtggctt

SEQ ID NO: 38970 - DNA, 16 bp, H. sapiens
agctgggcgtgtggcg

SEQ ID NO: 38971 - DNA, 16 bp, H. sapiens
agctgggctacaggtg

SEQ ID NO: 38972 - DNA, 16 bp, H. sapiens
agctgggctgccaggg

SEQ ID NO: 38973 - DNA, 16 bp, H. sapiens
agctgggctgctgggg

SEQ ID NO: 38974 - DNA, 16 bp, H. sapiens
agctgggctgggcaca

SEQ ID NO: 38975 - DNA, 16 bp, H. sapiens
agctgggctgggttcc

SEQ ID NO: 38976 - DNA, 16 bp, H. sapiens
agctgggctggtggtg

SEQ ID NO: 38977 - DNA, 16 bp, H. sapiens
agctgggctgtggtgg

SEQ ID NO: 38978 - DNA, 16 bp, H. sapiens
agctgggctgtgtggt

SEQ ID NO: 38979 - DNA, 16 bp, H. sapiens
agctgggcttagtggt

SEQ ID NO: 38980 - DNA, 16 bp, H. sapiens
agctgggcttcctggg

SEQ ID NO: 38981 - DNA, 16 bp, H. sapiens
agctgggcttggtggt

SEQ ID NO: 38982 - DNA, 16 bp, H. sapiens
agctggggaagagaga

SEQ ID NO: 38983 - DNA, 16 bp, H. sapiens
agctggggaggcctca

SEQ ID NO: 38984 - DNA, 16 bp, H. sapiens
agctggggaggggctg

SEQ ID NO: 38985 - DNA, 16 bp, H. sapiens
agctggggccacaggc

SEQ ID NO: 38986 - DNA, 16 bp, H. sapiens
agctggggctgcaggc

SEQ ID NO: 38987 - DNA, 16 bp, H. sapiens
agctggggctggaacc

SEQ ID NO: 38988 - DNA, 16 bp, H. sapiens
agctgggggaaaaaaa

SEQ ID NO: 38989 - DNA, 16 bp, H. sapiens
agctgggggcagtggc

SEQ ID NO: 38990 - DNA, 17 bp, H. sapiens
agctgggtatggtggca

SEQ ID NO: 38991 - DNA, 16 bp, H. sapiens
agctgggtatggtggt

SEQ ID NO: 38992 - DNA, 16 bp, H. sapiens
agctgggtctacaggc

SEQ ID NO: 38993 - DNA, 16 bp, H. sapiens
agctgggtgaagtggc

SEQ ID NO: 38994 - DNA, 16 bp, H. sapiens
agctgggtgactttgg

SEQ ID NO: 38995 - DNA, 16 bp, H. sapiens
agctgggtgcactggc

SEQ ID NO: 38996 - DNA, 20 bp, H. sapiens
agctgggtgcagtggctcat

SEQ ID NO: 38997 - DNA, 16 bp, H. sapiens
agctgggtgcagtggt

SEQ ID NO: 38998 - DNA, 16 bp, H. sapiens
agctgggtggtggtgg

SEQ ID NO: 38999 - DNA, 16 bp, H. sapiens
agctgggtgtgctggc

SEQ ID NO: 39000 - DNA, 16 bp, H. sapiens
agctgggtgtggtggt

SEQ ID NO: 39001 - DNA, 16 bp, H. sapiens
agctgggtgtgttggt

SEQ ID NO: 39002 - DNA, 16 bp, H. sapiens
agctggtaaatggcag

SEQ ID NO: 39003 - DNA, 16 bp, H. sapiens
agctggtaacattcct

SEQ ID NO: 39004 - DNA, 16 bp, H. sapiens
agctggtccatcagaa

SEQ ID NO: 39005 - DNA, 16 bp, H. sapiens
agctggtcctggtggc

SEQ ID NO: 39006 - DNA, 19 bp, H. sapiens
agctggtctcaaactccta

SEQ ID NO: 39007 - DNA, 16 bp, H. sapiens
agctggtctcgaactc

SEQ ID NO: 39008 - DNA, 16 bp, H. sapiens
agctggtcttgaattc

SEQ ID NO: 39009 - DNA, 16 bp, H. sapiens
agctggtgcagtggct

SEQ ID NO: 39010 - DNA, 16 bp, H. sapiens
agctggtgccattcct

SEQ ID NO: 39011 - DNA, 16 bp, H. sapiens
agctggtggtgttaga

SEQ ID NO: 39012 - DNA, 16 bp, H. sapiens
agctgtaaaactacaa

SEQ ID NO: 39013 - DNA, 16 bp, H. sapiens
agctgtaaccaatcca

SEQ ID NO: 39014 - DNA, 16 bp, H. sapiens
agctgtagttccagct

SEQ ID NO: 39015 - DNA, 16 bp, H. sapiens
agctgtcagtggagct

SEQ ID NO: 39016 - DNA, 16 bp, H. sapiens
agctgtcatcatgcca

SEQ ID NO: 39017 - DNA, 16 bp, H. sapiens
agctgtccttcagaaa

SEQ ID NO: 39018 - DNA, 16 bp, H. sapiens
agctgtccttcttggg

SEQ ID NO: 39019 - DNA, 16 bp, H. sapiens
agctgtccttgctcat

SEQ ID NO: 39020 - DNA, 16 bp, H. sapiens
agctgtcttcttgcac

SEQ ID NO: 39021 - DNA, 16 bp, H. sapiens
agctgtcttttctttt

SEQ ID NO: 39022 - DNA, 16 bp, H. sapiens
agctgtgactacaggc

SEQ ID NO: 39023 - DNA, 16 bp, H. sapiens
agctgtgactgcacca

SEQ ID NO: 39024 - DNA, 16 bp, H. sapiens
agctgtgagaaataca

SEQ ID NO: 39025 - DNA, 16 bp, H. sapiens
agctgtgagacaaaag

SEQ ID NO: 39026 - DNA, 16 bp, H. sapiens
agctgtgagctgtgca

SEQ ID NO: 39027 - DNA, 16 bp, H. sapiens
agctgtgatcacagca

SEQ ID NO: 39028 - DNA, 16 bp, H. sapiens
agctgtgatcatgcca

SEQ ID NO: 39029 - DNA, 16 bp, H. sapiens
agctgtgatgatgcca

SEQ ID NO: 39030 - DNA, 16 bp, H. sapiens
agctgtgattgcacaa

SEQ ID NO: 39031 - DNA, 16 bp, H. sapiens
agctgtgattgcactg

SEQ ID NO: 39032 - DNA, 16 bp, H. sapiens
agctgtgattgtgcta

SEQ ID NO: 39033 - DNA, 16 bp, H. sapiens
agctgtgcagattctc

SEQ ID NO: 39034 - DNA, 16 bp, H. sapiens
agctgtgcaggaggct

SEQ ID NO: 39035 - DNA, 16 bp, H. sapiens
agctgtgccacagctg

SEQ ID NO: 39036 - DNA, 16 bp, H. sapiens
agctgtgcccaggagg

SEQ ID NO: 39037 - DNA, 16 bp, H. sapiens
agctgtggagggtgca

SEQ ID NO: 39038 - DNA, 16 bp, H. sapiens
agctgtggcaatttct

SEQ ID NO: 39039 - DNA, 16 bp, H. sapiens
agctgtgggacaactt

SEQ ID NO: 39040 - DNA, 16 bp, H. sapiens
agctgtggtcccagct

SEQ ID NO: 39041 - DNA, 16 bp, H. sapiens
agctgtggtggcaggc

SEQ ID NO: 39042 - DNA, 16 bp, H. sapiens
agctgtgtgaacttag

SEQ ID NO: 39043 - DNA, 16 bp, H. sapiens
agctgtgtgaacttgg

SEQ ID NO: 39044 - DNA, 16 bp, H. sapiens
agctgtgtgaatttgg

SEQ ID NO: 39045 - DNA, 16 bp, H. sapiens
agctgtgtgacactga

SEQ ID NO: 39046 - DNA, 16 bp, H. sapiens
agctgtgtgaccctag

SEQ ID NO: 39047 - DNA, 16 bp, H. sapiens
agctgtgtgactctgg

SEQ ID NO: 39048 - DNA, 16 bp, H. sapiens
agctgtgtgacttcag

SEQ ID NO: 39049 - DNA, 16 bp, H. sapiens
agctgtgtgactttag

SEQ ID NO: 39050 - DNA, 16 bp, H. sapiens
agctgtgtgactttgg

SEQ ID NO: 39051 - DNA, 16 bp, H. sapiens
agctgtgtgatcatgg

SEQ ID NO: 39052 - DNA, 16 bp, H. sapiens
agctgtgtgattttgg

SEQ ID NO: 39053 - DNA, 16 bp, H. sapiens
agctgtgtggccctgg

SEQ ID NO: 39054 - DNA, 16 bp, H. sapiens
agctgtgtggtcttgg

SEQ ID NO: 39055 - DNA, 16 bp, H. sapiens
agctgtgttaccttgg

SEQ ID NO: 39056 - DNA, 16 bp, H. sapiens
agctgtgttccaataa

SEQ ID NO: 39057 - DNA, 16 bp, H. sapiens
agctgtgttgaagaaa

SEQ ID NO: 39058 - DNA, 16 bp, H. sapiens
agctgttaacacttaa

SEQ ID NO: 39059 - DNA, 23 bp, H. sapiens
agctgttcctattcggccatctt

SEQ ID NO: 39060 - DNA, 16 bp, H. sapiens
agctgttcctgttcag

SEQ ID NO: 39061 - DNA, 16 bp, H. sapiens
agctgttcctgtttgg

SEQ ID NO: 39062 - DNA, 16 bp, H. sapiens
agctgttggtggatct

SEQ ID NO: 39063 - DNA, 16 bp, H. sapiens
agctgtttgagctcct

SEQ ID NO: 39064 - DNA, 16 bp, H. sapiens
agctgttttccaaagt

SEQ ID NO: 39065 - DNA, 16 bp, H. sapiens
agctgttttcttttct

SEQ ID NO: 39066 - DNA, 16 bp, H. sapiens
agctgttttgaaatat

SEQ ID NO: 39067 - DNA, 16 bp, H. sapiens
agctgtttttttaaaa

SEQ ID NO: 39068 - DNA, 16 bp, H. sapiens
agcttaaacaacagaa

SEQ ID NO: 39069 - DNA, 16 bp, H. sapiens
agcttaaggagctttt

SEQ ID NO: 39070 - DNA, 16 bp, H. sapiens
agcttaagtgacagag

SEQ ID NO: 39071 - DNA, 16 bp, H. sapiens
agcttaatttttattt

SEQ ID NO: 39072 - DNA, 16 bp, H. sapiens
agcttacactctagtg

SEQ ID NO: 39073 - DNA, 16 bp, H. sapiens
agcttacattctagca

SEQ ID NO: 39074 - DNA, 18 bp, H. sapiens
agcttactgcaacctcca

SEQ ID NO: 39075 - DNA, 16 bp, H. sapiens
agcttactgcagcctc

SEQ ID NO: 39076 - DNA, 16 bp, H. sapiens
agcttataaaatcaaa

SEQ ID NO: 39077 - DNA, 16 bp, H. sapiens
agcttatttggatttt

SEQ ID NO: 39078 - DNA, 16 bp, H. sapiens
agcttatttttaaatt

SEQ ID NO: 39079 - DNA, 16 bp, H. sapiens
agcttcaaaagcaaag

SEQ ID NO: 39080 - DNA, 16 bp, H. sapiens
agcttcaaactggaaa

SEQ ID NO: 39081 - DNA, 16 bp, H. sapiens
agcttcaacctcctgg

SEQ ID NO: 39082 - DNA, 18 bp, H. sapiens
agcttcagcagacttaaa

SEQ ID NO: 39083 - DNA, 16 bp, H. sapiens
agcttcagcttcctca

SEQ ID NO: 39084 - DNA, 16 bp, H. sapiens
agcttcatccacgtcc

SEQ ID NO: 39085 - DNA, 16 bp, H. sapiens
agcttcatccatgctg

SEQ ID NO: 39086 - DNA, 16 bp, H. sapiens
agcttcatccccagga

SEQ ID NO: 39087 - DNA, 18 bp, H. sapiens
agcttcatctatgtccct

SEQ ID NO: 39088 - DNA, 16 bp, H. sapiens
agcttcatctgtgttt

SEQ ID NO: 39089 - DNA, 16 bp, H. sapiens
agcttcatgcctcttc

SEQ ID NO: 39090 - DNA, 16 bp, H. sapiens
agcttccaagagtcct

SEQ ID NO: 39091 - DNA, 16 bp, H. sapiens
agcttccacttcctgg

SEQ ID NO: 39092 - DNA, 16 bp, H. sapiens
agcttccagaggctgc

SEQ ID NO: 39093 - DNA, 16 bp, H. sapiens
agcttccagatagctg

SEQ ID NO: 39094 - DNA, 16 bp, H. sapiens
agcttccaggggaagg

SEQ ID NO: 39095 - DNA, 16 bp, H. sapiens
agcttccagtttttct

SEQ ID NO: 39096 - DNA, 16 bp, H. sapiens
agcttcccaactagct

SEQ ID NO: 39097 - DNA, 16 bp, H. sapiens
agcttcccgaggcctc

SEQ ID NO: 39098 - DNA, 16 bp, H. sapiens
agcttcccttgcagct

SEQ ID NO: 39099 - DNA, 16 bp, H. sapiens
agcttcctcccagagg

SEQ ID NO: 39100 - DNA, 16 bp, H. sapiens
agcttcctgaagccct

SEQ ID NO: 39101 - DNA, 16 bp, H. sapiens
agcttcctgaggccct

SEQ ID NO: 39102 - DNA, 16 bp, H. sapiens
agcttcctgaggcctc

SEQ ID NO: 39103 - DNA, 16 bp, H. sapiens
agcttcctgaggcctt

SEQ ID NO: 39104 - DNA, 16 bp, H. sapiens
agcttcctgagggcag

SEQ ID NO: 39105 - DNA, 16 bp, H. sapiens
agcttcctgagtagcc

SEQ ID NO: 39106 - DNA, 16 bp, H. sapiens
agcttcctgcagcctc

SEQ ID NO: 39107 - DNA, 16 bp, H. sapiens
agcttcctggcagcca

SEQ ID NO: 39108 - DNA, 16 bp, H. sapiens
agcttcctggggcctc

SEQ ID NO: 39109 - DNA, 16 bp, H. sapiens
agcttcgacttcctgg

SEQ ID NO: 39110 - DNA, 17 bp, H. sapiens
agcttcgcctcctgggt

SEQ ID NO: 39111 - DNA, 16 bp, H. sapiens
agcttctagaggccac

SEQ ID NO: 39112 - DNA, 16 bp, H. sapiens
agcttctcctgtgtct

SEQ ID NO: 39113 - DNA, 16 bp, H. sapiens
agcttctctggataag

SEQ ID NO: 39114 - DNA, 16 bp, H. sapiens
agcttctcttccttaa

SEQ ID NO: 39115 - DNA, 16 bp, H. sapiens
agcttctgaatgtgtt

SEQ ID NO: 39116 - DNA, 16 bp, H. sapiens
agcttctgcagagcaa

SEQ ID NO: 39117 - DNA, 17 bp, H. sapiens
agcttctgcatagcaaa

SEQ ID NO: 39118 - DNA, 16 bp, H. sapiens
agcttctgcctcctgg

SEQ ID NO: 39119 - DNA, 17 bp, H. sapiens
agcttctgtacagcaaa

SEQ ID NO: 39120 - DNA, 16 bp, H. sapiens
agcttctgtgccctct

SEQ ID NO: 39121 - DNA, 16 bp, H. sapiens
agcttctgttttcttt

SEQ ID NO: 39122 - DNA, 16 bp, H. sapiens
agcttcttggaggagg

SEQ ID NO: 39123 - DNA, 16 bp, H. sapiens
agcttctttctgtttt

SEQ ID NO: 39124 - DNA, 16 bp, H. sapiens
agcttcttttcatgtg

SEQ ID NO: 39125 - DNA, 16 bp, H. sapiens
agcttcttttgaaaaa

SEQ ID NO: 39126 - DNA, 16 bp, H. sapiens
agcttgaagactggct

SEQ ID NO: 39127 - DNA, 16 bp, H. sapiens
agcttgaagatgtgac

SEQ ID NO: 39128 - DNA, 16 bp, H. sapiens
agcttgagaaataaag

SEQ ID NO: 39129 - DNA, 16 bp, H. sapiens
agcttgagaagaatgt

SEQ ID NO: 39130 - DNA, 16 bp, H. sapiens
agcttgagacaagcct

SEQ ID NO: 39131 - DNA, 16 bp, H. sapiens
agcttgaggagcaagg

SEQ ID NO: 39132 - DNA, 16 bp, H. sapiens
agcttgatgggggtgg

SEQ ID NO: 39133 - DNA, 16 bp, H. sapiens
agcttgcaagactgga

SEQ ID NO: 39134 - DNA, 16 bp, H. sapiens
agcttgcagagagctg

SEQ ID NO: 39135 - DNA, 16 bp, H. sapiens
agcttgcagatgacct

SEQ ID NO: 39136 - DNA, 16 bp, H. sapiens
agcttgcagggctgga

SEQ ID NO: 39137 - DNA, 16 bp, H. sapiens
agcttgcagggtttct

SEQ ID NO: 39138 - DNA, 16 bp, H. sapiens
agcttgcagtgagctg

SEQ ID NO: 39139 - DNA, 16 bp, H. sapiens
agcttgccagctccca

SEQ ID NO: 39140 - DNA, 16 bp, H. sapiens
agcttgcccaacatgg

SEQ ID NO: 39141 - DNA, 16 bp, H. sapiens
agcttgctctgtcacc

SEQ ID NO: 39142 - DNA, 16 bp, H. sapiens
agcttgctgcaacctc

SEQ ID NO: 39143 - DNA, 16 bp, H. sapiens
agcttgctgcagcttc

SEQ ID NO: 39144 - DNA, 16 bp, H. sapiens
agcttgctgggttcca

SEQ ID NO: 39145 - DNA, 16 bp, H. sapiens
agcttggaaggttgag

SEQ ID NO: 39146 - DNA, 16 bp, H. sapiens
agcttggagatgccag

SEQ ID NO: 39147 - DNA, 17 bp, H. sapiens
agcttggaggagtttgt

SEQ ID NO: 39148 - DNA, 16 bp, H. sapiens
agcttgggagacagaa

SEQ ID NO: 39149 - DNA, 16 bp, H. sapiens
agcttgggcaacacag

SEQ ID NO: 39150 - DNA, 16 bp, H. sapiens
agcttgggcaacgtgg

SEQ ID NO: 39151 - DNA, 16 bp, H. sapiens
agcttgggcctcccgg

SEQ ID NO: 39152 - DNA, 16 bp, H. sapiens
agcttgggtggaagaa

SEQ ID NO: 39153 - DNA, 16 bp, H. sapiens
agcttggtcgctgttg

SEQ ID NO: 39154 - DNA, 16 bp, H. sapiens
agcttggtttattttt

SEQ ID NO: 39155 - DNA, 16 bp, H. sapiens
agcttgtatagccaag

SEQ ID NO: 39156 - DNA, 19 bp, H. sapiens
agcttgtctaactcctgct

SEQ ID NO: 39157 - DNA, 16 bp, H. sapiens
agcttgtggtaatttg

SEQ ID NO: 39158 - DNA, 16 bp, H. sapiens
agcttgtgtgtgtgtg

SEQ ID NO: 39159 - DNA, 16 bp, H. sapiens
agcttgttggaaatgc

SEQ ID NO: 39160 - DNA, 16 bp, H. sapiens
agcttgtttctacttt

SEQ ID NO: 39161 - DNA, 16 bp, H. sapiens
agcttgtttttgattt

SEQ ID NO: 39162 - DNA, 16 bp, H. sapiens
agctttaaaaaataaa

SEQ ID NO: 39163 - DNA, 16 bp, H. sapiens
agctttaagattttac

SEQ ID NO: 39164 - DNA, 16 bp, H. sapiens
agctttagtagatact

SEQ ID NO: 39165 - DNA, 16 bp, H. sapiens
agctttataaaaataa

SEQ ID NO: 39166 - DNA, 16 bp, H. sapiens
agctttataaatgaag

SEQ ID NO: 39167 - DNA, 16 bp, H. sapiens
agctttataataaata

SEQ ID NO: 39168 - DNA, 16 bp, H. sapiens
agctttattaaggtat

SEQ ID NO: 39169 - DNA, 17 bp, H. sapiens
agctttattgctcacac

SEQ ID NO: 39170 - DNA, 16 bp, H. sapiens
agctttattggggtat

SEQ ID NO: 39171 - DNA, 16 bp, H. sapiens
agctttatttctaggt

SEQ ID NO: 39172 - DNA, 16 bp, H. sapiens
agctttatttttcctt

SEQ ID NO: 39173 - DNA, 16 bp, H. sapiens
agctttcaagtgaaaa

SEQ ID NO: 39174 - DNA, 16 bp, H. sapiens
agctttcagtctttca

SEQ ID NO: 39175 - DNA, 16 bp, H. sapiens
agctttcatttgtctg

SEQ ID NO: 39176 - DNA, 16 bp, H. sapiens
agctttcccttttctc

SEQ ID NO: 39177 - DNA, 16 bp, H. sapiens
agctttctacatatag

SEQ ID NO: 39178 - DNA, 16 bp, H. sapiens
agctttctgaggccct

SEQ ID NO: 39179 - DNA, 16 bp, H. sapiens
agctttctggaggagg

SEQ ID NO: 39180 - DNA, 16 bp, H. sapiens
agctttgaagaaagca

SEQ ID NO: 39181 - DNA, 16 bp, H. sapiens
agctttgaagaaagta

SEQ ID NO: 39182 - DNA, 19 bp, H. sapiens
agctttgaatgcagcccaa

SEQ ID NO: 39183 - DNA, 16 bp, H. sapiens
agctttgagaagaggg

SEQ ID NO: 39184 - DNA, 16 bp, H. sapiens
agctttgaggcctatg

SEQ ID NO: 39185 - DNA, 16 bp, H. sapiens
agctttgcaggccata

SEQ ID NO: 39186 - DNA, 16 bp, H. sapiens
agctttgccaacatgg

SEQ ID NO: 39187 - DNA, 16 bp, H. sapiens
agctttgccagcatct

SEQ ID NO: 39188 - DNA, 16 bp, H. sapiens
agctttgcccctgtgg

SEQ ID NO: 39189 - DNA, 16 bp, H. sapiens
agctttggccactgga

SEQ ID NO: 39190 - DNA, 16 bp, H. sapiens
agctttggcctcctgg

SEQ ID NO: 39191 - DNA, 16 bp, H. sapiens
agctttgggtttcatt

SEQ ID NO: 39192 - DNA, 16 bp, H. sapiens
agctttgtcccagaag

SEQ ID NO: 39193 - DNA, 16 bp, H. sapiens
agctttgtgaccttga

SEQ ID NO: 39194 - DNA, 16 bp, H. sapiens
agctttgtgaccttgg

SEQ ID NO: 39195 - DNA, 16 bp, H. sapiens
agctttgtgactttgg

SEQ ID NO: 39196 - DNA, 16 bp, H. sapiens
agctttgttcctttgg

SEQ ID NO: 39197 - DNA, 16 bp, H. sapiens
agctttgttttcttct

SEQ ID NO: 39198 - DNA, 16 bp, H. sapiens
agctttgtttttaaaa

SEQ ID NO: 39199 - DNA, 16 bp, H. sapiens
agcttttaaaaaaaga

SEQ ID NO: 39200 - DNA, 16 bp, H. sapiens
agcttttaaaaaaatt

SEQ ID NO: 39201 - DNA, 16 bp, H. sapiens
agcttttaaaaactga

SEQ ID NO: 39202 - DNA, 16 bp, H. sapiens
agcttttaaaaataga

SEQ ID NO: 39203 - DNA, 16 bp, H. sapiens
agcttttaaaaatatt

SEQ ID NO: 39204 - DNA, 16 bp, H. sapiens
agcttttaaaatttat

SEQ ID NO: 39205 - DNA, 16 bp, H. sapiens
agcttttaaagaatta

SEQ ID NO: 39206 - DNA, 16 bp, H. sapiens
agcttttaatgtttaa

SEQ ID NO: 39207 - DNA, 16 bp, H. sapiens
agcttttatcttccct

SEQ ID NO: 39208 - DNA, 16 bp, H. sapiens
agcttttctctgcttt

SEQ ID NO: 39209 - DNA, 16 bp, H. sapiens
agcttttctttttcct

SEQ ID NO: 39210 - DNA, 17 bp, H. sapiens
agcttttgaaagtgttt

SEQ ID NO: 39211 - DNA, 16 bp, H. sapiens
agcttttgaatatgtt

SEQ ID NO: 39212 - DNA, 16 bp, H. sapiens
agcttttgaatttttt

SEQ ID NO: 39213 - DNA, 16 bp, H. sapiens
agcttttgattgaaag

SEQ ID NO: 39214 - DNA, 16 bp, H. sapiens
agcttttggagaaact

SEQ ID NO: 39215 - DNA, 16 bp, H. sapiens
agcttttgttcatatg

SEQ ID NO: 39216 - DNA, 16 bp, H. sapiens
agcttttgtttcattt

SEQ ID NO: 39217 - DNA, 16 bp, H. sapiens
agctttttaaaaacag

SEQ ID NO: 39218 - DNA, 16 bp, H. sapiens
agctttttaaaaatac

SEQ ID NO: 39219 - DNA, 16 bp, H. sapiens
agctttttaaatatat

SEQ ID NO: 39220 - DNA, 16 bp, H. sapiens
agctttttaaattttt

SEQ ID NO: 39221 - DNA, 16 bp, H. sapiens
agctttttattttgaa

SEQ ID NO: 39222 - DNA, 16 bp, H. sapiens
agctttttcacctttc

SEQ ID NO: 39223 - DNA, 16 bp, H. sapiens
agctttttgaatgagt

SEQ ID NO: 39224 - DNA, 16 bp, H. sapiens
agctttttgatgggct

SEQ ID NO: 39225 - DNA, 16 bp, H. sapiens
agctttttggtttaat

SEQ ID NO: 39226 - DNA, 16 bp, H. sapiens
agcttttttcataatt

SEQ ID NO: 39227 - DNA, 16 bp, H. sapiens
agcttttttgaggtat

SEQ ID NO: 39228 - DNA, 16 bp, H. sapiens
agctttttttcctatg

SEQ ID NO: 39229 - DNA, 16 bp, H. sapiens
aggaaaaaaaatccat

SEQ ID NO: 39230 - DNA, 16 bp, H. sapiens
aggaaaaaaaatcttt

SEQ ID NO: 39231 - DNA, 16 bp, H. sapiens
aggaaaaaaaattcag

SEQ ID NO: 39232 - DNA, 16 bp, H. sapiens
aggaaaaaaagatttt

SEQ ID NO: 39233 - DNA, 16 bp, H. sapiens
aggaaaaaaataatct

SEQ ID NO: 39234 - DNA, 16 bp, H. sapiens
aggaaaaaaatccaga

SEQ ID NO: 39235 - DNA, 16 bp, H. sapiens
aggaaaaaaatgcatt

SEQ ID NO: 39236 - DNA, 16 bp, H. sapiens
aggaaaaaaatgccaa

SEQ ID NO: 39237 - DNA, 16 bp, H. sapiens
aggaaaaaaatggttt

SEQ ID NO: 39238 - DNA, 16 bp, H. sapiens
aggaaaaaacaactcc

SEQ ID NO: 39239 - DNA, 16 bp, H. sapiens
aggaaaaaatctcaga

SEQ ID NO: 39240 - DNA, 16 bp, H. sapiens
aggaaaaaattgtttc

SEQ ID NO: 39241 - DNA, 16 bp, H. sapiens
aggaaaaacagaaatt

SEQ ID NO: 39242 - DNA, 16 bp, H. sapiens
aggaaaaacagtaaca

SEQ ID NO: 39243 - DNA, 16 bp, H. sapiens
aggaaaaacagtcttg

SEQ ID NO: 39244 - DNA, 16 bp, H. sapiens
aggaaaaacagtttgt

SEQ ID NO: 39245 - DNA, 16 bp, H. sapiens
aggaaaaacctgcccc

SEQ ID NO: 39246 - DNA, 16 bp, H. sapiens
aggaaaaataaaactg

SEQ ID NO: 39247 - DNA, 16 bp, H. sapiens
aggaaaaataaaactt

SEQ ID NO: 39248 - DNA, 16 bp, H. sapiens
aggaaaaataaatgtt

SEQ ID NO: 39249 - DNA, 16 bp, H. sapiens
aggaaaaataagtttt

SEQ ID NO: 39250 - DNA, 16 bp, H. sapiens
aggaaaaatagctcat

SEQ ID NO: 39251 - DNA, 16 bp, H. sapiens
aggaaaaataggacag

SEQ ID NO: 39252 - DNA, 16 bp, H. sapiens
aggaaaaatgaggctg

SEQ ID NO: 39253 - DNA, 16 bp, H. sapiens
aggaaaacaaaatgtt

SEQ ID NO: 39254 - DNA, 16 bp, H. sapiens
aggaaaacagcctgtt

SEQ ID NO: 39255 - DNA, 16 bp, H. sapiens
aggaaaacatcacaca

SEQ ID NO: 39256 - DNA, 16 bp, H. sapiens
aggaaaacattctttt

SEQ ID NO: 39257 - DNA, 16 bp, H. sapiens
aggaaaacattgtttt

SEQ ID NO: 39258 - DNA, 16 bp, H. sapiens
aggaaaacatttttat

SEQ ID NO: 39259 - DNA, 16 bp, H. sapiens
aggaaaacatttttct

SEQ ID NO: 39260 - DNA, 16 bp, H. sapiens
aggaaaaccaggagag

SEQ ID NO: 39261 - DNA, 16 bp, H. sapiens
aggaaaaccttaccaa

SEQ ID NO: 39262 - DNA, 16 bp, H. sapiens
aggaaaactgaaaaat

SEQ ID NO: 39263 - DNA, 16 bp, H. sapiens
aggaaaactgagaaaa

SEQ ID NO: 39264 - DNA, 16 bp, H. sapiens
aggaaaactgaggccc

SEQ ID NO: 39265 - DNA, 16 bp, H. sapiens
aggaaaacttagaact

SEQ ID NO: 39266 - DNA, 16 bp, H. sapiens
aggaaaacttttaaaa

SEQ ID NO: 39267 - DNA, 16 bp, H. sapiens
aggaaaagaaaactgg

SEQ ID NO: 39268 - DNA, 16 bp, H. sapiens
aggaaaagaaactatc

SEQ ID NO: 39269 - DNA, 16 bp, H. sapiens
aggaaaagaaatattt

SEQ ID NO: 39270 - DNA, 16 bp, H. sapiens
aggaaaagaaattgtt

SEQ ID NO: 39271 - DNA, 16 bp, H. sapiens
aggaaaagaacaaagt

SEQ ID NO: 39272 - DNA, 16 bp, H. sapiens
aggaaaagaagaaatc

SEQ ID NO: 39273 - DNA, 16 bp, H. sapiens
aggaaaagaagaagtc

SEQ ID NO: 39274 - DNA, 16 bp, H. sapiens
aggaaaagaagtaatt

SEQ ID NO: 39275 - DNA, 16 bp, H. sapiens
aggaaaagaattcatt

SEQ ID NO: 39276 - DNA, 17 bp, H. sapiens
aggaaaagaatttagtg

SEQ ID NO: 39277 - DNA, 16 bp, H. sapiens
aggaaaagagaaagtc

SEQ ID NO: 39278 - DNA, 16 bp, H. sapiens
aggaaaagaggaagtt

SEQ ID NO: 39279 - DNA, 16 bp, H. sapiens
aggaaaagatgttcaa

SEQ ID NO: 39280 - DNA, 16 bp, H. sapiens
aggaaaagatttctta

SEQ ID NO: 39281 - DNA, 16 bp, H. sapiens
aggaaaaggaaaactg

SEQ ID NO: 39282 - DNA, 16 bp, H. sapiens
aggaaaagtaaacttt

SEQ ID NO: 39283 - DNA, 16 bp, H. sapiens
aggaaaagtcaaagaa

SEQ ID NO: 39284 - DNA, 16 bp, H. sapiens
aggaaaagtggaagct

SEQ ID NO: 39285 - DNA, 16 bp, H. sapiens
aggaaaagtgtaatgt

SEQ ID NO: 39286 - DNA, 16 bp, H. sapiens
aggaaaagtttggaac

SEQ ID NO: 39287 - DNA, 16 bp, H. sapiens
aggaaaataaaagtca

SEQ ID NO: 39288 - DNA, 16 bp, H. sapiens
aggaaaataaatctcg

SEQ ID NO: 39289 - DNA, 16 bp, H. sapiens
aggaaaataaatctta

SEQ ID NO: 39290 - DNA, 16 bp, H. sapiens
aggaaaataattattt

SEQ ID NO: 39291 - DNA, 16 bp, H. sapiens
aggaaaataattttcc

SEQ ID NO: 39292 - DNA, 16 bp, H. sapiens
aggaaaatacaaatat

SEQ ID NO: 39293 - DNA, 16 bp, H. sapiens
aggaaaatacaaattt

SEQ ID NO: 39294 - DNA, 16 bp, H. sapiens
aggaaaatagcttgaa

SEQ ID NO: 39295 - DNA, 16 bp, H. sapiens
aggaaaatatacaaat

SEQ ID NO: 39296 - DNA, 16 bp, H. sapiens
aggaaaatatattcaa

SEQ ID NO: 39297 - DNA, 16 bp, H. sapiens
aggaaaatatcttggg

SEQ ID NO: 39298 - DNA, 16 bp, H. sapiens
aggaaaatatgaacaa

SEQ ID NO: 39299 - DNA, 16 bp, H. sapiens
aggaaaatatgagaat

SEQ ID NO: 39300 - DNA, 16 bp, H. sapiens
aggaaaatattatttc

SEQ ID NO: 39301 - DNA, 16 bp, H. sapiens
aggaaaatattcaaaa

SEQ ID NO: 39302 - DNA, 16 bp, H. sapiens
aggaaaatatttcctt

SEQ ID NO: 39303 - DNA, 16 bp, H. sapiens
aggaaaatattttcta

SEQ ID NO: 39304 - DNA, 16 bp, H. sapiens
aggaaaatctcttgaa

SEQ ID NO: 39305 - DNA, 16 bp, H. sapiens
aggaaaatgaatcatt

SEQ ID NO: 39306 - DNA, 16 bp, H. sapiens
aggaaaatgaggctga

SEQ ID NO: 39307 - DNA, 16 bp, H. sapiens
aggaaaatgatcagaa

SEQ ID NO: 39308 - DNA, 16 bp, H. sapiens
aggaaaatggataaat

SEQ ID NO: 39309 - DNA, 16 bp, H. sapiens
aggaaaatgtgaccca

SEQ ID NO: 39310 - DNA, 16 bp, H. sapiens
aggaaaatgtgtgaaa

SEQ ID NO: 39311 - DNA, 16 bp, H. sapiens
aggaaaatgtttccag

SEQ ID NO: 39312 - DNA, 16 bp, H. sapiens
aggaaaattattttct

SEQ ID NO: 39313 - DNA, 16 bp, H. sapiens
aggaaaattcagaaaa

SEQ ID NO: 39314 - DNA, 16 bp, H. sapiens
aggaaaattccagaaa

SEQ ID NO: 39315 - DNA, 16 bp, H. sapiens
aggaaaattgataaat

SEQ ID NO: 39316 - DNA, 16 bp, H. sapiens
aggaaaattgtttgaa

SEQ ID NO: 39317 - DNA, 16 bp, H. sapiens
aggaaaatttacagca

SEQ ID NO: 39318 - DNA, 16 bp, H. sapiens
aggaaacaaagcttag

SEQ ID NO: 39319 - DNA, 16 bp, H. sapiens
aggaaacaacaggggc

SEQ ID NO: 39320 - DNA, 16 bp, H. sapiens
aggaaacactaaacat

SEQ ID NO: 39321 - DNA, 16 bp, H. sapiens
aggaaacagaaaactt

SEQ ID NO: 39322 - DNA, 16 bp, H. sapiens
aggaaacagaagccca

SEQ ID NO: 39323 - DNA, 16 bp, H. sapiens
aggaaacagacacaga

SEQ ID NO: 39324 - DNA, 16 bp, H. sapiens
aggaaacagagacaca

SEQ ID NO: 39325 - DNA, 16 bp, H. sapiens
aggaaacagattcttc

SEQ ID NO: 39326 - DNA, 16 bp, H. sapiens
aggaaacagcaaatgc

SEQ ID NO: 39327 - DNA, 16 bp, H. sapiens
aggaaacagcagacac

SEQ ID NO: 39328 - DNA, 16 bp, H. sapiens
aggaaacatcagataa

SEQ ID NO: 39329 - DNA, 16 bp, H. sapiens
aggaaacatgactggg

SEQ ID NO: 39330 - DNA, 16 bp, H. sapiens
aggaaacatgatgctg

SEQ ID NO: 39331 - DNA, 16 bp, H. sapiens
aggaaacattaaaaat

SEQ ID NO: 39332 - DNA, 16 bp, H. sapiens
aggaaacattaaaatg

SEQ ID NO: 39333 - DNA, 16 bp, H. sapiens
aggaaacatttattta

SEQ ID NO: 39334 - DNA, 16 bp, H. sapiens
aggaaacatttgaaaa

SEQ ID NO: 39335 - DNA, 16 bp, H. sapiens
aggaaacattttcaga

SEQ ID NO: 39336 - DNA, 16 bp, H. sapiens
aggaaaccgagactca

SEQ ID NO: 39337 - DNA, 16 bp, H. sapiens
aggaaactaacacaga

SEQ ID NO: 39338 - DNA, 16 bp, H. sapiens
aggaaactaacattta

SEQ ID NO: 39339 - DNA, 16 bp, H. sapiens
aggaaactaaggctca

SEQ ID NO: 39340 - DNA, 16 bp, H. sapiens
aggaaactaatataga

SEQ ID NO: 39341 - DNA, 16 bp, H. sapiens
aggaaactcaatgaaa

SEQ ID NO: 39342 - DNA, 16 bp, H. sapiens
aggaaactgaagcata

SEQ ID NO: 39343 - DNA, 16 bp, H. sapiens
aggaaactgaagcatg

SEQ ID NO: 39344 - DNA, 16 bp, H. sapiens
aggaaactgaagcctg

SEQ ID NO: 39345 - DNA, 16 bp, H. sapiens
aggaaactgaatctca

SEQ ID NO: 39346 - DNA, 16 bp, H. sapiens
aggaaactgaattcaa

SEQ ID NO: 39347 - DNA, 16 bp, H. sapiens
aggaaactgacactca

SEQ ID NO: 39348 - DNA, 16 bp, H. sapiens
aggaaactgaccctca

SEQ ID NO: 39349 - DNA, 16 bp, H. sapiens
aggaaactgagacttt

SEQ ID NO: 39350 - DNA, 16 bp, H. sapiens
aggaaactgagatcca

SEQ ID NO: 39351 - DNA, 16 bp, H. sapiens
aggaaactgaggcaga

SEQ ID NO: 39352 - DNA, 16 bp, H. sapiens
aggaaactgaggccag

SEQ ID NO: 39353 - DNA, 16 bp, H. sapiens
aggaaactgaggctcc

SEQ ID NO: 39354 - DNA, 16 bp, H. sapiens
aggaaactgcagcaca

SEQ ID NO: 39355 - DNA, 16 bp, H. sapiens
aggaaacttacagtta

SEQ ID NO: 39356 - DNA, 16 bp, H. sapiens
aggaaagaaaaatctt

SEQ ID NO: 39357 - DNA, 16 bp, H. sapiens
aggaaagaaaaatgca

SEQ ID NO: 39358 - DNA, 16 bp, H. sapiens
aggaaagaaaaatgtt

SEQ ID NO: 39359 - DNA, 16 bp, H. sapiens
aggaaagaaaacagtt

SEQ ID NO: 39360 - DNA, 16 bp, H. sapiens
aggaaagaaaactaca

SEQ ID NO: 39361 - DNA, 16 bp, H. sapiens
aggaaagaaaattcca

SEQ ID NO: 39362 - DNA, 16 bp, H. sapiens
aggaaagaaagaacat

SEQ ID NO: 39363 - DNA, 16 bp, H. sapiens
aggaaagaaatcaaat

SEQ ID NO: 39364 - DNA, 16 bp, H. sapiens
aggaaagaaattctga

SEQ ID NO: 39365 - DNA, 16 bp, H. sapiens
aggaaagaagacatct

SEQ ID NO: 39366 - DNA, 16 bp, H. sapiens
aggaaagaagccacct

SEQ ID NO: 39367 - DNA, 16 bp, H. sapiens
aggaaagaatctcaga

SEQ ID NO: 39368 - DNA, 16 bp, H. sapiens
aggaaagacaattttg

SEQ ID NO: 39369 - DNA, 16 bp, H. sapiens
aggaaagacagaaaat

SEQ ID NO: 39370 - DNA, 16 bp, H. sapiens
aggaaagacagacagg

SEQ ID NO: 39371 - DNA, 16 bp, H. sapiens
aggaaagacatttaat

SEQ ID NO: 39372 - DNA, 16 bp, H. sapiens
aggaaagactgaaaaa

SEQ ID NO: 39373 - DNA, 16 bp, H. sapiens
aggaaagactgaataa

SEQ ID NO: 39374 - DNA, 16 bp, H. sapiens
aggaaagactgagaaa

SEQ ID NO: 39375 - DNA, 16 bp, H. sapiens
aggaaagagcattttc

SEQ ID NO: 39376 - DNA, 16 bp, H. sapiens
aggaaagaggttttat

SEQ ID NO: 39377 - DNA, 16 bp, H. sapiens
aggaaagagtggcatg

SEQ ID NO: 39378 - DNA, 16 bp, H. sapiens
aggaaagatccaaaac

SEQ ID NO: 39379 - DNA, 16 bp, H. sapiens
aggaaagcaaaatttt

SEQ ID NO: 39380 - DNA, 16 bp, H. sapiens
aggaaagcacaccaaa

SEQ ID NO: 39381 - DNA, 16 bp, H. sapiens
aggaaagctctggctg

SEQ ID NO: 39382 - DNA, 16 bp, H. sapiens
aggaaaggaaaacatg

SEQ ID NO: 39383 - DNA, 16 bp, H. sapiens
aggaaagggaattctc

SEQ ID NO: 39384 - DNA, 16 bp, H. sapiens
aggaaaggtagaatgg

SEQ ID NO: 39385 - DNA, 21 bp, H. sapiens
aggaaagtctttgaagaggaa

SEQ ID NO: 39386 - DNA, 16 bp, H. sapiens
aggaaagtgaggcaca

SEQ ID NO: 39387 - DNA, 16 bp, H. sapiens
aggaaagtgtgttgtt

SEQ ID NO: 39388 - DNA, 16 bp, H. sapiens
aggaaagtttgagaaa

SEQ ID NO: 39389 - DNA, 16 bp, H. sapiens
aggaaataaaacattt

SEQ ID NO: 39390 - DNA, 16 bp, H. sapiens
aggaaataaaatcaat

SEQ ID NO: 39391 - DNA, 16 bp, H. sapiens
aggaaataaaattgtc

SEQ ID NO: 39392 - DNA, 16 bp, H. sapiens
aggaaataaacatttt

SEQ ID NO: 39393 - DNA, 16 bp, H. sapiens
aggaaataaagacaca

SEQ ID NO: 39394 - DNA, 16 bp, H. sapiens
aggaaataaaggtatt

SEQ ID NO: 39395 - DNA, 16 bp, H. sapiens
aggaaataaatgtata

SEQ ID NO: 39396 - DNA, 16 bp, H. sapiens
aggaaataactaaaat

SEQ ID NO: 39397 - DNA, 16 bp, H. sapiens
aggaaataatcttaag

SEQ ID NO: 39398 - DNA, 16 bp, H. sapiens
aggaaataatgaagat

SEQ ID NO: 39399 - DNA, 16 bp, H. sapiens
aggaaataccattcag

SEQ ID NO: 39400 - DNA, 16 bp, H. sapiens
aggaaataccattcta

SEQ ID NO: 39401 - DNA, 16 bp, H. sapiens
aggaaataccattttg

SEQ ID NO: 39402 - DNA, 16 bp, H. sapiens
aggaaatacccttctt

SEQ ID NO: 39403 - DNA, 16 bp, H. sapiens
aggaaatacttccaaa

SEQ ID NO: 39404 - DNA, 16 bp, H. sapiens
aggaaatagaaacaca

SEQ ID NO: 39405 - DNA, 16 bp, H. sapiens
aggaaatagaggactt

SEQ ID NO: 39406 - DNA, 16 bp, H. sapiens
aggaaatagaggcaca

SEQ ID NO: 39407 - DNA, 16 bp, H. sapiens
aggaaatatatatgtg

SEQ ID NO: 39408 - DNA, 16 bp, H. sapiens
aggaaatatattcaga

SEQ ID NO: 39409 - DNA, 16 bp, H. sapiens
aggaaatatcattctg

SEQ ID NO: 39410 - DNA, 16 bp, H. sapiens
aggaaatatggagaac

SEQ ID NO: 39411 - DNA, 16 bp, H. sapiens
aggaaatatttaaaga

SEQ ID NO: 39412 - DNA, 16 bp, H. sapiens
aggaaatatttccaaa

SEQ ID NO: 39413 - DNA, 16 bp, H. sapiens
aggaaatatttctaaa

SEQ ID NO: 39414 - DNA, 16 bp, H. sapiens
aggaaatattttcatt

SEQ ID NO: 39415 - DNA, 16 bp, H. sapiens
aggaaatcaagaaagc

SEQ ID NO: 39416 - DNA, 16 bp, H. sapiens
aggaaatcaatatatt

SEQ ID NO: 39417 - DNA, 16 bp, H. sapiens
aggaaatcacaagaat

SEQ ID NO: 39418 - DNA, 16 bp, H. sapiens
aggaaatcagaaaaat

SEQ ID NO: 39419 - DNA, 16 bp, H. sapiens
aggaaatcagaaagga

SEQ ID NO: 39420 - DNA, 16 bp, H. sapiens
aggaaatcagtacatt

SEQ ID NO: 39421 - DNA, 16 bp, H. sapiens
aggaaatccaaaacct

SEQ ID NO: 39422 - DNA, 16 bp, H. sapiens
aggaaatctacaaacc

SEQ ID NO: 39423 - DNA, 16 bp, H. sapiens
aggaaatctatttttt

SEQ ID NO: 39424 - DNA, 17 bp, H. sapiens
aggaaatctcaactgca

SEQ ID NO: 39425 - DNA, 16 bp, H. sapiens
aggaaatgaaaatcaa

SEQ ID NO: 39426 - DNA, 16 bp, H. sapiens
aggaaatgaaatattt

SEQ ID NO: 39427 - DNA, 16 bp, H. sapiens
aggaaatgaaggcaca

SEQ ID NO: 39428 - DNA, 16 bp, H. sapiens
aggaaatgaaggcaga

SEQ ID NO: 39429 - DNA, 16 bp, H. sapiens
aggaaatgaagggtat

SEQ ID NO: 39430 - DNA, 16 bp, H. sapiens
aggaaatgaataaatg

SEQ ID NO: 39431 - DNA, 16 bp, H. sapiens
aggaaatgcaaataaa

SEQ ID NO: 39432 - DNA, 16 bp, H. sapiens
aggaaatgcagagaaa

SEQ ID NO: 39433 - DNA, 16 bp, H. sapiens
aggaaatgccattctg

SEQ ID NO: 39434 - DNA, 16 bp, H. sapiens
aggaaatgctcaaaga

SEQ ID NO: 39435 - DNA, 16 bp, H. sapiens
aggaaatgctgagaga

SEQ ID NO: 39436 - DNA, 16 bp, H. sapiens
aggaaatggaagaaca

SEQ ID NO: 39437 - DNA, 16 bp, H. sapiens
aggaaatggagacaca

SEQ ID NO: 39438 - DNA, 16 bp, H. sapiens
aggaaatggaggaaat

SEQ ID NO: 39439 - DNA, 16 bp, H. sapiens
aggaaatggattttcc

SEQ ID NO: 39440 - DNA, 16 bp, H. sapiens
aggaaatggggagatg

SEQ ID NO: 39441 - DNA, 16 bp, H. sapiens
aggaaatgtaaattaa

SEQ ID NO: 39442 - DNA, 16 bp, H. sapiens
aggaaatgttttcttc

SEQ ID NO: 39443 - DNA, 16 bp, H. sapiens
aggaaatgttttcttt

SEQ ID NO: 39444 - DNA, 16 bp, H. sapiens
aggaaattaaaatgca

SEQ ID NO: 39445 - DNA, 16 bp, H. sapiens
aggaaattaaaatgtt

SEQ ID NO: 39446 - DNA, 16 bp, H. sapiens
aggaaattaaatttta

SEQ ID NO: 39447 - DNA, 16 bp, H. sapiens
aggaaattaagaaaca

SEQ ID NO: 39448 - DNA, 16 bp, H. sapiens
aggaaattataaaaca

SEQ ID NO: 39449 - DNA, 16 bp, H. sapiens
aggaaattataaaagt

SEQ ID NO: 39450 - DNA, 16 bp, H. sapiens
aggaaattcctagtga

SEQ ID NO: 39451 - DNA, 16 bp, H. sapiens
aggaaattcttcctaa

SEQ ID NO: 39452 - DNA, 16 bp, H. sapiens
aggaaattgaagctca

SEQ ID NO: 39453 - DNA, 16 bp, H. sapiens
aggaaattgaggccca

SEQ ID NO: 39454 - DNA, 16 bp, H. sapiens
aggaaatttagaaaat

SEQ ID NO: 39455 - DNA, 16 bp, H. sapiens
aggaaatttataatca

SEQ ID NO: 39456 - DNA, 16 bp, H. sapiens
aggaaatttggaaaat

SEQ ID NO: 39457 - DNA, 16 bp, H. sapiens
aggaaattttaaaagt

SEQ ID NO: 39458 - DNA, 16 bp, H. sapiens
aggaaattttatagca

SEQ ID NO: 39459 - DNA, 16 bp, H. sapiens
aggaacaaacaactct

SEQ ID NO: 39460 - DNA, 16 bp, H. sapiens
aggaacaaagtcacat

SEQ ID NO: 39461 - DNA, 16 bp, H. sapiens
aggaacaaattctgga

SEQ ID NO: 39462 - DNA, 19 bp, H. sapiens
aggaacaactggtaccagc

SEQ ID NO: 39463 - DNA, 16 bp, H. sapiens
aggaacaagaattgct

SEQ ID NO: 39464 - DNA, 16 bp, H. sapiens
aggaacacagccaaac

SEQ ID NO: 39465 - DNA, 16 bp, H. sapiens
aggaacaccagggtcc

SEQ ID NO: 39466 - DNA, 24 bp, H. sapiens
aggaacacctggcccacccagggc

SEQ ID NO: 39467 - DNA, 16 bp, H. sapiens
aggaacagaaaaatca

SEQ ID NO: 39468 - DNA, 16 bp, H. sapiens
aggaacagaaaaccag

SEQ ID NO: 39469 - DNA, 16 bp, H. sapiens
aggaacagaaaactaa

SEQ ID NO: 39470 - DNA, 16 bp, H. sapiens
aggaacagaaagttaa

SEQ ID NO: 39471 - DNA, 16 bp, H. sapiens
aggaacagaagaaata

SEQ ID NO: 39472 - DNA, 16 bp, H. sapiens
aggaacagcaaggagg

SEQ ID NO: 39473 - DNA, 16 bp, H. sapiens
aggaacaggagaggcc

SEQ ID NO: 39474 - DNA, 16 bp, H. sapiens
aggaacaggccaaaaa

SEQ ID NO: 39475 - DNA, 16 bp, H. sapiens
aggaacagtttgactt

SEQ ID NO: 39476 - DNA, 16 bp, H. sapiens
aggaacataaatgacc

SEQ ID NO: 39477 - DNA, 16 bp, H. sapiens
aggaacatggctcact

SEQ ID NO: 39478 - DNA, 16 bp, H. sapiens
aggaaccaaccctgcc

SEQ ID NO: 39479 - DNA, 16 bp, H. sapiens
aggaaccacagagccc

SEQ ID NO: 39480 - DNA, 16 bp, H. sapiens
aggaaccagctctgcc

SEQ ID NO: 39481 - DNA, 16 bp, H. sapiens
aggaaccatctatacc

SEQ ID NO: 39482 - DNA, 16 bp, H. sapiens
aggaacccagtgggag

SEQ ID NO: 39483 - DNA, 16 bp, H. sapiens
aggaaccgagggagag

SEQ ID NO: 39484 - DNA, 16 bp, H. sapiens
aggaacctaaccctgt

SEQ ID NO: 39485 - DNA, 16 bp, H. sapiens
aggaacctgaggcagg

SEQ ID NO: 39486 - DNA, 16 bp, H. sapiens
aggaacctggctgcac

SEQ ID NO: 39487 - DNA, 19 bp, H. sapiens
aggaacgaacaactccaga

SEQ ID NO: 39488 - DNA, 16 bp, H. sapiens
aggaactgaaagaaaa

SEQ ID NO: 39489 - DNA, 16 bp, H. sapiens
aggaactgccagactt

SEQ ID NO: 39490 - DNA, 16 bp, H. sapiens
aggaactgccatactg

SEQ ID NO: 39491 - DNA, 16 bp, H. sapiens
aggaactggaaaaaca

SEQ ID NO: 39492 - DNA, 16 bp, H. sapiens
aggaactggccatttt

SEQ ID NO: 39493 - DNA, 16 bp, H. sapiens
aggaactgtcaaacac

SEQ ID NO: 39494 - DNA, 16 bp, H. sapiens
aggaacttgttagaaa

SEQ ID NO: 39495 - DNA, 16 bp, H. sapiens
aggaactttccttcta

SEQ ID NO: 39496 - DNA, 16 bp, H. sapiens
aggaagaaaaatcata

SEQ ID NO: 39497 - DNA, 16 bp, H. sapiens
aggaagaaaactagga

SEQ ID NO: 39498 - DNA, 16 bp, H. sapiens
aggaagaaaatcaaag

SEQ ID NO: 39499 - DNA, 16 bp, H. sapiens
aggaagaaaattcaga

SEQ ID NO: 39500 - DNA, 16 bp, H. sapiens
aggaagaaacactgga

SEQ ID NO: 39501 - DNA, 16 bp, H. sapiens
aggaagaaacagcatc

SEQ ID NO: 39502 - DNA, 16 bp, H. sapiens
aggaagaaactccaga

SEQ ID NO: 39503 - DNA, 16 bp, H. sapiens
aggaagaaactgaaaa

SEQ ID NO: 39504 - DNA, 16 bp, H. sapiens
aggaagaaactgaaac

SEQ ID NO: 39505 - DNA, 16 bp, H. sapiens
aggaagaaactgaatc

SEQ ID NO: 39506 - DNA, 16 bp, H. sapiens
aggaagaaactgcaga

SEQ ID NO: 39507 - DNA, 16 bp, H. sapiens
aggaagaaataaaact

SEQ ID NO: 39508 - DNA, 16 bp, H. sapiens
aggaagaaatacaaat

SEQ ID NO: 39509 - DNA, 16 bp, H. sapiens
aggaagaaatcaaatc

SEQ ID NO: 39510 - DNA, 16 bp, H. sapiens
aggaagaaatcaagaa

SEQ ID NO: 39511 - DNA, 16 bp, H. sapiens
aggaagaaatggaaac

SEQ ID NO: 39512 - DNA, 16 bp, H. sapiens
aggaagaaatggaatc

SEQ ID NO: 39513 - DNA, 16 bp, H. sapiens
aggaagaaattcaaaa

SEQ ID NO: 39514 - DNA, 16 bp, H. sapiens
aggaagaaattgaaat

SEQ ID NO: 39515 - DNA, 16 bp, H. sapiens
aggaagaaccaatatt

SEQ ID NO: 39516 - DNA, 16 bp, H. sapiens
aggaagaacttgaatc

SEQ ID NO: 39517 - DNA, 16 bp, H. sapiens
aggaagaagaaaacat

SEQ ID NO: 39518 - DNA, 16 bp, H. sapiens
aggaagaagaaaattt

SEQ ID NO: 39519 - DNA, 16 bp, H. sapiens
aggaagaagacagcca

SEQ ID NO: 39520 - DNA, 16 bp, H. sapiens
aggaagaagataaatc

SEQ ID NO: 39521 - DNA, 16 bp, H. sapiens
aggaagaagatgaatc

SEQ ID NO: 39522 - DNA, 16 bp, H. sapiens
aggaagaagatggcca

SEQ ID NO: 39523 - DNA, 16 bp, H. sapiens
aggaagaagcagcagc

SEQ ID NO: 39524 - DNA, 16 bp, H. sapiens
aggaagaagctgaggc

SEQ ID NO: 39525 - DNA, 16 bp, H. sapiens
aggaagaatatatttt

SEQ ID NO: 39526 - DNA, 16 bp, H. sapiens
aggaagacactctgga

SEQ ID NO: 39527 - DNA, 16 bp, H. sapiens
aggaagacagagtgag

SEQ ID NO: 39528 - DNA, 16 bp, H. sapiens
aggaagacagcaagag

SEQ ID NO: 39529 - DNA, 16 bp, H. sapiens
aggaagacccccatct

SEQ ID NO: 39530 - DNA, 16 bp, H. sapiens
aggaagactcaatatc

SEQ ID NO: 39531 - DNA, 16 bp, H. sapiens
aggaagacttcctgga

SEQ ID NO: 39532 - DNA, 16 bp, H. sapiens
aggaagagaaaatcaa

SEQ ID NO: 39533 - DNA, 16 bp, H. sapiens
aggaagagagaattct

SEQ ID NO: 39534 - DNA, 16 bp, H. sapiens
aggaagagagccctcc

SEQ ID NO: 39535 - DNA, 16 bp, H. sapiens
aggaagagaggaactc

SEQ ID NO: 39536 - DNA, 16 bp, H. sapiens
aggaagagatccagtt

SEQ ID NO: 39537 - DNA, 16 bp, H. sapiens
aggaagagcaaaggca

SEQ ID NO: 39538 - DNA, 16 bp, H. sapiens
aggaagagcagtgtgg

SEQ ID NO: 39539 - DNA, 16 bp, H. sapiens
aggaagagctgatgtt

SEQ ID NO: 39540 - DNA, 16 bp, H. sapiens
aggaagagctgggcct

SEQ ID NO: 39541 - DNA, 16 bp, H. sapiens
aggaagaggaaattcc

SEQ ID NO: 39542 - DNA, 16 bp, H. sapiens
aggaagaggaacaggc

SEQ ID NO: 39543 - DNA, 16 bp, H. sapiens
aggaagaggaagcagc

SEQ ID NO: 39544 - DNA, 16 bp, H. sapiens
aggaagaggagaggcc

SEQ ID NO: 39545 - DNA, 16 bp, H. sapiens
aggaagaggaggagct

SEQ ID NO: 39546 - DNA, 16 bp, H. sapiens
aggaagaggaggctgc

SEQ ID NO: 39547 - DNA, 16 bp, H. sapiens
aggaagaggccaggtg

SEQ ID NO: 39548 - DNA, 16 bp, H. sapiens
aggaagaggctgaggc

SEQ ID NO: 39549 - DNA, 16 bp, H. sapiens
aggaagagtcagcaga

SEQ ID NO: 39550 - DNA, 16 bp, H. sapiens
aggaagagtcttggtt

SEQ ID NO: 39551 - DNA, 16 bp, H. sapiens
aggaagagtttttaaa

SEQ ID NO: 39552 - DNA, 16 bp, H. sapiens
aggaagatagcttgag

SEQ ID NO: 39553 - DNA, 16 bp, H. sapiens
aggaagatatagaatc

SEQ ID NO: 39554 - DNA, 16 bp, H. sapiens
aggaagatcacttgag

SEQ ID NO: 39555 - DNA, 16 bp, H. sapiens
aggaagatctgccaag

SEQ ID NO: 39556 - DNA, 16 bp, H. sapiens
aggaagatgcaaagga

SEQ ID NO: 39557 - DNA, 16 bp, H. sapiens
aggaagatgtggaaaa

SEQ ID NO: 39558 - DNA, 16 bp, H. sapiens
aggaagatgtgggaaa

SEQ ID NO: 39559 - DNA, 16 bp, H. sapiens
aggaagattaaaaatg

SEQ ID NO: 39560 - DNA, 16 bp, H. sapiens
aggaagattacttgag

SEQ ID NO: 39561 - DNA, 16 bp, H. sapiens
aggaagattcaatatt

SEQ ID NO: 39562 - DNA, 16 bp, H. sapiens
aggaagattttctttt

SEQ ID NO: 39563 - DNA, 16 bp, H. sapiens
aggaagcaaggcatgt

SEQ ID NO: 39564 - DNA, 16 bp, H. sapiens
aggaagcacagcagca

SEQ ID NO: 39565 - DNA, 16 bp, H. sapiens
aggaagcacagtgctg

SEQ ID NO: 39566 - DNA, 16 bp, H. sapiens
aggaagcagaggatgc

SEQ ID NO: 39567 - DNA, 16 bp, H. sapiens
aggaagcagaggctgc

SEQ ID NO: 39568 - DNA, 16 bp, H. sapiens
aggaagcagcagcagc

SEQ ID NO: 39569 - DNA, 16 bp, H. sapiens
aggaagcagccctgcc

SEQ ID NO: 39570 - DNA, 16 bp, H. sapiens
aggaagcaggactggg

SEQ ID NO: 39571 - DNA, 16 bp, H. sapiens
aggaagcaggagtgag

SEQ ID NO: 39572 - DNA, 16 bp, H. sapiens
aggaagcaggctgaga

SEQ ID NO: 39573 - DNA, 16 bp, H. sapiens
aggaagcagggctggg

SEQ ID NO: 39574 - DNA, 16 bp, H. sapiens
aggaagcaggggctgg

SEQ ID NO: 39575 - DNA, 16 bp, H. sapiens
aggaagcatggccctg

SEQ ID NO: 39576 - DNA, 16 bp, H. sapiens
aggaagcattcagcat

SEQ ID NO: 39577 - DNA, 16 bp, H. sapiens
aggaagccaacagtgc

SEQ ID NO: 39578 - DNA, 16 bp, H. sapiens
aggaagccagagagag

SEQ ID NO: 39579 - DNA, 16 bp, H. sapiens
aggaagcccagctggc

SEQ ID NO: 39580 - DNA, 16 bp, H. sapiens
aggaagccccatccct

SEQ ID NO: 39581 - DNA, 16 bp, H. sapiens
aggaagctcaaagaaa

SEQ ID NO: 39582 - DNA, 16 bp, H. sapiens
aggaagctcagtgaaa

SEQ ID NO: 39583 - DNA, 16 bp, H. sapiens
aggaagctcagtgaga

SEQ ID NO: 39584 - DNA, 16 bp, H. sapiens
aggaagctgaagaaaa

SEQ ID NO: 39585 - DNA, 16 bp, H. sapiens
aggaagctgaggcagt

SEQ ID NO: 39586 - DNA, 16 bp, H. sapiens
aggaagctgaggttgg

SEQ ID NO: 39587 - DNA, 16 bp, H. sapiens
aggaagctgatgcagg

SEQ ID NO: 39588 - DNA, 16 bp, H. sapiens
aggaagctgcaaaaga

SEQ ID NO: 39589 - DNA, 16 bp, H. sapiens
aggaagctgcagaaga

SEQ ID NO: 39590 - DNA, 16 bp, H. sapiens
aggaagctgcagagga

SEQ ID NO: 39591 - DNA, 16 bp, H. sapiens
aggaagctgggaagcc

SEQ ID NO: 39592 - DNA, 16 bp, H. sapiens
aggaagcttcagaaga

SEQ ID NO: 39593 - DNA, 16 bp, H. sapiens
aggaagcttttagtca

SEQ ID NO: 39594 - DNA, 16 bp, H. sapiens
aggaaggaaattctaa

SEQ ID NO: 39595 - DNA, 16 bp, H. sapiens
aggaaggaactgcaga

SEQ ID NO: 39596 - DNA, 16 bp, H. sapiens
aggaaggaattcagtt

SEQ ID NO: 39597 - DNA, 16 bp, H. sapiens
aggaaggaccctcccc

SEQ ID NO: 39598 - DNA, 16 bp, H. sapiens
aggaaggactttgtct

SEQ ID NO: 39599 - DNA, 16 bp, H. sapiens
aggaaggagagccagt

SEQ ID NO: 39600 - DNA, 16 bp, H. sapiens
aggaaggagaggctgg

SEQ ID NO: 39601 - DNA, 16 bp, H. sapiens
aggaaggagcagacag

SEQ ID NO: 39602 - DNA, 16 bp, H. sapiens
aggaaggaggatggct

SEQ ID NO: 39603 - DNA, 16 bp, H. sapiens
aggaaggaggcagctg

SEQ ID NO: 39604 - DNA, 16 bp, H. sapiens
aggaaggaggctggga

SEQ ID NO: 39605 - DNA, 16 bp, H. sapiens
aggaaggaggctgggc

SEQ ID NO: 39606 - DNA, 16 bp, H. sapiens
aggaaggcagaggctg

SEQ ID NO: 39607 - DNA, 16 bp, H. sapiens
aggaaggcagattgct

SEQ ID NO: 39608 - DNA, 16 bp, H. sapiens
aggaaggcaggcagga

SEQ ID NO: 39609 - DNA, 16 bp, H. sapiens
aggaaggccattacat

SEQ ID NO: 39610 - DNA, 16 bp, H. sapiens
aggaaggctatgggtt

SEQ ID NO: 39611 - DNA, 16 bp, H. sapiens
aggaaggctgaggagg

SEQ ID NO: 39612 - DNA, 16 bp, H. sapiens
aggaaggctgaggcgg

SEQ ID NO: 39613 - DNA, 16 bp, H. sapiens
aggaagggaaccagtt

SEQ ID NO: 39614 - DNA, 16 bp, H. sapiens
aggaagggcctggtgg

SEQ ID NO: 39615 - DNA, 16 bp, H. sapiens
aggaagggctgtcact

SEQ ID NO: 39616 - DNA, 16 bp, H. sapiens
aggaagggctttattc

SEQ ID NO: 39617 - DNA, 16 bp, H. sapiens
aggaaggggccccagg

SEQ ID NO: 39618 - DNA, 16 bp, H. sapiens
aggaaggggctcccac

SEQ ID NO: 39619 - DNA, 16 bp, H. sapiens
aggaaggggctggagg

SEQ ID NO: 39620 - DNA, 16 bp, H. sapiens
aggaaggggctgggag

SEQ ID NO: 39621 - DNA, 16 bp, H. sapiens
aggaagggtaatatca

SEQ ID NO: 39622 - DNA, 16 bp, H. sapiens
aggaagggtcctcccc

SEQ ID NO: 39623 - DNA, 16 bp, H. sapiens
aggaagggtgaatttg

SEQ ID NO: 39624 - DNA, 16 bp, H. sapiens
aggaagggtggggcag

SEQ ID NO: 39625 - DNA, 16 bp, H. sapiens
aggaaggtgtccagtt

SEQ ID NO: 39626 - DNA, 16 bp, H. sapiens
aggaagtcaaattatc

SEQ ID NO: 39627 - DNA, 16 bp, H. sapiens
aggaagtccaattgtc

SEQ ID NO: 39628 - DNA, 16 bp, H. sapiens
aggaagtccattcaga

SEQ ID NO: 39629 - DNA, 16 bp, H. sapiens
aggaagtgaaatcaaa

SEQ ID NO: 39630 - DNA, 16 bp, H. sapiens
aggaagtgacctcaca

SEQ ID NO: 39631 - DNA, 16 bp, H. sapiens
aggaagtgatgagttt

SEQ ID NO: 39632 - DNA, 16 bp, H. sapiens
aggaagtgatgtcagt

SEQ ID NO: 39633 - DNA, 16 bp, H. sapiens
aggaagtgctgggaag

SEQ ID NO: 39634 - DNA, 16 bp, H. sapiens
aggaagtggaggtggc

SEQ ID NO: 39635 - DNA, 16 bp, H. sapiens
aggaagtggcatttga

SEQ ID NO: 39636 - DNA, 16 bp, H. sapiens
aggaagtggtccagtt

SEQ ID NO: 39637 - DNA, 16 bp, H. sapiens
aggaagttccaaattt

SEQ ID NO: 39638 - DNA, 16 bp, H. sapiens
aggaagtttcaaattt

SEQ ID NO: 39639 - DNA, 16 bp, H. sapiens
aggaataaaataatgg

SEQ ID NO: 39640 - DNA, 16 bp, H. sapiens
aggaataacattgaat

SEQ ID NO: 39641 - DNA, 16 bp, H. sapiens
aggaataagctctagt

SEQ ID NO: 39642 - DNA, 16 bp, H. sapiens
aggaataatactttgc

SEQ ID NO: 39643 - DNA, 16 bp, H. sapiens
aggaataattgaggaa

SEQ ID NO: 39644 - DNA, 16 bp, H. sapiens
aggaatacattttttt

SEQ ID NO: 39645 - DNA, 16 bp, H. sapiens
aggaatagctctagga

SEQ ID NO: 39646 - DNA, 16 bp, H. sapiens
aggaatataaatagtt

SEQ ID NO: 39647 - DNA, 16 bp, H. sapiens
aggaatattttaataa

SEQ ID NO: 39648 - DNA, 16 bp, H. sapiens
aggaatatttttatta

SEQ ID NO: 39649 - DNA, 16 bp, H. sapiens
aggaatattttttaaa

SEQ ID NO: 39650 - DNA, 16 bp, H. sapiens
aggaatcactatgtat

SEQ ID NO: 39651 - DNA, 16 bp, H. sapiens
aggaatcatttaaaaa

SEQ ID NO: 39652 - DNA, 16 bp, H. sapiens
aggaatccaacttaaa

SEQ ID NO: 39653 - DNA, 16 bp, H. sapiens
aggaatctccacactg

SEQ ID NO: 39654 - DNA, 16 bp, H. sapiens
aggaatctttattttt

SEQ ID NO: 39655 - DNA, 16 bp, H. sapiens
aggaatgaaactagac

SEQ ID NO: 39656 - DNA, 16 bp, H. sapiens
aggaatgaagaaagct

SEQ ID NO: 39657 - DNA, 16 bp, H. sapiens
aggaatgaagctgcag

SEQ ID NO: 39658 - DNA, 16 bp, H. sapiens
aggaatgaagtcagtg

SEQ ID NO: 39659 - DNA, 16 bp, H. sapiens
aggaatgatcagacag

SEQ ID NO: 39660 - DNA, 16 bp, H. sapiens
aggaatgcaaagatga

SEQ ID NO: 39661 - DNA, 16 bp, H. sapiens
aggaatgcagccctgc

SEQ ID NO: 39662 - DNA, 16 bp, H. sapiens
aggaatgcaggcagcc

SEQ ID NO: 39663 - DNA, 16 bp, H. sapiens
aggaatgctacgtttt

SEQ ID NO: 39664 - DNA, 17 bp, H. sapiens
aggaatggaaaaccaaa

SEQ ID NO: 39665 - DNA, 16 bp, H. sapiens
aggaatggaaagccaa

SEQ ID NO: 39666 - DNA, 16 bp, H. sapiens
aggaatggaaccagct

SEQ ID NO: 39667 - DNA, 16 bp, H. sapiens
aggaatggaatttctg

SEQ ID NO: 39668 - DNA, 16 bp, H. sapiens
aggaatggaggaagat

SEQ ID NO: 39669 - DNA, 16 bp, H. sapiens
aggaatggatccagtt

SEQ ID NO: 39670 - DNA, 16 bp, H. sapiens
aggaatgggagaaaat

SEQ ID NO: 39671 - DNA, 16 bp, H. sapiens
aggaatgggctccaga

SEQ ID NO: 39672 - DNA, 16 bp, H. sapiens
aggaatggggagtgac

SEQ ID NO: 39673 - DNA, 16 bp, H. sapiens
aggaatggtatcagct

SEQ ID NO: 39674 - DNA, 16 bp, H. sapiens
aggaatggtgccatat

SEQ ID NO: 39675 - DNA, 16 bp, H. sapiens
aggaatgtaaaatgat

SEQ ID NO: 39676 - DNA, 16 bp, H. sapiens
aggaatgtgggtggcc

SEQ ID NO: 39677 - DNA, 16 bp, H. sapiens
aggaattaaaagcaaa

SEQ ID NO: 39678 - DNA, 16 bp, H. sapiens
aggaattagaaaagca

SEQ ID NO: 39679 - DNA, 16 bp, H. sapiens
aggaattcaaaaccag

SEQ ID NO: 39680 - DNA, 16 bp, H. sapiens
aggaattcagaattcc

SEQ ID NO: 39681 - DNA, 16 bp, H. sapiens
aggaattcaggagcag

SEQ ID NO: 39682 - DNA, 16 bp, H. sapiens
aggaattcagtttctt

SEQ ID NO: 39683 - DNA, 16 bp, H. sapiens
aggaattcataattct

SEQ ID NO: 39684 - DNA, 16 bp, H. sapiens
aggaattccagaagaa

SEQ ID NO: 39685 - DNA, 16 bp, H. sapiens
aggaattcgagaccat

SEQ ID NO: 39686 - DNA, 17 bp, H. sapiens
aggaattctcctgcctc

SEQ ID NO: 39687 - DNA, 16 bp, H. sapiens
aggaattctgggagat

SEQ ID NO: 39688 - DNA, 16 bp, H. sapiens
aggaattgaaggaaca

SEQ ID NO: 39689 - DNA, 16 bp, H. sapiens
aggaattgaattttaa

SEQ ID NO: 39690 - DNA, 16 bp, H. sapiens
aggaatttaatttata

SEQ ID NO: 39691 - DNA, 16 bp, H. sapiens
aggaatttcagaaaat

SEQ ID NO: 39692 - DNA, 16 bp, H. sapiens
aggaatttcatcaaca

SEQ ID NO: 39693 - DNA, 16 bp, H. sapiens
aggaatttccacactg

SEQ ID NO: 39694 - DNA, 16 bp, H. sapiens
aggaatttgagagcag

SEQ ID NO: 39695 - DNA, 16 bp, H. sapiens
aggaatttgaggccag

SEQ ID NO: 39696 - DNA, 16 bp, H. sapiens
aggaatttgatcagat

SEQ ID NO: 39697 - DNA, 16 bp, H. sapiens
aggaatttgtttattt

SEQ ID NO: 39698 - DNA, 16 bp, H. sapiens
aggaattttataattt

SEQ ID NO: 39699 - DNA, 16 bp, H. sapiens
aggaattttgtcacca

SEQ ID NO: 39700 - DNA, 16 bp, H. sapiens
aggaattttgtgagcc

SEQ ID NO: 39701 - DNA, 16 bp, H. sapiens
aggaatttttttcttt

SEQ ID NO: 39702 - DNA, 16 bp, H. sapiens
aggacaaacccaggca

SEQ ID NO: 39703 - DNA, 16 bp, H. sapiens
aggacaaagaagggca

SEQ ID NO: 39704 - DNA, 16 bp, H. sapiens
aggacaaatacctaat

SEQ ID NO: 39705 - DNA, 16 bp, H. sapiens
aggacaaatattgtat

SEQ ID NO: 39706 - DNA, 16 bp, H. sapiens
aggacaactgcagcta

SEQ ID NO: 39707 - DNA, 16 bp, H. sapiens
aggacaaggaggtggc

SEQ ID NO: 39708 - DNA, 24 bp, H. sapiens
aggacaagtgatggaggaaggatg

SEQ ID NO: 39709 - DNA, 16 bp, H. sapiens
aggacaatctgcttta

SEQ ID NO: 39710 - DNA, 16 bp, H. sapiens
aggacaatggcttcca

SEQ ID NO: 39711 - DNA, 16 bp, H. sapiens
aggacaatttgctgag

SEQ ID NO: 39712 - DNA, 16 bp, H. sapiens
aggacacaagtcatat

SEQ ID NO: 39713 - DNA, 16 bp, H. sapiens
aggacacacacaaatg

SEQ ID NO: 39714 - DNA, 16 bp, H. sapiens
aggacacagagacaaa

SEQ ID NO: 39715 - DNA, 16 bp, H. sapiens
aggacacagagagaag

SEQ ID NO: 39716 - DNA, 16 bp, H. sapiens
aggacacagcaagaag

SEQ ID NO: 39717 - DNA, 16 bp, H. sapiens
aggacacagccaaatc

SEQ ID NO: 39718 - DNA, 16 bp, H. sapiens
aggacacagcgagaag

SEQ ID NO: 39719 - DNA, 16 bp, H. sapiens
aggacacaggacacag

SEQ ID NO: 39720 - DNA, 16 bp, H. sapiens
aggacacatagaaggc

SEQ ID NO: 39721 - DNA, 16 bp, H. sapiens
aggacaccaagtcctg

SEQ ID NO: 39722 - DNA, 16 bp, H. sapiens
aggacaccatcaagaa

SEQ ID NO: 39723 - DNA, 16 bp, H. sapiens
aggacacccagctggt

SEQ ID NO: 39724 - DNA, 16 bp, H. sapiens
aggacaccccagatcc

SEQ ID NO: 39725 - DNA, 16 bp, H. sapiens
aggacactataagaaa

SEQ ID NO: 39726 - DNA, 16 bp, H. sapiens
aggacactgaggctca

SEQ ID NO: 39727 - DNA, 16 bp, H. sapiens
aggacagaaaatggag

SEQ ID NO: 39728 - DNA, 16 bp, H. sapiens
aggacagagcctggca

SEQ ID NO: 39729 - DNA, 16 bp, H. sapiens
aggacagcttggagat

SEQ ID NO: 39730 - DNA, 16 bp, H. sapiens
aggacaggaggcagag

SEQ ID NO: 39731 - DNA, 16 bp, H. sapiens
aggacaggcacagtgg

SEQ ID NO: 39732 - DNA, 16 bp, H. sapiens
aggacagggactgtgt

SEQ ID NO: 39733 - DNA, 16 bp, H. sapiens
aggacagtatcttcaa

SEQ ID NO: 39734 - DNA, 16 bp, H. sapiens
aggacatccctgaagg

SEQ ID NO: 39735 - DNA, 16 bp, H. sapiens
aggacatctacaaaaa

SEQ ID NO: 39736 - DNA, 17 bp, H. sapiens
aggacatcttcaaggag

SEQ ID NO: 39737 - DNA, 16 bp, H. sapiens
aggacatgaacacaca

SEQ ID NO: 39738 - DNA, 16 bp, H. sapiens
aggacatgaacagaga

SEQ ID NO: 39739 - DNA, 16 bp, H. sapiens
aggacatgatcttgtt

SEQ ID NO: 39740 - DNA, 16 bp, H. sapiens
aggacatggaagctct

SEQ ID NO: 39741 - DNA, 16 bp, H. sapiens
aggacatggacatctt

SEQ ID NO: 39742 - DNA, 16 bp, H. sapiens
aggacatggatgaagc

SEQ ID NO: 39743 - DNA, 16 bp, H. sapiens
aggacattattttgtt

SEQ ID NO: 39744 - DNA, 16 bp, H. sapiens
aggacattggtctggg

SEQ ID NO: 39745 - DNA, 16 bp, H. sapiens
aggacattggtcttgg

SEQ ID NO: 39746 - DNA, 16 bp, H. sapiens
aggacatttgaaatta

SEQ ID NO: 39747 - DNA, 16 bp, H. sapiens
aggaccaacctgggca

SEQ ID NO: 39748 - DNA, 16 bp, H. sapiens
aggaccacccagattc

SEQ ID NO: 39749 - DNA, 16 bp, H. sapiens
aggaccaccttcatga

SEQ ID NO: 39750 - DNA, 16 bp, H. sapiens
aggaccagacagattt

SEQ ID NO: 39751 - DNA, 16 bp, H. sapiens
aggaccaggtgggagg

SEQ ID NO: 39752 - DNA, 16 bp, H. sapiens
aggaccagtctgggca

SEQ ID NO: 39753 - DNA, 16 bp, H. sapiens
aggaccagttttgtgg

SEQ ID NO: 39754 - DNA, 16 bp, H. sapiens
aggaccatgctgtttt

SEQ ID NO: 39755 - DNA, 17 bp, H. sapiens
aggacccagattcataa

SEQ ID NO: 39756 - DNA, 16 bp, H. sapiens
aggacccagtgggagg

SEQ ID NO: 39757 - DNA, 16 bp, H. sapiens
aggaccccagtccctt

SEQ ID NO: 39758 - DNA, 16 bp, H. sapiens
aggaccctctctggaa

SEQ ID NO: 39759 - DNA, 16 bp, H. sapiens
aggacccttgtgatta

SEQ ID NO: 39760 - DNA, 18 bp, H. sapiens
aggacctcttcaaggaca

SEQ ID NO: 39761 - DNA, 17 bp, H. sapiens
aggacctcttccaggag

SEQ ID NO: 39762 - DNA, 16 bp, H. sapiens
aggacctctttgagga

SEQ ID NO: 39763 - DNA, 16 bp, H. sapiens
aggacctggtgggaga

SEQ ID NO: 39764 - DNA, 16 bp, H. sapiens
aggaccttaaacaaat

SEQ ID NO: 39765 - DNA, 16 bp, H. sapiens
aggaccttgatcttgg

SEQ ID NO: 39766 - DNA, 16 bp, H. sapiens
aggacgagccacagac

SEQ ID NO: 39767 - DNA, 16 bp, H. sapiens
aggactacaggcaagt

SEQ ID NO: 39768 - DNA, 17 bp, H. sapiens
aggactacaggcgtgca

SEQ ID NO: 39769 - DNA, 16 bp, H. sapiens
aggactacatttccca

SEQ ID NO: 39770 - DNA, 16 bp, H. sapiens
aggactatgagaaata

SEQ ID NO: 39771 - DNA, 16 bp, H. sapiens
aggactcagaagaaga

SEQ ID NO: 39772 - DNA, 16 bp, H. sapiens
aggactcatgtgatta

SEQ ID NO: 39773 - DNA, 16 bp, H. sapiens
aggactctgcagagag

SEQ ID NO: 39774 - DNA, 16 bp, H. sapiens
aggactcttttgccct

SEQ ID NO: 39775 - DNA, 16 bp, H. sapiens
aggactgatttgtttg

SEQ ID NO: 39776 - DNA, 16 bp, H. sapiens
aggactgcttcaggcc

SEQ ID NO: 39777 - DNA, 16 bp, H. sapiens
aggactgcttgagcct

SEQ ID NO: 39778 - DNA, 16 bp, H. sapiens
aggactgggtccttcc

SEQ ID NO: 39779 - DNA, 16 bp, H. sapiens
aggactgggtcctttc

SEQ ID NO: 39780 - DNA, 16 bp, H. sapiens
aggactggtttcatgg

SEQ ID NO: 39781 - DNA, 19 bp, H. sapiens
aggactgtatttgtgacta

SEQ ID NO: 39782 - DNA, 16 bp, H. sapiens
aggactgtgggagaat

SEQ ID NO: 39783 - DNA, 16 bp, H. sapiens
aggacttcaacatgaa

SEQ ID NO: 39784 - DNA, 16 bp, H. sapiens
aggacttcccagcctc

SEQ ID NO: 39785 - DNA, 16 bp, H. sapiens
aggacttccccaacct

SEQ ID NO: 39786 - DNA, 16 bp, H. sapiens
aggacttcctggagga

SEQ ID NO: 39787 - DNA, 16 bp, H. sapiens
aggacttcttcaagga

SEQ ID NO: 39788 - DNA, 16 bp, H. sapiens
aggacttctttcaaaa

SEQ ID NO: 39789 - DNA, 16 bp, H. sapiens
aggacttgaacccagg

SEQ ID NO: 39790 - DNA, 16 bp, H. sapiens
aggacttgtatccaga

SEQ ID NO: 39791 - DNA, 16 bp, H. sapiens
aggacttttttctttt

SEQ ID NO: 39792 - DNA, 17 bp, H. sapiens
aggagaaaaaccatatg

SEQ ID NO: 39793 - DNA, 16 bp, H. sapiens
aggagaaaaccacctt

SEQ ID NO: 39794 - DNA, 16 bp, H. sapiens
aggagaaaactgcctt

SEQ ID NO: 39795 - DNA, 16 bp, H. sapiens
aggagaaaataaaact

SEQ ID NO: 39796 - DNA, 16 bp, H. sapiens
aggagaaaatatttat

SEQ ID NO: 39797 - DNA, 16 bp, H. sapiens
aggagaaaatctagat

SEQ ID NO: 39798 - DNA, 16 bp, H. sapiens
aggagaaaatcttgaa

SEQ ID NO: 39799 - DNA, 16 bp, H. sapiens
aggagaaaatttttac

SEQ ID NO: 39800 - DNA, 16 bp, H. sapiens
aggagaaacagataaa

SEQ ID NO: 39801 - DNA, 16 bp, H. sapiens
aggagaaacccttgaa

SEQ ID NO: 39802 - DNA, 16 bp, H. sapiens
aggagaaactgaggca

SEQ ID NO: 39803 - DNA, 16 bp, H. sapiens
aggagaaagaatttca

SEQ ID NO: 39804 - DNA, 16 bp, H. sapiens
aggagaaagactgaaa

SEQ ID NO: 39805 - DNA, 16 bp, H. sapiens
aggagaaatacctgat

SEQ ID NO: 39806 - DNA, 16 bp, H. sapiens
aggagaaatattttca

SEQ ID NO: 39807 - DNA, 16 bp, H. sapiens
aggagaaatgcctaat

SEQ ID NO: 39808 - DNA, 16 bp, H. sapiens
aggagaaatgcttcag

SEQ ID NO: 39809 - DNA, 16 bp, H. sapiens
aggagaaattatattt

SEQ ID NO: 39810 - DNA, 16 bp, H. sapiens
aggagaaattcaagcc

SEQ ID NO: 39811 - DNA, 16 bp, H. sapiens
aggagaaattgaagcc

SEQ ID NO: 39812 - DNA, 16 bp, H. sapiens
aggagaaatttagttt

SEQ ID NO: 39813 - DNA, 16 bp, H. sapiens
aggagaacagcttgaa

SEQ ID NO: 39814 - DNA, 16 bp, H. sapiens
aggagaacattttgga

SEQ ID NO: 39815 - DNA, 16 bp, H. sapiens
aggagaactgctggaa

SEQ ID NO: 39816 - DNA, 16 bp, H. sapiens
aggagaacttacccaa

SEQ ID NO: 39817 - DNA, 16 bp, H. sapiens
aggagaagaggtgttc

SEQ ID NO: 39818 - DNA, 16 bp, H. sapiens
aggagaagatgggtgt

SEQ ID NO: 39819 - DNA, 16 bp, H. sapiens
aggagaagcagcagca

SEQ ID NO: 39820 - DNA, 16 bp, H. sapiens
aggagaagcagcagga

SEQ ID NO: 39821 - DNA, 16 bp, H. sapiens
aggagaagcagctgga

SEQ ID NO: 39822 - DNA, 16 bp, H. sapiens
aggagaagcaggcaca

SEQ ID NO: 39823 - DNA, 16 bp, H. sapiens
aggagaagcaggcact

SEQ ID NO: 39824 - DNA, 16 bp, H. sapiens
aggagaaggaatttca

SEQ ID NO: 39825 - DNA, 16 bp, H. sapiens
aggagaaggccagaga

SEQ ID NO: 39826 - DNA, 16 bp, H. sapiens
aggagaaggcttcaga

SEQ ID NO: 39827 - DNA, 16 bp, H. sapiens
aggagaaggtcagaga

SEQ ID NO: 39828 - DNA, 16 bp, H. sapiens
aggagaaggtcagagg

SEQ ID NO: 39829 - DNA, 16 bp, H. sapiens
aggagaataggttgaa

SEQ ID NO: 39830 - DNA, 16 bp, H. sapiens
aggagaatatcttcat

SEQ ID NO: 39831 - DNA, 16 bp, H. sapiens
aggagaatcatttcaa

SEQ ID NO: 39832 - DNA, 16 bp, H. sapiens
aggagaatctgagctc

SEQ ID NO: 39833 - DNA, 16 bp, H. sapiens
aggagaatcttttgag

SEQ ID NO: 39834 - DNA, 16 bp, H. sapiens
aggagaatgctgtgaa

SEQ ID NO: 39835 - DNA, 16 bp, H. sapiens
aggagaatgcttccag

SEQ ID NO: 39836 - DNA, 16 bp, H. sapiens
aggagaatggaaccaa

SEQ ID NO: 39837 - DNA, 16 bp, H. sapiens
aggagaatggcataaa

SEQ ID NO: 39838 - DNA, 16 bp, H. sapiens
aggagaatggcatcaa

SEQ ID NO: 39839 - DNA, 16 bp, H. sapiens
aggagaatggcgagaa

SEQ ID NO: 39840 - DNA, 17 bp, H. sapiens
aggagaatggtgtgacc

SEQ ID NO: 39841 - DNA, 16 bp, H. sapiens
aggagaatgtctttgt

SEQ ID NO: 39842 - DNA, 16 bp, H. sapiens
aggagaatgttgtgaa

SEQ ID NO: 39843 - DNA, 16 bp, H. sapiens
aggagaattgacatct

SEQ ID NO: 39844 - DNA, 16 bp, H. sapiens
aggagaattgctcgag

SEQ ID NO: 39845 - DNA, 16 bp, H. sapiens
aggagaattgcttgga

SEQ ID NO: 39846 - DNA, 16 bp, H. sapiens
aggagaattgttggaa

SEQ ID NO: 39847 - DNA, 16 bp, H. sapiens
aggagaatttaaaaat

SEQ ID NO: 39848 - DNA, 16 bp, H. sapiens
aggagaattttttgaa

SEQ ID NO: 39849 - DNA, 16 bp, H. sapiens
aggagacaatctgagg

SEQ ID NO: 39850 - DNA, 16 bp, H. sapiens
aggagacacaaacatt

SEQ ID NO: 39851 - DNA, 16 bp, H. sapiens
aggagacagaaagtca

SEQ ID NO: 39852 - DNA, 16 bp, H. sapiens
aggagacagacacaga

SEQ ID NO: 39853 - DNA, 16 bp, H. sapiens
aggagacagacagaga

SEQ ID NO: 39854 - DNA, 16 bp, H. sapiens
aggagacagagctgag

SEQ ID NO: 39855 - DNA, 16 bp, H. sapiens
aggagacagggaaata

SEQ ID NO: 39856 - DNA, 16 bp, H. sapiens
aggagacccagagtgg

SEQ ID NO: 39857 - DNA, 16 bp, H. sapiens
aggagaccctggagtg

SEQ ID NO: 39858 - DNA, 16 bp, H. sapiens
aggagaccgaggtggg

SEQ ID NO: 39859 - DNA, 16 bp, H. sapiens
aggagacctatctcat

SEQ ID NO: 39860 - DNA, 16 bp, H. sapiens
aggagacctctggcct

SEQ ID NO: 39861 - DNA, 16 bp, H. sapiens
aggagacctggattct

SEQ ID NO: 39862 - DNA, 16 bp, H. sapiens
aggagacggaggctgc

SEQ ID NO: 39863 - DNA, 16 bp, H. sapiens
aggagactgagacaca

SEQ ID NO: 39864 - DNA, 16 bp, H. sapiens
aggagactgaggcatg

SEQ ID NO: 39865 - DNA, 16 bp, H. sapiens
aggagactgaggctca

SEQ ID NO: 39866 - DNA, 16 bp, H. sapiens
aggagactttgggctg

SEQ ID NO: 39867 - DNA, 16 bp, H. sapiens
aggagagaaaatgagt

SEQ ID NO: 39868 - DNA, 16 bp, H. sapiens
aggagagaaagcaagc

SEQ ID NO: 39869 - DNA, 16 bp, H. sapiens
aggagagaagaggctg

SEQ ID NO: 39870 - DNA, 16 bp, H. sapiens
aggagagaatatttcc

SEQ ID NO: 39871 - DNA, 16 bp, H. sapiens
aggagagaatcacctt

SEQ ID NO: 39872 - DNA, 16 bp, H. sapiens
aggagagaatggcatg

SEQ ID NO: 39873 - DNA, 16 bp, H. sapiens
aggagagactcctccc

SEQ ID NO: 39874 - DNA, 16 bp, H. sapiens
aggagagagaagatca

SEQ ID NO: 39875 - DNA, 16 bp, H. sapiens
aggagagagaagtgca

SEQ ID NO: 39876 - DNA, 16 bp, H. sapiens
aggagagagagctggg

SEQ ID NO: 39877 - DNA, 16 bp, H. sapiens
aggagagaggcctggg

SEQ ID NO: 39878 - DNA, 16 bp, H. sapiens
aggagagaggtctggg

SEQ ID NO: 39879 - DNA, 16 bp, H. sapiens
aggagagccagagaag

SEQ ID NO: 39880 - DNA, 16 bp, H. sapiens
aggagagcctgcaggc

SEQ ID NO: 39881 - DNA, 16 bp, H. sapiens
aggagaggaagctgag

SEQ ID NO: 39882 - DNA, 16 bp, H. sapiens
aggagaggaattcacc

SEQ ID NO: 39883 - DNA, 16 bp, H. sapiens
aggagaggacacagag

SEQ ID NO: 39884 - DNA, 16 bp, H. sapiens
aggagaggatcagaaa

SEQ ID NO: 39885 - DNA, 16 bp, H. sapiens
aggagaggctgctgga

SEQ ID NO: 39886 - DNA, 16 bp, H. sapiens
aggagaggctgggcac

SEQ ID NO: 39887 - DNA, 16 bp, H. sapiens
aggagaggggcctcag

SEQ ID NO: 39888 - DNA, 16 bp, H. sapiens
aggagaggggctggag

SEQ ID NO: 39889 - DNA, 16 bp, H. sapiens
aggagagtgggggcca

SEQ ID NO: 39890 - DNA, 16 bp, H. sapiens
aggagagttgcttgaa

SEQ ID NO: 39891 - DNA, 16 bp, H. sapiens
aggagatagagaccat

SEQ ID NO: 39892 - DNA, 16 bp, H. sapiens
aggagatatgcctaat

SEQ ID NO: 39893 - DNA, 16 bp, H. sapiens
aggagatattataact

SEQ ID NO: 39894 - DNA, 16 bp, H. sapiens
aggagatattcctaat

SEQ ID NO: 39895 - DNA, 16 bp, H. sapiens
aggagatcaaaaccat

SEQ ID NO: 39896 - DNA, 16 bp, H. sapiens
aggagatcaagaacat

SEQ ID NO: 39897 - DNA, 16 bp, H. sapiens
aggagatcaagaccct

SEQ ID NO: 39898 - DNA, 16 bp, H. sapiens
aggagatcagcaggac

SEQ ID NO: 39899 - DNA, 16 bp, H. sapiens
aggagatcattttaga

SEQ ID NO: 39900 - DNA, 16 bp, H. sapiens
aggagatgagatcaga

SEQ ID NO: 39901 - DNA, 16 bp, H. sapiens
aggagatgaggctgga

SEQ ID NO: 39902 - DNA, 16 bp, H. sapiens
aggagatgaggctggg

SEQ ID NO: 39903 - DNA, 16 bp, H. sapiens
aggagatggaggctac

SEQ ID NO: 39904 - DNA, 16 bp, H. sapiens
aggagatggaggtggc

SEQ ID NO: 39905 - DNA, 16 bp, H. sapiens
aggagatggggtctca

SEQ ID NO: 39906 - DNA, 16 bp, H. sapiens
aggagatgtgatgaca

SEQ ID NO: 39907 - DNA, 16 bp, H. sapiens
aggagattgaggctga

SEQ ID NO: 39908 - DNA, 16 bp, H. sapiens
aggagattgaggctgc

SEQ ID NO: 39909 - DNA, 16 bp, H. sapiens
aggagatttctcaaag

SEQ ID NO: 39910 - DNA, 16 bp, H. sapiens
aggagatttggggcta

SEQ ID NO: 39911 - DNA, 16 bp, H. sapiens
aggagcaaagaagcca

SEQ ID NO: 39912 - DNA, 16 bp, H. sapiens
aggagcaagaaagcca

SEQ ID NO: 39913 - DNA, 16 bp, H. sapiens
aggagcaagacagaga

SEQ ID NO: 39914 - DNA, 16 bp, H. sapiens
aggagcaataggctat

SEQ ID NO: 39915 - DNA, 16 bp, H. sapiens
aggagcacaccaccat

SEQ ID NO: 39916 - DNA, 16 bp, H. sapiens
aggagcacatcaaaaa

SEQ ID NO: 39917 - DNA, 20 bp, H. sapiens
aggagcacccagattcataa

SEQ ID NO: 39918 - DNA, 27 bp, H. sapiens
aggagcacccagattcataaagcaagc

SEQ ID NO: 39919 - DNA, 16 bp, H. sapiens
aggagcaccctttctg

SEQ ID NO: 39920 - DNA, 16 bp, H. sapiens
aggagcagagagttta

SEQ ID NO: 39921 - DNA, 16 bp, H. sapiens
aggagcagagccaggg

SEQ ID NO: 39922 - DNA, 16 bp, H. sapiens
aggagcagaggcagca

SEQ ID NO: 39923 - DNA, 16 bp, H. sapiens
aggagcagatgcggaa

SEQ ID NO: 39924 - DNA, 16 bp, H. sapiens
aggagcagcagcagca

SEQ ID NO: 39925 - DNA, 16 bp, H. sapiens
aggagcagcagcaggg

SEQ ID NO: 39926 - DNA, 16 bp, H. sapiens
aggagcaggaacccta

SEQ ID NO: 39927 - DNA, 16 bp, H. sapiens
aggagcaggggctggg

SEQ ID NO: 39928 - DNA, 16 bp, H. sapiens
aggagcaggttcttca

SEQ ID NO: 39929 - DNA, 16 bp, H. sapiens
aggagcagtcacagag

SEQ ID NO: 39930 - DNA, 16 bp, H. sapiens
aggagcagtggctcaa

SEQ ID NO: 39931 - DNA, 16 bp, H. sapiens
aggagcagtgggaagt

SEQ ID NO: 39932 - DNA, 16 bp, H. sapiens
aggagccaacttgaag

SEQ ID NO: 39933 - DNA, 16 bp, H. sapiens
aggagccaaggaatgt

SEQ ID NO: 39934 - DNA, 16 bp, H. sapiens
aggagccagacacaaa

SEQ ID NO: 39935 - DNA, 16 bp, H. sapiens
aggagccagaggcaga

SEQ ID NO: 39936 - DNA, 16 bp, H. sapiens
aggagccagagggcaa

SEQ ID NO: 39937 - DNA, 16 bp, H. sapiens
aggagccagccatggg

SEQ ID NO: 39938 - DNA, 16 bp, H. sapiens
aggagccagccctgcc

SEQ ID NO: 39939 - DNA, 16 bp, H. sapiens
aggagccagcttgaag

SEQ ID NO: 39940 - DNA, 16 bp, H. sapiens
aggagccaggagagag

SEQ ID NO: 39941 - DNA, 16 bp, H. sapiens
aggagccaggagcaga

SEQ ID NO: 39942 - DNA, 16 bp, H. sapiens
aggagcccaccaagag

SEQ ID NO: 39943 - DNA, 16 bp, H. sapiens
aggagcccaggcagag

SEQ ID NO: 39944 - DNA, 16 bp, H. sapiens
aggagcccaggctggg

SEQ ID NO: 39945 - DNA, 16 bp, H. sapiens
aggagcccagttggct

SEQ ID NO: 39946 - DNA, 16 bp, H. sapiens
aggagccccgccctcc

SEQ ID NO: 39947 - DNA, 18 bp, H. sapiens
aggagcccttcagcccgc

SEQ ID NO: 39948 - DNA, 16 bp, H. sapiens
aggagcctaatgttaa

SEQ ID NO: 39949 - DNA, 16 bp, H. sapiens
aggagcctgagacagg

SEQ ID NO: 39950 - DNA, 16 bp, H. sapiens
aggagcctgaggtgag

SEQ ID NO: 39951 - DNA, 16 bp, H. sapiens
aggagcctggcctctc

SEQ ID NO: 39952 - DNA, 16 bp, H. sapiens
aggagccttcaaagcc

SEQ ID NO: 39953 - DNA, 16 bp, H. sapiens
aggagcgcctctaccc

SEQ ID NO: 39954 - DNA, 16 bp, H. sapiens
aggagcgcctctgctg

SEQ ID NO: 39955 - DNA, 16 bp, H. sapiens
aggagctaatgcagct

SEQ ID NO: 39956 - DNA, 16 bp, H. sapiens
aggagctagaaaaaga

SEQ ID NO: 39957 - DNA, 16 bp, H. sapiens
aggagctaggaccaca

SEQ ID NO: 39958 - DNA, 16 bp, H. sapiens
aggagctcaagaccac

SEQ ID NO: 39959 - DNA, 16 bp, H. sapiens
aggagctcaaggccag

SEQ ID NO: 39960 - DNA, 16 bp, H. sapiens
aggagctcattgaggc

SEQ ID NO: 39961 - DNA, 16 bp, H. sapiens
aggagctctcactccc

SEQ ID NO: 39962 - DNA, 16 bp, H. sapiens
aggagctctggttcct

SEQ ID NO: 39963 - DNA, 16 bp, H. sapiens
aggagctgaaagatga

SEQ ID NO: 39964 - DNA, 16 bp, H. sapiens
aggagctgacagacaa

SEQ ID NO: 39965 - DNA, 18 bp, H. sapiens
aggagctgacggagctga

SEQ ID NO: 39966 - DNA, 16 bp, H. sapiens
aggagctgactgggtg

SEQ ID NO: 39967 - DNA, 16 bp, H. sapiens
aggagctgaggcagga

SEQ ID NO: 39968 - DNA, 16 bp, H. sapiens
aggagctgcagaccag

SEQ ID NO: 39969 - DNA, 16 bp, H. sapiens
aggagctgccttcctt

SEQ ID NO: 39970 - DNA, 16 bp, H. sapiens
aggagctgctctcctc

SEQ ID NO: 39971 - DNA, 16 bp, H. sapiens
aggagctgctgctgct

SEQ ID NO: 39972 - DNA, 16 bp, H. sapiens
aggagctggaaccatt

SEQ ID NO: 39973 - DNA, 16 bp, H. sapiens
aggagctggaagaggc

SEQ ID NO: 39974 - DNA, 16 bp, H. sapiens
aggagctggaggaagg

SEQ ID NO: 39975 - DNA, 16 bp, H. sapiens
aggagctggaggaggg

SEQ ID NO: 39976 - DNA, 16 bp, H. sapiens
aggagctggaggccag

SEQ ID NO: 39977 - DNA, 16 bp, H. sapiens
aggagctggaggccat

SEQ ID NO: 39978 - DNA, 16 bp, H. sapiens
aggagctggaggctgc

SEQ ID NO: 39979 - DNA, 16 bp, H. sapiens
aggagctggagggagg

SEQ ID NO: 39980 - DNA, 16 bp, H. sapiens
aggagctgggaagcag

SEQ ID NO: 39981 - DNA, 16 bp, H. sapiens
aggagctgggactaca

SEQ ID NO: 39982 - DNA, 16 bp, H. sapiens
aggagctgggaggaga

SEQ ID NO: 39983 - DNA, 16 bp, H. sapiens
aggagctgggcctgga

SEQ ID NO: 39984 - DNA, 16 bp, H. sapiens
aggagctggggaaagg

SEQ ID NO: 39985 - DNA, 16 bp, H. sapiens
aggagctggggagcag

SEQ ID NO: 39986 - DNA, 16 bp, H. sapiens
aggagctggggctaca

SEQ ID NO: 39987 - DNA, 16 bp, H. sapiens
aggagctgggggagag

SEQ ID NO: 39988 - DNA, 16 bp, H. sapiens
aggagctgggggagga

SEQ ID NO: 39989 - DNA, 19 bp, H. sapiens
aggagctggttttctgaaa

SEQ ID NO: 39990 - DNA, 16 bp, H. sapiens
aggagctgtgctatac

SEQ ID NO: 39991 - DNA, 16 bp, H. sapiens
aggagctgttaactag

SEQ ID NO: 39992 - DNA, 16 bp, H. sapiens
aggagcttggatttta

SEQ ID NO: 39993 - DNA, 16 bp, H. sapiens
aggagctttttagttt

SEQ ID NO: 39994 - DNA, 16 bp, H. sapiens
aggaggaaaaaaatca

SEQ ID NO: 39995 - DNA, 16 bp, H. sapiens
aggaggaaaaccagga

SEQ ID NO: 39996 - DNA, 16 bp, H. sapiens
aggaggaaacagaggc

SEQ ID NO: 39997 - DNA, 16 bp, H. sapiens
aggaggaaactgaggc

SEQ ID NO: 39998 - DNA, 16 bp, H. sapiens
aggaggaaatggaggc

SEQ ID NO: 39999 - DNA, 16 bp, H. sapiens
aggaggaagaaatgct

SEQ ID NO: 40000 - DNA, 16 bp, H. sapiens
aggaggaagaggatca

SEQ ID NO: 40001 - DNA, 16 bp, H. sapiens
aggaggaagaggggct

SEQ ID NO: 40002 - DNA, 16 bp, H. sapiens
aggaggaatcctgggc

SEQ ID NO: 40003 - DNA, 16 bp, H. sapiens
aggaggaattccagaa

SEQ ID NO: 40004 - DNA, 16 bp, H. sapiens
aggaggaattctctct

SEQ ID NO: 40005 - DNA, 16 bp, H. sapiens
aggaggaatttcaggg

SEQ ID NO: 40006 - DNA, 16 bp, H. sapiens
aggaggacacaaacat

SEQ ID NO: 40007 - DNA, 16 bp, H. sapiens
aggaggactcaggaag

SEQ ID NO: 40008 - DNA, 16 bp, H. sapiens
aggaggactgaggaag

SEQ ID NO: 40009 - DNA, 16 bp, H. sapiens
aggaggactgcctgcc

SEQ ID NO: 40010 - DNA, 16 bp, H. sapiens
aggaggagaaagtcac

SEQ ID NO: 40011 - DNA, 16 bp, H. sapiens
aggaggagaaccagga

SEQ ID NO: 40012 - DNA, 16 bp, H. sapiens
aggaggagcagaagca

SEQ ID NO: 40013 - DNA, 16 bp, H. sapiens
aggaggagcaggcaga

SEQ ID NO: 40014 - DNA, 16 bp, H. sapiens
aggaggagcccaggag

SEQ ID NO: 40015 - DNA, 16 bp, H. sapiens
aggaggagctggatga

SEQ ID NO: 40016 - DNA, 16 bp, H. sapiens
aggaggagctgggcag

SEQ ID NO: 40017 - DNA, 16 bp, H. sapiens
aggaggaggaagcagc

SEQ ID NO: 40018 - DNA, 16 bp, H. sapiens
aggaggaggaagctgg

SEQ ID NO: 40019 - DNA, 16 bp, H. sapiens
aggaggaggagctgga

SEQ ID NO: 40020 - DNA, 16 bp, H. sapiens
aggaggaggagctggg

SEQ ID NO: 40021 - DNA, 16 bp, H. sapiens
aggaggaggagcttgc

SEQ ID NO: 40022 - DNA, 16 bp, H. sapiens
aggaggaggagggctg

SEQ ID NO: 40023 - DNA, 16 bp, H. sapiens
aggaggaggcagaggt

SEQ ID NO: 40024 - DNA, 16 bp, H. sapiens
aggaggaggcagcagc

SEQ ID NO: 40025 - DNA, 16 bp, H. sapiens
aggaggaggcaggtgg

SEQ ID NO: 40026 - DNA, 16 bp, H. sapiens
aggaggagggactctt

SEQ ID NO: 40027 - DNA, 16 bp, H. sapiens
aggaggaggtggagca

SEQ ID NO: 40028 - DNA, 16 bp, H. sapiens
aggaggaggtggaggc

SEQ ID NO: 40029 - DNA, 16 bp, H. sapiens
aggaggaggtggcagt

SEQ ID NO: 40030 - DNA, 16 bp, H. sapiens
aggaggaggtggtgat

SEQ ID NO: 40031 - DNA, 16 bp, H. sapiens
aggaggataatttgag

SEQ ID NO: 40032 - DNA, 16 bp, H. sapiens
aggaggatcactggag

SEQ ID NO: 40033 - DNA, 16 bp, H. sapiens
aggaggatcccttgat

SEQ ID NO: 40034 - DNA, 16 bp, H. sapiens
aggaggatctcttcag

SEQ ID NO: 40035 - DNA, 16 bp, H. sapiens
aggaggatgctggcct

SEQ ID NO: 40036 - DNA, 16 bp, H. sapiens
aggaggatggattgag

SEQ ID NO: 40037 - DNA, 16 bp, H. sapiens
aggaggatggctggag

SEQ ID NO: 40038 - DNA, 17 bp, H. sapiens
aggaggattgcttgaag

SEQ ID NO: 40039 - DNA, 19 bp, H. sapiens
aggaggattgcttgagcct

SEQ ID NO: 40040 - DNA, 16 bp, H. sapiens
aggaggatttcttgag

SEQ ID NO: 40041 - DNA, 16 bp, H. sapiens
aggaggcaaaagatct

SEQ ID NO: 40042 - DNA, 16 bp, H. sapiens
aggaggcaaaagttgc

SEQ ID NO: 40043 - DNA, 16 bp, H. sapiens
aggaggcaagtccaga

SEQ ID NO: 40044 - DNA, 16 bp, H. sapiens
aggaggcaccgagagc

SEQ ID NO: 40045 - DNA, 16 bp, H. sapiens
aggaggcagagactgg

SEQ ID NO: 40046 - DNA, 16 bp, H. sapiens
aggaggcagagatcac

SEQ ID NO: 40047 - DNA, 16 bp, H. sapiens
aggaggcagagctggg

SEQ ID NO: 40048 - DNA, 16 bp, H. sapiens
aggaggcagaggagca

SEQ ID NO: 40049 - DNA, 16 bp, H. sapiens
aggaggcagaggaggt

SEQ ID NO: 40050 - DNA, 16 bp, H. sapiens
aggaggcagaggccac

SEQ ID NO: 40051 - DNA, 17 bp, H. sapiens
aggaggcagaggctgca

SEQ ID NO: 40052 - DNA, 16 bp, H. sapiens
aggaggcagaggctgg

SEQ ID NO: 40053 - DNA, 16 bp, H. sapiens
aggaggcagaggctgt

SEQ ID NO: 40054 - DNA, 16 bp, H. sapiens
aggaggcagagtgaga

SEQ ID NO: 40055 - DNA, 16 bp, H. sapiens
aggaggcagagtgagg

SEQ ID NO: 40056 - DNA, 16 bp, H. sapiens
aggaggcagctgaggc

SEQ ID NO: 40057 - DNA, 16 bp, H. sapiens
aggaggcaggagctgg

SEQ ID NO: 40058 - DNA, 16 bp, H. sapiens
aggaggcaggaggctg

SEQ ID NO: 40059 - DNA, 16 bp, H. sapiens
aggaggcaggagtggg

SEQ ID NO: 40060 - DNA, 16 bp, H. sapiens
aggaggcagtctgccc

SEQ ID NO: 40061 - DNA, 16 bp, H. sapiens
aggaggcagtctgccg

SEQ ID NO: 40062 - DNA, 16 bp, H. sapiens
aggaggcagtctgtcc

SEQ ID NO: 40063 - DNA, 16 bp, H. sapiens
aggaggcagtggttgc

SEQ ID NO: 40064 - DNA, 16 bp, H. sapiens
aggaggcatctggaaa

SEQ ID NO: 40065 - DNA, 16 bp, H. sapiens
aggaggcatggctggg

SEQ ID NO: 40066 - DNA, 16 bp, H. sapiens
aggaggccaaagcagg

SEQ ID NO: 40067 - DNA, 16 bp, H. sapiens
aggaggccaaggcggg

SEQ ID NO: 40068 - DNA, 16 bp, H. sapiens
aggaggccaaggtgga

SEQ ID NO: 40069 - DNA, 16 bp, H. sapiens
aggaggccaaggtggg

SEQ ID NO: 40070 - DNA, 16 bp, H. sapiens
aggaggccagagaagg

SEQ ID NO: 40071 - DNA, 16 bp, H. sapiens
aggaggccaggcaggg

SEQ ID NO: 40072 - DNA, 16 bp, H. sapiens
aggaggccagggaggc

SEQ ID NO: 40073 - DNA, 16 bp, H. sapiens
aggaggccgaggcaga

SEQ ID NO: 40074 - DNA, 16 bp, H. sapiens
aggaggccgaggccgg

SEQ ID NO: 40075 - DNA, 16 bp, H. sapiens
aggaggccgaggctgc

SEQ ID NO: 40076 - DNA, 17 bp, H. sapiens
aggaggcctgcctacct

SEQ ID NO: 40077 - DNA, 16 bp, H. sapiens
aggaggccttcctgcc

SEQ ID NO: 40078 - DNA, 16 bp, H. sapiens
aggaggcggagctggc

SEQ ID NO: 40079 - DNA, 16 bp, H. sapiens
aggaggcggaggaggt

SEQ ID NO: 40080 - DNA, 16 bp, H. sapiens
aggaggcggaggtggc

SEQ ID NO: 40081 - DNA, 16 bp, H. sapiens
aggaggctcacttgaa

SEQ ID NO: 40082 - DNA, 16 bp, H. sapiens
aggaggctgaagaagg

SEQ ID NO: 40083 - DNA, 16 bp, H. sapiens
aggaggctgaaggagg

SEQ ID NO: 40084 - DNA, 16 bp, H. sapiens
aggaggctgaaggcag

SEQ ID NO: 40085 - DNA, 16 bp, H. sapiens
aggaggctgagaaagg

SEQ ID NO: 40086 - DNA, 16 bp, H. sapiens
aggaggctgagagagg

SEQ ID NO: 40087 - DNA, 16 bp, H. sapiens
aggaggctgagaggag

SEQ ID NO: 40088 - DNA, 16 bp, H. sapiens
aggaggctgagatgag

SEQ ID NO: 40089 - DNA, 16 bp, H. sapiens
aggaggctgagccagg

SEQ ID NO: 40090 - DNA, 16 bp, H. sapiens
aggaggctgaggaaga

SEQ ID NO: 40091 - DNA, 16 bp, H. sapiens
aggaggctgaggagaa

SEQ ID NO: 40092 - DNA, 16 bp, H. sapiens
aggaggctgaggatca

SEQ ID NO: 40093 - DNA, 16 bp, H. sapiens
aggaggctgaggatgg

SEQ ID NO: 40094 - DNA, 18 bp, H. sapiens
aggaggctgaggcaggga

SEQ ID NO: 40095 - DNA, 17 bp, H. sapiens
aggaggctgaggcaggt

SEQ ID NO: 40096 - DNA, 16 bp, H. sapiens
aggaggctgaggccca

SEQ ID NO: 40097 - DNA, 16 bp, H. sapiens
aggaggctgaggcctg

SEQ ID NO: 40098 - DNA, 16 bp, H. sapiens
aggaggctgaggctgc

SEQ ID NO: 40099 - DNA, 16 bp, H. sapiens
aggaggctgaggtgcg

SEQ ID NO: 40100 - DNA, 16 bp, H. sapiens
aggaggctgaggtgga

SEQ ID NO: 40101 - DNA, 16 bp, H. sapiens
aggaggctgaggtggg

SEQ ID NO: 40102 - DNA, 16 bp, H. sapiens
aggaggctgatggggg

SEQ ID NO: 40103 - DNA, 16 bp, H. sapiens
aggaggctgcagggag

SEQ ID NO: 40104 - DNA, 16 bp, H. sapiens
aggaggctgcagtggg

SEQ ID NO: 40105 - DNA, 16 bp, H. sapiens
aggaggctggcaggag

SEQ ID NO: 40106 - DNA, 16 bp, H. sapiens
aggaggctgggaaatg

SEQ ID NO: 40107 - DNA, 16 bp, H. sapiens
aggaggctgggcatgg

SEQ ID NO: 40108 - DNA, 16 bp, H. sapiens
aggaggctgggcctgg

SEQ ID NO: 40109 - DNA, 16 bp, H. sapiens
aggaggctggggcaga

SEQ ID NO: 40110 - DNA, 16 bp, H. sapiens
aggaggctggggccag

SEQ ID NO: 40111 - DNA, 16 bp, H. sapiens
aggaggctgggggaag

SEQ ID NO: 40112 - DNA, 16 bp, H. sapiens
aggaggctgggggcag

SEQ ID NO: 40113 - DNA, 16 bp, H. sapiens
aggaggctgggtgtgg

SEQ ID NO: 40114 - DNA, 16 bp, H. sapiens
aggaggctgtggcagg

SEQ ID NO: 40115 - DNA, 16 bp, H. sapiens
aggaggctgtggtagg

SEQ ID NO: 40116 - DNA, 16 bp, H. sapiens
aggaggctgttgcagt

SEQ ID NO: 40117 - DNA, 16 bp, H. sapiens
aggaggcttgaaggaa

SEQ ID NO: 40118 - DNA, 16 bp, H. sapiens
aggagggaaaagtggt

SEQ ID NO: 40119 - DNA, 16 bp, H. sapiens
aggagggacaggatca

SEQ ID NO: 40120 - DNA, 16 bp, H. sapiens
aggagggacccggtgg

SEQ ID NO: 40121 - DNA, 16 bp, H. sapiens
aggagggagccccagg

SEQ ID NO: 40122 - DNA, 16 bp, H. sapiens
aggagggaggaccgac

SEQ ID NO: 40123 - DNA, 16 bp, H. sapiens
aggagggaggactgct

SEQ ID NO: 40124 - DNA, 16 bp, H. sapiens
aggagggatagcatta

SEQ ID NO: 40125 - DNA, 16 bp, H. sapiens
aggagggcagggccag

SEQ ID NO: 40126 - DNA, 16 bp, H. sapiens
aggagggcaggtggag

SEQ ID NO: 40127 - DNA, 16 bp, H. sapiens
aggagggccaggcatg

SEQ ID NO: 40128 - DNA, 16 bp, H. sapiens
aggagggcggatcacc

SEQ ID NO: 40129 - DNA, 16 bp, H. sapiens
aggagggcggcagctt

SEQ ID NO: 40130 - DNA, 16 bp, H. sapiens
aggaggggaaactgag

SEQ ID NO: 40131 - DNA, 16 bp, H. sapiens
aggaggggccaggtgg

SEQ ID NO: 40132 - DNA, 16 bp, H. sapiens
aggaggggctgagggc

SEQ ID NO: 40133 - DNA, 16 bp, H. sapiens
aggaggggctgctgtg

SEQ ID NO: 40134 - DNA, 16 bp, H. sapiens
aggaggggctgggcct

SEQ ID NO: 40135 - DNA, 16 bp, H. sapiens
aggagggtgaggctgc

SEQ ID NO: 40136 - DNA, 21 bp, H. sapiens
aggaggtagaagttgcagtga

SEQ ID NO: 40137 - DNA, 16 bp, H. sapiens
aggaggtcaaggcggc

SEQ ID NO: 40138 - DNA, 16 bp, H. sapiens
aggaggtcaaggcttc

SEQ ID NO: 40139 - DNA, 16 bp, H. sapiens
aggaggtcagaagatc

SEQ ID NO: 40140 - DNA, 16 bp, H. sapiens
aggaggtcctgagaac

SEQ ID NO: 40141 - DNA, 16 bp, H. sapiens
aggaggtcctggagga

SEQ ID NO: 40142 - DNA, 16 bp, H. sapiens
aggaggtcgaggcagc

SEQ ID NO: 40143 - DNA, 16 bp, H. sapiens
aggaggtcggcacaag

SEQ ID NO: 40144 - DNA, 16 bp, H. sapiens
aggaggtgaaacatct

SEQ ID NO: 40145 - DNA, 16 bp, H. sapiens
aggaggtgacagctcc

SEQ ID NO: 40146 - DNA, 16 bp, H. sapiens
aggaggtgagcagcag

SEQ ID NO: 40147 - DNA, 16 bp, H. sapiens
aggaggtgagggagca

SEQ ID NO: 40148 - DNA, 16 bp, H. sapiens
aggaggtgatatttga

SEQ ID NO: 40149 - DNA, 16 bp, H. sapiens
aggaggtgattgaatt

SEQ ID NO: 40150 - DNA, 16 bp, H. sapiens
aggaggtggagcagaa

SEQ ID NO: 40151 - DNA, 16 bp, H. sapiens
aggaggtggagcccag

SEQ ID NO: 40152 - DNA, 16 bp, H. sapiens
aggaggtggagcctgc

SEQ ID NO: 40153 - DNA, 16 bp, H. sapiens
aggaggtggagccttt

SEQ ID NO: 40154 - DNA, 16 bp, H. sapiens
aggaggtggagctgag

SEQ ID NO: 40155 - DNA, 16 bp, H. sapiens
aggaggtggaggaggc

SEQ ID NO: 40156 - DNA, 16 bp, H. sapiens
aggaggtggaggcagc

SEQ ID NO: 40157 - DNA, 16 bp, H. sapiens
aggaggtggagttgca

SEQ ID NO: 40158 - DNA, 16 bp, H. sapiens
aggaggtggatgttgc

SEQ ID NO: 40159 - DNA, 16 bp, H. sapiens
aggaggtggcatctga

SEQ ID NO: 40160 - DNA, 16 bp, H. sapiens
aggaggtggtggctgc

SEQ ID NO: 40161 - DNA, 16 bp, H. sapiens
aggaggtgtctcccag

SEQ ID NO: 40162 - DNA, 16 bp, H. sapiens
aggaggttaaggtggg

SEQ ID NO: 40163 - DNA, 16 bp, H. sapiens
aggaggttctggagga

SEQ ID NO: 40164 - DNA, 16 bp, H. sapiens
aggaggttgagatcag

SEQ ID NO: 40165 - DNA, 16 bp, H. sapiens
aggaggttgaggcttc

SEQ ID NO: 40166 - DNA, 16 bp, H. sapiens
aggagtaaggaagcca

SEQ ID NO: 40167 - DNA, 16 bp, H. sapiens
aggagtaaggtggtat

SEQ ID NO: 40168 - DNA, 16 bp, H. sapiens
aggagtacccggccat

SEQ ID NO: 40169 - DNA, 16 bp, H. sapiens
aggagtagaaaaccaa

SEQ ID NO: 40170 - DNA, 16 bp, H. sapiens
aggagtcatgcagcca

SEQ ID NO: 40171 - DNA, 16 bp, H. sapiens
aggagtccaagatcag

SEQ ID NO: 40172 - DNA, 16 bp, H. sapiens
aggagtcctcctgcct

SEQ ID NO: 40173 - DNA, 16 bp, H. sapiens
aggagtctctcccaga

SEQ ID NO: 40174 - DNA, 16 bp, H. sapiens
aggagtctgagagcag

SEQ ID NO: 40175 - DNA, 16 bp, H. sapiens
aggagtctgaggccag

SEQ ID NO: 40176 - DNA, 16 bp, H. sapiens
aggagtctgaggctgt

SEQ ID NO: 40177 - DNA, 16 bp, H. sapiens
aggagtgaagctgtgg

SEQ ID NO: 40178 - DNA, 16 bp, H. sapiens
aggagtgactttgaat

SEQ ID NO: 40179 - DNA, 16 bp, H. sapiens
aggagtgaggctgcag

SEQ ID NO: 40180 - DNA, 16 bp, H. sapiens
aggagtgatttttttt

SEQ ID NO: 40181 - DNA, 16 bp, H. sapiens
aggagtggacatttca

SEQ ID NO: 40182 - DNA, 16 bp, H. sapiens
aggagtggagctgccc

SEQ ID NO: 40183 - DNA, 16 bp, H. sapiens
aggagtggaggctgag

SEQ ID NO: 40184 - DNA, 16 bp, H. sapiens
aggagtggcagaggca

SEQ ID NO: 40185 - DNA, 16 bp, H. sapiens
aggagtgtgccatcac

SEQ ID NO: 40186 - DNA, 16 bp, H. sapiens
aggagtgtgtgtgtgt

SEQ ID NO: 40187 - DNA, 16 bp, H. sapiens
aggagtgttttccttc

SEQ ID NO: 40188 - DNA, 16 bp, H. sapiens
aggagttatagaccag

SEQ ID NO: 40189 - DNA, 16 bp, H. sapiens
aggagttcaaagctgc

SEQ ID NO: 40190 - DNA, 16 bp, H. sapiens
aggagttcaagaactg

SEQ ID NO: 40191 - DNA, 16 bp, H. sapiens
aggagttcaaggcagc

SEQ ID NO: 40192 - DNA, 16 bp, H. sapiens
aggagttcaaggccaa

SEQ ID NO: 40193 - DNA, 16 bp, H. sapiens
aggagttcaaggcctg

SEQ ID NO: 40194 - DNA, 16 bp, H. sapiens
aggagttcaggaccag

SEQ ID NO: 40195 - DNA, 16 bp, H. sapiens
aggagttccagaaaga

SEQ ID NO: 40196 - DNA, 17 bp, H. sapiens
aggagttccagaccagt

SEQ ID NO: 40197 - DNA, 20 bp, H. sapiens
aggagttcgagaccagcctt

SEQ ID NO: 40198 - DNA, 16 bp, H. sapiens
aggagttggaggctgt

SEQ ID NO: 40199 - DNA, 16 bp, H. sapiens
aggagttgggagacca

SEQ ID NO: 40200 - DNA, 16 bp, H. sapiens
aggagtttaagaccat

SEQ ID NO: 40201 - DNA, 16 bp, H. sapiens
aggagtttaagactag

SEQ ID NO: 40202 - DNA, 16 bp, H. sapiens
aggagtttgaagctac

SEQ ID NO: 40203 - DNA, 16 bp, H. sapiens
aggagtttgacaccag

SEQ ID NO: 40204 - DNA, 16 bp, H. sapiens
aggagtttgagaagag

SEQ ID NO: 40205 - DNA, 16 bp, H. sapiens
aggagtttgagaccat

SEQ ID NO: 40206 - DNA, 16 bp, H. sapiens
aggagtttgagcccag

SEQ ID NO: 40207 - DNA, 16 bp, H. sapiens
aggagtttgagctgca

SEQ ID NO: 40208 - DNA, 16 bp, H. sapiens
aggagtttgaggtcac

SEQ ID NO: 40209 - DNA, 16 bp, H. sapiens
aggagtttgcgatcag

SEQ ID NO: 40210 - DNA, 16 bp, H. sapiens
aggagtttggaaacac

SEQ ID NO: 40211 - DNA, 16 bp, H. sapiens
aggagtttggaggaag

SEQ ID NO: 40212 - DNA, 16 bp, H. sapiens
aggagtttggggccag

SEQ ID NO: 40213 - DNA, 16 bp, H. sapiens
aggagtttgtgaccaa

SEQ ID NO: 40214 - DNA, 16 bp, H. sapiens
aggagtttgtgatcag

SEQ ID NO: 40215 - DNA, 16 bp, H. sapiens
aggataaaagtttgga

SEQ ID NO: 40216 - DNA, 16 bp, H. sapiens
aggataaaatctaaac

SEQ ID NO: 40217 - DNA, 16 bp, H. sapiens
aggataaagaggatga

SEQ ID NO: 40218 - DNA, 16 bp, H. sapiens
aggataaagtccaaat

SEQ ID NO: 40219 - DNA, 16 bp, H. sapiens
aggataacggcctcca

SEQ ID NO: 40220 - DNA, 16 bp, H. sapiens
aggataataaaaatgt

SEQ ID NO: 40221 - DNA, 16 bp, H. sapiens
aggataataccaagag

SEQ ID NO: 40222 - DNA, 16 bp, H. sapiens
aggataatgatgatga

SEQ ID NO: 40223 - DNA, 16 bp, H. sapiens
aggataatggggaaca

SEQ ID NO: 40224 - DNA, 16 bp, H. sapiens
aggataatggtctcca

SEQ ID NO: 40225 - DNA, 16 bp, H. sapiens
aggataatttttaaaa

SEQ ID NO: 40226 - DNA, 16 bp, H. sapiens
aggatacaaaatcaac

SEQ ID NO: 40227 - DNA, 17 bp, H. sapiens
aggatacaaaatcaata

SEQ ID NO: 40228 - DNA, 16 bp, H. sapiens
aggatacaaatggaag

SEQ ID NO: 40229 - DNA, 16 bp, H. sapiens
aggatacaacaagaag

SEQ ID NO: 40230 - DNA, 16 bp, H. sapiens
aggatacagtggtgaa

SEQ ID NO: 40231 - DNA, 16 bp, H. sapiens
aggatactgaggcaca

SEQ ID NO: 40232 - DNA, 16 bp, H. sapiens
aggatagcttgagcca

SEQ ID NO: 40233 - DNA, 16 bp, H. sapiens
aggatagtgagctctt

SEQ ID NO: 40234 - DNA, 16 bp, H. sapiens
aggatagtggcttcca

SEQ ID NO: 40235 - DNA, 16 bp, H. sapiens
aggatatagaagactt

SEQ ID NO: 40236 - DNA, 17 bp, H. sapiens
aggatatcatttttgat

SEQ ID NO: 40237 - DNA, 16 bp, H. sapiens
aggatatgaagaaatt

SEQ ID NO: 40238 - DNA, 16 bp, H. sapiens
aggatatggaaaaatt

SEQ ID NO: 40239 - DNA, 16 bp, H. sapiens
aggatatggacatctt

SEQ ID NO: 40240 - DNA, 16 bp, H. sapiens
aggatatggagcaaca

SEQ ID NO: 40241 - DNA, 16 bp, H. sapiens
aggatattacaaagga

SEQ ID NO: 40242 - DNA, 16 bp, H. sapiens
aggatattgtccatga

SEQ ID NO: 40243 - DNA, 16 bp, H. sapiens
aggatatttagcagca

SEQ ID NO: 40244 - DNA, 16 bp, H. sapiens
aggatatttggttttt

SEQ ID NO: 40245 - DNA, 16 bp, H. sapiens
aggatattttccagga

SEQ ID NO: 40246 - DNA, 16 bp, H. sapiens
aggatatttttttctt

SEQ ID NO: 40247 - DNA, 25 bp, H. sapiens
aggatcaaagtcacacataacaata

SEQ ID NO: 40248 - DNA, 16 bp, H. sapiens
aggatcaaatgagaaa

SEQ ID NO: 40249 - DNA, 16 bp, H. sapiens
aggatcaaatgagaca

SEQ ID NO: 40250 - DNA, 16 bp, H. sapiens
aggatcaccagagcct

SEQ ID NO: 40251 - DNA, 16 bp, H. sapiens
aggatcacttgagcct

SEQ ID NO: 40252 - DNA, 16 bp, H. sapiens
aggatcacttgagctt

SEQ ID NO: 40253 - DNA, 17 bp, H. sapiens
aggatcacttgaggcct

SEQ ID NO: 40254 - DNA, 16 bp, H. sapiens
aggatcagcctggcca

SEQ ID NO: 40255 - DNA, 16 bp, H. sapiens
aggatcagctgagccc

SEQ ID NO: 40256 - DNA, 16 bp, H. sapiens
aggatcagttgagccc

SEQ ID NO: 40257 - DNA, 16 bp, H. sapiens
aggatcattaatatca

SEQ ID NO: 40258 - DNA, 16 bp, H. sapiens
aggatcatttgagcct

SEQ ID NO: 40259 - DNA, 16 bp, H. sapiens
aggatccaaaatcaat

SEQ ID NO: 40260 - DNA, 16 bp, H. sapiens
aggatcccattcagga

SEQ ID NO: 40261 - DNA, 16 bp, H. sapiens
aggatcgcctgaacct

SEQ ID NO: 40262 - DNA, 16 bp, H. sapiens
aggatcgctcaagccc

SEQ ID NO: 40263 - DNA, 16 bp, H. sapiens
aggatcgcttgagctt

SEQ ID NO: 40264 - DNA, 16 bp, H. sapiens
aggatcgcttgtgcct

SEQ ID NO: 40265 - DNA, 16 bp, H. sapiens
aggatctacaaccaga

SEQ ID NO: 40266 - DNA, 16 bp, H. sapiens
aggatctagaatcaga

SEQ ID NO: 40267 - DNA, 16 bp, H. sapiens
aggatctagaattaga

SEQ ID NO: 40268 - DNA, 16 bp, H. sapiens
aggatctaggttgcat

SEQ ID NO: 40269 - DNA, 16 bp, H. sapiens
aggatctctctctgtc

SEQ ID NO: 40270 - DNA, 16 bp, H. sapiens
aggatctgaactcagg

SEQ ID NO: 40271 - DNA, 16 bp, H. sapiens
aggatctgtttccttg

SEQ ID NO: 40272 - DNA, 16 bp, H. sapiens
aggatcttgagatgga

SEQ ID NO: 40273 - DNA, 16 bp, H. sapiens
aggatcttgagatggg

SEQ ID NO: 40274 - DNA, 16 bp, H. sapiens
aggatctttaaagagg

SEQ ID NO: 40275 - DNA, 16 bp, H. sapiens
aggatctttgcagatg

SEQ ID NO: 40276 - DNA, 16 bp, H. sapiens
aggatcttttgtattt

SEQ ID NO: 40277 - DNA, 16 bp, H. sapiens
aggatgaaatgagata

SEQ ID NO: 40278 - DNA, 16 bp, H. sapiens
aggatgaaatgagatc

SEQ ID NO: 40279 - DNA, 16 bp, H. sapiens
aggatgaactatgtgt

SEQ ID NO: 40280 - DNA, 16 bp, H. sapiens
aggatgaagaaactca

SEQ ID NO: 40281 - DNA, 16 bp, H. sapiens
aggatgaagaccttta

SEQ ID NO: 40282 - DNA, 16 bp, H. sapiens
aggatgaataggagtt

SEQ ID NO: 40283 - DNA, 16 bp, H. sapiens
aggatgagaagcaggc

SEQ ID NO: 40284 - DNA, 16 bp, H. sapiens
aggatgagccaggaga

SEQ ID NO: 40285 - DNA, 16 bp, H. sapiens
aggatgagctgcagac

SEQ ID NO: 40286 - DNA, 16 bp, H. sapiens
aggatgaggatgaaga

SEQ ID NO: 40287 - DNA, 16 bp, H. sapiens
aggatgaggcagaaga

SEQ ID NO: 40288 - DNA, 16 bp, H. sapiens
aggatgatgacatcac

SEQ ID NO: 40289 - DNA, 16 bp, H. sapiens
aggatgatgacttcca

SEQ ID NO: 40290 - DNA, 16 bp, H. sapiens
aggatgatgatgatgg

SEQ ID NO: 40291 - DNA, 16 bp, H. sapiens
aggatgatgctggcct

SEQ ID NO: 40292 - DNA, 16 bp, H. sapiens
aggatgcaaaggcaga

SEQ ID NO: 40293 - DNA, 16 bp, H. sapiens
aggatgcagtgagcca

SEQ ID NO: 40294 - DNA, 16 bp, H. sapiens
aggatgcccactccca

SEQ ID NO: 40295 - DNA, 16 bp, H. sapiens
aggatgcccactgtca

SEQ ID NO: 40296 - DNA, 16 bp, H. sapiens
aggatgcccactttca

SEQ ID NO: 40297 - DNA, 16 bp, H. sapiens
aggatgccctccctca

SEQ ID NO: 40298 - DNA, 16 bp, H. sapiens
aggatgcctccagctt

SEQ ID NO: 40299 - DNA, 16 bp, H. sapiens
aggatgcggtgagcca

SEQ ID NO: 40300 - DNA, 16 bp, H. sapiens
aggatgctgaatttta

SEQ ID NO: 40301 - DNA, 16 bp, H. sapiens
aggatggaaaaattca

SEQ ID NO: 40302 - DNA, 16 bp, H. sapiens
aggatggaacatgaaa

SEQ ID NO: 40303 - DNA, 16 bp, H. sapiens
aggatggaaggatgga

SEQ ID NO: 40304 - DNA, 16 bp, H. sapiens
aggatggaatattttt

SEQ ID NO: 40305 - DNA, 16 bp, H. sapiens
aggatggagcaggtga

SEQ ID NO: 40306 - DNA, 16 bp, H. sapiens
aggatggagtgcggtg

SEQ ID NO: 40307 - DNA, 16 bp, H. sapiens
aggatggagtgtagtg

SEQ ID NO: 40308 - DNA, 16 bp, H. sapiens
aggatggatgaatgga

SEQ ID NO: 40309 - DNA, 16 bp, H. sapiens
aggatggatttgggga

SEQ ID NO: 40310 - DNA, 16 bp, H. sapiens
aggatggcagagcaga

SEQ ID NO: 40311 - DNA, 16 bp, H. sapiens
aggatggctactattt

SEQ ID NO: 40312 - DNA, 16 bp, H. sapiens
aggatggctggagcct

SEQ ID NO: 40313 - DNA, 16 bp, H. sapiens
aggatggcttgagcac

SEQ ID NO: 40314 - DNA, 16 bp, H. sapiens
aggatgggaaaagata

SEQ ID NO: 40315 - DNA, 16 bp, H. sapiens
aggatgggagtgatga

SEQ ID NO: 40316 - DNA, 16 bp, H. sapiens
aggatggggagaggtt

SEQ ID NO: 40317 - DNA, 16 bp, H. sapiens
aggatgggggctggtt

SEQ ID NO: 40318 - DNA, 16 bp, H. sapiens
aggatggtctctaact

SEQ ID NO: 40319 - DNA, 17 bp, H. sapiens
aggatggtctctatctc

SEQ ID NO: 40320 - DNA, 16 bp, H. sapiens
aggatggtctcttcaa

SEQ ID NO: 40321 - DNA, 16 bp, H. sapiens
aggatggtcttgctct

SEQ ID NO: 40322 - DNA, 16 bp, H. sapiens
aggatggtgctggcct

SEQ ID NO: 40323 - DNA, 16 bp, H. sapiens
aggatggtgtgtgtgt

SEQ ID NO: 40324 - DNA, 16 bp, H. sapiens
aggatggttaccagaa

SEQ ID NO: 40325 - DNA, 16 bp, H. sapiens
aggatggttcaaaata

SEQ ID NO: 40326 - DNA, 16 bp, H. sapiens
aggatgtaaagaaatt

SEQ ID NO: 40327 - DNA, 16 bp, H. sapiens
aggatgtacagggatg

SEQ ID NO: 40328 - DNA, 16 bp, H. sapiens
aggatgtagtgagcca

SEQ ID NO: 40329 - DNA, 16 bp, H. sapiens
aggatgtatgaaaaag

SEQ ID NO: 40330 - DNA, 16 bp, H. sapiens
aggatgtcttgagccc

SEQ ID NO: 40331 - DNA, 16 bp, H. sapiens
aggatgtggacatttt

SEQ ID NO: 40332 - DNA, 16 bp, H. sapiens
aggatgtggagaagct

SEQ ID NO: 40333 - DNA, 16 bp, H. sapiens
aggatgtggaggctgc

SEQ ID NO: 40334 - DNA, 16 bp, H. sapiens
aggatgtgtttacttc

SEQ ID NO: 40335 - DNA, 16 bp, H. sapiens
aggatgtgtttgcttc

SEQ ID NO: 40336 - DNA, 16 bp, H. sapiens
aggatgtgtttgcttt

SEQ ID NO: 40337 - DNA, 16 bp, H. sapiens
aggatgtttagtagca

SEQ ID NO: 40338 - DNA, 16 bp, H. sapiens
aggatgtttccagaag

SEQ ID NO: 40339 - DNA, 16 bp, H. sapiens
aggattaaaagagata

SEQ ID NO: 40340 - DNA, 16 bp, H. sapiens
aggattaaatgagaaa

SEQ ID NO: 40341 - DNA, 16 bp, H. sapiens
aggattaaatgcatta

SEQ ID NO: 40342 - DNA, 16 bp, H. sapiens
aggattaattttctta

SEQ ID NO: 40343 - DNA, 16 bp, H. sapiens
aggattacaaatgtga

SEQ ID NO: 40344 - DNA, 16 bp, H. sapiens
aggattacaccattga

SEQ ID NO: 40345 - DNA, 16 bp, H. sapiens
aggattacaggcatcc

SEQ ID NO: 40346 - DNA, 16 bp, H. sapiens
aggattacaggtacac

SEQ ID NO: 40347 - DNA, 16 bp, H. sapiens
aggattagtgccctta

SEQ ID NO: 40348 - DNA, 16 bp, H. sapiens
aggattataggcgtga

SEQ ID NO: 40349 - DNA, 16 bp, H. sapiens
aggattatgggaatta

SEQ ID NO: 40350 - DNA, 16 bp, H. sapiens
aggattatgggagggg

SEQ ID NO: 40351 - DNA, 16 bp, H. sapiens
aggattattgtgagga

SEQ ID NO: 40352 - DNA, 16 bp, H. sapiens
aggattcaaaatcaac

SEQ ID NO: 40353 - DNA, 16 bp, H. sapiens
aggattcaaagccagg

SEQ ID NO: 40354 - DNA, 16 bp, H. sapiens
aggattccaaaacact

SEQ ID NO: 40355 - DNA, 16 bp, H. sapiens
aggattccatccagga

SEQ ID NO: 40356 - DNA, 16 bp, H. sapiens
aggattccctcctttt

SEQ ID NO: 40357 - DNA, 16 bp, H. sapiens
aggattctaaaagtag

SEQ ID NO: 40358 - DNA, 16 bp, H. sapiens
aggattcttacagttt

SEQ ID NO: 40359 - DNA, 17 bp, H. sapiens
aggattgactctaattt

SEQ ID NO: 40360 - DNA, 16 bp, H. sapiens
aggattgagatagagt

SEQ ID NO: 40361 - DNA, 16 bp, H. sapiens
aggattgcaaccctgc

SEQ ID NO: 40362 - DNA, 16 bp, H. sapiens
aggattgcttgagcca

SEQ ID NO: 40363 - DNA, 16 bp, H. sapiens
aggattgcttgagccg

SEQ ID NO: 40364 - DNA, 17 bp, H. sapiens
aggattgcttgagccta

SEQ ID NO: 40365 - DNA, 16 bp, H. sapiens
aggattgcttgcacct

SEQ ID NO: 40366 - DNA, 16 bp, H. sapiens
aggattggtaccagtt

SEQ ID NO: 40367 - DNA, 16 bp, H. sapiens
aggattggtttcttct

SEQ ID NO: 40368 - DNA, 16 bp, H. sapiens
aggattgtaaaacgca

SEQ ID NO: 40369 - DNA, 16 bp, H. sapiens
aggattgtgatatttt

SEQ ID NO: 40370 - DNA, 16 bp, H. sapiens
aggattgttatgaaga

SEQ ID NO: 40371 - DNA, 16 bp, H. sapiens
aggattgttttaaatt

SEQ ID NO: 40372 - DNA, 16 bp, H. sapiens
aggatttagaatattt

SEQ ID NO: 40373 - DNA, 16 bp, H. sapiens
aggatttatgactaag

SEQ ID NO: 40374 - DNA, 16 bp, H. sapiens
aggatttatttcaaga

SEQ ID NO: 40375 - DNA, 16 bp, H. sapiens
aggatttcaacatgaa

SEQ ID NO: 40376 - DNA, 16 bp, H. sapiens
aggatttcatatccag

SEQ ID NO: 40377 - DNA, 16 bp, H. sapiens
aggatttcatcatgtt

SEQ ID NO: 40378 - DNA, 16 bp, H. sapiens
aggatttcattataaa

SEQ ID NO: 40379 - DNA, 16 bp, H. sapiens
aggatttcattctctt

SEQ ID NO: 40380 - DNA, 16 bp, H. sapiens
aggatttcatttatat

SEQ ID NO: 40381 - DNA, 16 bp, H. sapiens
aggatttctatttttt

SEQ ID NO: 40382 - DNA, 16 bp, H. sapiens
aggatttctcaacctt

SEQ ID NO: 40383 - DNA, 16 bp, H. sapiens
aggatttctttctttc

SEQ ID NO: 40384 - DNA, 16 bp, H. sapiens
aggatttgaactcaga

SEQ ID NO: 40385 - DNA, 16 bp, H. sapiens
aggatttgaagccagg

SEQ ID NO: 40386 - DNA, 16 bp, H. sapiens
aggatttgaataggca

SEQ ID NO: 40387 - DNA, 16 bp, H. sapiens
aggatttgaatccaga

SEQ ID NO: 40388 - DNA, 16 bp, H. sapiens
aggatttgaattcagg

SEQ ID NO: 40389 - DNA, 16 bp, H. sapiens
aggatttgctgatgga

SEQ ID NO: 40390 - DNA, 16 bp, H. sapiens
aggatttggagaaaag

SEQ ID NO: 40391 - DNA, 16 bp, H. sapiens
aggattttaaaaagaa

SEQ ID NO: 40392 - DNA, 16 bp, H. sapiens
aggattttcacatcaa

SEQ ID NO: 40393 - DNA, 16 bp, H. sapiens
aggattttcttttctt

SEQ ID NO: 40394 - DNA, 16 bp, H. sapiens
aggattttgaaaaatt

SEQ ID NO: 40395 - DNA, 16 bp, H. sapiens
aggattttgaatgttt

SEQ ID NO: 40396 - DNA, 16 bp, H. sapiens
aggattttgaggctgc

SEQ ID NO: 40397 - DNA, 16 bp, H. sapiens
aggattttgataggga

SEQ ID NO: 40398 - DNA, 16 bp, H. sapiens
aggattttgctgtgtt

SEQ ID NO: 40399 - DNA, 16 bp, H. sapiens
aggattttggagcaaa

SEQ ID NO: 40400 - DNA, 16 bp, H. sapiens
aggattttgtcaccac

SEQ ID NO: 40401 - DNA, 16 bp, H. sapiens
aggatttttacagttt

SEQ ID NO: 40402 - DNA, 16 bp, H. sapiens
aggatttttacatcaa

SEQ ID NO: 40403 - DNA, 16 bp, H. sapiens
aggatttttagagttt

SEQ ID NO: 40404 - DNA, 16 bp, H. sapiens
aggatttttatatcaa

SEQ ID NO: 40405 - DNA, 16 bp, H. sapiens
aggatttttcaacttt

SEQ ID NO: 40406 - DNA, 16 bp, H. sapiens
aggatttttgcctcta

SEQ ID NO: 40407 - DNA, 16 bp, H. sapiens
aggcaaaaaataaatg

SEQ ID NO: 40408 - DNA, 16 bp, H. sapiens
aggcaaaaatatttaa

SEQ ID NO: 40409 - DNA, 16 bp, H. sapiens
aggcaaaaattgacaa

SEQ ID NO: 40410 - DNA, 16 bp, H. sapiens
aggcaaaactgtgaag

SEQ ID NO: 40411 - DNA, 16 bp, H. sapiens
aggcaaaactttgtag

SEQ ID NO: 40412 - DNA, 16 bp, H. sapiens
aggcaaaagagcgaga

SEQ ID NO: 40413 - DNA, 16 bp, H. sapiens
aggcaaaatatctgaa

SEQ ID NO: 40414 - DNA, 16 bp, H. sapiens
aggcaaaccatatcat

SEQ ID NO: 40415 - DNA, 16 bp, H. sapiens
aggcaaacgctgagct

SEQ ID NO: 40416 - DNA, 16 bp, H. sapiens
aggcaaagaaggagca

SEQ ID NO: 40417 - DNA, 16 bp, H. sapiens
aggcaaagactgcagt

SEQ ID NO: 40418 - DNA, 16 bp, H. sapiens
aggcaaagagagaact

SEQ ID NO: 40419 - DNA, 16 bp, H. sapiens
aggcaaagagaggtta

SEQ ID NO: 40420 - DNA, 16 bp, H. sapiens
aggcaaagaggaactg

SEQ ID NO: 40421 - DNA, 16 bp, H. sapiens
aggcaaagaggagcaa

SEQ ID NO: 40422 - DNA, 16 bp, H. sapiens
aggcaaagagggagca

SEQ ID NO: 40423 - DNA, 16 bp, H. sapiens
aggcaaaggaaatgaa

SEQ ID NO: 40424 - DNA, 16 bp, H. sapiens
aggcaaaggcagagga

SEQ ID NO: 40425 - DNA, 16 bp, H. sapiens
aggcaaagggggagcc

SEQ ID NO: 40426 - DNA, 16 bp, H. sapiens
aggcaaataaaaagct

SEQ ID NO: 40427 - DNA, 16 bp, H. sapiens
aggcaaatagaccaat

SEQ ID NO: 40428 - DNA, 16 bp, H. sapiens
aggcaaatatataaaa

SEQ ID NO: 40429 - DNA, 16 bp, H. sapiens
aggcaaatcaataaat

SEQ ID NO: 40430 - DNA, 16 bp, H. sapiens
aggcaaatccacagaa

SEQ ID NO: 40431 - DNA, 16 bp, H. sapiens
aggcaaatccatggag

SEQ ID NO: 40432 - DNA, 16 bp, H. sapiens
aggcaaatctataaag

SEQ ID NO: 40433 - DNA, 17 bp, H. sapiens
aggcaacaagagcaaaa

SEQ ID NO: 40434 - DNA, 16 bp, H. sapiens
aggcaacacagcaaga

SEQ ID NO: 40435 - DNA, 16 bp, H. sapiens
aggcaacacagtgaga

SEQ ID NO: 40436 - DNA, 17 bp, H. sapiens
aggcaacagaattgctt

SEQ ID NO: 40437 - DNA, 16 bp, H. sapiens
aggcaacatggcaaga

SEQ ID NO: 40438 - DNA, 16 bp, H. sapiens
aggcaacatttgggca

SEQ ID NO: 40439 - DNA, 16 bp, H. sapiens
aggcaaccaaagcaaa

SEQ ID NO: 40440 - DNA, 16 bp, H. sapiens
aggcaactaaagcaaa

SEQ ID NO: 40441 - DNA, 16 bp, H. sapiens
aggcaactgtaacaca

SEQ ID NO: 40442 - DNA, 16 bp, H. sapiens
aggcaacttggaagtg

SEQ ID NO: 40443 - DNA, 16 bp, H. sapiens
aggcaagaaggaggtc

SEQ ID NO: 40444 - DNA, 16 bp, H. sapiens
aggcaagactctgtct

SEQ ID NO: 40445 - DNA, 16 bp, H. sapiens
aggcaagagaaagata

SEQ ID NO: 40446 - DNA, 16 bp, H. sapiens
aggcaagagaatttct

SEQ ID NO: 40447 - DNA, 16 bp, H. sapiens
aggcaagagccactgc

SEQ ID NO: 40448 - DNA, 16 bp, H. sapiens
aggcaagaggattgct

SEQ ID NO: 40449 - DNA, 16 bp, H. sapiens
aggcaagagtattgct

SEQ ID NO: 40450 - DNA, 16 bp, H. sapiens
aggcaagagtgcaatg

SEQ ID NO: 40451 - DNA, 16 bp, H. sapiens
aggcaagatcatgcca

SEQ ID NO: 40452 - DNA, 16 bp, H. sapiens
aggcaaggagagaatg

SEQ ID NO: 40453 - DNA, 16 bp, H. sapiens
aggcaagggccaccac

SEQ ID NO: 40454 - DNA, 16 bp, H. sapiens
aggcaataataaatag

SEQ ID NO: 40455 - DNA, 16 bp, H. sapiens
aggcaatccacccacc

SEQ ID NO: 40456 - DNA, 16 bp, H. sapiens
aggcaatcctaagcaa

SEQ ID NO: 40457 - DNA, 16 bp, H. sapiens
aggcaatcgggcagtg

SEQ ID NO: 40458 - DNA, 16 bp, H. sapiens
aggcaatctgcccatc

SEQ ID NO: 40459 - DNA, 16 bp, H. sapiens
aggcaatctggacttt

SEQ ID NO: 40460 - DNA, 16 bp, H. sapiens
aggcaatgatcttttt

SEQ ID NO: 40461 - DNA, 16 bp, H. sapiens
aggcaatgccccaccc

SEQ ID NO: 40462 - DNA, 17 bp, H. sapiens
aggcaattctcctgcct

SEQ ID NO: 40463 - DNA, 16 bp, H. sapiens
aggcacacacagccac

SEQ ID NO: 40464 - DNA, 16 bp, H. sapiens
aggcacagaaagacac

SEQ ID NO: 40465 - DNA, 16 bp, H. sapiens
aggcacagaaagataa

SEQ ID NO: 40466 - DNA, 16 bp, H. sapiens
aggcacagaaaggtta

SEQ ID NO: 40467 - DNA, 16 bp, H. sapiens
aggcacagagaaaaca

SEQ ID NO: 40468 - DNA, 16 bp, H. sapiens
aggcacagagagatta

SEQ ID NO: 40469 - DNA, 16 bp, H. sapiens
aggcacagagaggaaa

SEQ ID NO: 40470 - DNA, 16 bp, H. sapiens
aggcacagagaggcag

SEQ ID NO: 40471 - DNA, 16 bp, H. sapiens
aggcacagagaggcca

SEQ ID NO: 40472 - DNA, 16 bp, H. sapiens
aggcacagagaggtta

SEQ ID NO: 40473 - DNA, 16 bp, H. sapiens
aggcacagctggatcc

SEQ ID NO: 40474 - DNA, 16 bp, H. sapiens
aggcacaggatggggg

SEQ ID NO: 40475 - DNA, 16 bp, H. sapiens
aggcacaggctgcagt

SEQ ID NO: 40476 - DNA, 16 bp, H. sapiens
aggcacaggtgggagg

SEQ ID NO: 40477 - DNA, 16 bp, H. sapiens
aggcacagtgccaggc

SEQ ID NO: 40478 - DNA, 16 bp, H. sapiens
aggcacataccaccaa

SEQ ID NO: 40479 - DNA, 16 bp, H. sapiens
aggcacatgccaccac

SEQ ID NO: 40480 - DNA, 17 bp, H. sapiens
aggcacatgccaccata

SEQ ID NO: 40481 - DNA, 16 bp, H. sapiens
aggcaccaccaccaca

SEQ ID NO: 40482 - DNA, 16 bp, H. sapiens
aggcaccaccagccac

SEQ ID NO: 40483 - DNA, 16 bp, H. sapiens
aggcaccatctatgag

SEQ ID NO: 40484 - DNA, 16 bp, H. sapiens
aggcacccaagggaat

SEQ ID NO: 40485 - DNA, 16 bp, H. sapiens
aggcacccaccatgcc

SEQ ID NO: 40486 - DNA, 16 bp, H. sapiens
aggcacccctccccca

SEQ ID NO: 40487 - DNA, 16 bp, H. sapiens
aggcacctcttcacag

SEQ ID NO: 40488 - DNA, 16 bp, H. sapiens
aggcacctgccaccca

SEQ ID NO: 40489 - DNA, 16 bp, H. sapiens
aggcacctgccactac

SEQ ID NO: 40490 - DNA, 16 bp, H. sapiens
aggcacctgcccccac

SEQ ID NO: 40491 - DNA, 16 bp, H. sapiens
aggcacctgtgagcca

SEQ ID NO: 40492 - DNA, 16 bp, H. sapiens
aggcaccttctttaca

SEQ ID NO: 40493 - DNA, 16 bp, H. sapiens
aggcacgagccactgc

SEQ ID NO: 40494 - DNA, 16 bp, H. sapiens
aggcacgcaccactgc

SEQ ID NO: 40495 - DNA, 16 bp, H. sapiens
aggcacggcggctcat

SEQ ID NO: 40496 - DNA, 17 bp, H. sapiens
aggcacggtggcttatg

SEQ ID NO: 40497 - DNA, 16 bp, H. sapiens
aggcactattctagat

SEQ ID NO: 40498 - DNA, 16 bp, H. sapiens
aggcactcaataaata

SEQ ID NO: 40499 - DNA, 16 bp, H. sapiens
aggcactcaccaccac

SEQ ID NO: 40500 - DNA, 16 bp, H. sapiens
aggcactgaaagaaaa

SEQ ID NO: 40501 - DNA, 16 bp, H. sapiens
aggcactgagagtgga

SEQ ID NO: 40502 - DNA, 16 bp, H. sapiens
aggcactgaggacaca

SEQ ID NO: 40503 - DNA, 16 bp, H. sapiens
aggcactgggaatgca

SEQ ID NO: 40504 - DNA, 16 bp, H. sapiens
aggcactgggctgggc

SEQ ID NO: 40505 - DNA, 16 bp, H. sapiens
aggcactggggacaca

SEQ ID NO: 40506 - DNA, 16 bp, H. sapiens
aggcactggggataca

SEQ ID NO: 40507 - DNA, 16 bp, H. sapiens
aggcactggggatgca

SEQ ID NO: 40508 - DNA, 16 bp, H. sapiens
aggcactgtactaggc

SEQ ID NO: 40509 - DNA, 16 bp, H. sapiens
aggcactgtgccaggc

SEQ ID NO: 40510 - DNA, 16 bp, H. sapiens
aggcactgtgccaggt

SEQ ID NO: 40511 - DNA, 16 bp, H. sapiens
aggcactgtgcccagc

SEQ ID NO: 40512 - DNA, 16 bp, H. sapiens
aggcactgtgctaggc

SEQ ID NO: 40513 - DNA, 16 bp, H. sapiens
aggcactgtgctcagt

SEQ ID NO: 40514 - DNA, 16 bp, H. sapiens
aggcactgtgctgggc

SEQ ID NO: 40515 - DNA, 16 bp, H. sapiens
aggcactgttctaaat

SEQ ID NO: 40516 - DNA, 16 bp, H. sapiens
aggcagaaaaaaattt

SEQ ID NO: 40517 - DNA, 16 bp, H. sapiens
aggcagaaaagggtgg

SEQ ID NO: 40518 - DNA, 16 bp, H. sapiens
aggcagaaacatttaa

SEQ ID NO: 40519 - DNA, 16 bp, H. sapiens
aggcagaaataaaaat

SEQ ID NO: 40520 - DNA, 16 bp, H. sapiens
aggcagaaatccaggc

SEQ ID NO: 40521 - DNA, 16 bp, H. sapiens
aggcagaaatttgctg

SEQ ID NO: 40522 - DNA, 16 bp, H. sapiens
aggcagaagaaaatct

SEQ ID NO: 40523 - DNA, 16 bp, H. sapiens
aggcagaagaaatagc

SEQ ID NO: 40524 - DNA, 16 bp, H. sapiens
aggcagaagaaatgct

SEQ ID NO: 40525 - DNA, 16 bp, H. sapiens
aggcagaagaagatgg

SEQ ID NO: 40526 - DNA, 16 bp, H. sapiens
aggcagaagaaggtgg

SEQ ID NO: 40527 - DNA, 19 bp, H. sapiens
aggcagaagaatctcttga

SEQ ID NO: 40528 - DNA, 16 bp, H. sapiens
aggcagaagaatcttt

SEQ ID NO: 40529 - DNA, 16 bp, H. sapiens
aggcagaagacagtga

SEQ ID NO: 40530 - DNA, 16 bp, H. sapiens
aggcagaagaggtgga

SEQ ID NO: 40531 - DNA, 16 bp, H. sapiens
aggcagaagattgctt

SEQ ID NO: 40532 - DNA, 16 bp, H. sapiens
aggcagaagcaggagg

SEQ ID NO: 40533 - DNA, 16 bp, H. sapiens
aggcagaaggactgct

SEQ ID NO: 40534 - DNA, 16 bp, H. sapiens
aggcagaaggatgact

SEQ ID NO: 40535 - DNA, 16 bp, H. sapiens
aggcagaaggtggaag

SEQ ID NO: 40536 - DNA, 16 bp, H. sapiens
aggcagaagtgggcag

SEQ ID NO: 40537 - DNA, 16 bp, H. sapiens
aggcagaattctaaga

SEQ ID NO: 40538 - DNA, 16 bp, H. sapiens
aggcagacaaaaataa

SEQ ID NO: 40539 - DNA, 16 bp, H. sapiens
aggcagacacacaggc

SEQ ID NO: 40540 - DNA, 16 bp, H. sapiens
aggcagacacagaaag

SEQ ID NO: 40541 - DNA, 16 bp, H. sapiens
aggcagacactcccag

SEQ ID NO: 40542 - DNA, 16 bp, H. sapiens
aggcagacagattgct

SEQ ID NO: 40543 - DNA, 16 bp, H. sapiens
aggcagacagcccagc

SEQ ID NO: 40544 - DNA, 16 bp, H. sapiens
aggcagacagggatgg

SEQ ID NO: 40545 - DNA, 41 bp, H. sapiens
aggcagaccaaggagttcatcttctcagagctgctgtccaa

SEQ ID NO: 40546 - DNA, 17 bp, H. sapiens
aggcagacccaccctca

SEQ ID NO: 40547 - DNA, 16 bp, H. sapiens
aggcagaccttgcagt

SEQ ID NO: 40548 - DNA, 16 bp, H. sapiens
aggcagactggtcccc

SEQ ID NO: 40549 - DNA, 16 bp, H. sapiens
aggcagagaaacagca

SEQ ID NO: 40550 - DNA, 16 bp, H. sapiens
aggcagagacagagaa

SEQ ID NO: 40551 - DNA, 16 bp, H. sapiens
aggcagagacaggagg

SEQ ID NO: 40552 - DNA, 16 bp, H. sapiens
aggcagagagaatggc

SEQ ID NO: 40553 - DNA, 16 bp, H. sapiens
aggcagagaggcagaa

SEQ ID NO: 40554 - DNA, 16 bp, H. sapiens
aggcagagaggttgca

SEQ ID NO: 40555 - DNA, 16 bp, H. sapiens
aggcagagatggagag

SEQ ID NO: 40556 - DNA, 16 bp, H. sapiens
aggcagagatggcagt

SEQ ID NO: 40557 - DNA, 16 bp, H. sapiens
aggcagagattggagt

SEQ ID NO: 40558 - DNA, 16 bp, H. sapiens
aggcagagattgtcaa

SEQ ID NO: 40559 - DNA, 16 bp, H. sapiens
aggcagagcacagagg

SEQ ID NO: 40560 - DNA, 16 bp, H. sapiens
aggcagagcctggagt

SEQ ID NO: 40561 - DNA, 16 bp, H. sapiens
aggcagagctcaggtg

SEQ ID NO: 40562 - DNA, 16 bp, H. sapiens
aggcagagctgggatt

SEQ ID NO: 40563 - DNA, 16 bp, H. sapiens
aggcagagctgggcct

SEQ ID NO: 40564 - DNA, 16 bp, H. sapiens
aggcagaggaaacagc

SEQ ID NO: 40565 - DNA, 16 bp, H. sapiens
aggcagaggaaggtgg

SEQ ID NO: 40566 - DNA, 16 bp, H. sapiens
aggcagaggacagagg

SEQ ID NO: 40567 - DNA, 16 bp, H. sapiens
aggcagaggagaagca

SEQ ID NO: 40568 - DNA, 16 bp, H. sapiens
aggcagaggaggtgcc

SEQ ID NO: 40569 - DNA, 16 bp, H. sapiens
aggcagaggaggtgct

SEQ ID NO: 40570 - DNA, 18 bp, H. sapiens
aggcagaggatgcagtga

SEQ ID NO: 40571 - DNA, 16 bp, H. sapiens
aggcagaggcagctgg

SEQ ID NO: 40572 - DNA, 16 bp, H. sapiens
aggcagaggcaggagc

SEQ ID NO: 40573 - DNA, 16 bp, H. sapiens
aggcagaggcaggagt

SEQ ID NO: 40574 - DNA, 16 bp, H. sapiens
aggcagaggcaggcag

SEQ ID NO: 40575 - DNA, 16 bp, H. sapiens
aggcagaggcaggtga

SEQ ID NO: 40576 - DNA, 16 bp, H. sapiens
aggcagaggccaggga

SEQ ID NO: 40577 - DNA, 16 bp, H. sapiens
aggcagaggcctgggc

SEQ ID NO: 40578 - DNA, 16 bp, H. sapiens
aggcagaggctgaggc

SEQ ID NO: 40579 - DNA, 18 bp, H. sapiens
aggcagaggctgcagtga

SEQ ID NO: 40580 - DNA, 16 bp, H. sapiens
aggcagagggaagaca

SEQ ID NO: 40581 - DNA, 16 bp, H. sapiens
aggcagagggagattt

SEQ ID NO: 40582 - DNA, 16 bp, H. sapiens
aggcagagggaggtgg

SEQ ID NO: 40583 - DNA, 16 bp, H. sapiens
aggcagagggcacagc

SEQ ID NO: 40584 - DNA, 16 bp, H. sapiens
aggcagaggtggagga

SEQ ID NO: 40585 - DNA, 16 bp, H. sapiens
aggcagaggtggcagt

SEQ ID NO: 40586 - DNA, 16 bp, H. sapiens
aggcagaggtgggtga

SEQ ID NO: 40587 - DNA, 16 bp, H. sapiens
aggcagaggttgcagg

SEQ ID NO: 40588 - DNA, 17 bp, H. sapiens
aggcagaggttgcagtt

SEQ ID NO: 40589 - DNA, 16 bp, H. sapiens
aggcagagtctctctc

SEQ ID NO: 40590 - DNA, 16 bp, H. sapiens
aggcagagtttgtggt

SEQ ID NO: 40591 - DNA, 16 bp, H. sapiens
aggcagatattattat

SEQ ID NO: 40592 - DNA, 16 bp, H. sapiens
aggcagattccccagg

SEQ ID NO: 40593 - DNA, 16 bp, H. sapiens
aggcagattgcctgag

SEQ ID NO: 40594 - DNA, 16 bp, H. sapiens
aggcagcaagagagaa

SEQ ID NO: 40595 - DNA, 16 bp, H. sapiens
aggcagcaaggagaag

SEQ ID NO: 40596 - DNA, 16 bp, H. sapiens
aggcagcagaaaggag

SEQ ID NO: 40597 - DNA, 17 bp, H. sapiens
aggcagcagaatggcat

SEQ ID NO: 40598 - DNA, 16 bp, H. sapiens
aggcagcagaattact

SEQ ID NO: 40599 - DNA, 16 bp, H. sapiens
aggcagcagcaggagg

SEQ ID NO: 40600 - DNA, 16 bp, H. sapiens
aggcagcagccacagt

SEQ ID NO: 40601 - DNA, 16 bp, H. sapiens
aggcagcagcctcagt

SEQ ID NO: 40602 - DNA, 16 bp, H. sapiens
aggcagcagctccagt

SEQ ID NO: 40603 - DNA, 16 bp, H. sapiens
aggcagcaggagaaag

SEQ ID NO: 40604 - DNA, 16 bp, H. sapiens
aggcagcaggagcagg

SEQ ID NO: 40605 - DNA, 16 bp, H. sapiens
aggcagcagggggctg

SEQ ID NO: 40606 - DNA, 16 bp, H. sapiens
aggcagcagttgcagt

SEQ ID NO: 40607 - DNA, 16 bp, H. sapiens
aggcagccaccaccac

SEQ ID NO: 40608 - DNA, 16 bp, H. sapiens
aggcagccagtgacca

SEQ ID NO: 40609 - DNA, 16 bp, H. sapiens
aggcagccatctgcaa

SEQ ID NO: 40610 - DNA, 16 bp, H. sapiens
aggcagcccccagccc

SEQ ID NO: 40611 - DNA, 16 bp, H. sapiens
aggcagccctggttcc

SEQ ID NO: 40612 - DNA, 16 bp, H. sapiens
aggcagccgtctgcaa

SEQ ID NO: 40613 - DNA, 16 bp, H. sapiens
aggcagcctggctcca

SEQ ID NO: 40614 - DNA, 16 bp, H. sapiens
aggcagcctggggaac

SEQ ID NO: 40615 - DNA, 16 bp, H. sapiens
aggcagcggctggagg

SEQ ID NO: 40616 - DNA, 16 bp, H. sapiens
aggcagctaaagagaa

SEQ ID NO: 40617 - DNA, 16 bp, H. sapiens
aggcagctcatttttt

SEQ ID NO: 40618 - DNA, 16 bp, H. sapiens
aggcagctctctgcag

SEQ ID NO: 40619 - DNA, 16 bp, H. sapiens
aggcagctctctgggg

SEQ ID NO: 40620 - DNA, 16 bp, H. sapiens
aggcagctgaggcctg

SEQ ID NO: 40621 - DNA, 16 bp, H. sapiens
aggcagctggagagaa

SEQ ID NO: 40622 - DNA, 16 bp, H. sapiens
aggcagctggaggcca

SEQ ID NO: 40623 - DNA, 17 bp, H. sapiens
aggcagctggatcactt

SEQ ID NO: 40624 - DNA, 16 bp, H. sapiens
aggcagctttgcaggg

SEQ ID NO: 40625 - DNA, 16 bp, H. sapiens
aggcaggaaaatcagt

SEQ ID NO: 40626 - DNA, 16 bp, H. sapiens
aggcaggaaaattact

SEQ ID NO: 40627 - DNA, 16 bp, H. sapiens
aggcaggaacatcact

SEQ ID NO: 40628 - DNA, 16 bp, H. sapiens
aggcaggaagaattct

SEQ ID NO: 40629 - DNA, 16 bp, H. sapiens
aggcaggaagatggct

SEQ ID NO: 40630 - DNA, 16 bp, H. sapiens
aggcaggaagattgct

SEQ ID NO: 40631 - DNA, 16 bp, H. sapiens
aggcaggaaggcaggc

SEQ ID NO: 40632 - DNA, 16 bp, H. sapiens
aggcaggaagtccaag

SEQ ID NO: 40633 - DNA, 16 bp, H. sapiens
aggcaggaatgcagtg

SEQ ID NO: 40634 - DNA, 16 bp, H. sapiens
aggcaggaccaggtgg

SEQ ID NO: 40635 - DNA, 16 bp, H. sapiens
aggcaggactacaaat

SEQ ID NO: 40636 - DNA, 16 bp, H. sapiens
aggcaggagaaagaat

SEQ ID NO: 40637 - DNA, 16 bp, H. sapiens
aggcaggagaaccagg

SEQ ID NO: 40638 - DNA, 16 bp, H. sapiens
aggcaggagaaggtgg

SEQ ID NO: 40639 - DNA, 18 bp, H. sapiens
aggcaggagaatcgcttt

SEQ ID NO: 40640 - DNA, 16 bp, H. sapiens
aggcaggagactggcg

SEQ ID NO: 40641 - DNA, 16 bp, H. sapiens
aggcaggagagaatca

SEQ ID NO: 40642 - DNA, 16 bp, H. sapiens
aggcaggagccaggga

SEQ ID NO: 40643 - DNA, 16 bp, H. sapiens
aggcaggagctgggcc

SEQ ID NO: 40644 - DNA, 16 bp, H. sapiens
aggcaggagctgggtc

SEQ ID NO: 40645 - DNA, 16 bp, H. sapiens
aggcaggaggaacagc

SEQ ID NO: 40646 - DNA, 16 bp, H. sapiens
aggcaggaggacctct

SEQ ID NO: 40647 - DNA, 16 bp, H. sapiens
aggcaggaggagcgct

SEQ ID NO: 40648 - DNA, 16 bp, H. sapiens
aggcaggaggagggct

SEQ ID NO: 40649 - DNA, 16 bp, H. sapiens
aggcaggaggatcaga

SEQ ID NO: 40650 - DNA, 16 bp, H. sapiens
aggcaggaggatgcct

SEQ ID NO: 40651 - DNA, 16 bp, H. sapiens
aggcaggaggattgct

SEQ ID NO: 40652 - DNA, 16 bp, H. sapiens
aggcaggaggccgggc

SEQ ID NO: 40653 - DNA, 16 bp, H. sapiens
aggcaggagtgcagca

SEQ ID NO: 40654 - DNA, 16 bp, H. sapiens
aggcaggcaagaagga

SEQ ID NO: 40655 - DNA, 16 bp, H. sapiens
aggcaggcacagtggc

SEQ ID NO: 40656 - DNA, 16 bp, H. sapiens
aggcaggcagaccacg

SEQ ID NO: 40657 - DNA, 16 bp, H. sapiens
aggcaggcagagaaga

SEQ ID NO: 40658 - DNA, 16 bp, H. sapiens
aggcaggcagagagaa

SEQ ID NO: 40659 - DNA, 16 bp, H. sapiens
aggcaggcagaggaaa

SEQ ID NO: 40660 - DNA, 16 bp, H. sapiens
aggcaggcagaggcag

SEQ ID NO: 40661 - DNA, 16 bp, H. sapiens
aggcaggcagatcagt

SEQ ID NO: 40662 - DNA, 16 bp, H. sapiens
aggcaggcagccctcc

SEQ ID NO: 40663 - DNA, 16 bp, H. sapiens
aggcaggcaggaagca

SEQ ID NO: 40664 - DNA, 16 bp, H. sapiens
aggcaggcaggaagga

SEQ ID NO: 40665 - DNA, 16 bp, H. sapiens
aggcaggcaggcagga

SEQ ID NO: 40666 - DNA, 16 bp, H. sapiens
aggcaggcaggcaggc

SEQ ID NO: 40667 - DNA, 18 bp, H. sapiens
aggcaggcaggcctcctt

SEQ ID NO: 40668 - DNA, 16 bp, H. sapiens
aggcaggcaggctgga

SEQ ID NO: 40669 - DNA, 16 bp, H. sapiens
aggcaggcagggaagt

SEQ ID NO: 40670 - DNA, 16 bp, H. sapiens
aggcaggcctggtggc

SEQ ID NO: 40671 - DNA, 16 bp, H. sapiens
aggcaggccttgtggt

SEQ ID NO: 40672 - DNA, 16 bp, H. sapiens
aggcaggcggaggttg

SEQ ID NO: 40673 - DNA, 19 bp, H. sapiens
aggcaggcggatcacctga

SEQ ID NO: 40674 - DNA, 16 bp, H. sapiens
aggcaggcgggtcaca

SEQ ID NO: 40675 - DNA, 16 bp, H. sapiens
aggcaggctggggagg

SEQ ID NO: 40676 - DNA, 16 bp, H. sapiens
aggcaggctggggtcc

SEQ ID NO: 40677 - DNA, 16 bp, H. sapiens
aggcaggcttcctgga

SEQ ID NO: 40678 - DNA, 18 bp, H. sapiens
aggcagggaacataaggc

SEQ ID NO: 40679 - DNA, 16 bp, H. sapiens
aggcagggaacatcac

SEQ ID NO: 40680 - DNA, 16 bp, H. sapiens
aggcagggactggagt

SEQ ID NO: 40681 - DNA, 16 bp, H. sapiens
aggcagggagaccagg

SEQ ID NO: 40682 - DNA, 16 bp, H. sapiens
aggcagggcaaggtgg

SEQ ID NO: 40683 - DNA, 16 bp, H. sapiens
aggcagggcctggctc

SEQ ID NO: 40684 - DNA, 16 bp, H. sapiens
aggcagggcgcagtgg

SEQ ID NO: 40685 - DNA, 16 bp, H. sapiens
aggcagggcttgcagt

SEQ ID NO: 40686 - DNA, 16 bp, H. sapiens
aggcaggggaagaacc

SEQ ID NO: 40687 - DNA, 16 bp, H. sapiens
aggcaggggcaggcag

SEQ ID NO: 40688 - DNA, 16 bp, H. sapiens
aggcaggggctgctgg

SEQ ID NO: 40689 - DNA, 16 bp, H. sapiens
aggcaggggctgggcc

SEQ ID NO: 40690 - DNA, 16 bp, H. sapiens
aggcagggggatcatt

SEQ ID NO: 40691 - DNA, 16 bp, H. sapiens
aggcaggggtggcagg

SEQ ID NO: 40692 - DNA, 16 bp, H. sapiens
aggcagggtttctcaa

SEQ ID NO: 40693 - DNA, 16 bp, H. sapiens
aggcagggtttgagag

SEQ ID NO: 40694 - DNA, 16 bp, H. sapiens
aggcaggtactattat

SEQ ID NO: 40695 - DNA, 16 bp, H. sapiens
aggcaggtcatcctga

SEQ ID NO: 40696 - DNA, 19 bp, H. sapiens
aggcaggtggatcacctca

SEQ ID NO: 40697 - DNA, 18 bp, H. sapiens
aggcaggtggatcactca

SEQ ID NO: 40698 - DNA, 17 bp, H. sapiens
aggcaggtggatctcct

SEQ ID NO: 40699 - DNA, 16 bp, H. sapiens
aggcaggtggatgact

SEQ ID NO: 40700 - DNA, 16 bp, H. sapiens
aggcagtgagctatga

SEQ ID NO: 40701 - DNA, 16 bp, H. sapiens
aggcagtgcagaccca

SEQ ID NO: 40702 - DNA, 16 bp, H. sapiens
aggcagtgccccaatg

SEQ ID NO: 40703 - DNA, 16 bp, H. sapiens
aggcagtgctgtgtgg

SEQ ID NO: 40704 - DNA, 16 bp, H. sapiens
aggcagtgggagtagg

SEQ ID NO: 40705 - DNA, 16 bp, H. sapiens
aggcagtggggctggg

SEQ ID NO: 40706 - DNA, 16 bp, H. sapiens
aggcagtgtgcccaga

SEQ ID NO: 40707 - DNA, 16 bp, H. sapiens
aggcagtgtgtgtgtg

SEQ ID NO: 40708 - DNA, 16 bp, H. sapiens
aggcagttgctgggca

SEQ ID NO: 40709 - DNA, 16 bp, H. sapiens
aggcagtttttttttt

SEQ ID NO: 40710 - DNA, 16 bp, H. sapiens
aggcataaatgggtta

SEQ ID NO: 40711 - DNA, 16 bp, H. sapiens
aggcataagccaccac

SEQ ID NO: 40712 - DNA, 16 bp, H. sapiens
aggcataagccaccat

SEQ ID NO: 40713 - DNA, 16 bp, H. sapiens
aggcatagaaagaaaa

SEQ ID NO: 40714 - DNA, 16 bp, H. sapiens
aggcatagtggtgcac

SEQ ID NO: 40715 - DNA, 16 bp, H. sapiens
aggcatatttttaaaa

SEQ ID NO: 40716 - DNA, 16 bp, H. sapiens
aggcatcagccactgt

SEQ ID NO: 40717 - DNA, 16 bp, H. sapiens
aggcatctgccaccat

SEQ ID NO: 40718 - DNA, 16 bp, H. sapiens
aggcatctgccactgc

SEQ ID NO: 40719 - DNA, 16 bp, H. sapiens
aggcatctgccatcac

SEQ ID NO: 40720 - DNA, 16 bp, H. sapiens
aggcatgaaccactgc

SEQ ID NO: 40721 - DNA, 17 bp, H. sapiens
aggcatgacccaccgcg

SEQ ID NO: 40722 - DNA, 16 bp, H. sapiens
aggcatgagaatggca

SEQ ID NO: 40723 - DNA, 16 bp, H. sapiens
aggcatgagcaaagat

SEQ ID NO: 40724 - DNA, 17 bp, H. sapiens
aggcatgagccaccaca

SEQ ID NO: 40725 - DNA, 17 bp, H. sapiens
aggcatgagccaccacc

SEQ ID NO: 40726 - DNA, 17 bp, H. sapiens
aggcatgagccaccacg

SEQ ID NO: 40727 - DNA, 20 bp, H. sapiens
aggcatgagccaccacgccc

SEQ ID NO: 40728 - DNA, 19 bp, H. sapiens
aggcatgagccaccacgct

SEQ ID NO: 40729 - DNA, 18 bp, H. sapiens
aggcatgagccaccacgg

SEQ ID NO: 40730 - DNA, 17 bp, H. sapiens
aggcatgagccaccact

SEQ ID NO: 40731 - DNA, 16 bp, H. sapiens
aggcatgagccaccag

SEQ ID NO: 40732 - DNA, 16 bp, H. sapiens
aggcatgagccaccat

SEQ ID NO: 40733 - DNA, 18 bp, H. sapiens
aggcatgagccaccatgt

SEQ ID NO: 40734 - DNA, 17 bp, H. sapiens
aggcatgagccaccatt

SEQ ID NO: 40735 - DNA, 16 bp, H. sapiens
aggcatgagccaccga

SEQ ID NO: 40736 - DNA, 16 bp, H. sapiens
aggcatgagccaccgc

SEQ ID NO: 40737 - DNA, 18 bp, H. sapiens
aggcatgagccaccgtgg

SEQ ID NO: 40738 - DNA, 18 bp, H. sapiens
aggcatgagccaccgtgt

SEQ ID NO: 40739 - DNA, 16 bp, H. sapiens
aggcatgagccactga

SEQ ID NO: 40740 - DNA, 16 bp, H. sapiens
aggcatgagccactgc

SEQ ID NO: 40741 - DNA, 16 bp, H. sapiens
aggcatgagccactgg

SEQ ID NO: 40742 - DNA, 16 bp, H. sapiens
aggcatgagccactgt

SEQ ID NO: 40743 - DNA, 17 bp, H. sapiens
aggcatgagccactgta

SEQ ID NO: 40744 - DNA, 18 bp, H. sapiens
aggcatgagccactgtgt

SEQ ID NO: 40745 - DNA, 17 bp, H. sapiens
aggcatgagccacttca

SEQ ID NO: 40746 - DNA, 16 bp, H. sapiens
aggcatgagccatgag

SEQ ID NO: 40747 - DNA, 16 bp, H. sapiens
aggcatgagccgctgc

SEQ ID NO: 40748 - DNA, 17 bp, H. sapiens
aggcatgagctaccaca

SEQ ID NO: 40749 - DNA, 16 bp, H. sapiens
aggcatgagctaccat

SEQ ID NO: 40750 - DNA, 16 bp, H. sapiens
aggcatgagctgggct

SEQ ID NO: 40751 - DNA, 16 bp, H. sapiens
aggcatgagtcaccat

SEQ ID NO: 40752 - DNA, 18 bp, H. sapiens
aggcatgagttactgtgc

SEQ ID NO: 40753 - DNA, 16 bp, H. sapiens
aggcatgcactaccat

SEQ ID NO: 40754 - DNA, 16 bp, H. sapiens
aggcatggagctggga

SEQ ID NO: 40755 - DNA, 16 bp, H. sapiens
aggcatggaggtgcat

SEQ ID NO: 40756 - DNA, 16 bp, H. sapiens
aggcatggaggtggga

SEQ ID NO: 40757 - DNA, 16 bp, H. sapiens
aggcatgggcaaggtc

SEQ ID NO: 40758 - DNA, 18 bp, H. sapiens
aggcatgggcagggactt

SEQ ID NO: 40759 - DNA, 16 bp, H. sapiens
aggcatggtcaaggac

SEQ ID NO: 40760 - DNA, 16 bp, H. sapiens
aggcatggtgctggca

SEQ ID NO: 40761 - DNA, 18 bp, H. sapiens
aggcatggtggcgggtgc

SEQ ID NO: 40762 - DNA, 16 bp, H. sapiens
aggcatggttagtgtg

SEQ ID NO: 40763 - DNA, 16 bp, H. sapiens
aggcatgtaccactgc

SEQ ID NO: 40764 - DNA, 16 bp, H. sapiens
aggcatgtcaaaagct

SEQ ID NO: 40765 - DNA, 16 bp, H. sapiens
aggcatgtctgacctc

SEQ ID NO: 40766 - DNA, 16 bp, H. sapiens
aggcattaaaaaaaat

SEQ ID NO: 40767 - DNA, 16 bp, H. sapiens
aggcattcaataaatg

SEQ ID NO: 40768 - DNA, 16 bp, H. sapiens
aggcattcctatttct

SEQ ID NO: 40769 - DNA, 16 bp, H. sapiens
aggcattctgactggt

SEQ ID NO: 40770 - DNA, 16 bp, H. sapiens
aggcatttaataaaat

SEQ ID NO: 40771 - DNA, 16 bp, H. sapiens
aggcatttattattat

SEQ ID NO: 40772 - DNA, 16 bp, H. sapiens
aggcatttattgccat

SEQ ID NO: 40773 - DNA, 16 bp, H. sapiens
aggcatttccatacat

SEQ ID NO: 40774 - DNA, 16 bp, H. sapiens
aggcatttcctgctta

SEQ ID NO: 40775 - DNA, 16 bp, H. sapiens
aggcatttcttcaaag

SEQ ID NO: 40776 - DNA, 16 bp, H. sapiens
aggcatttgagtttgc

SEQ ID NO: 40777 - DNA, 16 bp, H. sapiens
aggccaaaagcccaac

SEQ ID NO: 40778 - DNA, 16 bp, H. sapiens
aggccaaagcaggcaa

SEQ ID NO: 40779 - DNA, 17 bp, H. sapiens
aggccaaagcgggagga

SEQ ID NO: 40780 - DNA, 16 bp, H. sapiens
aggccaaagtggacag

SEQ ID NO: 40781 - DNA, 16 bp, H. sapiens
aggccaaagtgggcag

SEQ ID NO: 40782 - DNA, 16 bp, H. sapiens
aggccaacatccctga

SEQ ID NO: 40783 - DNA, 16 bp, H. sapiens
aggccaacatgcaaat

SEQ ID NO: 40784 - DNA, 21 bp, H. sapiens
aggccaacatggtgaaaccct

SEQ ID NO: 40785 - DNA, 18 bp, H. sapiens
aggccaacattccaattc

SEQ ID NO: 40786 - DNA, 16 bp, H. sapiens
aggccaaccaactcaa

SEQ ID NO: 40787 - DNA, 16 bp, H. sapiens
aggccaacctaggcaa

SEQ ID NO: 40788 - DNA, 16 bp, H. sapiens
aggccaacctggacaa

SEQ ID NO: 40789 - DNA, 16 bp, H. sapiens
aggccaacctggccaa

SEQ ID NO: 40790 - DNA, 16 bp, H. sapiens
aggccaagaagaatct

SEQ ID NO: 40791 - DNA, 18 bp, H. sapiens
aggccaagacaggtggat

SEQ ID NO: 40792 - DNA, 16 bp, H. sapiens
aggccaagaccagcct

SEQ ID NO: 40793 - DNA, 16 bp, H. sapiens
aggccaagaggggcag

SEQ ID NO: 40794 - DNA, 17 bp, H. sapiens
aggccaagagtttgagg

SEQ ID NO: 40795 - DNA, 16 bp, H. sapiens
aggccaagatcaaggt

SEQ ID NO: 40796 - DNA, 16 bp, H. sapiens
aggccaagcaggagga

SEQ ID NO: 40797 - DNA, 16 bp, H. sapiens
aggccaaggaaggaag

SEQ ID NO: 40798 - DNA, 16 bp, H. sapiens
aggccaaggaaggcag

SEQ ID NO: 40799 - DNA, 16 bp, H. sapiens
aggccaaggagagtgg

SEQ ID NO: 40800 - DNA, 16 bp, H. sapiens
aggccaaggaggcgcc

SEQ ID NO: 40801 - DNA, 17 bp, H. sapiens
aggccaaggagggcaga

SEQ ID NO: 40802 - DNA, 16 bp, H. sapiens
aggccaaggcagacat

SEQ ID NO: 40803 - DNA, 16 bp, H. sapiens
aggccaaggcagccag

SEQ ID NO: 40804 - DNA, 16 bp, H. sapiens
aggccaaggcaggaga

SEQ ID NO: 40805 - DNA, 16 bp, H. sapiens
aggccaaggcaggcaa

SEQ ID NO: 40806 - DNA, 16 bp, H. sapiens
aggccaaggcaggcat

SEQ ID NO: 40807 - DNA, 16 bp, H. sapiens
aggccaaggcagtggg

SEQ ID NO: 40808 - DNA, 16 bp, H. sapiens
aggccaaggccaaggc

SEQ ID NO: 40809 - DNA, 16 bp, H. sapiens
aggccaaggccagcag

SEQ ID NO: 40810 - DNA, 16 bp, H. sapiens
aggccaaggctacagt

SEQ ID NO: 40811 - DNA, 16 bp, H. sapiens
aggccaaggctggaga

SEQ ID NO: 40812 - DNA, 16 bp, H. sapiens
aggccaaggctggtga

SEQ ID NO: 40813 - DNA, 16 bp, H. sapiens
aggccaagggaggcag

SEQ ID NO: 40814 - DNA, 16 bp, H. sapiens
aggccaagggggcaga

SEQ ID NO: 40815 - DNA, 16 bp, H. sapiens
aggccaaggtggaaga

SEQ ID NO: 40816 - DNA, 16 bp, H. sapiens
aggccaaggtggagga

SEQ ID NO: 40817 - DNA, 16 bp, H. sapiens
aggccaaggtggatga

SEQ ID NO: 40818 - DNA, 16 bp, H. sapiens
aggccaaggtggccgg

SEQ ID NO: 40819 - DNA, 16 bp, H. sapiens
aggccaaggtgggaga

SEQ ID NO: 40820 - DNA, 17 bp, H. sapiens
aggccaaggtgggcggg

SEQ ID NO: 40821 - DNA, 16 bp, H. sapiens
aggccaaggtggggtg

SEQ ID NO: 40822 - DNA, 18 bp, H. sapiens
aggccaaggtgggtagat

SEQ ID NO: 40823 - DNA, 16 bp, H. sapiens
aggccaagtacagtgg

SEQ ID NO: 40824 - DNA, 16 bp, H. sapiens
aggccaatatcactga

SEQ ID NO: 40825 - DNA, 16 bp, H. sapiens
aggccaatattaccct

SEQ ID NO: 40826 - DNA, 16 bp, H. sapiens
aggccacaaaagaagt

SEQ ID NO: 40827 - DNA, 16 bp, H. sapiens
aggccacaaagcaagt

SEQ ID NO: 40828 - DNA, 16 bp, H. sapiens
aggccacacagcaggt

SEQ ID NO: 40829 - DNA, 16 bp, H. sapiens
aggccacacagctggc

SEQ ID NO: 40830 - DNA, 16 bp, H. sapiens
aggccacacagctggg

SEQ ID NO: 40831 - DNA, 16 bp, H. sapiens
aggccacagtgagaag

SEQ ID NO: 40832 - DNA, 16 bp, H. sapiens
aggccacagtgtctgt

SEQ ID NO: 40833 - DNA, 16 bp, H. sapiens
aggccacatggagaag

SEQ ID NO: 40834 - DNA, 16 bp, H. sapiens
aggccacattggaaga

SEQ ID NO: 40835 - DNA, 16 bp, H. sapiens
aggccacattttcttt

SEQ ID NO: 40836 - DNA, 16 bp, H. sapiens
aggccaccatcctcca

SEQ ID NO: 40837 - DNA, 16 bp, H. sapiens
aggccacctcctccag

SEQ ID NO: 40838 - DNA, 16 bp, H. sapiens
aggccacgtgaagatg

SEQ ID NO: 40839 - DNA, 16 bp, H. sapiens
aggccactctttttct

SEQ ID NO: 40840 - DNA, 16 bp, H. sapiens
aggccactgcttcaga

SEQ ID NO: 40841 - DNA, 17 bp, H. sapiens
aggccactgtgcatgtg

SEQ ID NO: 40842 - DNA, 16 bp, H. sapiens
aggccagaagagagtg

SEQ ID NO: 40843 - DNA, 16 bp, H. sapiens
aggccagaagttcaaa

SEQ ID NO: 40844 - DNA, 16 bp, H. sapiens
aggccagactgcagtg

SEQ ID NO: 40845 - DNA, 16 bp, H. sapiens
aggccagactgggcaa

SEQ ID NO: 40846 - DNA, 16 bp, H. sapiens
aggccagagatgctgc

SEQ ID NO: 40847 - DNA, 16 bp, H. sapiens
aggccagagcccaggc

SEQ ID NO: 40848 - DNA, 16 bp, H. sapiens
aggccagagggcagtg

SEQ ID NO: 40849 - DNA, 16 bp, H. sapiens
aggccagagttcaaga

SEQ ID NO: 40850 - DNA, 16 bp, H. sapiens
aggccagcagctgcag

SEQ ID NO: 40851 - DNA, 16 bp, H. sapiens
aggccagcatcaccct

SEQ ID NO: 40852 - DNA, 18 bp, H. sapiens
aggccagcatcgtcctga

SEQ ID NO: 40853 - DNA, 16 bp, H. sapiens
aggccagcatgatcct

SEQ ID NO: 40854 - DNA, 16 bp, H. sapiens
aggccagcctgaccaa

SEQ ID NO: 40855 - DNA, 16 bp, H. sapiens
aggccagcctgcccaa

SEQ ID NO: 40856 - DNA, 16 bp, H. sapiens
aggccagcctggccaa

SEQ ID NO: 40857 - DNA, 16 bp, H. sapiens
aggccagcctgggcaa

SEQ ID NO: 40858 - DNA, 16 bp, H. sapiens
aggccaggaagagagc

SEQ ID NO: 40859 - DNA, 16 bp, H. sapiens
aggccaggaatctgag

SEQ ID NO: 40860 - DNA, 16 bp, H. sapiens
aggccaggaatttgaa

SEQ ID NO: 40861 - DNA, 16 bp, H. sapiens
aggccaggaatttgag

SEQ ID NO: 40862 - DNA, 16 bp, H. sapiens
aggccaggagagagta

SEQ ID NO: 40863 - DNA, 16 bp, H. sapiens
aggccaggaggtggag

SEQ ID NO: 40864 - DNA, 16 bp, H. sapiens
aggccaggagtcccag

SEQ ID NO: 40865 - DNA, 16 bp, H. sapiens
aggccaggagttccaa

SEQ ID NO: 40866 - DNA, 16 bp, H. sapiens
aggccaggagttgggg

SEQ ID NO: 40867 - DNA, 16 bp, H. sapiens
aggccaggagtttgaa

SEQ ID NO: 40868 - DNA, 16 bp, H. sapiens
aggccaggcacagcgg

SEQ ID NO: 40869 - DNA, 18 bp, H. sapiens
aggccaggcacagtggct

SEQ ID NO: 40870 - DNA, 16 bp, H. sapiens
aggccaggcactatgg

SEQ ID NO: 40871 - DNA, 16 bp, H. sapiens
aggccaggctggccaa

SEQ ID NO: 40872 - DNA, 16 bp, H. sapiens
aggccagggatttgag

SEQ ID NO: 40873 - DNA, 16 bp, H. sapiens
aggccagggcaggtgg

SEQ ID NO: 40874 - DNA, 16 bp, H. sapiens
aggccagggctgctgc

SEQ ID NO: 40875 - DNA, 16 bp, H. sapiens
aggccagggtgggtgg

SEQ ID NO: 40876 - DNA, 16 bp, H. sapiens
aggccaggtgctgtgg

SEQ ID NO: 40877 - DNA, 16 bp, H. sapiens
aggccaggtgtgctgg

SEQ ID NO: 40878 - DNA, 22 bp, H. sapiens
aggccaggtgtggtggctcacg

SEQ ID NO: 40879 - DNA, 16 bp, H. sapiens
aggccaggtgttcaag

SEQ ID NO: 40880 - DNA, 16 bp, H. sapiens
aggccagtaatcccag

SEQ ID NO: 40881 - DNA, 16 bp, H. sapiens
aggccagtattaccct

SEQ ID NO: 40882 - DNA, 16 bp, H. sapiens
aggccagtggaacaga

SEQ ID NO: 40883 - DNA, 16 bp, H. sapiens
aggccagtggggctgg

SEQ ID NO: 40884 - DNA, 16 bp, H. sapiens
aggccagtgtccagaa

SEQ ID NO: 40885 - DNA, 16 bp, H. sapiens
aggccatagtgagcta

SEQ ID NO: 40886 - DNA, 16 bp, H. sapiens
aggccatcatcatcct

SEQ ID NO: 40887 - DNA, 16 bp, H. sapiens
aggccatcctagacca

SEQ ID NO: 40888 - DNA, 16 bp, H. sapiens
aggccatcctggccaa

SEQ ID NO: 40889 - DNA, 16 bp, H. sapiens
aggccatctgcaagcc

SEQ ID NO: 40890 - DNA, 18 bp, H. sapiens
aggccatctggatgtata

SEQ ID NO: 40891 - DNA, 16 bp, H. sapiens
aggccatgagtttgag

SEQ ID NO: 40892 - DNA, 16 bp, H. sapiens
aggccatgcagtctct

SEQ ID NO: 40893 - DNA, 16 bp, H. sapiens
aggccattccactgtt

SEQ ID NO: 40894 - DNA, 16 bp, H. sapiens
aggccatttatattca

SEQ ID NO: 40895 - DNA, 16 bp, H. sapiens
aggccatttcctgatg

SEQ ID NO: 40896 - DNA, 16 bp, H. sapiens
aggccattttcctgcc

SEQ ID NO: 40897 - DNA, 16 bp, H. sapiens
aggcccaagagatcct

SEQ ID NO: 40898 - DNA, 16 bp, H. sapiens
aggcccaagaggacag

SEQ ID NO: 40899 - DNA, 16 bp, H. sapiens
aggcccaaggagagga

SEQ ID NO: 40900 - DNA, 16 bp, H. sapiens
aggcccaaggagaggg

SEQ ID NO: 40901 - DNA, 16 bp, H. sapiens
aggcccacatggcaag

SEQ ID NO: 40902 - DNA, 16 bp, H. sapiens
aggcccactgccccag

SEQ ID NO: 40903 - DNA, 16 bp, H. sapiens
aggcccagaaaggtga

SEQ ID NO: 40904 - DNA, 16 bp, H. sapiens
aggcccagaactttct

SEQ ID NO: 40905 - DNA, 16 bp, H. sapiens
aggcccagagaaggga

SEQ ID NO: 40906 - DNA, 16 bp, H. sapiens
aggcccagagagaaga

SEQ ID NO: 40907 - DNA, 16 bp, H. sapiens
aggcccagaggcagga

SEQ ID NO: 40908 - DNA, 16 bp, H. sapiens
aggcccagaggcccag

SEQ ID NO: 40909 - DNA, 16 bp, H. sapiens
aggcccagaggctggg

SEQ ID NO: 40910 - DNA, 16 bp, H. sapiens
aggcccagcaagaatt

SEQ ID NO: 40911 - DNA, 16 bp, H. sapiens
aggcccagcacagtgg

SEQ ID NO: 40912 - DNA, 16 bp, H. sapiens
aggcccagctaatttt

SEQ ID NO: 40913 - DNA, 16 bp, H. sapiens
aggcccagctctgcca

SEQ ID NO: 40914 - DNA, 17 bp, H. sapiens
aggcccagctgtaaaat

SEQ ID NO: 40915 - DNA, 16 bp, H. sapiens
aggcccaggaaggagg

SEQ ID NO: 40916 - DNA, 16 bp, H. sapiens
aggcccaggagggagg

SEQ ID NO: 40917 - DNA, 16 bp, H. sapiens
aggcccaggagtttga

SEQ ID NO: 40918 - DNA, 16 bp, H. sapiens
aggcccaggatggggg

SEQ ID NO: 40919 - DNA, 17 bp, H. sapiens
aggcccaggcaggcgga

SEQ ID NO: 40920 - DNA, 16 bp, H. sapiens
aggcccaggcccagga

SEQ ID NO: 40921 - DNA, 16 bp, H. sapiens
aggcccaggctggcag

SEQ ID NO: 40922 - DNA, 16 bp, H. sapiens
aggcccagggaggaga

SEQ ID NO: 40923 - DNA, 16 bp, H. sapiens
aggcccagggcccagc

SEQ ID NO: 40924 - DNA, 16 bp, H. sapiens
aggcccagggcccagg

SEQ ID NO: 40925 - DNA, 16 bp, H. sapiens
aggcccagggccccct

SEQ ID NO: 40926 - DNA, 16 bp, H. sapiens
aggcccagggtccctg

SEQ ID NO: 40927 - DNA, 16 bp, H. sapiens
aggcccaggtggacag

SEQ ID NO: 40928 - DNA, 16 bp, H. sapiens
aggcccaggtgggctg

SEQ ID NO: 40929 - DNA, 16 bp, H. sapiens
aggcccagtggccagg

SEQ ID NO: 40930 - DNA, 16 bp, H. sapiens
aggccccaccctggac

SEQ ID NO: 40931 - DNA, 16 bp, H. sapiens
aggccccacctgcaac

SEQ ID NO: 40932 - DNA, 16 bp, H. sapiens
aggccccagagagcta

SEQ ID NO: 40933 - DNA, 16 bp, H. sapiens
aggccccagagtgtgt

SEQ ID NO: 40934 - DNA, 16 bp, H. sapiens
aggcccccgtggagga

SEQ ID NO: 40935 - DNA, 17 bp, H. sapiens
aggcccccgtggaggat

SEQ ID NO: 40936 - DNA, 16 bp, H. sapiens
aggccccgaggcagga

SEQ ID NO: 40937 - DNA, 16 bp, H. sapiens
aggccctaaagaaggc

SEQ ID NO: 40938 - DNA, 16 bp, H. sapiens
aggccctaacccaagc

SEQ ID NO: 40939 - DNA, 16 bp, H. sapiens
aggccctagctcccag

SEQ ID NO: 40940 - DNA, 16 bp, H. sapiens
aggccctcaataaatg

SEQ ID NO: 40941 - DNA, 16 bp, H. sapiens
aggccctcagtccaac

SEQ ID NO: 40942 - DNA, 16 bp, H. sapiens
aggccctcccaatcct

SEQ ID NO: 40943 - DNA, 16 bp, H. sapiens
aggccctctgattttt

SEQ ID NO: 40944 - DNA, 16 bp, H. sapiens
aggccctgaggcaaga

SEQ ID NO: 40945 - DNA, 16 bp, H. sapiens
aggccctgaggcagca

SEQ ID NO: 40946 - DNA, 16 bp, H. sapiens
aggccctgcccctgcc

SEQ ID NO: 40947 - DNA, 16 bp, H. sapiens
aggccctgcctcccag

SEQ ID NO: 40948 - DNA, 16 bp, H. sapiens
aggccctggagagggt

SEQ ID NO: 40949 - DNA, 16 bp, H. sapiens
aggccctggggcaggg

SEQ ID NO: 40950 - DNA, 16 bp, H. sapiens
aggccctggggcctag

SEQ ID NO: 40951 - DNA, 16 bp, H. sapiens
aggccctggggtggag

SEQ ID NO: 40952 - DNA, 16 bp, H. sapiens
aggccctggggtggga

SEQ ID NO: 40953 - DNA, 16 bp, H. sapiens
aggccctgggtgggtc

SEQ ID NO: 40954 - DNA, 16 bp, H. sapiens
aggccctggtggtgtg

SEQ ID NO: 40955 - DNA, 16 bp, H. sapiens
aggccctgtctcaaaa

SEQ ID NO: 40956 - DNA, 16 bp, H. sapiens
aggccctgtgctaagc

SEQ ID NO: 40957 - DNA, 16 bp, H. sapiens
aggccctgtggcagga

SEQ ID NO: 40958 - DNA, 16 bp, H. sapiens
aggcccttaccagaca

SEQ ID NO: 40959 - DNA, 16 bp, H. sapiens
aggccctttgttttgg

SEQ ID NO: 40960 - DNA, 16 bp, H. sapiens
aggcccttttctttct

SEQ ID NO: 40961 - DNA, 16 bp, H. sapiens
aggccgacgtgggcag

SEQ ID NO: 40962 - DNA, 16 bp, H. sapiens
aggccgagaagggcgg

SEQ ID NO: 40963 - DNA, 16 bp, H. sapiens
aggccgagataggcgg

SEQ ID NO: 40964 - DNA, 17 bp, H. sapiens
aggccgagatgggagga

SEQ ID NO: 40965 - DNA, 18 bp, H. sapiens
aggccgagcacagtggct

SEQ ID NO: 40966 - DNA, 16 bp, H. sapiens
aggccgaggaaggcag

SEQ ID NO: 40967 - DNA, 16 bp, H. sapiens
aggccgaggaggacag

SEQ ID NO: 40968 - DNA, 18 bp, H. sapiens
aggccgaggagggtggat

SEQ ID NO: 40969 - DNA, 19 bp, H. sapiens
aggccgaggcaggcagatt

SEQ ID NO: 40970 - DNA, 19 bp, H. sapiens
aggccgaggcaggcggatt

SEQ ID NO: 40971 - DNA, 17 bp, H. sapiens
aggccgaggccggcaga

SEQ ID NO: 40972 - DNA, 16 bp, H. sapiens
aggccgaggcgggaga

SEQ ID NO: 40973 - DNA, 20 bp, H. sapiens
aggccgaggtggacggatca

SEQ ID NO: 40974 - DNA, 16 bp, H. sapiens
aggccgaggtggagga

SEQ ID NO: 40975 - DNA, 16 bp, H. sapiens
aggccgaggtgggaga

SEQ ID NO: 40976 - DNA, 19 bp, H. sapiens
aggccgaggtgggtggatt

SEQ ID NO: 40977 - DNA, 16 bp, H. sapiens
aggccgctgcactcca

SEQ ID NO: 40978 - DNA, 18 bp, H. sapiens
aggccggacgcggtggct

SEQ ID NO: 40979 - DNA, 18 bp, H. sapiens
aggccggagtgcagtggt

SEQ ID NO: 40980 - DNA, 16 bp, H. sapiens
aggccggcacggtggc

SEQ ID NO: 40981 - DNA, 16 bp, H. sapiens
aggccggggcggtggc

SEQ ID NO: 40982 - DNA, 16 bp, H. sapiens
aggccgtgcgtggtgg

SEQ ID NO: 40983 - DNA, 16 bp, H. sapiens
aggccgtggcaggtgg

SEQ ID NO: 40984 - DNA, 16 bp, H. sapiens
aggccgtggtgggagg

SEQ ID NO: 40985 - DNA, 16 bp, H. sapiens
aggccgtggtgggcgg

SEQ ID NO: 40986 - DNA, 16 bp, H. sapiens
aggcctagctttcagc

SEQ ID NO: 40987 - DNA, 17 bp, H. sapiens
aggcctatagtgaaaac

SEQ ID NO: 40988 - DNA, 16 bp, H. sapiens
aggcctcacctccagc

SEQ ID NO: 40989 - DNA, 16 bp, H. sapiens
aggcctcactgagaag

SEQ ID NO: 40990 - DNA, 16 bp, H. sapiens
aggcctcagagagctg

SEQ ID NO: 40991 - DNA, 16 bp, H. sapiens
aggcctcagcccaggc

SEQ ID NO: 40992 - DNA, 16 bp, H. sapiens
aggcctcagcctcctg

SEQ ID NO: 40993 - DNA, 16 bp, H. sapiens
aggcctcaggaaactt

SEQ ID NO: 40994 - DNA, 16 bp, H. sapiens
aggcctcagtgggctc

SEQ ID NO: 40995 - DNA, 16 bp, H. sapiens
aggcctcagtttcccc

SEQ ID NO: 40996 - DNA, 16 bp, H. sapiens
aggcctcagtttcctt

SEQ ID NO: 40997 - DNA, 16 bp, H. sapiens
aggcctccagaacttc

SEQ ID NO: 40998 - DNA, 16 bp, H. sapiens
aggcctccagataact

SEQ ID NO: 40999 - DNA, 16 bp, H. sapiens
aggcctcccaaagtac

SEQ ID NO: 41000 - DNA, 16 bp, H. sapiens
aggcctccccagacac

SEQ ID NO: 41001 - DNA, 16 bp, H. sapiens
aggcctccccagaggc

SEQ ID NO: 41002 - DNA, 18 bp, H. sapiens
aggcctccccagccatgc

SEQ ID NO: 41003 - DNA, 16 bp, H. sapiens
aggcctccccagccct

SEQ ID NO: 41004 - DNA, 16 bp, H. sapiens
aggcctccccaggcac

SEQ ID NO: 41005 - DNA, 16 bp, H. sapiens
aggcctccccggaagc

SEQ ID NO: 41006 - DNA, 16 bp, H. sapiens
aggcctccctgcctct

SEQ ID NO: 41007 - DNA, 16 bp, H. sapiens
aggcctccgcagaagc

SEQ ID NO: 41008 - DNA, 16 bp, H. sapiens
aggcctcctcagccac

SEQ ID NO: 41009 - DNA, 16 bp, H. sapiens
aggcctcctgccaaca

SEQ ID NO: 41010 - DNA, 16 bp, H. sapiens
aggcctcgggaagctt

SEQ ID NO: 41011 - DNA, 16 bp, H. sapiens
aggcctctccagccct

SEQ ID NO: 41012 - DNA, 16 bp, H. sapiens
aggcctcttctcctcc

SEQ ID NO: 41013 - DNA, 16 bp, H. sapiens
aggcctcttctgcatc

SEQ ID NO: 41014 - DNA, 16 bp, H. sapiens
aggcctgagccaccac

SEQ ID NO: 41015 - DNA, 17 bp, H. sapiens
aggcctgagccactgca

SEQ ID NO: 41016 - DNA, 16 bp, H. sapiens
aggcctgagccatggc

SEQ ID NO: 41017 - DNA, 16 bp, H. sapiens
aggcctgcctgcctct

SEQ ID NO: 41018 - DNA, 17 bp, H. sapiens
aggcctgcctgcctgcc

SEQ ID NO: 41019 - DNA, 16 bp, H. sapiens
aggcctggaacagatc

SEQ ID NO: 41020 - DNA, 16 bp, H. sapiens
aggcctggagacctag

SEQ ID NO: 41021 - DNA, 16 bp, H. sapiens
aggcctggaggcctaa

SEQ ID NO: 41022 - DNA, 16 bp, H. sapiens
aggcctggaggctgga

SEQ ID NO: 41023 - DNA, 16 bp, H. sapiens
aggcctggaggtggga

SEQ ID NO: 41024 - DNA, 16 bp, H. sapiens
aggcctggagttccag

SEQ ID NO: 41025 - DNA, 16 bp, H. sapiens
aggcctggcctctgcc

SEQ ID NO: 41026 - DNA, 16 bp, H. sapiens
aggcctggcgaggtgg

SEQ ID NO: 41027 - DNA, 16 bp, H. sapiens
aggcctgggaaccagg

SEQ ID NO: 41028 - DNA, 16 bp, H. sapiens
aggcctgggaggggag

SEQ ID NO: 41029 - DNA, 16 bp, H. sapiens
aggcctgggcaggggc

SEQ ID NO: 41030 - DNA, 16 bp, H. sapiens
aggcctggggcagggg

SEQ ID NO: 41031 - DNA, 16 bp, H. sapiens
aggcctggggtggaaa

SEQ ID NO: 41032 - DNA, 16 bp, H. sapiens
aggcctgggtctgcag

SEQ ID NO: 41033 - DNA, 16 bp, H. sapiens
aggcctgggtgggagg

SEQ ID NO: 41034 - DNA, 16 bp, H. sapiens
aggcctggtagtgaca

SEQ ID NO: 41035 - DNA, 18 bp, H. sapiens
aggcctggtgcagtggct

SEQ ID NO: 41036 - DNA, 16 bp, H. sapiens
aggcctggtgccctga

SEQ ID NO: 41037 - DNA, 16 bp, H. sapiens
aggcctggtggaacca

SEQ ID NO: 41038 - DNA, 18 bp, H. sapiens
aggcctggtggtgagaaa

SEQ ID NO: 41039 - DNA, 16 bp, H. sapiens
aggccttaagaaaata

SEQ ID NO: 41040 - DNA, 16 bp, H. sapiens
aggccttcactcttct

SEQ ID NO: 41041 - DNA, 16 bp, H. sapiens
aggccttcagccacag

SEQ ID NO: 41042 - DNA, 16 bp, H. sapiens
aggccttcagcctcag

SEQ ID NO: 41043 - DNA, 16 bp, H. sapiens
aggccttccctgaccc

SEQ ID NO: 41044 - DNA, 17 bp, H. sapiens
aggccttgacttactca

SEQ ID NO: 41045 - DNA, 16 bp, H. sapiens
aggccttggaagccca

SEQ ID NO: 41046 - DNA, 16 bp, H. sapiens
aggccttggacagctc

SEQ ID NO: 41047 - DNA, 16 bp, H. sapiens
aggccttgggagccca

SEQ ID NO: 41048 - DNA, 16 bp, H. sapiens
aggccttgggagctca

SEQ ID NO: 41049 - DNA, 17 bp, H. sapiens
aggcctttcctacaggg

SEQ ID NO: 41050 - DNA, 16 bp, H. sapiens
aggcctttgagaaaat

SEQ ID NO: 41051 - DNA, 16 bp, H. sapiens
aggcctttggccttgg

SEQ ID NO: 41052 - DNA, 16 bp, H. sapiens
aggcctttggtgaaaa

SEQ ID NO: 41053 - DNA, 16 bp, H. sapiens
aggccttttttgcatc

SEQ ID NO: 41054 - DNA, 16 bp, H. sapiens
aggcgaatcacaaggt

SEQ ID NO: 41055 - DNA, 16 bp, H. sapiens
aggcgacagagggaga

SEQ ID NO: 41056 - DNA, 17 bp, H. sapiens
aggcgagaagattgctt

SEQ ID NO: 41057 - DNA, 16 bp, H. sapiens
aggcgcacgccaccac

SEQ ID NO: 41058 - DNA, 16 bp, H. sapiens
aggcgcccattgccgc

SEQ ID NO: 41059 - DNA, 16 bp, H. sapiens
aggcgccgccaccatg

SEQ ID NO: 41060 - DNA, 17 bp, H. sapiens
aggcgcctgccaccacg

SEQ ID NO: 41061 - DNA, 16 bp, H. sapiens
aggcgcctgccacctc

SEQ ID NO: 41062 - DNA, 16 bp, H. sapiens
aggcgcctgccactgt

SEQ ID NO: 41063 - DNA, 16 bp, H. sapiens
aggcgcctgccagcac

SEQ ID NO: 41064 - DNA, 16 bp, H. sapiens
aggcgcctgcctccac

SEQ ID NO: 41065 - DNA, 18 bp, H. sapiens
aggcgcctgtaatcccag

SEQ ID NO: 41066 - DNA, 16 bp, H. sapiens
aggcgcctgtaatcct

SEQ ID NO: 41067 - DNA, 22 bp, H. sapiens
aggcgcctgtagtcgcagctac

SEQ ID NO: 41068 - DNA, 16 bp, H. sapiens
aggcgcggtggctctc

SEQ ID NO: 41069 - DNA, 16 bp, H. sapiens
aggcgctcaataaatg

SEQ ID NO: 41070 - DNA, 16 bp, H. sapiens
aggcggaggctgcaat

SEQ ID NO: 41071 - DNA, 16 bp, H. sapiens
aggcggaggctgctgt

SEQ ID NO: 41072 - DNA, 16 bp, H. sapiens
aggcggaggtgggcag

SEQ ID NO: 41073 - DNA, 17 bp, H. sapiens
aggcggaggttatggtg

SEQ ID NO: 41074 - DNA, 18 bp, H. sapiens
aggcggaggttgcagtga

SEQ ID NO: 41075 - DNA, 16 bp, H. sapiens
aggcggatcaactgag

SEQ ID NO: 41076 - DNA, 18 bp, H. sapiens
aggcggatcacctgaagt

SEQ ID NO: 41077 - DNA, 18 bp, H. sapiens
aggcggatcacctgaggc

SEQ ID NO: 41078 - DNA, 22 bp, H. sapiens
aggcggatcacctgaggtcagc

SEQ ID NO: 41079 - DNA, 17 bp, H. sapiens
aggcggatcacttgagc

SEQ ID NO: 41080 - DNA, 16 bp, H. sapiens
aggcggcagccaggct

SEQ ID NO: 41081 - DNA, 16 bp, H. sapiens
aggcggccgccaccac

SEQ ID NO: 41082 - DNA, 17 bp, H. sapiens
aggcggcgctgcaggag

SEQ ID NO: 41083 - DNA, 16 bp, H. sapiens
aggcggctgaggcaga

SEQ ID NO: 41084 - DNA, 16 bp, H. sapiens
aggcggctgaggcctg

SEQ ID NO: 41085 - DNA, 16 bp, H. sapiens
aggcgggaggatcact

SEQ ID NO: 41086 - DNA, 16 bp, H. sapiens
aggcgggcagatcatc

SEQ ID NO: 41087 - DNA, 16 bp, H. sapiens
aggcgggcaggtcact

SEQ ID NO: 41088 - DNA, 17 bp, H. sapiens
aggcgggcggatcacag

SEQ ID NO: 41089 - DNA, 19 bp, H. sapiens
aggcgggcggatcacgaga

SEQ ID NO: 41090 - DNA, 16 bp, H. sapiens
aggcgggcggatcact

SEQ ID NO: 41091 - DNA, 24 bp, H. sapiens
aggcgggcggatcacttgaggtcg

SEQ ID NO: 41092 - DNA, 19 bp, H. sapiens
aggcgggcggatcatctga

SEQ ID NO: 41093 - DNA, 17 bp, H. sapiens
aggcgggcggatgacga

SEQ ID NO: 41094 - DNA, 16 bp, H. sapiens
aggcgggggctgcccc

SEQ ID NO: 41095 - DNA, 22 bp, H. sapiens
aggcgggtggatcacttgaggg

SEQ ID NO: 41096 - DNA, 23 bp, H. sapiens
aggcgggtggatcatgaggtcaa

SEQ ID NO: 41097 - DNA, 16 bp, H. sapiens
aggcgtaagccactgt

SEQ ID NO: 41098 - DNA, 16 bp, H. sapiens
aggcgtctgtcaccac

SEQ ID NO: 41099 - DNA, 16 bp, H. sapiens
aggcgtgagcaactgc

SEQ ID NO: 41100 - DNA, 16 bp, H. sapiens
aggcgtgagccacccc

SEQ ID NO: 41101 - DNA, 19 bp, H. sapiens
aggcgtgagccacggcgcc

SEQ ID NO: 41102 - DNA, 19 bp, H. sapiens
aggcgtgagccactgcgca

SEQ ID NO: 41103 - DNA, 25 bp, H. sapiens
aggcgtgagccactgcgcccggccc

SEQ ID NO: 41104 - DNA, 16 bp, H. sapiens
aggcgtgagccacttc

SEQ ID NO: 41105 - DNA, 19 bp, H. sapiens
aggcgtgagccatcgcgcc

SEQ ID NO: 41106 - DNA, 16 bp, H. sapiens
aggcgtgagcccccat

SEQ ID NO: 41107 - DNA, 16 bp, H. sapiens
aggcgtgagcccctgc

SEQ ID NO: 41108 - DNA, 16 bp, H. sapiens
aggcgtgagctatcac

SEQ ID NO: 41109 - DNA, 16 bp, H. sapiens
aggcgtgagtcaccaa

SEQ ID NO: 41110 - DNA, 16 bp, H. sapiens
aggcgtgagtcactgc

SEQ ID NO: 41111 - DNA, 16 bp, H. sapiens
aggcgtgcagatcacc

SEQ ID NO: 41112 - DNA, 16 bp, H. sapiens
aggcgtgcagcaccac

SEQ ID NO: 41113 - DNA, 16 bp, H. sapiens
aggcgtgcgccaccac

SEQ ID NO: 41114 - DNA, 16 bp, H. sapiens
aggcgtggcggtgcgc

SEQ ID NO: 41115 - DNA, 17 bp, H. sapiens
aggcgtggtggcacaca

SEQ ID NO: 41116 - DNA, 20 bp, H. sapiens
aggcgtggtggctcatgcct

SEQ ID NO: 41117 - DNA, 16 bp, H. sapiens
aggcgtgtgccaccag

SEQ ID NO: 41118 - DNA, 16 bp, H. sapiens
aggctaaaaataaagg

SEQ ID NO: 41119 - DNA, 17 bp, H. sapiens
aggctaacgcaggagaa

SEQ ID NO: 41120 - DNA, 16 bp, H. sapiens
aggctaagatgggagg

SEQ ID NO: 41121 - DNA, 16 bp, H. sapiens
aggctaagcaaaaaga

SEQ ID NO: 41122 - DNA, 16 bp, H. sapiens
aggctaaggcaagaag

SEQ ID NO: 41123 - DNA, 16 bp, H. sapiens
aggctaaggtagaaga

SEQ ID NO: 41124 - DNA, 17 bp, H. sapiens
aggctaagttttgtatt

SEQ ID NO: 41125 - DNA, 16 bp, H. sapiens
aggctaatcttgaact

SEQ ID NO: 41126 - DNA, 16 bp, H. sapiens
aggctacaaacctgta

SEQ ID NO: 41127 - DNA, 16 bp, H. sapiens
aggctacactacattt

SEQ ID NO: 41128 - DNA, 16 bp, H. sapiens
aggctacagtgagcca

SEQ ID NO: 41129 - DNA, 18 bp, H. sapiens
aggctacagtgcagtggt

SEQ ID NO: 41130 - DNA, 16 bp, H. sapiens
aggctagaatgcagtg

SEQ ID NO: 41131 - DNA, 16 bp, H. sapiens
aggctagacaggaaat

SEQ ID NO: 41132 - DNA, 16 bp, H. sapiens
aggctagactgcagtg

SEQ ID NO: 41133 - DNA, 16 bp, H. sapiens
aggctagagtacagtg

SEQ ID NO: 41134 - DNA, 16 bp, H. sapiens
aggctagagtgcaatg

SEQ ID NO: 41135 - DNA, 16 bp, H. sapiens
aggctagagtgcagtg

SEQ ID NO: 41136 - DNA, 16 bp, H. sapiens
aggctaggtcacaaaa

SEQ ID NO: 41137 - DNA, 16 bp, H. sapiens
aggctagtatcaaact

SEQ ID NO: 41138 - DNA, 16 bp, H. sapiens
aggctagtctcacact

SEQ ID NO: 41139 - DNA, 16 bp, H. sapiens
aggctagtcttgaact

SEQ ID NO: 41140 - DNA, 16 bp, H. sapiens
aggctataccattcag

SEQ ID NO: 41141 - DNA, 16 bp, H. sapiens
aggctatgcatgtgtg

SEQ ID NO: 41142 - DNA, 16 bp, H. sapiens
aggctatggagaaaag

SEQ ID NO: 41143 - DNA, 16 bp, H. sapiens
aggctattatcctaag

SEQ ID NO: 41144 - DNA, 16 bp, H. sapiens
aggctatttgaaaaca

SEQ ID NO: 41145 - DNA, 16 bp, H. sapiens
aggctcaagcgattct

SEQ ID NO: 41146 - DNA, 16 bp, H. sapiens
aggctcaagctattct

SEQ ID NO: 41147 - DNA, 18 bp, H. sapiens
aggctcaagtgatcctct

SEQ ID NO: 41148 - DNA, 16 bp, H. sapiens
aggctcaagtgcagtg

SEQ ID NO: 41149 - DNA, 19 bp, H. sapiens
aggctcacacctgtaatcc

SEQ ID NO: 41150 - DNA, 16 bp, H. sapiens
aggctcagaaatgcct

SEQ ID NO: 41151 - DNA, 16 bp, H. sapiens
aggctcagagaagtta

SEQ ID NO: 41152 - DNA, 16 bp, H. sapiens
aggctcagagagatta

SEQ ID NO: 41153 - DNA, 16 bp, H. sapiens
aggctcagagaggaga

SEQ ID NO: 41154 - DNA, 16 bp, H. sapiens
aggctcagagaggctg

SEQ ID NO: 41155 - DNA, 16 bp, H. sapiens
aggctcagagaggtga

SEQ ID NO: 41156 - DNA, 16 bp, H. sapiens
aggctcagagaggtta

SEQ ID NO: 41157 - DNA, 23 bp, H. sapiens
aggctcagcagggagctgctgga

SEQ ID NO: 41158 - DNA, 16 bp, H. sapiens
aggctcaggagggagg

SEQ ID NO: 41159 - DNA, 16 bp, H. sapiens
aggctcagggaggcca

SEQ ID NO: 41160 - DNA, 16 bp, H. sapiens
aggctcagggagggga

SEQ ID NO: 41161 - DNA, 16 bp, H. sapiens
aggctcaggtgaccct

SEQ ID NO: 41162 - DNA, 16 bp, H. sapiens
aggctcagtggttcat

SEQ ID NO: 41163 - DNA, 16 bp, H. sapiens
aggctcagtgtggaca

SEQ ID NO: 41164 - DNA, 16 bp, H. sapiens
aggctcagttttctca

SEQ ID NO: 41165 - DNA, 16 bp, H. sapiens
aggctccagacccggg

SEQ ID NO: 41166 - DNA, 16 bp, H. sapiens
aggctccagaggaagg

SEQ ID NO: 41167 - DNA, 16 bp, H. sapiens
aggctccagggaaggg

SEQ ID NO: 41168 - DNA, 16 bp, H. sapiens
aggctccaggggagga

SEQ ID NO: 41169 - DNA, 16 bp, H. sapiens
aggctccatcaaaaaa

SEQ ID NO: 41170 - DNA, 16 bp, H. sapiens
aggctccatgagcaga

SEQ ID NO: 41171 - DNA, 16 bp, H. sapiens
aggctcccaaagtgct

SEQ ID NO: 41172 - DNA, 16 bp, H. sapiens
aggctcccatgtcatg

SEQ ID NO: 41173 - DNA, 16 bp, H. sapiens
aggctccgtgggcata

SEQ ID NO: 41174 - DNA, 16 bp, H. sapiens
aggctcctggagggtg

SEQ ID NO: 41175 - DNA, 16 bp, H. sapiens
aggctcggaagtgcct

SEQ ID NO: 41176 - DNA, 16 bp, H. sapiens
aggctctagagtcaga

SEQ ID NO: 41177 - DNA, 16 bp, H. sapiens
aggctctcaataaata

SEQ ID NO: 41178 - DNA, 16 bp, H. sapiens
aggctctgaaattgaa

SEQ ID NO: 41179 - DNA, 16 bp, H. sapiens
aggctctgaccccaca

SEQ ID NO: 41180 - DNA, 16 bp, H. sapiens
aggctctgaggaagaa

SEQ ID NO: 41181 - DNA, 16 bp, H. sapiens
aggctctggaaaaggg

SEQ ID NO: 41182 - DNA, 16 bp, H. sapiens
aggctctggagaagaa

SEQ ID NO: 41183 - DNA, 16 bp, H. sapiens
aggctctgggggagaa

SEQ ID NO: 41184 - DNA, 16 bp, H. sapiens
aggctctgtctcaaaa

SEQ ID NO: 41185 - DNA, 18 bp, H. sapiens
aggctctgtgggcatagg

SEQ ID NO: 41186 - DNA, 16 bp, H. sapiens
aggctctgttcatttt

SEQ ID NO: 41187 - DNA, 16 bp, H. sapiens
aggctcttggggtccc

SEQ ID NO: 41188 - DNA, 16 bp, H. sapiens
aggctgaaagaaaaaa

SEQ ID NO: 41189 - DNA, 16 bp, H. sapiens
aggctgaaatgaaagg

SEQ ID NO: 41190 - DNA, 16 bp, H. sapiens
aggctgaagaacagca

SEQ ID NO: 41191 - DNA, 16 bp, H. sapiens
aggctgaagaggagga

SEQ ID NO: 41192 - DNA, 16 bp, H. sapiens
aggctgaagcagagga

SEQ ID NO: 41193 - DNA, 16 bp, H. sapiens
aggctgaagcagatgg

SEQ ID NO: 41194 - DNA, 16 bp, H. sapiens
aggctgaagcagcaga

SEQ ID NO: 41195 - DNA, 16 bp, H. sapiens
aggctgaagcagcagg

SEQ ID NO: 41196 - DNA, 16 bp, H. sapiens
aggctgaagcaggaca

SEQ ID NO: 41197 - DNA, 18 bp, H. sapiens
aggctgaagcaggagaac

SEQ ID NO: 41198 - DNA, 18 bp, H. sapiens
aggctgaagcaggagaat

SEQ ID NO: 41199 - DNA, 16 bp, H. sapiens
aggctgaagcagggga

SEQ ID NO: 41200 - DNA, 16 bp, H. sapiens
aggctgaagctggaga

SEQ ID NO: 41201 - DNA, 16 bp, H. sapiens
aggctgaagggcagtg

SEQ ID NO: 41202 - DNA, 16 bp, H. sapiens
aggctgaagtcagagg

SEQ ID NO: 41203 - DNA, 16 bp, H. sapiens
aggctgaagtgattct

SEQ ID NO: 41204 - DNA, 16 bp, H. sapiens
aggctgaagtggaaag

SEQ ID NO: 41205 - DNA, 17 bp, H. sapiens
aggctgaagtgggagga

SEQ ID NO: 41206 - DNA, 16 bp, H. sapiens
aggctgaagtggggga

SEQ ID NO: 41207 - DNA, 16 bp, H. sapiens
aggctgaatagtattt

SEQ ID NO: 41208 - DNA, 16 bp, H. sapiens
aggctgaatttattga

SEQ ID NO: 41209 - DNA, 16 bp, H. sapiens
aggctgacacagaaga

SEQ ID NO: 41210 - DNA, 16 bp, H. sapiens
aggctgagaaaagaga

SEQ ID NO: 41211 - DNA, 16 bp, H. sapiens
aggctgagaaacactg

SEQ ID NO: 41212 - DNA, 16 bp, H. sapiens
aggctgagaaatcctg

SEQ ID NO: 41213 - DNA, 16 bp, H. sapiens
aggctgagaaggagaa

SEQ ID NO: 41214 - DNA, 16 bp, H. sapiens
aggctgagaagtttca

SEQ ID NO: 41215 - DNA, 16 bp, H. sapiens
aggctgagaattgctt

SEQ ID NO: 41216 - DNA, 16 bp, H. sapiens
aggctgagacaaaaga

SEQ ID NO: 41217 - DNA, 16 bp, H. sapiens
aggctgagacagaatc

SEQ ID NO: 41218 - DNA, 17 bp, H. sapiens
aggctgagacaggaaaa

SEQ ID NO: 41219 - DNA, 26 bp, H. sapiens
aggctgagacaggagaatggcgtgaa

SEQ ID NO: 41220 - DNA, 16 bp, H. sapiens
aggctgagacaggagg

SEQ ID NO: 41221 - DNA, 16 bp, H. sapiens
aggctgagacaggcga

SEQ ID NO: 41222 - DNA, 16 bp, H. sapiens
aggctgagacgggtgg

SEQ ID NO: 41223 - DNA, 16 bp, H. sapiens
aggctgagagagatga

SEQ ID NO: 41224 - DNA, 16 bp, H. sapiens
aggctgagagcagtgg

SEQ ID NO: 41225 - DNA, 16 bp, H. sapiens
aggctgagaggctgag

SEQ ID NO: 41226 - DNA, 16 bp, H. sapiens
aggctgagatggagga

SEQ ID NO: 41227 - DNA, 16 bp, H. sapiens
aggctgagcagaagaa

SEQ ID NO: 41228 - DNA, 16 bp, H. sapiens
aggctgagccccagag

SEQ ID NO: 41229 - DNA, 16 bp, H. sapiens
aggctgagcctggaga

SEQ ID NO: 41230 - DNA, 16 bp, H. sapiens
aggctgagcctggagg

SEQ ID NO: 41231 - DNA, 16 bp, H. sapiens
aggctgaggaagaaga

SEQ ID NO: 41232 - DNA, 16 bp, H. sapiens
aggctgaggaagagga

SEQ ID NO: 41233 - DNA, 16 bp, H. sapiens
aggctgaggaaggaaa

SEQ ID NO: 41234 - DNA, 16 bp, H. sapiens
aggctgaggaaggtga

SEQ ID NO: 41235 - DNA, 16 bp, H. sapiens
aggctgaggagaaaga

SEQ ID NO: 41236 - DNA, 16 bp, H. sapiens
aggctgaggagaagga

SEQ ID NO: 41237 - DNA, 16 bp, H. sapiens
aggctgaggagaatgg

SEQ ID NO: 41238 - DNA, 16 bp, H. sapiens
aggctgaggagagaga

SEQ ID NO: 41239 - DNA, 16 bp, H. sapiens
aggctgaggagcaggg

SEQ ID NO: 41240 - DNA, 16 bp, H. sapiens
aggctgaggaggaagg

SEQ ID NO: 41241 - DNA, 16 bp, H. sapiens
aggctgaggaggagga

SEQ ID NO: 41242 - DNA, 16 bp, H. sapiens
aggctgaggaggcagg

SEQ ID NO: 41243 - DNA, 16 bp, H. sapiens
aggctgaggaggcctc

SEQ ID NO: 41244 - DNA, 16 bp, H. sapiens
aggctgaggaggtctc

SEQ ID NO: 41245 - DNA, 16 bp, H. sapiens
aggctgaggagtgggg

SEQ ID NO: 41246 - DNA, 16 bp, H. sapiens
aggctgaggatggtgg

SEQ ID NO: 41247 - DNA, 18 bp, H. sapiens
aggctgaggcaaaagaat

SEQ ID NO: 41248 - DNA, 16 bp, H. sapiens
aggctgaggcaagtga

SEQ ID NO: 41249 - DNA, 16 bp, H. sapiens
aggctgaggcacagag

SEQ ID NO: 41250 - DNA, 17 bp, H. sapiens
aggctgaggcacgagac

SEQ ID NO: 41251 - DNA, 16 bp, H. sapiens
aggctgaggcagatga

SEQ ID NO: 41252 - DNA, 16 bp, H. sapiens
aggctgaggcagcagc

SEQ ID NO: 41253 - DNA, 16 bp, H. sapiens
aggctgaggcagctgg

SEQ ID NO: 41254 - DNA, 17 bp, H. sapiens
aggctgaggcaggaaga

SEQ ID NO: 41255 - DNA, 18 bp, H. sapiens
aggctgaggcaggagaaa

SEQ ID NO: 41256 - DNA, 17 bp, H. sapiens
aggctgaggcaggagag

SEQ ID NO: 41257 - DNA, 16 bp, H. sapiens
aggctgaggcaggagc

SEQ ID NO: 41258 - DNA, 17 bp, H. sapiens
aggctgaggcaggaggc

SEQ ID NO: 41259 - DNA, 16 bp, H. sapiens
aggctgaggcataaga

SEQ ID NO: 41260 - DNA, 16 bp, H. sapiens
aggctgaggcatgagg

SEQ ID NO: 41261 - DNA, 16 bp, H. sapiens
aggctgaggccaaaga

SEQ ID NO: 41262 - DNA, 16 bp, H. sapiens
aggctgaggccagcag

SEQ ID NO: 41263 - DNA, 16 bp, H. sapiens
aggctgaggcccagga

SEQ ID NO: 41264 - DNA, 18 bp, H. sapiens
aggctgaggcgggagaat

SEQ ID NO: 41265 - DNA, 16 bp, H. sapiens
aggctgaggctgagga

SEQ ID NO: 41266 - DNA, 16 bp, H. sapiens
aggctgaggctgaggg

SEQ ID NO: 41267 - DNA, 16 bp, H. sapiens
aggctgaggctgaggt

SEQ ID NO: 41268 - DNA, 16 bp, H. sapiens
aggctgaggctggggg

SEQ ID NO: 41269 - DNA, 16 bp, H. sapiens
aggctgagggaacagc

SEQ ID NO: 41270 - DNA, 16 bp, H. sapiens
aggctgagggagccgg

SEQ ID NO: 41271 - DNA, 16 bp, H. sapiens
aggctgagggaggaag

SEQ ID NO: 41272 - DNA, 16 bp, H. sapiens
aggctgagggaggcag

SEQ ID NO: 41273 - DNA, 16 bp, H. sapiens
aggctgagggcagagg

SEQ ID NO: 41274 - DNA, 16 bp, H. sapiens
aggctgaggtaagcag

SEQ ID NO: 41275 - DNA, 16 bp, H. sapiens
aggctgaggtcaggag

SEQ ID NO: 41276 - DNA, 16 bp, H. sapiens
aggctgaggtggaaaa

SEQ ID NO: 41277 - DNA, 16 bp, H. sapiens
aggctgaggtggcaga

SEQ ID NO: 41278 - DNA, 16 bp, H. sapiens
aggctgaggtgggaga

SEQ ID NO: 41279 - DNA, 16 bp, H. sapiens
aggctgaggtgggagc

SEQ ID NO: 41280 - DNA, 16 bp, H. sapiens
aggctgaggtgggcat

SEQ ID NO: 41281 - DNA, 16 bp, H. sapiens
aggctgaggtggggga

SEQ ID NO: 41282 - DNA, 16 bp, H. sapiens
aggctgaggtggtctc

SEQ ID NO: 41283 - DNA, 16 bp, H. sapiens
aggctgaggtggtgga

SEQ ID NO: 41284 - DNA, 18 bp, H. sapiens
aggctgaggttgcagtga

SEQ ID NO: 41285 - DNA, 16 bp, H. sapiens
aggctgaggttggaga

SEQ ID NO: 41286 - DNA, 16 bp, H. sapiens
aggctgagtacagtgg

SEQ ID NO: 41287 - DNA, 16 bp, H. sapiens
aggctgagtcacgaga

SEQ ID NO: 41288 - DNA, 16 bp, H. sapiens
aggctgagtcaggcag

SEQ ID NO: 41289 - DNA, 16 bp, H. sapiens
aggctgagtgcggtgg

SEQ ID NO: 41290 - DNA, 16 bp, H. sapiens
aggctgagtggaagga

SEQ ID NO: 41291 - DNA, 17 bp, H. sapiens
aggctgagttgggtgga

SEQ ID NO: 41292 - DNA, 16 bp, H. sapiens
aggctgatctcaaacc

SEQ ID NO: 41293 - DNA, 16 bp, H. sapiens
aggctgatctcaaact

SEQ ID NO: 41294 - DNA, 16 bp, H. sapiens
aggctgatcttgaacc

SEQ ID NO: 41295 - DNA, 16 bp, H. sapiens
aggctgatcttgaact

SEQ ID NO: 41296 - DNA, 16 bp, H. sapiens
aggctgatgcaggcag

SEQ ID NO: 41297 - DNA, 16 bp, H. sapiens
aggctgcaaggagcca

SEQ ID NO: 41298 - DNA, 16 bp, H. sapiens
aggctgcaataagctg

SEQ ID NO: 41299 - DNA, 16 bp, H. sapiens
aggctgcaatgagcag

SEQ ID NO: 41300 - DNA, 16 bp, H. sapiens
aggctgcacacagcag

SEQ ID NO: 41301 - DNA, 16 bp, H. sapiens
aggctgcacagagcag

SEQ ID NO: 41302 - DNA, 16 bp, H. sapiens
aggctgcacagcttgt

SEQ ID NO: 41303 - DNA, 16 bp, H. sapiens
aggctgcacaggagag

SEQ ID NO: 41304 - DNA, 16 bp, H. sapiens
aggctgcactgagcca

SEQ ID NO: 41305 - DNA, 16 bp, H. sapiens
aggctgcagaacagct

SEQ ID NO: 41306 - DNA, 16 bp, H. sapiens
aggctgcagagaaaag

SEQ ID NO: 41307 - DNA, 16 bp, H. sapiens
aggctgcagagagctg

SEQ ID NO: 41308 - DNA, 16 bp, H. sapiens
aggctgcagcaggagg

SEQ ID NO: 41309 - DNA, 16 bp, H. sapiens
aggctgcagcaggcag

SEQ ID NO: 41310 - DNA, 16 bp, H. sapiens
aggctgcagcctggca

SEQ ID NO: 41311 - DNA, 16 bp, H. sapiens
aggctgcagcgagcca

SEQ ID NO: 41312 - DNA, 16 bp, H. sapiens
aggctgcagggagcag

SEQ ID NO: 41313 - DNA, 16 bp, H. sapiens
aggctgcagggagcca

SEQ ID NO: 41314 - DNA, 16 bp, H. sapiens
aggctgcagggcagga

SEQ ID NO: 41315 - DNA, 16 bp, H. sapiens
aggctgcagggcagtg

SEQ ID NO: 41316 - DNA, 16 bp, H. sapiens
aggctgcagtaagcca

SEQ ID NO: 41317 - DNA, 19 bp, H. sapiens
aggctgcagtgagccgaga

SEQ ID NO: 41318 - DNA, 16 bp, H. sapiens
aggctgcagtgagcta

SEQ ID NO: 41319 - DNA, 17 bp, H. sapiens
aggctgcagtgagctct

SEQ ID NO: 41320 - DNA, 16 bp, H. sapiens
aggctgcagtgagtca

SEQ ID NO: 41321 - DNA, 16 bp, H. sapiens
aggctgcagtgagtgg

SEQ ID NO: 41322 - DNA, 16 bp, H. sapiens
aggctgcagtgcacta

SEQ ID NO: 41323 - DNA, 16 bp, H. sapiens
aggctgcagtgcactg

SEQ ID NO: 41324 - DNA, 16 bp, H. sapiens
aggctgcagtgcagtg

SEQ ID NO: 41325 - DNA, 16 bp, H. sapiens
aggctgcagtgcgcca

SEQ ID NO: 41326 - DNA, 16 bp, H. sapiens
aggctgcagtgtgcca

SEQ ID NO: 41327 - DNA, 16 bp, H. sapiens
aggctgcagtgtgcta

SEQ ID NO: 41328 - DNA, 16 bp, H. sapiens
aggctgcagtgtgctg

SEQ ID NO: 41329 - DNA, 16 bp, H. sapiens
aggctgcattgagcca

SEQ ID NO: 41330 - DNA, 16 bp, H. sapiens
aggctgccaagcctcc

SEQ ID NO: 41331 - DNA, 16 bp, H. sapiens
aggctgccaggctgga

SEQ ID NO: 41332 - DNA, 16 bp, H. sapiens
aggctgccatctttgc

SEQ ID NO: 41333 - DNA, 16 bp, H. sapiens
aggctgcggtgggcag

SEQ ID NO: 41334 - DNA, 16 bp, H. sapiens
aggctgctacaacaaa

SEQ ID NO: 41335 - DNA, 16 bp, H. sapiens
aggctgctcttgaact

SEQ ID NO: 41336 - DNA, 16 bp, H. sapiens
aggctgctgccttgca

SEQ ID NO: 41337 - DNA, 16 bp, H. sapiens
aggctgctgtgaactg

SEQ ID NO: 41338 - DNA, 16 bp, H. sapiens
aggctgcttttccacc

SEQ ID NO: 41339 - DNA, 16 bp, H. sapiens
aggctggaaagcagtg

SEQ ID NO: 41340 - DNA, 16 bp, H. sapiens
aggctggaagagtttt

SEQ ID NO: 41341 - DNA, 16 bp, H. sapiens
aggctggaagcagtgg

SEQ ID NO: 41342 - DNA, 16 bp, H. sapiens
aggctggaaggaggaa

SEQ ID NO: 41343 - DNA, 16 bp, H. sapiens
aggctggaatgcaatg

SEQ ID NO: 41344 - DNA, 19 bp, H. sapiens
aggctggaatgcaatggcg

SEQ ID NO: 41345 - DNA, 16 bp, H. sapiens
aggctggaatgcagta

SEQ ID NO: 41346 - DNA, 17 bp, H. sapiens
aggctggaatgcagtga

SEQ ID NO: 41347 - DNA, 18 bp, H. sapiens
aggctggaatgcagtggc

SEQ ID NO: 41348 - DNA, 16 bp, H. sapiens
aggctggacatgatgg

SEQ ID NO: 41349 - DNA, 16 bp, H. sapiens
aggctggactggagtg

SEQ ID NO: 41350 - DNA, 16 bp, H. sapiens
aggctggactgtgctg

SEQ ID NO: 41351 - DNA, 16 bp, H. sapiens
aggctggagaaggaaa

SEQ ID NO: 41352 - DNA, 16 bp, H. sapiens
aggctggagagcagag

SEQ ID NO: 41353 - DNA, 16 bp, H. sapiens
aggctggagagcagca

SEQ ID NO: 41354 - DNA, 16 bp, H. sapiens
aggctggagagcagtg

SEQ ID NO: 41355 - DNA, 16 bp, H. sapiens
aggctggagagcctgg

SEQ ID NO: 41356 - DNA, 16 bp, H. sapiens
aggctggagaggcagg

SEQ ID NO: 41357 - DNA, 16 bp, H. sapiens
aggctggagcaaagtg

SEQ ID NO: 41358 - DNA, 16 bp, H. sapiens
aggctggagcacaatg

SEQ ID NO: 41359 - DNA, 16 bp, H. sapiens
aggctggagcacaggg

SEQ ID NO: 41360 - DNA, 16 bp, H. sapiens
aggctggagcacagtg

SEQ ID NO: 41361 - DNA, 16 bp, H. sapiens
aggctggagcaggcag

SEQ ID NO: 41362 - DNA, 17 bp, H. sapiens
aggctggagcgcaatgg

SEQ ID NO: 41363 - DNA, 19 bp, H. sapiens
aggctggagcgcaatggcg

SEQ ID NO: 41364 - DNA, 16 bp, H. sapiens
aggctggagcgctgtg

SEQ ID NO: 41365 - DNA, 16 bp, H. sapiens
aggctggagctattat

SEQ ID NO: 41366 - DNA, 16 bp, H. sapiens
aggctggaggaggaag

SEQ ID NO: 41367 - DNA, 16 bp, H. sapiens
aggctggaggaggtgg

SEQ ID NO: 41368 - DNA, 16 bp, H. sapiens
aggctggaggcaggag

SEQ ID NO: 41369 - DNA, 16 bp, H. sapiens
aggctggaggcaggga

SEQ ID NO: 41370 - DNA, 16 bp, H. sapiens
aggctggaggctgagg

SEQ ID NO: 41371 - DNA, 16 bp, H. sapiens
aggctggaggctggag

SEQ ID NO: 41372 - DNA, 16 bp, H. sapiens
aggctggagggcaggg

SEQ ID NO: 41373 - DNA, 16 bp, H. sapiens
aggctggagtaaaatg

SEQ ID NO: 41374 - DNA, 19 bp, H. sapiens
aggctggagtacagtggcg

SEQ ID NO: 41375 - DNA, 20 bp, H. sapiens
aggctggagtacagtggcgc

SEQ ID NO: 41376 - DNA, 16 bp, H. sapiens
aggctggagtacgatg

SEQ ID NO: 41377 - DNA, 18 bp, H. sapiens
aggctggagtagagtggc

SEQ ID NO: 41378 - DNA, 18 bp, H. sapiens
aggctggagtgaaatggc

SEQ ID NO: 41379 - DNA, 16 bp, H. sapiens
aggctggagtgaaggg

SEQ ID NO: 41380 - DNA, 16 bp, H. sapiens
aggctggagtgcaagg

SEQ ID NO: 41381 - DNA, 21 bp, H. sapiens
aggctggagtgcaatggcgca

SEQ ID NO: 41382 - DNA, 16 bp, H. sapiens
aggctggagtgcagga

SEQ ID NO: 41383 - DNA, 16 bp, H. sapiens
aggctggagtgccatg

SEQ ID NO: 41384 - DNA, 16 bp, H. sapiens
aggctggagtgccctg

SEQ ID NO: 41385 - DNA, 16 bp, H. sapiens
aggctggagtgctatg

SEQ ID NO: 41386 - DNA, 16 bp, H. sapiens
aggctggagtggaggg

SEQ ID NO: 41387 - DNA, 16 bp, H. sapiens
aggctggagtgtagta

SEQ ID NO: 41388 - DNA, 16 bp, H. sapiens
aggctggagtgtcatg

SEQ ID NO: 41389 - DNA, 16 bp, H. sapiens
aggctggagtgtggtg

SEQ ID NO: 41390 - DNA, 16 bp, H. sapiens
aggctggagttcactg

SEQ ID NO: 41391 - DNA, 16 bp, H. sapiens
aggctggagttcagtg

SEQ ID NO: 41392 - DNA, 16 bp, H. sapiens
aggctggattccagtg

SEQ ID NO: 41393 - DNA, 16 bp, H. sapiens
aggctggattgcagtg

SEQ ID NO: 41394 - DNA, 17 bp, H. sapiens
aggctggattgcagtgc

SEQ ID NO: 41395 - DNA, 16 bp, H. sapiens
aggctggcagagacac

SEQ ID NO: 41396 - DNA, 16 bp, H. sapiens
aggctggcagatcatg

SEQ ID NO: 41397 - DNA, 16 bp, H. sapiens
aggctggcagggctgg

SEQ ID NO: 41398 - DNA, 16 bp, H. sapiens
aggctggccacagtgg

SEQ ID NO: 41399 - DNA, 16 bp, H. sapiens
aggctggcgtacagtg

SEQ ID NO: 41400 - DNA, 19 bp, H. sapiens
aggctggcgtgcagtggcg

SEQ ID NO: 41401 - DNA, 16 bp, H. sapiens
aggctgggaaatgtgg

SEQ ID NO: 41402 - DNA, 16 bp, H. sapiens
aggctgggaagcagag

SEQ ID NO: 41403 - DNA, 16 bp, H. sapiens
aggctgggaagcatag

SEQ ID NO: 41404 - DNA, 16 bp, H. sapiens
aggctgggaaggggag

SEQ ID NO: 41405 - DNA, 16 bp, H. sapiens
aggctgggacttgctg

SEQ ID NO: 41406 - DNA, 16 bp, H. sapiens
aggctgggagaggctg

SEQ ID NO: 41407 - DNA, 16 bp, H. sapiens
aggctgggagaggtgg

SEQ ID NO: 41408 - DNA, 16 bp, H. sapiens
aggctgggaggcagga

SEQ ID NO: 41409 - DNA, 16 bp, H. sapiens
aggctgggaggcaggg

SEQ ID NO: 41410 - DNA, 16 bp, H. sapiens
aggctgggaggccagg

SEQ ID NO: 41411 - DNA, 16 bp, H. sapiens
aggctgggaggctagg

SEQ ID NO: 41412 - DNA, 16 bp, H. sapiens
aggctgggaggggctg

SEQ ID NO: 41413 - DNA, 16 bp, H. sapiens
aggctgggagtggtgg

SEQ ID NO: 41414 - DNA, 17 bp, H. sapiens
aggctgggcaacatagc

SEQ ID NO: 41415 - DNA, 16 bp, H. sapiens
aggctgggcacagagg

SEQ ID NO: 41416 - DNA, 16 bp, H. sapiens
aggctgggcaccgtgg

SEQ ID NO: 41417 - DNA, 16 bp, H. sapiens
aggctgggcactgtgg

SEQ ID NO: 41418 - DNA, 16 bp, H. sapiens
aggctgggcaggagga

SEQ ID NO: 41419 - DNA, 16 bp, H. sapiens
aggctgggcagggagg

SEQ ID NO: 41420 - DNA, 16 bp, H. sapiens
aggctgggcatgctgg

SEQ ID NO: 41421 - DNA, 16 bp, H. sapiens
aggctgggccctgggg

SEQ ID NO: 41422 - DNA, 16 bp, H. sapiens
aggctgggccgggcgc

SEQ ID NO: 41423 - DNA, 16 bp, H. sapiens
aggctgggcctggagg

SEQ ID NO: 41424 - DNA, 16 bp, H. sapiens
aggctgggctgggcac

SEQ ID NO: 41425 - DNA, 16 bp, H. sapiens
aggctgggctggggag

SEQ ID NO: 41426 - DNA, 16 bp, H. sapiens
aggctgggcttgcagg

SEQ ID NO: 41427 - DNA, 16 bp, H. sapiens
aggctggggaagttct

SEQ ID NO: 41428 - DNA, 16 bp, H. sapiens
aggctggggaccactg

SEQ ID NO: 41429 - DNA, 16 bp, H. sapiens
aggctggggacccagg

SEQ ID NO: 41430 - DNA, 16 bp, H. sapiens
aggctggggcagagga

SEQ ID NO: 41431 - DNA, 16 bp, H. sapiens
aggctggggcaggcag

SEQ ID NO: 41432 - DNA, 16 bp, H. sapiens
aggctggggcagggga

SEQ ID NO: 41433 - DNA, 16 bp, H. sapiens
aggctggggctggggc

SEQ ID NO: 41434 - DNA, 16 bp, H. sapiens
aggctggggctggtgg

SEQ ID NO: 41435 - DNA, 16 bp, H. sapiens
aggctgggggcagagg

SEQ ID NO: 41436 - DNA, 16 bp, H. sapiens
aggctgggggcagtgg

SEQ ID NO: 41437 - DNA, 16 bp, H. sapiens
aggctgggggctgggc

SEQ ID NO: 41438 - DNA, 16 bp, H. sapiens
aggctggggtccagtg

SEQ ID NO: 41439 - DNA, 16 bp, H. sapiens
aggctggggtcctgcc

SEQ ID NO: 41440 - DNA, 16 bp, H. sapiens
aggctggggtgcaatg

SEQ ID NO: 41441 - DNA, 16 bp, H. sapiens
aggctggggtgcaggg

SEQ ID NO: 41442 - DNA, 16 bp, H. sapiens
aggctggggtgctgtg

SEQ ID NO: 41443 - DNA, 16 bp, H. sapiens
aggctggggtggaaga

SEQ ID NO: 41444 - DNA, 16 bp, H. sapiens
aggctggggtgggaga

SEQ ID NO: 41445 - DNA, 16 bp, H. sapiens
aggctgggtgccgtgg

SEQ ID NO: 41446 - DNA, 16 bp, H. sapiens
aggctgggtgcgatgg

SEQ ID NO: 41447 - DNA, 16 bp, H. sapiens
aggctgggtggctggg

SEQ ID NO: 41448 - DNA, 16 bp, H. sapiens
aggctgggtgtggtga

SEQ ID NO: 41449 - DNA, 16 bp, H. sapiens
aggctgggttcagtgg

SEQ ID NO: 41450 - DNA, 16 bp, H. sapiens
aggctggtaatttata

SEQ ID NO: 41451 - DNA, 16 bp, H. sapiens
aggctggtcacaaact

SEQ ID NO: 41452 - DNA, 16 bp, H. sapiens
aggctggtcatggtgg

SEQ ID NO: 41453 - DNA, 17 bp, H. sapiens
aggctggtctcaaactg

SEQ ID NO: 41454 - DNA, 17 bp, H. sapiens
aggctggtctcaaactt

SEQ ID NO: 41455 - DNA, 16 bp, H. sapiens
aggctggtctccatct

SEQ ID NO: 41456 - DNA, 16 bp, H. sapiens
aggctggtctcctact

SEQ ID NO: 41457 - DNA, 19 bp, H. sapiens
aggctggtctcgaactcca

SEQ ID NO: 41458 - DNA, 17 bp, H. sapiens
aggctggtctctaactc

SEQ ID NO: 41459 - DNA, 16 bp, H. sapiens
aggctggtctctgaac

SEQ ID NO: 41460 - DNA, 16 bp, H. sapiens
aggctggtctggaaat

SEQ ID NO: 41461 - DNA, 16 bp, H. sapiens
aggctggtcttgaaca

SEQ ID NO: 41462 - DNA, 18 bp, H. sapiens
aggctggtcttgaactca

SEQ ID NO: 41463 - DNA, 16 bp, H. sapiens
aggctggttgcaaact

SEQ ID NO: 41464 - DNA, 16 bp, H. sapiens
aggctggttttgaact

SEQ ID NO: 41465 - DNA, 16 bp, H. sapiens
aggctgtacaggaagc

SEQ ID NO: 41466 - DNA, 16 bp, H. sapiens
aggctgtagtgagcca

SEQ ID NO: 41467 - DNA, 16 bp, H. sapiens
aggctgtagtgcagca

SEQ ID NO: 41468 - DNA, 16 bp, H. sapiens
aggctgtcacactgac

SEQ ID NO: 41469 - DNA, 16 bp, H. sapiens
aggctgtcagtggatc

SEQ ID NO: 41470 - DNA, 16 bp, H. sapiens
aggctgtgaaacagca

SEQ ID NO: 41471 - DNA, 16 bp, H. sapiens
aggctgtgaagaaaag

SEQ ID NO: 41472 - DNA, 16 bp, H. sapiens
aggctgtgacaggagg

SEQ ID NO: 41473 - DNA, 16 bp, H. sapiens
aggctgtgagggagaa

SEQ ID NO: 41474 - DNA, 16 bp, H. sapiens
aggctgtggaagcttt

SEQ ID NO: 41475 - DNA, 16 bp, H. sapiens
aggctgtggaaggagg

SEQ ID NO: 41476 - DNA, 16 bp, H. sapiens
aggctgtggagtgcag

SEQ ID NO: 41477 - DNA, 16 bp, H. sapiens
aggctgtggcaggagg

SEQ ID NO: 41478 - DNA, 16 bp, H. sapiens
aggctgtgggagccca

SEQ ID NO: 41479 - DNA, 16 bp, H. sapiens
aggctgtggtgagcta

SEQ ID NO: 41480 - DNA, 16 bp, H. sapiens
aggctgtggtgggcgg

SEQ ID NO: 41481 - DNA, 16 bp, H. sapiens
aggctgtttattcact

SEQ ID NO: 41482 - DNA, 16 bp, H. sapiens
aggctgtttcatttac

SEQ ID NO: 41483 - DNA, 16 bp, H. sapiens
aggctgttttccaaag

SEQ ID NO: 41484 - DNA, 16 bp, H. sapiens
aggcttattttatttt

SEQ ID NO: 41485 - DNA, 16 bp, H. sapiens
aggcttcacagagaag

SEQ ID NO: 41486 - DNA, 16 bp, H. sapiens
aggcttcagaaagtgg

SEQ ID NO: 41487 - DNA, 16 bp, H. sapiens
aggcttcagaatgtgg

SEQ ID NO: 41488 - DNA, 16 bp, H. sapiens
aggcttcagccaccat

SEQ ID NO: 41489 - DNA, 16 bp, H. sapiens
aggcttcataatcatg

SEQ ID NO: 41490 - DNA, 16 bp, H. sapiens
aggcttccaggaggaa

SEQ ID NO: 41491 - DNA, 17 bp, H. sapiens
aggcttccccagccatg

SEQ ID NO: 41492 - DNA, 16 bp, H. sapiens
aggcttccccagccct

SEQ ID NO: 41493 - DNA, 16 bp, H. sapiens
aggcttccctgaccac

SEQ ID NO: 41494 - DNA, 16 bp, H. sapiens
aggcttctcagcagaa

SEQ ID NO: 41495 - DNA, 16 bp, H. sapiens
aggcttctccagccac

SEQ ID NO: 41496 - DNA, 16 bp, H. sapiens
aggcttgagcctggga

SEQ ID NO: 41497 - DNA, 16 bp, H. sapiens
aggcttgaggtgggag

SEQ ID NO: 41498 - DNA, 16 bp, H. sapiens
aggcttgagtgcagtg

SEQ ID NO: 41499 - DNA, 18 bp, H. sapiens
aggcttgagtgcagtggc

SEQ ID NO: 41500 - DNA, 16 bp, H. sapiens
aggcttgatggctcat

SEQ ID NO: 41501 - DNA, 16 bp, H. sapiens
aggcttgccaagaaac

SEQ ID NO: 41502 - DNA, 16 bp, H. sapiens
aggcttggagcttgca

SEQ ID NO: 41503 - DNA, 16 bp, H. sapiens
aggcttggggaggggc

SEQ ID NO: 41504 - DNA, 16 bp, H. sapiens
aggcttgtcttgaact

SEQ ID NO: 41505 - DNA, 16 bp, H. sapiens
aggctttacaggaagc

SEQ ID NO: 41506 - DNA, 16 bp, H. sapiens
aggctttattttaaat

SEQ ID NO: 41507 - DNA, 16 bp, H. sapiens
aggctttcctcctcag

SEQ ID NO: 41508 - DNA, 16 bp, H. sapiens
aggctttctggaggaa

SEQ ID NO: 41509 - DNA, 16 bp, H. sapiens
aggctttgagggccat

SEQ ID NO: 41510 - DNA, 16 bp, H. sapiens
aggctttgcaggccac

SEQ ID NO: 41511 - DNA, 16 bp, H. sapiens
aggctttggaatcaga

SEQ ID NO: 41512 - DNA, 16 bp, H. sapiens
aggctttggagttaga

SEQ ID NO: 41513 - DNA, 16 bp, H. sapiens
aggctttggggtcaga

SEQ ID NO: 41514 - DNA, 16 bp, H. sapiens
aggctttgtttacact

SEQ ID NO: 41515 - DNA, 16 bp, H. sapiens
aggcttttaaaaaatt

SEQ ID NO: 41516 - DNA, 16 bp, H. sapiens
aggcttttcagattgg

SEQ ID NO: 41517 - DNA, 16 bp, H. sapiens
aggcttttcttgaact

SEQ ID NO: 41518 - DNA, 16 bp, H. sapiens
aggcttttctttttaa

SEQ ID NO: 41519 - DNA, 16 bp, H. sapiens
aggcttttggacttgg

SEQ ID NO: 41520 - DNA, 16 bp, H. sapiens
aggcttttttaaacaa

SEQ ID NO: 41521 - DNA, 16 bp, H. sapiens
aggcttttttcctttt

SEQ ID NO: 41522 - DNA, 16 bp, H. sapiens
agggaaaaaaaatcag

SEQ ID NO: 41523 - DNA, 16 bp, H. sapiens
agggaaaaaaaatctt

SEQ ID NO: 41524 - DNA, 16 bp, H. sapiens
agggaaaaaaatcatt

SEQ ID NO: 41525 - DNA, 16 bp, H. sapiens
agggaaaaaaatgcct

SEQ ID NO: 41526 - DNA, 16 bp, H. sapiens
agggaaaaaagtcatt

SEQ ID NO: 41527 - DNA, 16 bp, H. sapiens
agggaaaaatatttta

SEQ ID NO: 41528 - DNA, 17 bp, H. sapiens
agggaaaaatggtttcc

SEQ ID NO: 41529 - DNA, 16 bp, H. sapiens
agggaaaaatgttaag

SEQ ID NO: 41530 - DNA, 16 bp, H. sapiens
agggaaaactgaggct

SEQ ID NO: 41531 - DNA, 16 bp, H. sapiens
agggaaaagagagatc

SEQ ID NO: 41532 - DNA, 16 bp, H. sapiens
agggaaaccgccccca

SEQ ID NO: 41533 - DNA, 16 bp, H. sapiens
agggaaactgacagtg

SEQ ID NO: 41534 - DNA, 16 bp, H. sapiens
agggaaactgaggctt

SEQ ID NO: 41535 - DNA, 16 bp, H. sapiens
agggaaagaatagtct

SEQ ID NO: 41536 - DNA, 16 bp, H. sapiens
agggaaaggcagtttc

SEQ ID NO: 41537 - DNA, 16 bp, H. sapiens
agggaaatagcaaatg

SEQ ID NO: 41538 - DNA, 16 bp, H. sapiens
agggaaatatggggtt

SEQ ID NO: 41539 - DNA, 16 bp, H. sapiens
agggaaatgcaagtca

SEQ ID NO: 41540 - DNA, 16 bp, H. sapiens
agggaaatgtgtggtt

SEQ ID NO: 41541 - DNA, 16 bp, H. sapiens
agggaaattccaggca

SEQ ID NO: 41542 - DNA, 16 bp, H. sapiens
agggaaatttgaatat

SEQ ID NO: 41543 - DNA, 16 bp, H. sapiens
agggaaattttttttt

SEQ ID NO: 41544 - DNA, 16 bp, H. sapiens
agggaacagattctcc

SEQ ID NO: 41545 - DNA, 16 bp, H. sapiens
agggaacaggtggtgt

SEQ ID NO: 41546 - DNA, 16 bp, H. sapiens
agggaactgaggcaga

SEQ ID NO: 41547 - DNA, 16 bp, H. sapiens
agggaactttctggag

SEQ ID NO: 41548 - DNA, 16 bp, H. sapiens
agggaagaaagcctca

SEQ ID NO: 41549 - DNA, 16 bp, H. sapiens
agggaagacaattttg

SEQ ID NO: 41550 - DNA, 16 bp, H. sapiens
agggaagagggcagcc

SEQ ID NO: 41551 - DNA, 16 bp, H. sapiens
agggaagcagtgacag

SEQ ID NO: 41552 - DNA, 16 bp, H. sapiens
agggaagcccaccaga

SEQ ID NO: 41553 - DNA, 16 bp, H. sapiens
agggaagcccagcaga

SEQ ID NO: 41554 - DNA, 16 bp, H. sapiens
agggaagcctcaggaa

SEQ ID NO: 41555 - DNA, 16 bp, H. sapiens
agggaagcttcatctg

SEQ ID NO: 41556 - DNA, 16 bp, H. sapiens
agggaaggcattgaga

SEQ ID NO: 41557 - DNA, 16 bp, H. sapiens
agggaagggagagcat

SEQ ID NO: 41558 - DNA, 18 bp, H. sapiens
agggaagggccccctgtc

SEQ ID NO: 41559 - DNA, 16 bp, H. sapiens
agggaaggggcagctg

SEQ ID NO: 41560 - DNA, 16 bp, H. sapiens
agggaaggggctggag

SEQ ID NO: 41561 - DNA, 16 bp, H. sapiens
agggaagggggctgtg

SEQ ID NO: 41562 - DNA, 16 bp, H. sapiens
agggaagtaaaggacc

SEQ ID NO: 41563 - DNA, 16 bp, H. sapiens
agggaagtggaggttg

SEQ ID NO: 41564 - DNA, 16 bp, H. sapiens
agggaagttggggaaa

SEQ ID NO: 41565 - DNA, 16 bp, H. sapiens
agggaataaaactaga

SEQ ID NO: 41566 - DNA, 16 bp, H. sapiens
agggaatagagaggcc

SEQ ID NO: 41567 - DNA, 16 bp, H. sapiens
agggaatcaaaaggaa

SEQ ID NO: 41568 - DNA, 19 bp, H. sapiens
agggaatcaaatggctgat

SEQ ID NO: 41569 - DNA, 16 bp, H. sapiens
agggaatccattcccc

SEQ ID NO: 41570 - DNA, 16 bp, H. sapiens
agggaatgatgacaag

SEQ ID NO: 41571 - DNA, 16 bp, H. sapiens
agggaatgcagccctg

SEQ ID NO: 41572 - DNA, 16 bp, H. sapiens
agggaatgcttccagc

SEQ ID NO: 41573 - DNA, 16 bp, H. sapiens
agggaattttttcccc

SEQ ID NO: 41574 - DNA, 16 bp, H. sapiens
agggacacagaagcca

SEQ ID NO: 41575 - DNA, 16 bp, H. sapiens
agggacacagagccag

SEQ ID NO: 41576 - DNA, 16 bp, H. sapiens
agggacagactgacac

SEQ ID NO: 41577 - DNA, 16 bp, H. sapiens
agggacagactgcttc

SEQ ID NO: 41578 - DNA, 16 bp, H. sapiens
agggacagagccagga

SEQ ID NO: 41579 - DNA, 16 bp, H. sapiens
agggacagcctgaagc

SEQ ID NO: 41580 - DNA, 16 bp, H. sapiens
agggacaggaggcaga

SEQ ID NO: 41581 - DNA, 16 bp, H. sapiens
agggacagggccatgg

SEQ ID NO: 41582 - DNA, 16 bp, H. sapiens
agggacagggtcaggg

SEQ ID NO: 41583 - DNA, 16 bp, H. sapiens
agggacaggtccctgg

SEQ ID NO: 41584 - DNA, 16 bp, H. sapiens
agggacaggtgggagg

SEQ ID NO: 41585 - DNA, 16 bp, H. sapiens
agggacagtgagagag

SEQ ID NO: 41586 - DNA, 16 bp, H. sapiens
agggacatggatggaa

SEQ ID NO: 41587 - DNA, 16 bp, H. sapiens
agggacatttctgaag

SEQ ID NO: 41588 - DNA, 16 bp, H. sapiens
agggaccacactttga

SEQ ID NO: 41589 - DNA, 16 bp, H. sapiens
agggaccagccccaca

SEQ ID NO: 41590 - DNA, 16 bp, H. sapiens
agggaccagcctggcc

SEQ ID NO: 41591 - DNA, 16 bp, H. sapiens
agggaccagtgggagg

SEQ ID NO: 41592 - DNA, 16 bp, H. sapiens
agggacccactggagg

SEQ ID NO: 41593 - DNA, 16 bp, H. sapiens
agggacccagagggag

SEQ ID NO: 41594 - DNA, 16 bp, H. sapiens
agggacccaggctctt

SEQ ID NO: 41595 - DNA, 16 bp, H. sapiens
agggacctggcaggag

SEQ ID NO: 41596 - DNA, 16 bp, H. sapiens
agggacctggggggag

SEQ ID NO: 41597 - DNA, 16 bp, H. sapiens
agggacctggtgggag

SEQ ID NO: 41598 - DNA, 16 bp, H. sapiens
agggactatcacagaa

SEQ ID NO: 41599 - DNA, 16 bp, H. sapiens
agggactctcagcaaa

SEQ ID NO: 41600 - DNA, 16 bp, H. sapiens
agggactctgtgggag

SEQ ID NO: 41601 - DNA, 16 bp, H. sapiens
agggactgaggggagg

SEQ ID NO: 41602 - DNA, 16 bp, H. sapiens
agggactgctgtgaag

SEQ ID NO: 41603 - DNA, 16 bp, H. sapiens
agggactggcagtggg

SEQ ID NO: 41604 - DNA, 16 bp, H. sapiens
agggacttcccttgtc

SEQ ID NO: 41605 - DNA, 16 bp, H. sapiens
agggacttgagcatcc

SEQ ID NO: 41606 - DNA, 16 bp, H. sapiens
agggacttgcccaggg

SEQ ID NO: 41607 - DNA, 16 bp, H. sapiens
agggactttgcaggtg

SEQ ID NO: 41608 - DNA, 16 bp, H. sapiens
agggagaaactgaggc

SEQ ID NO: 41609 - DNA, 16 bp, H. sapiens
agggagaaataaacag

SEQ ID NO: 41610 - DNA, 16 bp, H. sapiens
agggagaaataaagac

SEQ ID NO: 41611 - DNA, 16 bp, H. sapiens
agggagaaattagcca

SEQ ID NO: 41612 - DNA, 16 bp, H. sapiens
agggagaagagcccct

SEQ ID NO: 41613 - DNA, 16 bp, H. sapiens
agggagaagatggcca

SEQ ID NO: 41614 - DNA, 16 bp, H. sapiens
agggagaagcagcagc

SEQ ID NO: 41615 - DNA, 16 bp, H. sapiens
agggagaagccaggag

SEQ ID NO: 41616 - DNA, 16 bp, H. sapiens
agggagaaggggctgg

SEQ ID NO: 41617 - DNA, 16 bp, H. sapiens
agggagaatggaaaca

SEQ ID NO: 41618 - DNA, 16 bp, H. sapiens
agggagaattgcttga

SEQ ID NO: 41619 - DNA, 16 bp, H. sapiens
agggagacagacaata

SEQ ID NO: 41620 - DNA, 16 bp, H. sapiens
agggagacagaggcag

SEQ ID NO: 41621 - DNA, 16 bp, H. sapiens
agggagacatgagaca

SEQ ID NO: 41622 - DNA, 16 bp, H. sapiens
agggagacatgaggca

SEQ ID NO: 41623 - DNA, 16 bp, H. sapiens
agggagaccccatctc

SEQ ID NO: 41624 - DNA, 16 bp, H. sapiens
agggagaccccttctc

SEQ ID NO: 41625 - DNA, 16 bp, H. sapiens
agggagaccctgtccc

SEQ ID NO: 41626 - DNA, 16 bp, H. sapiens
agggagaccctgtctc

SEQ ID NO: 41627 - DNA, 16 bp, H. sapiens
agggagaccctgtctt

SEQ ID NO: 41628 - DNA, 16 bp, H. sapiens
agggagactctgtctc

SEQ ID NO: 41629 - DNA, 16 bp, H. sapiens
agggagactctgtttc

SEQ ID NO: 41630 - DNA, 16 bp, H. sapiens
agggagactgcatctc

SEQ ID NO: 41631 - DNA, 16 bp, H. sapiens
agggagagacagagac

SEQ ID NO: 41632 - DNA, 16 bp, H. sapiens
agggagagagctgggg

SEQ ID NO: 41633 - DNA, 16 bp, H. sapiens
agggagagaggctggg

SEQ ID NO: 41634 - DNA, 16 bp, H. sapiens
agggagagcaccagga

SEQ ID NO: 41635 - DNA, 16 bp, H. sapiens
agggagaggaagctgg

SEQ ID NO: 41636 - DNA, 16 bp, H. sapiens
agggagaggatcaaga

SEQ ID NO: 41637 - DNA, 16 bp, H. sapiens
agggagaggccagaga

SEQ ID NO: 41638 - DNA, 16 bp, H. sapiens
agggagaggctgagga

SEQ ID NO: 41639 - DNA, 16 bp, H. sapiens
agggagaggggctgga

SEQ ID NO: 41640 - DNA, 16 bp, H. sapiens
agggagaggtcagatg

SEQ ID NO: 41641 - DNA, 16 bp, H. sapiens
agggagagtctgtctc

SEQ ID NO: 41642 - DNA, 16 bp, H. sapiens
agggagagtttctgtg

SEQ ID NO: 41643 - DNA, 16 bp, H. sapiens
agggagatgttggtca

SEQ ID NO: 41644 - DNA, 16 bp, H. sapiens
agggagcacagggttg

SEQ ID NO: 41645 - DNA, 16 bp, H. sapiens
agggagcagggctggg

SEQ ID NO: 41646 - DNA, 16 bp, H. sapiens
agggagccaagatcgt

SEQ ID NO: 41647 - DNA, 16 bp, H. sapiens
agggagccaagattgt

SEQ ID NO: 41648 - DNA, 16 bp, H. sapiens
agggagccccaggagg

SEQ ID NO: 41649 - DNA, 16 bp, H. sapiens
agggagcgtggccctg

SEQ ID NO: 41650 - DNA, 16 bp, H. sapiens
agggagctcccaggtc

SEQ ID NO: 41651 - DNA, 16 bp, H. sapiens
agggagctctggagca

SEQ ID NO: 41652 - DNA, 16 bp, H. sapiens
agggagctggctccag

SEQ ID NO: 41653 - DNA, 16 bp, H. sapiens
agggagctggctccgg

SEQ ID NO: 41654 - DNA, 16 bp, H. sapiens
agggagctggtgggag

SEQ ID NO: 41655 - DNA, 16 bp, H. sapiens
agggagctttttaaaa

SEQ ID NO: 41656 - DNA, 16 bp, H. sapiens
agggaggaacactgcc

SEQ ID NO: 41657 - DNA, 16 bp, H. sapiens
agggaggaggctggga

SEQ ID NO: 41658 - DNA, 16 bp, H. sapiens
agggaggatcaggtgg

SEQ ID NO: 41659 - DNA, 16 bp, H. sapiens
agggaggattgcttga

SEQ ID NO: 41660 - DNA, 16 bp, H. sapiens
agggaggcaggagggt

SEQ ID NO: 41661 - DNA, 16 bp, H. sapiens
agggaggcagggatgg

SEQ ID NO: 41662 - DNA, 16 bp, H. sapiens
agggaggcagtgggag

SEQ ID NO: 41663 - DNA, 16 bp, H. sapiens
agggaggcattgagga

SEQ ID NO: 41664 - DNA, 16 bp, H. sapiens
agggaggccaaggcag

SEQ ID NO: 41665 - DNA, 16 bp, H. sapiens
agggaggccagggcag

SEQ ID NO: 41666 - DNA, 16 bp, H. sapiens
agggaggcccagggag

SEQ ID NO: 41667 - DNA, 16 bp, H. sapiens
agggaggccccaggag

SEQ ID NO: 41668 - DNA, 16 bp, H. sapiens
agggaggctataccct

SEQ ID NO: 41669 - DNA, 16 bp, H. sapiens
agggaggctgaagcgg

SEQ ID NO: 41670 - DNA, 16 bp, H. sapiens
agggaggctgagaggg

SEQ ID NO: 41671 - DNA, 16 bp, H. sapiens
agggaggctgaggcag

SEQ ID NO: 41672 - DNA, 16 bp, H. sapiens
agggaggctggaaaag

SEQ ID NO: 41673 - DNA, 16 bp, H. sapiens
agggaggctggctggg

SEQ ID NO: 41674 - DNA, 16 bp, H. sapiens
agggaggctgggaagg

SEQ ID NO: 41675 - DNA, 16 bp, H. sapiens
agggaggctgggagag

SEQ ID NO: 41676 - DNA, 16 bp, H. sapiens
agggaggctgggcagg

SEQ ID NO: 41677 - DNA, 16 bp, H. sapiens
agggaggctgtgtgtg

SEQ ID NO: 41678 - DNA, 16 bp, H. sapiens
agggagggaactggtg

SEQ ID NO: 41679 - DNA, 16 bp, H. sapiens
agggagggagaggctg

SEQ ID NO: 41680 - DNA, 16 bp, H. sapiens
agggagggagctgagg

SEQ ID NO: 41681 - DNA, 16 bp, H. sapiens
agggaggggtgctcag

SEQ ID NO: 41682 - DNA, 16 bp, H. sapiens
agggaggtattattat

SEQ ID NO: 41683 - DNA, 16 bp, H. sapiens
agggaggtgaaagata

SEQ ID NO: 41684 - DNA, 16 bp, H. sapiens
agggaggtggaagttg

SEQ ID NO: 41685 - DNA, 16 bp, H. sapiens
agggaggtgggggtca

SEQ ID NO: 41686 - DNA, 16 bp, H. sapiens
agggaggttgaagctg

SEQ ID NO: 41687 - DNA, 16 bp, H. sapiens
agggagtcaaaggaga

SEQ ID NO: 41688 - DNA, 16 bp, H. sapiens
agggagtcctttcccc

SEQ ID NO: 41689 - DNA, 16 bp, H. sapiens
agggagtgcagccctg

SEQ ID NO: 41690 - DNA, 16 bp, H. sapiens
agggagtgtggccctg

SEQ ID NO: 41691 - DNA, 16 bp, H. sapiens
agggagtttatcacca

SEQ ID NO: 41692 - DNA, 16 bp, H. sapiens
agggataaaagaatac

SEQ ID NO: 41693 - DNA, 18 bp, H. sapiens
agggataacattaggaga

SEQ ID NO: 41694 - DNA, 16 bp, H. sapiens
agggatatttaggagt

SEQ ID NO: 41695 - DNA, 16 bp, H. sapiens
agggatcagaagaaga

SEQ ID NO: 41696 - DNA, 16 bp, H. sapiens
agggatcctcctgccc

SEQ ID NO: 41697 - DNA, 16 bp, H. sapiens
agggatcctggaacca

SEQ ID NO: 41698 - DNA, 16 bp, H. sapiens
agggatctgtgaaact

SEQ ID NO: 41699 - DNA, 16 bp, H. sapiens
agggatctttcacttc

SEQ ID NO: 41700 - DNA, 16 bp, H. sapiens
agggatgaacaagggc

SEQ ID NO: 41701 - DNA, 16 bp, H. sapiens
agggatgaatcccact

SEQ ID NO: 41702 - DNA, 16 bp, H. sapiens
agggatgagcaggaga

SEQ ID NO: 41703 - DNA, 16 bp, H. sapiens
agggatgaggcccact

SEQ ID NO: 41704 - DNA, 16 bp, H. sapiens
agggatgatttcattg

SEQ ID NO: 41705 - DNA, 16 bp, H. sapiens
agggatgcaggaatgg

SEQ ID NO: 41706 - DNA, 16 bp, H. sapiens
agggatgcctgggtcc

SEQ ID NO: 41707 - DNA, 16 bp, H. sapiens
agggatggcattagga

SEQ ID NO: 41708 - DNA, 16 bp, H. sapiens
agggatgggcaaggac

SEQ ID NO: 41709 - DNA, 16 bp, H. sapiens
agggatggggacaggg

SEQ ID NO: 41710 - DNA, 16 bp, H. sapiens
agggatggtttaacat

SEQ ID NO: 41711 - DNA, 18 bp, H. sapiens
agggattatgctccacca

SEQ ID NO: 41712 - DNA, 17 bp, H. sapiens
agggattcgatttcttc

SEQ ID NO: 41713 - DNA, 16 bp, H. sapiens
agggattctcaacctg

SEQ ID NO: 41714 - DNA, 17 bp, H. sapiens
agggattcttctgcctc

SEQ ID NO: 41715 - DNA, 16 bp, H. sapiens
agggattttcacagtg

SEQ ID NO: 41716 - DNA, 16 bp, H. sapiens
agggattttgcagata

SEQ ID NO: 41717 - DNA, 16 bp, H. sapiens
agggcaaaaactggaa

SEQ ID NO: 41718 - DNA, 16 bp, H. sapiens
agggcaaggagcagcc

SEQ ID NO: 41719 - DNA, 16 bp, H. sapiens
agggcaatcaggaaag

SEQ ID NO: 41720 - DNA, 16 bp, H. sapiens
agggcaatgaggactg

SEQ ID NO: 41721 - DNA, 16 bp, H. sapiens
agggcaatgcagaggg

SEQ ID NO: 41722 - DNA, 16 bp, H. sapiens
agggcaatggggagcc

SEQ ID NO: 41723 - DNA, 16 bp, H. sapiens
agggcacaggctctgg

SEQ ID NO: 41724 - DNA, 16 bp, H. sapiens
agggcaccaagcaagg

SEQ ID NO: 41725 - DNA, 16 bp, H. sapiens
agggcaccatgtccca

SEQ ID NO: 41726 - DNA, 16 bp, H. sapiens
agggcacctgtaattc

SEQ ID NO: 41727 - DNA, 19 bp, H. sapiens
agggcacgagctgttccag

SEQ ID NO: 41728 - DNA, 16 bp, H. sapiens
agggcactctgatagg

SEQ ID NO: 41729 - DNA, 16 bp, H. sapiens
agggcagaaggcagag

SEQ ID NO: 41730 - DNA, 16 bp, H. sapiens
agggcagagcctgctg

SEQ ID NO: 41731 - DNA, 16 bp, H. sapiens
agggcagaggaaacaa

SEQ ID NO: 41732 - DNA, 16 bp, H. sapiens
agggcagaggaagcaa

SEQ ID NO: 41733 - DNA, 16 bp, H. sapiens
agggcagaggctgcag

SEQ ID NO: 41734 - DNA, 16 bp, H. sapiens
agggcagaggtgggag

SEQ ID NO: 41735 - DNA, 16 bp, H. sapiens
agggcagcaggaaaga

SEQ ID NO: 41736 - DNA, 16 bp, H. sapiens
agggcagccagacaga

SEQ ID NO: 41737 - DNA, 16 bp, H. sapiens
agggcagccagagaaa

SEQ ID NO: 41738 - DNA, 16 bp, H. sapiens
agggcagccaggcaga

SEQ ID NO: 41739 - DNA, 16 bp, H. sapiens
agggcagccagggaga

SEQ ID NO: 41740 - DNA, 16 bp, H. sapiens
agggcagctcacaaca

SEQ ID NO: 41741 - DNA, 16 bp, H. sapiens
agggcagctttgaatg

SEQ ID NO: 41742 - DNA, 16 bp, H. sapiens
agggcagcttttctcc

SEQ ID NO: 41743 - DNA, 16 bp, H. sapiens
agggcaggagaggccc

SEQ ID NO: 41744 - DNA, 16 bp, H. sapiens
agggcaggaggagatg

SEQ ID NO: 41745 - DNA, 16 bp, H. sapiens
agggcaggcaggcagg

SEQ ID NO: 41746 - DNA, 16 bp, H. sapiens
agggcaggcatggtgg

SEQ ID NO: 41747 - DNA, 16 bp, H. sapiens
agggcaggctggcagg

SEQ ID NO: 41748 - DNA, 16 bp, H. sapiens
agggcagggacagggc

SEQ ID NO: 41749 - DNA, 16 bp, H. sapiens
agggcagggaccatgt

SEQ ID NO: 41750 - DNA, 16 bp, H. sapiens
agggcagggaccttgt

SEQ ID NO: 41751 - DNA, 16 bp, H. sapiens
agggcagggatttttg

SEQ ID NO: 41752 - DNA, 16 bp, H. sapiens
agggcagggccagggc

SEQ ID NO: 41753 - DNA, 16 bp, H. sapiens
agggcagggccagggt

SEQ ID NO: 41754 - DNA, 16 bp, H. sapiens
agggcagggcctggcc

SEQ ID NO: 41755 - DNA, 16 bp, H. sapiens
agggcagggctccctg

SEQ ID NO: 41756 - DNA, 16 bp, H. sapiens
agggcagggctgggca

SEQ ID NO: 41757 - DNA, 16 bp, H. sapiens
agggcagggctgggga

SEQ ID NO: 41758 - DNA, 16 bp, H. sapiens
agggcagggctgtgtc

SEQ ID NO: 41759 - DNA, 16 bp, H. sapiens
agggcaggggctgagg

SEQ ID NO: 41760 - DNA, 16 bp, H. sapiens
agggcaggtgggcagg

SEQ ID NO: 41761 - DNA, 16 bp, H. sapiens
agggcagtgaagaagg

SEQ ID NO: 41762 - DNA, 16 bp, H. sapiens
agggcagtgagggagg

SEQ ID NO: 41763 - DNA, 16 bp, H. sapiens
agggcagtgcggaagg

SEQ ID NO: 41764 - DNA, 16 bp, H. sapiens
agggcagtgctgaagg

SEQ ID NO: 41765 - DNA, 16 bp, H. sapiens
agggcagtggcaagat

SEQ ID NO: 41766 - DNA, 16 bp, H. sapiens
agggcagtggcacgat

SEQ ID NO: 41767 - DNA, 16 bp, H. sapiens
agggcagtggcatgat

SEQ ID NO: 41768 - DNA, 16 bp, H. sapiens
agggcagtggggaagg

SEQ ID NO: 41769 - DNA, 16 bp, H. sapiens
agggcagtggtgccat

SEQ ID NO: 41770 - DNA, 16 bp, H. sapiens
agggcagttccccagc

SEQ ID NO: 41771 - DNA, 16 bp, H. sapiens
agggcagttccctggc

SEQ ID NO: 41772 - DNA, 16 bp, H. sapiens
agggcagttgtgagga

SEQ ID NO: 41773 - DNA, 18 bp, H. sapiens
agggcatccctgtgttgt

SEQ ID NO: 41774 - DNA, 16 bp, H. sapiens
agggcatctctgaaaa

SEQ ID NO: 41775 - DNA, 16 bp, H. sapiens
agggccaccagagggc

SEQ ID NO: 41776 - DNA, 16 bp, H. sapiens
agggccaccatcctct

SEQ ID NO: 41777 - DNA, 16 bp, H. sapiens
agggccactgtcctcc

SEQ ID NO: 41778 - DNA, 16 bp, H. sapiens
agggccactgtcctct

SEQ ID NO: 41779 - DNA, 16 bp, H. sapiens
agggccagagccaggg

SEQ ID NO: 41780 - DNA, 16 bp, H. sapiens
agggccagagctgccc

SEQ ID NO: 41781 - DNA, 16 bp, H. sapiens
agggccagagctgggg

SEQ ID NO: 41782 - DNA, 16 bp, H. sapiens
agggccaggcaggcag

SEQ ID NO: 41783 - DNA, 16 bp, H. sapiens
agggccaggcgcggtg

SEQ ID NO: 41784 - DNA, 16 bp, H. sapiens
agggccagggccagaa

SEQ ID NO: 41785 - DNA, 16 bp, H. sapiens
agggccagggccaggg

SEQ ID NO: 41786 - DNA, 16 bp, H. sapiens
agggccagggccatgg

SEQ ID NO: 41787 - DNA, 16 bp, H. sapiens
agggccaggtagaaaa

SEQ ID NO: 41788 - DNA, 16 bp, H. sapiens
agggccaggtgcagtg

SEQ ID NO: 41789 - DNA, 21 bp, H. sapiens
agggccaggtgcggtggctca

SEQ ID NO: 41790 - DNA, 16 bp, H. sapiens
agggccaggtggtggc

SEQ ID NO: 41791 - DNA, 16 bp, H. sapiens
agggccatccagcttc

SEQ ID NO: 41792 - DNA, 16 bp, H. sapiens
agggccccaaagaggg

SEQ ID NO: 41793 - DNA, 16 bp, H. sapiens
agggccccacccacca

SEQ ID NO: 41794 - DNA, 16 bp, H. sapiens
agggccctctctggaa

SEQ ID NO: 41795 - DNA, 16 bp, H. sapiens
agggccctctttctgg

SEQ ID NO: 41796 - DNA, 16 bp, H. sapiens
agggccctggcagcaa

SEQ ID NO: 41797 - DNA, 16 bp, H. sapiens
agggccctggccaagg

SEQ ID NO: 41798 - DNA, 16 bp, H. sapiens
agggccctgggcccag

SEQ ID NO: 41799 - DNA, 16 bp, H. sapiens
agggccctgggcctgg

SEQ ID NO: 41800 - DNA, 19 bp, H. sapiens
agggccgggcacagtggct

SEQ ID NO: 41801 - DNA, 16 bp, H. sapiens
agggcctcaaaggcca

SEQ ID NO: 41802 - DNA, 16 bp, H. sapiens
agggcctcactctgtg

SEQ ID NO: 41803 - DNA, 16 bp, H. sapiens
agggcctcagaagcaa

SEQ ID NO: 41804 - DNA, 16 bp, H. sapiens
agggcctcagggagct

SEQ ID NO: 41805 - DNA, 16 bp, H. sapiens
agggcctgaggcagga

SEQ ID NO: 41806 - DNA, 16 bp, H. sapiens
agggcctgcctgaggc

SEQ ID NO: 41807 - DNA, 16 bp, H. sapiens
agggcctgctgtctgt

SEQ ID NO: 41808 - DNA, 16 bp, H. sapiens
agggcctgctttctgg

SEQ ID NO: 41809 - DNA, 16 bp, H. sapiens
agggcctggagttgga

SEQ ID NO: 41810 - DNA, 16 bp, H. sapiens
agggcctggcacaaag

SEQ ID NO: 41811 - DNA, 16 bp, H. sapiens
agggcctggcccagag

SEQ ID NO: 41812 - DNA, 16 bp, H. sapiens
agggcctggcctgggg

SEQ ID NO: 41813 - DNA, 16 bp, H. sapiens
agggcctggggctggg

SEQ ID NO: 41814 - DNA, 16 bp, H. sapiens
agggcctgggggctgg

SEQ ID NO: 41815 - DNA, 16 bp, H. sapiens
agggcctggtacacag

SEQ ID NO: 41816 - DNA, 16 bp, H. sapiens
agggcctggtgcagtg

SEQ ID NO: 41817 - DNA, 16 bp, H. sapiens
agggcctgtcgggggg

SEQ ID NO: 41818 - DNA, 16 bp, H. sapiens
agggcctgttgcaggg

SEQ ID NO: 41819 - DNA, 16 bp, H. sapiens
agggccttcctgctgt

SEQ ID NO: 41820 - DNA, 16 bp, H. sapiens
agggccttcttgctgc

SEQ ID NO: 41821 - DNA, 16 bp, H. sapiens
agggcgagatcacagg

SEQ ID NO: 41822 - DNA, 16 bp, H. sapiens
agggcgcggtggctca

SEQ ID NO: 41823 - DNA, 19 bp, H. sapiens
agggcggggcatcgcctca

SEQ ID NO: 41824 - DNA, 16 bp, H. sapiens
agggcgtgtgtgtgtg

SEQ ID NO: 41825 - DNA, 18 bp, H. sapiens
agggctacagtaaccaaa

SEQ ID NO: 41826 - DNA, 16 bp, H. sapiens
agggctcaagtgatcc

SEQ ID NO: 41827 - DNA, 16 bp, H. sapiens
agggctccactctcat

SEQ ID NO: 41828 - DNA, 16 bp, H. sapiens
agggctccaggccagg

SEQ ID NO: 41829 - DNA, 16 bp, H. sapiens
agggctcctgctttgc

SEQ ID NO: 41830 - DNA, 16 bp, H. sapiens
agggctctgccctctt

SEQ ID NO: 41831 - DNA, 16 bp, H. sapiens
agggctctgccttcat

SEQ ID NO: 41832 - DNA, 16 bp, H. sapiens
agggctcttcctgctg

SEQ ID NO: 41833 - DNA, 16 bp, H. sapiens
agggctgaggggctgg

SEQ ID NO: 41834 - DNA, 16 bp, H. sapiens
agggctgcagtaacaa

SEQ ID NO: 41835 - DNA, 16 bp, H. sapiens
agggctgccagaggaa

SEQ ID NO: 41836 - DNA, 16 bp, H. sapiens
agggctgctgctgctg

SEQ ID NO: 41837 - DNA, 16 bp, H. sapiens
agggctgctggctgcc

SEQ ID NO: 41838 - DNA, 16 bp, H. sapiens
agggctgctgggagga

SEQ ID NO: 41839 - DNA, 16 bp, H. sapiens
agggctgctggttgcc

SEQ ID NO: 41840 - DNA, 16 bp, H. sapiens
agggctgctgtgagaa

SEQ ID NO: 41841 - DNA, 16 bp, H. sapiens
agggctggctccttct

SEQ ID NO: 41842 - DNA, 16 bp, H. sapiens
agggctgggacccagg

SEQ ID NO: 41843 - DNA, 16 bp, H. sapiens
agggctgggagctggg

SEQ ID NO: 41844 - DNA, 16 bp, H. sapiens
agggctgggagggctg

SEQ ID NO: 41845 - DNA, 16 bp, H. sapiens
agggctgggcacacag

SEQ ID NO: 41846 - DNA, 16 bp, H. sapiens
agggctgggcaccatg

SEQ ID NO: 41847 - DNA, 16 bp, H. sapiens
agggctgggctggggc

SEQ ID NO: 41848 - DNA, 16 bp, H. sapiens
agggctggggaggccc

SEQ ID NO: 41849 - DNA, 16 bp, H. sapiens
agggctggggaggcct

SEQ ID NO: 41850 - DNA, 16 bp, H. sapiens
agggctggggctggga

SEQ ID NO: 41851 - DNA, 16 bp, H. sapiens
agggctggggtcaggg

SEQ ID NO: 41852 - DNA, 16 bp, H. sapiens
agggctggtttctgtt

SEQ ID NO: 41853 - DNA, 16 bp, H. sapiens
agggctgtgaggactg

SEQ ID NO: 41854 - DNA, 28 bp, H. sapiens
agggctgtgcaggacgtgccttgttaac

SEQ ID NO: 41855 - DNA, 19 bp, H. sapiens
agggctgtgcaggatgtgc

SEQ ID NO: 41856 - DNA, 16 bp, H. sapiens
agggctgtggcctggg

SEQ ID NO: 41857 - DNA, 16 bp, H. sapiens
agggctgttgtgaaga

SEQ ID NO: 41858 - DNA, 16 bp, H. sapiens
agggctgttgtgaggg

SEQ ID NO: 41859 - DNA, 16 bp, H. sapiens
agggcttcacagagga

SEQ ID NO: 41860 - DNA, 16 bp, H. sapiens
agggcttcaggctgct

SEQ ID NO: 41861 - DNA, 16 bp, H. sapiens
agggcttcatcctcat

SEQ ID NO: 41862 - DNA, 16 bp, H. sapiens
agggcttcccttggct

SEQ ID NO: 41863 - DNA, 16 bp, H. sapiens
agggcttcctgaagga

SEQ ID NO: 41864 - DNA, 16 bp, H. sapiens
agggcttcctggagaa

SEQ ID NO: 41865 - DNA, 16 bp, H. sapiens
agggcttcctggaggc

SEQ ID NO: 41866 - DNA, 16 bp, H. sapiens
agggcttgctctctgc

SEQ ID NO: 41867 - DNA, 16 bp, H. sapiens
agggcttgtaactcag

SEQ ID NO: 41868 - DNA, 16 bp, H. sapiens
agggcttgttaaaaca

SEQ ID NO: 41869 - DNA, 16 bp, H. sapiens
agggctttaaaaaaat

SEQ ID NO: 41870 - DNA, 16 bp, H. sapiens
agggctttaagaaagc

SEQ ID NO: 41871 - DNA, 16 bp, H. sapiens
agggctttctggagga

SEQ ID NO: 41872 - DNA, 16 bp, H. sapiens
agggctttggagtcag

SEQ ID NO: 41873 - DNA, 16 bp, H. sapiens
aggggaaaaaaaactt

SEQ ID NO: 41874 - DNA, 16 bp, H. sapiens
aggggaaaaaaatgtt

SEQ ID NO: 41875 - DNA, 16 bp, H. sapiens
aggggaaaaaagcagc

SEQ ID NO: 41876 - DNA, 16 bp, H. sapiens
aggggaaattgtccat

SEQ ID NO: 41877 - DNA, 16 bp, H. sapiens
aggggaacagggagct

SEQ ID NO: 41878 - DNA, 16 bp, H. sapiens
aggggaacatcactca

SEQ ID NO: 41879 - DNA, 16 bp, H. sapiens
aggggaagcaaagacc

SEQ ID NO: 41880 - DNA, 16 bp, H. sapiens
aggggaagcaagcact

SEQ ID NO: 41881 - DNA, 16 bp, H. sapiens
aggggaagccaggaag

SEQ ID NO: 41882 - DNA, 16 bp, H. sapiens
aggggaagctttccct

SEQ ID NO: 41883 - DNA, 16 bp, H. sapiens
aggggaaggggcagct

SEQ ID NO: 41884 - DNA, 16 bp, H. sapiens
aggggaattcttccag

SEQ ID NO: 41885 - DNA, 18 bp, H. sapiens
aggggaatttggcccaac

SEQ ID NO: 41886 - DNA, 16 bp, H. sapiens
aggggacaccccaagc

SEQ ID NO: 41887 - DNA, 16 bp, H. sapiens
aggggacagaggaaca

SEQ ID NO: 41888 - DNA, 16 bp, H. sapiens
aggggacagaggttgc

SEQ ID NO: 41889 - DNA, 16 bp, H. sapiens
aggggactcacagcct

SEQ ID NO: 41890 - DNA, 16 bp, H. sapiens
aggggacttggagaac

SEQ ID NO: 41891 - DNA, 16 bp, H. sapiens
aggggagaaaactgag

SEQ ID NO: 41892 - DNA, 16 bp, H. sapiens
aggggagagaggctga

SEQ ID NO: 41893 - DNA, 16 bp, H. sapiens
aggggagcatcacaca

SEQ ID NO: 41894 - DNA, 16 bp, H. sapiens
aggggagctgtgagaa

SEQ ID NO: 41895 - DNA, 16 bp, H. sapiens
aggggaggaggctgag

SEQ ID NO: 41896 - DNA, 16 bp, H. sapiens
aggggaggcctggtgg

SEQ ID NO: 41897 - DNA, 16 bp, H. sapiens
aggggaggctgaggtg

SEQ ID NO: 41898 - DNA, 16 bp, H. sapiens
aggggaggggcctggt

SEQ ID NO: 41899 - DNA, 16 bp, H. sapiens
aggggaggtgccaggc

SEQ ID NO: 41900 - DNA, 18 bp, H. sapiens
aggggaggttgcagtgag

SEQ ID NO: 41901 - DNA, 16 bp, H. sapiens
aggggagtcagggagg

SEQ ID NO: 41902 - DNA, 16 bp, H. sapiens
aggggagtggctgtgg

SEQ ID NO: 41903 - DNA, 16 bp, H. sapiens
aggggatacaggcccc

SEQ ID NO: 41904 - DNA, 16 bp, H. sapiens
aggggatacgatggct

SEQ ID NO: 41905 - DNA, 16 bp, H. sapiens
aggggatggacacccc

SEQ ID NO: 41906 - DNA, 16 bp, H. sapiens
aggggattctgatgca

SEQ ID NO: 41907 - DNA, 16 bp, H. sapiens
aggggcaaaatgctgc

SEQ ID NO: 41908 - DNA, 17 bp, H. sapiens
aggggcaacccacccct

SEQ ID NO: 41909 - DNA, 16 bp, H. sapiens
aggggcacctgcaggc

SEQ ID NO: 41910 - DNA, 16 bp, H. sapiens
aggggcagaaagcaga

SEQ ID NO: 41911 - DNA, 16 bp, H. sapiens
aggggcagacagacac

SEQ ID NO: 41912 - DNA, 22 bp, H. sapiens
aggggcagactgacacctcaca

SEQ ID NO: 41913 - DNA, 16 bp, H. sapiens
aggggcagagccagga

SEQ ID NO: 41914 - DNA, 16 bp, H. sapiens
aggggcagagccaggg

SEQ ID NO: 41915 - DNA, 16 bp, H. sapiens
aggggcagagctggga

SEQ ID NO: 41916 - DNA, 16 bp, H. sapiens
aggggcagagctgggg

SEQ ID NO: 41917 - DNA, 16 bp, H. sapiens
aggggcagcatgggaa

SEQ ID NO: 41918 - DNA, 16 bp, H. sapiens
aggggcaggcctgggg

SEQ ID NO: 41919 - DNA, 16 bp, H. sapiens
aggggcagggcactca

SEQ ID NO: 41920 - DNA, 16 bp, H. sapiens
aggggcagggccagag

SEQ ID NO: 41921 - DNA, 16 bp, H. sapiens
aggggcagggcccagg

SEQ ID NO: 41922 - DNA, 16 bp, H. sapiens
aggggcagggcctggg

SEQ ID NO: 41923 - DNA, 16 bp, H. sapiens
aggggcatggacgagg

SEQ ID NO: 41924 - DNA, 16 bp, H. sapiens
aggggcatggagcttc

SEQ ID NO: 41925 - DNA, 16 bp, H. sapiens
aggggccagggtggaa

SEQ ID NO: 41926 - DNA, 16 bp, H. sapiens
aggggccattattcag

SEQ ID NO: 41927 - DNA, 16 bp, H. sapiens
aggggcctgcatctgg

SEQ ID NO: 41928 - DNA, 16 bp, H. sapiens
aggggcctggggcagg

SEQ ID NO: 41929 - DNA, 16 bp, H. sapiens
aggggcggccaggcag

SEQ ID NO: 41930 - DNA, 16 bp, H. sapiens
aggggcggctgtgggc

SEQ ID NO: 41931 - DNA, 16 bp, H. sapiens
aggggcgggtccctgg

SEQ ID NO: 41932 - DNA, 16 bp, H. sapiens
aggggctacaggccct

SEQ ID NO: 41933 - DNA, 16 bp, H. sapiens
aggggctaggggtgga

SEQ ID NO: 41934 - DNA, 19 bp, H. sapiens
aggggctcccacagtgcag

SEQ ID NO: 41935 - DNA, 17 bp, H. sapiens
aggggctctgggagtgg

SEQ ID NO: 41936 - DNA, 16 bp, H. sapiens
aggggctgaggctggg

SEQ ID NO: 41937 - DNA, 16 bp, H. sapiens
aggggctgagggaagg

SEQ ID NO: 41938 - DNA, 16 bp, H. sapiens
aggggctgaggggaga

SEQ ID NO: 41939 - DNA, 16 bp, H. sapiens
aggggctgcaggaggg

SEQ ID NO: 41940 - DNA, 16 bp, H. sapiens
aggggctgcaggcccc

SEQ ID NO: 41941 - DNA, 16 bp, H. sapiens
aggggctgcagtgaag

SEQ ID NO: 41942 - DNA, 16 bp, H. sapiens
aggggctgccccaggc

SEQ ID NO: 41943 - DNA, 16 bp, H. sapiens
aggggctgctgggaag

SEQ ID NO: 41944 - DNA, 16 bp, H. sapiens
aggggctggaagggaa

SEQ ID NO: 41945 - DNA, 16 bp, H. sapiens
aggggctggactcagg

SEQ ID NO: 41946 - DNA, 16 bp, H. sapiens
aggggctggagctggg

SEQ ID NO: 41947 - DNA, 16 bp, H. sapiens
aggggctggaggagag

SEQ ID NO: 41948 - DNA, 16 bp, H. sapiens
aggggctggggaaagg

SEQ ID NO: 41949 - DNA, 16 bp, H. sapiens
aggggctggggaagga

SEQ ID NO: 41950 - DNA, 16 bp, H. sapiens
aggggctggggacccc

SEQ ID NO: 41951 - DNA, 16 bp, H. sapiens
aggggctggggctgga

SEQ ID NO: 41952 - DNA, 16 bp, H. sapiens
aggggctggggtggaa

SEQ ID NO: 41953 - DNA, 16 bp, H. sapiens
aggggcttcccccttc

SEQ ID NO: 41954 - DNA, 16 bp, H. sapiens
aggggcttctgggaaa

SEQ ID NO: 41955 - DNA, 16 bp, H. sapiens
aggggcttttccccca

SEQ ID NO: 41956 - DNA, 16 bp, H. sapiens
agggggacagaactaa

SEQ ID NO: 41957 - DNA, 16 bp, H. sapiens
agggggagctgcaggg

SEQ ID NO: 41958 - DNA, 16 bp, H. sapiens
agggggcagaggttgc

SEQ ID NO: 41959 - DNA, 16 bp, H. sapiens
agggggcagggaagtg

SEQ ID NO: 41960 - DNA, 16 bp, H. sapiens
agggggcagtgctgag

SEQ ID NO: 41961 - DNA, 16 bp, H. sapiens
agggggccacaagcca

SEQ ID NO: 41962 - DNA, 16 bp, H. sapiens
agggggcgctcaggac

SEQ ID NO: 41963 - DNA, 16 bp, H. sapiens
agggggcggaggctgc

SEQ ID NO: 41964 - DNA, 16 bp, H. sapiens
agggggcggcgctcat

SEQ ID NO: 41965 - DNA, 16 bp, H. sapiens
agggggcggtggctca

SEQ ID NO: 41966 - DNA, 16 bp, H. sapiens
agggggctgaagccaa

SEQ ID NO: 41967 - DNA, 16 bp, H. sapiens
agggggctgaagtcag

SEQ ID NO: 41968 - DNA, 16 bp, H. sapiens
agggggctgaggctgg

SEQ ID NO: 41969 - DNA, 16 bp, H. sapiens
agggggctgcagggag

SEQ ID NO: 41970 - DNA, 16 bp, H. sapiens
agggggctgtaccctg

SEQ ID NO: 41971 - DNA, 16 bp, H. sapiens
agggggcttagaattt

SEQ ID NO: 41972 - DNA, 16 bp, H. sapiens
agggggtacatatgca

SEQ ID NO: 41973 - DNA, 16 bp, H. sapiens
agggggtctcaccatg

SEQ ID NO: 41974 - DNA, 16 bp, H. sapiens
agggggtctcactttg

SEQ ID NO: 41975 - DNA, 16 bp, H. sapiens
agggggttaggacttc

SEQ ID NO: 41976 - DNA, 16 bp, H. sapiens
aggggtacatgtgaag

SEQ ID NO: 41977 - DNA, 16 bp, H. sapiens
aggggtcagcaaacta

SEQ ID NO: 41978 - DNA, 16 bp, H. sapiens
aggggtcagggaactc

SEQ ID NO: 41979 - DNA, 16 bp, H. sapiens
aggggtcaggggcaga

SEQ ID NO: 41980 - DNA, 16 bp, H. sapiens
aggggtcaggggtcag

SEQ ID NO: 41981 - DNA, 16 bp, H. sapiens
aggggtccagtttcat

SEQ ID NO: 41982 - DNA, 16 bp, H. sapiens
aggggtccccaactcc

SEQ ID NO: 41983 - DNA, 16 bp, H. sapiens
aggggtccctggagaa

SEQ ID NO: 41984 - DNA, 16 bp, H. sapiens
aggggtcctaggacag

SEQ ID NO: 41985 - DNA, 16 bp, H. sapiens
aggggtgattttgccc

SEQ ID NO: 41986 - DNA, 17 bp, H. sapiens
aggggtgcattctcttt

SEQ ID NO: 41987 - DNA, 16 bp, H. sapiens
aggggtgctgaatttt

SEQ ID NO: 41988 - DNA, 16 bp, H. sapiens
aggggtggagctgcct

SEQ ID NO: 41989 - DNA, 16 bp, H. sapiens
aggggtggagctggga

SEQ ID NO: 41990 - DNA, 16 bp, H. sapiens
aggggtggctgggcag

SEQ ID NO: 41991 - DNA, 16 bp, H. sapiens
aggggtggggctgttt

SEQ ID NO: 41992 - DNA, 16 bp, H. sapiens
aggggttcctccagaa

SEQ ID NO: 41993 - DNA, 16 bp, H. sapiens
aggggttgaagaccag

SEQ ID NO: 41994 - DNA, 16 bp, H. sapiens
aggggttggggaccct

SEQ ID NO: 41995 - DNA, 16 bp, H. sapiens
aggggttggtcttgct

SEQ ID NO: 41996 - DNA, 16 bp, H. sapiens
agggtaggtatatgta

SEQ ID NO: 41997 - DNA, 16 bp, H. sapiens
agggtatctgctggaa

SEQ ID NO: 41998 - DNA, 16 bp, H. sapiens
agggtatggtggctca

SEQ ID NO: 41999 - DNA, 16 bp, H. sapiens
agggtattaatattaa

SEQ ID NO: 42000 - DNA, 16 bp, H. sapiens
agggtattaattattg

SEQ ID NO: 42001 - DNA, 16 bp, H. sapiens
agggtcaaaataaagg

SEQ ID NO: 42002 - DNA, 16 bp, H. sapiens
agggtcaactgtacta

SEQ ID NO: 42003 - DNA, 16 bp, H. sapiens
agggtcacctgagcct

SEQ ID NO: 42004 - DNA, 16 bp, H. sapiens
agggtcacttgggccc

SEQ ID NO: 42005 - DNA, 16 bp, H. sapiens
agggtcagcaggaaaa

SEQ ID NO: 42006 - DNA, 16 bp, H. sapiens
agggtcagggtcaggg

SEQ ID NO: 42007 - DNA, 16 bp, H. sapiens
agggtccctctctgtc

SEQ ID NO: 42008 - DNA, 16 bp, H. sapiens
agggtcctccagagaa

SEQ ID NO: 42009 - DNA, 16 bp, H. sapiens
agggtcctgcaggcag

SEQ ID NO: 42010 - DNA, 16 bp, H. sapiens
agggtctatgttcagc

SEQ ID NO: 42011 - DNA, 16 bp, H. sapiens
agggtctcaaactcct

SEQ ID NO: 42012 - DNA, 16 bp, H. sapiens
agggtctcactctgtc

SEQ ID NO: 42013 - DNA, 16 bp, H. sapiens
agggtctcactttgtc

SEQ ID NO: 42014 - DNA, 16 bp, H. sapiens
agggtctccctttgtt

SEQ ID NO: 42015 - DNA, 16 bp, H. sapiens
agggtctcgctgtcac

SEQ ID NO: 42016 - DNA, 16 bp, H. sapiens
agggtctcttttggag

SEQ ID NO: 42017 - DNA, 16 bp, H. sapiens
agggtctgaatgtttg

SEQ ID NO: 42018 - DNA, 16 bp, H. sapiens
agggtctgtgctgagg

SEQ ID NO: 42019 - DNA, 16 bp, H. sapiens
agggtcttgttctgcc

SEQ ID NO: 42020 - DNA, 16 bp, H. sapiens
agggtctttgcacttg

SEQ ID NO: 42021 - DNA, 16 bp, H. sapiens
agggtgaaactagaat

SEQ ID NO: 42022 - DNA, 16 bp, H. sapiens
agggtgaagattgaaa

SEQ ID NO: 42023 - DNA, 17 bp, H. sapiens
agggtgacagagcaaga

SEQ ID NO: 42024 - DNA, 16 bp, H. sapiens
agggtgactacagtca

SEQ ID NO: 42025 - DNA, 16 bp, H. sapiens
agggtgagacaggaga

SEQ ID NO: 42026 - DNA, 17 bp, H. sapiens
agggtgagattccgtct

SEQ ID NO: 42027 - DNA, 16 bp, H. sapiens
agggtgagctgaagca

SEQ ID NO: 42028 - DNA, 16 bp, H. sapiens
agggtgaggacagggg

SEQ ID NO: 42029 - DNA, 16 bp, H. sapiens
agggtgatgctggttt

SEQ ID NO: 42030 - DNA, 16 bp, H. sapiens
agggtgcagcctccct

SEQ ID NO: 42031 - DNA, 16 bp, H. sapiens
agggtgctgattgatg

SEQ ID NO: 42032 - DNA, 16 bp, H. sapiens
agggtgctgattggtg

SEQ ID NO: 42033 - DNA, 16 bp, H. sapiens
agggtggagtgcagca

SEQ ID NO: 42034 - DNA, 16 bp, H. sapiens
agggtggagtgcagtt

SEQ ID NO: 42035 - DNA, 16 bp, H. sapiens
agggtggattacctga

SEQ ID NO: 42036 - DNA, 16 bp, H. sapiens
agggtggcaagagaga

SEQ ID NO: 42037 - DNA, 16 bp, H. sapiens
agggtggccagctttt

SEQ ID NO: 42038 - DNA, 16 bp, H. sapiens
agggtgggagtgggcc

SEQ ID NO: 42039 - DNA, 16 bp, H. sapiens
agggtgggcctgcctt

SEQ ID NO: 42040 - DNA, 16 bp, H. sapiens
agggtgggcctgggaa

SEQ ID NO: 42041 - DNA, 16 bp, H. sapiens
agggtgggcctgggga

SEQ ID NO: 42042 - DNA, 16 bp, H. sapiens
agggtggtggctcaca

SEQ ID NO: 42043 - DNA, 16 bp, H. sapiens
agggtggtggctgctg

SEQ ID NO: 42044 - DNA, 16 bp, H. sapiens
agggtggtggtggctg

SEQ ID NO: 42045 - DNA, 16 bp, H. sapiens
agggtgtcagcagggc

SEQ ID NO: 42046 - DNA, 16 bp, H. sapiens
agggtgtggacatctt

SEQ ID NO: 42047 - DNA, 16 bp, H. sapiens
agggtgttgattggtg

SEQ ID NO: 42048 - DNA, 16 bp, H. sapiens
agggttagggttagga

SEQ ID NO: 42049 - DNA, 16 bp, H. sapiens
agggttcactcttggt

SEQ ID NO: 42050 - DNA, 16 bp, H. sapiens
agggttctccagagga

SEQ ID NO: 42051 - DNA, 16 bp, H. sapiens
agggttctcttataaa

SEQ ID NO: 42052 - DNA, 16 bp, H. sapiens
agggttctgagcagag

SEQ ID NO: 42053 - DNA, 16 bp, H. sapiens
agggttctggaatcct

SEQ ID NO: 42054 - DNA, 16 bp, H. sapiens
agggttcttgtgagga

SEQ ID NO: 42055 - DNA, 16 bp, H. sapiens
agggttggggataagg

SEQ ID NO: 42056 - DNA, 16 bp, H. sapiens
agggttggtcttgctg

SEQ ID NO: 42057 - DNA, 16 bp, H. sapiens
agggtttatttctgaa

SEQ ID NO: 42058 - DNA, 16 bp, H. sapiens
agggtttcaccatatt

SEQ ID NO: 42059 - DNA, 18 bp, H. sapiens
agggtttcaccatgttgc

SEQ ID NO: 42060 - DNA, 23 bp, H. sapiens
agggtttcaccatgttggccagt

SEQ ID NO: 42061 - DNA, 20 bp, H. sapiens
agggtttcaccatgttggct

SEQ ID NO: 42062 - DNA, 21 bp, H. sapiens
agggtttcaccatgttggtca

SEQ ID NO: 42063 - DNA, 16 bp, H. sapiens
agggtttcactatgtt

SEQ ID NO: 42064 - DNA, 16 bp, H. sapiens
agggtttctccatgct

SEQ ID NO: 42065 - DNA, 16 bp, H. sapiens
agggtttctgatctgt

SEQ ID NO: 42066 - DNA, 16 bp, H. sapiens
agggtttcttttggag

SEQ ID NO: 42067 - DNA, 16 bp, H. sapiens
agggttttgctatatt

SEQ ID NO: 42068 - DNA, 16 bp, H. sapiens
agggttttgctttgtc

SEQ ID NO: 42069 - DNA, 16 bp, H. sapiens
agggtttttgctgaga

SEQ ID NO: 42070 - DNA, 16 bp, H. sapiens
aggtaaacttgtgtca

SEQ ID NO: 42071 - DNA, 16 bp, H. sapiens
aggtaaagaaactgag

SEQ ID NO: 42072 - DNA, 16 bp, H. sapiens
aggtaaagaaagacaa

SEQ ID NO: 42073 - DNA, 16 bp, H. sapiens
aggtaaagtcggaaac

SEQ ID NO: 42074 - DNA, 16 bp, H. sapiens
aggtaaataaaatttt

SEQ ID NO: 42075 - DNA, 16 bp, H. sapiens
aggtaaatatattttt

SEQ ID NO: 42076 - DNA, 16 bp, H. sapiens
aggtaacacagcaaga

SEQ ID NO: 42077 - DNA, 16 bp, H. sapiens
aggtaacatttgagca

SEQ ID NO: 42078 - DNA, 16 bp, H. sapiens
aggtaactgaggctca

SEQ ID NO: 42079 - DNA, 16 bp, H. sapiens
aggtaagaagattgct

SEQ ID NO: 42080 - DNA, 16 bp, H. sapiens
aggtaaggaaactgag

SEQ ID NO: 42081 - DNA, 17 bp, H. sapiens
aggtaatccacccgcct

SEQ ID NO: 42082 - DNA, 16 bp, H. sapiens
aggtaatctagagatg

SEQ ID NO: 42083 - DNA, 16 bp, H. sapiens
aggtaatgaatatgtt

SEQ ID NO: 42084 - DNA, 16 bp, H. sapiens
aggtaatgtgattcct

SEQ ID NO: 42085 - DNA, 16 bp, H. sapiens
aggtaattgaatcata

SEQ ID NO: 42086 - DNA, 16 bp, H. sapiens
aggtaatttattctct

SEQ ID NO: 42087 - DNA, 16 bp, H. sapiens
aggtaatttttaaaga

SEQ ID NO: 42088 - DNA, 16 bp, H. sapiens
aggtaattttttaaaa

SEQ ID NO: 42089 - DNA, 16 bp, H. sapiens
aggtacaaagagaagc

SEQ ID NO: 42090 - DNA, 16 bp, H. sapiens
aggtacagagatttct

SEQ ID NO: 42091 - DNA, 16 bp, H. sapiens
aggtacagcttgggcc

SEQ ID NO: 42092 - DNA, 16 bp, H. sapiens
aggtaccacattttct

SEQ ID NO: 42093 - DNA, 16 bp, H. sapiens
aggtaccattattatt

SEQ ID NO: 42094 - DNA, 16 bp, H. sapiens
aggtacctagagtagt

SEQ ID NO: 42095 - DNA, 16 bp, H. sapiens
aggtactatgcctgga

SEQ ID NO: 42096 - DNA, 16 bp, H. sapiens
aggtactcagtaaata

SEQ ID NO: 42097 - DNA, 16 bp, H. sapiens
aggtacttggaaggct

SEQ ID NO: 42098 - DNA, 16 bp, H. sapiens
aggtagaaaagacaaa

SEQ ID NO: 42099 - DNA, 16 bp, H. sapiens
aggtagatagacagat

SEQ ID NO: 42100 - DNA, 16 bp, H. sapiens
aggtagatcacttgaa

SEQ ID NO: 42101 - DNA, 16 bp, H. sapiens
aggtagatgagagaca

SEQ ID NO: 42102 - DNA, 16 bp, H. sapiens
aggtagattttaaaaa

SEQ ID NO: 42103 - DNA, 16 bp, H. sapiens
aggtagcagtgagcta

SEQ ID NO: 42104 - DNA, 16 bp, H. sapiens
aggtagcagtgagctg

SEQ ID NO: 42105 - DNA, 20 bp, H. sapiens
aggtagctgggattacaggt

SEQ ID NO: 42106 - DNA, 16 bp, H. sapiens
aggtaggagcattgct

SEQ ID NO: 42107 - DNA, 16 bp, H. sapiens
aggtagtgtttgccag

SEQ ID NO: 42108 - DNA, 16 bp, H. sapiens
aggtagttttggaaaa

SEQ ID NO: 42109 - DNA, 16 bp, H. sapiens
aggtagtttttcaatt

SEQ ID NO: 42110 - DNA, 16 bp, H. sapiens
aggtataacttacata

SEQ ID NO: 42111 - DNA, 16 bp, H. sapiens
aggtataccattttta

SEQ ID NO: 42112 - DNA, 16 bp, H. sapiens
aggtatcaaaatatca

SEQ ID NO: 42113 - DNA, 16 bp, H. sapiens
aggtatcattctttca

SEQ ID NO: 42114 - DNA, 16 bp, H. sapiens
aggtatctaagaactt

SEQ ID NO: 42115 - DNA, 16 bp, H. sapiens
aggtatctgcccacct

SEQ ID NO: 42116 - DNA, 16 bp, H. sapiens
aggtatgagccaccac

SEQ ID NO: 42117 - DNA, 16 bp, H. sapiens
aggtatgtttagatac

SEQ ID NO: 42118 - DNA, 18 bp, H. sapiens
aggtattaccattcagga

SEQ ID NO: 42119 - DNA, 16 bp, H. sapiens
aggtattctagaagaa

SEQ ID NO: 42120 - DNA, 16 bp, H. sapiens
aggtattgaagaaaca

SEQ ID NO: 42121 - DNA, 16 bp, H. sapiens
aggtattgggagatcc

SEQ ID NO: 42122 - DNA, 16 bp, H. sapiens
aggtattttatagatg

SEQ ID NO: 42123 - DNA, 16 bp, H. sapiens
aggtattttgcaaaaa

SEQ ID NO: 42124 - DNA, 16 bp, H. sapiens
aggtattttgtaaaat

SEQ ID NO: 42125 - DNA, 16 bp, H. sapiens
aggtcaaaaaacattc

SEQ ID NO: 42126 - DNA, 16 bp, H. sapiens
aggtcaaagaagaaat

SEQ ID NO: 42127 - DNA, 16 bp, H. sapiens
aggtcaaagacaaaga

SEQ ID NO: 42128 - DNA, 16 bp, H. sapiens
aggtcaagaccaacct

SEQ ID NO: 42129 - DNA, 16 bp, H. sapiens
aggtcaagagatcaaa

SEQ ID NO: 42130 - DNA, 20 bp, H. sapiens
aggtcaagagatcgagacca

SEQ ID NO: 42131 - DNA, 16 bp, H. sapiens
aggtcaagagttggag

SEQ ID NO: 42132 - DNA, 16 bp, H. sapiens
aggtcaaggataaaga

SEQ ID NO: 42133 - DNA, 16 bp, H. sapiens
aggtcaaggatgcagt

SEQ ID NO: 42134 - DNA, 16 bp, H. sapiens
aggtcaaggctgaggt

SEQ ID NO: 42135 - DNA, 16 bp, H. sapiens
aggtcaaggtgggtgg

SEQ ID NO: 42136 - DNA, 16 bp, H. sapiens
aggtcacaaagctggt

SEQ ID NO: 42137 - DNA, 16 bp, H. sapiens
aggtcacacagcaagt

SEQ ID NO: 42138 - DNA, 16 bp, H. sapiens
aggtcacacagcaggt

SEQ ID NO: 42139 - DNA, 16 bp, H. sapiens
aggtcacacagcctgt

SEQ ID NO: 42140 - DNA, 16 bp, H. sapiens
aggtcacaggcaggtt

SEQ ID NO: 42141 - DNA, 16 bp, H. sapiens
aggtcaccatcatcaa

SEQ ID NO: 42142 - DNA, 17 bp, H. sapiens
aggtcactgcaacctcc

SEQ ID NO: 42143 - DNA, 20 bp, H. sapiens
aggtcagaagttcgagacca

SEQ ID NO: 42144 - DNA, 16 bp, H. sapiens
aggtcagaatttcaag

SEQ ID NO: 42145 - DNA, 16 bp, H. sapiens
aggtcagagcagaaat

SEQ ID NO: 42146 - DNA, 16 bp, H. sapiens
aggtcagaggtcagca

SEQ ID NO: 42147 - DNA, 16 bp, H. sapiens
aggtcagctgattagc

SEQ ID NO: 42148 - DNA, 17 bp, H. sapiens
aggtcaggaattcaaga

SEQ ID NO: 42149 - DNA, 16 bp, H. sapiens
aggtcaggagaccatc

SEQ ID NO: 42150 - DNA, 16 bp, H. sapiens
aggtcaggagatcaag

SEQ ID NO: 42151 - DNA, 20 bp, H. sapiens
aggtcaggagatcgaggcca

SEQ ID NO: 42152 - DNA, 19 bp, H. sapiens
aggtcaggagttcgagact

SEQ ID NO: 42153 - DNA, 17 bp, H. sapiens
aggtcaggatttcgaga

SEQ ID NO: 42154 - DNA, 16 bp, H. sapiens
aggtcaggctgcagtg

SEQ ID NO: 42155 - DNA, 16 bp, H. sapiens
aggtcatcaaaaacaa

SEQ ID NO: 42156 - DNA, 16 bp, H. sapiens
aggtcatcaagacaaa

SEQ ID NO: 42157 - DNA, 16 bp, H. sapiens
aggtcatcaagagaga

SEQ ID NO: 42158 - DNA, 16 bp, H. sapiens
aggtcatcaaggcaga

SEQ ID NO: 42159 - DNA, 16 bp, H. sapiens
aggtcatctgcaagct

SEQ ID NO: 42160 - DNA, 16 bp, H. sapiens
aggtcatctgcctgcc

SEQ ID NO: 42161 - DNA, 16 bp, H. sapiens
aggtcatgaaggtgaa

SEQ ID NO: 42162 - DNA, 16 bp, H. sapiens
aggtcatgaaggtgga

SEQ ID NO: 42163 - DNA, 16 bp, H. sapiens
aggtcatgtgaagaca

SEQ ID NO: 42164 - DNA, 16 bp, H. sapiens
aggtcattgtgcacag

SEQ ID NO: 42165 - DNA, 16 bp, H. sapiens
aggtcatttctttgct

SEQ ID NO: 42166 - DNA, 16 bp, H. sapiens
aggtccactccagatg

SEQ ID NO: 42167 - DNA, 17 bp, H. sapiens
aggtcccaacaggagtc

SEQ ID NO: 42168 - DNA, 16 bp, H. sapiens
aggtcccacaataggc

SEQ ID NO: 42169 - DNA, 16 bp, H. sapiens
aggtccccaccaccat

SEQ ID NO: 42170 - DNA, 16 bp, H. sapiens
aggtccgcctcctggg

SEQ ID NO: 42171 - DNA, 16 bp, H. sapiens
aggtcctcagaccaac

SEQ ID NO: 42172 - DNA, 16 bp, H. sapiens
aggtcctccctgtggc

SEQ ID NO: 42173 - DNA, 16 bp, H. sapiens
aggtcctgctgcttgc

SEQ ID NO: 42174 - DNA, 17 bp, H. sapiens
aggtcctggagaggatg

SEQ ID NO: 42175 - DNA, 16 bp, H. sapiens
aggtcctggtgtctgt

SEQ ID NO: 42176 - DNA, 16 bp, H. sapiens
aggtcctgtctctaca

SEQ ID NO: 42177 - DNA, 16 bp, H. sapiens
aggtccttcacaaccc

SEQ ID NO: 42178 - DNA, 17 bp, H. sapiens
aggtcgtaggtggatct

SEQ ID NO: 42179 - DNA, 16 bp, H. sapiens
aggtctcacacttcct

SEQ ID NO: 42180 - DNA, 16 bp, H. sapiens
aggtctcactatattg

SEQ ID NO: 42181 - DNA, 16 bp, H. sapiens
aggtctcactatgttg

SEQ ID NO: 42182 - DNA, 16 bp, H. sapiens
aggtctcactctgttg

SEQ ID NO: 42183 - DNA, 16 bp, H. sapiens
aggtctcaggaagctt

SEQ ID NO: 42184 - DNA, 16 bp, H. sapiens
aggtctcgaactcctg

SEQ ID NO: 42185 - DNA, 16 bp, H. sapiens
aggtctcgctgtgttg

SEQ ID NO: 42186 - DNA, 16 bp, H. sapiens
aggtctctctccttgg

SEQ ID NO: 42187 - DNA, 16 bp, H. sapiens
aggtctctcttcttct

SEQ ID NO: 42188 - DNA, 16 bp, H. sapiens
aggtctctggttttcc

SEQ ID NO: 42189 - DNA, 16 bp, H. sapiens
aggtctgaaatcaagg

SEQ ID NO: 42190 - DNA, 16 bp, H. sapiens
aggtctgcagcttcag

SEQ ID NO: 42191 - DNA, 16 bp, H. sapiens
aggtctgccttacaag

SEQ ID NO: 42192 - DNA, 16 bp, H. sapiens
aggtctggaaagtcct

SEQ ID NO: 42193 - DNA, 18 bp, H. sapiens
aggtctggacatcatcat

SEQ ID NO: 42194 - DNA, 16 bp, H. sapiens
aggtctggagttcaaa

SEQ ID NO: 42195 - DNA, 16 bp, H. sapiens
aggtctgggtggggcc

SEQ ID NO: 42196 - DNA, 16 bp, H. sapiens
aggtcttactctgtca

SEQ ID NO: 42197 - DNA, 16 bp, H. sapiens
aggtcttagattcaag

SEQ ID NO: 42198 - DNA, 16 bp, H. sapiens
aggtcttatatccaga

SEQ ID NO: 42199 - DNA, 16 bp, H. sapiens
aggtcttatttaattt

SEQ ID NO: 42200 - DNA, 16 bp, H. sapiens
aggtcttcaaggcagc

SEQ ID NO: 42201 - DNA, 16 bp, H. sapiens
aggtcttctgactcct

SEQ ID NO: 42202 - DNA, 16 bp, H. sapiens
aggtcttgctctgctg

SEQ ID NO: 42203 - DNA, 16 bp, H. sapiens
aggtcttgctctgtca

SEQ ID NO: 42204 - DNA, 16 bp, H. sapiens
aggtcttgctttgttg

SEQ ID NO: 42205 - DNA, 16 bp, H. sapiens
aggtcttgttatattg

SEQ ID NO: 42206 - DNA, 16 bp, H. sapiens
aggtctttatttcttc

SEQ ID NO: 42207 - DNA, 16 bp, H. sapiens
aggtctttcatctcct

SEQ ID NO: 42208 - DNA, 16 bp, H. sapiens
aggtctttcctgcact

SEQ ID NO: 42209 - DNA, 16 bp, H. sapiens
aggtctttctctctct

SEQ ID NO: 42210 - DNA, 16 bp, H. sapiens
aggtctttttaaattt

SEQ ID NO: 42211 - DNA, 17 bp, H. sapiens
aggtgaaacccccgtct

SEQ ID NO: 42212 - DNA, 16 bp, H. sapiens
aggtgaaagaagccaa

SEQ ID NO: 42213 - DNA, 16 bp, H. sapiens
aggtgaaataaacagt

SEQ ID NO: 42214 - DNA, 16 bp, H. sapiens
aggtgaaatggtgtct

SEQ ID NO: 42215 - DNA, 16 bp, H. sapiens
aggtgaaattcacata

SEQ ID NO: 42216 - DNA, 16 bp, H. sapiens
aggtgaacaccaccac

SEQ ID NO: 42217 - DNA, 16 bp, H. sapiens
aggtgaacccactggg

SEQ ID NO: 42218 - DNA, 16 bp, H. sapiens
aggtgaactcctgggc

SEQ ID NO: 42219 - DNA, 16 bp, H. sapiens
aggtgaagaggaagca

SEQ ID NO: 42220 - DNA, 16 bp, H. sapiens
aggtgaagcagaagca

SEQ ID NO: 42221 - DNA, 16 bp, H. sapiens
aggtgaagccggctgg

SEQ ID NO: 42222 - DNA, 16 bp, H. sapiens
aggtgaaggggagctg

SEQ ID NO: 42223 - DNA, 16 bp, H. sapiens
aggtgaatgggaagca

SEQ ID NO: 42224 - DNA, 16 bp, H. sapiens
aggtgaattcaaagat

SEQ ID NO: 42225 - DNA, 16 bp, H. sapiens
aggtgaatttttaaaa

SEQ ID NO: 42226 - DNA, 16 bp, H. sapiens
aggtgacaaaactgag

SEQ ID NO: 42227 - DNA, 16 bp, H. sapiens
aggtgacacaaacaaa

SEQ ID NO: 42228 - DNA, 16 bp, H. sapiens
aggtgacagagactct

SEQ ID NO: 42229 - DNA, 16 bp, H. sapiens
aggtgacaggaaggag

SEQ ID NO: 42230 - DNA, 16 bp, H. sapiens
aggtgacagttaataa

SEQ ID NO: 42231 - DNA, 16 bp, H. sapiens
aggtgaccatctgcaa

SEQ ID NO: 42232 - DNA, 16 bp, H. sapiens
aggtgacctgtccttt

SEQ ID NO: 42233 - DNA, 16 bp, H. sapiens
aggtgactgaggcagg

SEQ ID NO: 42234 - DNA, 16 bp, H. sapiens
aggtgacttttttttt

SEQ ID NO: 42235 - DNA, 16 bp, H. sapiens
aggtgagaaaactgag

SEQ ID NO: 42236 - DNA, 16 bp, H. sapiens
aggtgagaaaatagag

SEQ ID NO: 42237 - DNA, 16 bp, H. sapiens
aggtgagaactgaaca

SEQ ID NO: 42238 - DNA, 16 bp, H. sapiens
aggtgagaagttcaag

SEQ ID NO: 42239 - DNA, 16 bp, H. sapiens
aggtgagcaagcaaag

SEQ ID NO: 42240 - DNA, 16 bp, H. sapiens
aggtgagcagattgcc

SEQ ID NO: 42241 - DNA, 16 bp, H. sapiens
aggtgaggaaactgaa

SEQ ID NO: 42242 - DNA, 16 bp, H. sapiens
aggtgaggaaactgag

SEQ ID NO: 42243 - DNA, 16 bp, H. sapiens
aggtgaggaagctgaa

SEQ ID NO: 42244 - DNA, 16 bp, H. sapiens
aggtgaggctggaggg

SEQ ID NO: 42245 - DNA, 16 bp, H. sapiens
aggtgaggctgggccc

SEQ ID NO: 42246 - DNA, 20 bp, H. sapiens
aggtgatccacccgcctcga

SEQ ID NO: 42247 - DNA, 16 bp, H. sapiens
aggtgatccgcctgac

SEQ ID NO: 42248 - DNA, 16 bp, H. sapiens
aggtgatctcctgcct

SEQ ID NO: 42249 - DNA, 16 bp, H. sapiens
aggtgatgatgatgat

SEQ ID NO: 42250 - DNA, 16 bp, H. sapiens
aggtgatgctgatgct

SEQ ID NO: 42251 - DNA, 16 bp, H. sapiens
aggtgatgtgcccacc

SEQ ID NO: 42252 - DNA, 16 bp, H. sapiens
aggtgattaaaggaaa

SEQ ID NO: 42253 - DNA, 16 bp, H. sapiens
aggtgattctgatgct

SEQ ID NO: 42254 - DNA, 16 bp, H. sapiens
aggtgattctgattca

SEQ ID NO: 42255 - DNA, 16 bp, H. sapiens
aggtgatttagggtat

SEQ ID NO: 42256 - DNA, 16 bp, H. sapiens
aggtgattttgatgca

SEQ ID NO: 42257 - DNA, 16 bp, H. sapiens
aggtgcacagaagaca

SEQ ID NO: 42258 - DNA, 17 bp, H. sapiens
aggtgcacgccaccaca

SEQ ID NO: 42259 - DNA, 16 bp, H. sapiens
aggtgcacgccagcac

SEQ ID NO: 42260 - DNA, 16 bp, H. sapiens
aggtgcagccaaccac

SEQ ID NO: 42261 - DNA, 16 bp, H. sapiens
aggtgcagcggctcac

SEQ ID NO: 42262 - DNA, 16 bp, H. sapiens
aggtgcagttgctcat

SEQ ID NO: 42263 - DNA, 16 bp, H. sapiens
aggtgcatgccaccat

SEQ ID NO: 42264 - DNA, 16 bp, H. sapiens
aggtgcatgccatcac

SEQ ID NO: 42265 - DNA, 16 bp, H. sapiens
aggtgccaccaccaca

SEQ ID NO: 42266 - DNA, 16 bp, H. sapiens
aggtgccagcagattt

SEQ ID NO: 42267 - DNA, 16 bp, H. sapiens
aggtgccaggcactgt

SEQ ID NO: 42268 - DNA, 16 bp, H. sapiens
aggtgccaggccctgg

SEQ ID NO: 42269 - DNA, 16 bp, H. sapiens
aggtgccaggctcttt

SEQ ID NO: 42270 - DNA, 16 bp, H. sapiens
aggtgccatcttggaa

SEQ ID NO: 42271 - DNA, 16 bp, H. sapiens
aggtgcccaccactat

SEQ ID NO: 42272 - DNA, 16 bp, H. sapiens
aggtgccccctgaccc

SEQ ID NO: 42273 - DNA, 16 bp, H. sapiens
aggtgcctcacacctg

SEQ ID NO: 42274 - DNA, 16 bp, H. sapiens
aggtgcctgcccccac

SEQ ID NO: 42275 - DNA, 16 bp, H. sapiens
aggtgcgcaccaccac

SEQ ID NO: 42276 - DNA, 16 bp, H. sapiens
aggtgctaaaggaaat

SEQ ID NO: 42277 - DNA, 16 bp, H. sapiens
aggtgctcaataaaag

SEQ ID NO: 42278 - DNA, 16 bp, H. sapiens
aggtgctcaataaaca

SEQ ID NO: 42279 - DNA, 16 bp, H. sapiens
aggtgctcaataaata

SEQ ID NO: 42280 - DNA, 16 bp, H. sapiens
aggtgctcaccatcac

SEQ ID NO: 42281 - DNA, 16 bp, H. sapiens
aggtgctcagtaaaca

SEQ ID NO: 42282 - DNA, 16 bp, H. sapiens
aggtgctgaagggaca

SEQ ID NO: 42283 - DNA, 16 bp, H. sapiens
aggtgctgagattaca

SEQ ID NO: 42284 - DNA, 16 bp, H. sapiens
aggtgctggagaggaa

SEQ ID NO: 42285 - DNA, 16 bp, H. sapiens
aggtgctggagaggac

SEQ ID NO: 42286 - DNA, 16 bp, H. sapiens
aggtgctggagagggt

SEQ ID NO: 42287 - DNA, 16 bp, H. sapiens
aggtgctggccaccat

SEQ ID NO: 42288 - DNA, 16 bp, H. sapiens
aggtgctgggaataca

SEQ ID NO: 42289 - DNA, 16 bp, H. sapiens
aggtgctggggataca

SEQ ID NO: 42290 - DNA, 16 bp, H. sapiens
aggtgctgtgattaca

SEQ ID NO: 42291 - DNA, 16 bp, H. sapiens
aggtgctgtggctcac

SEQ ID NO: 42292 - DNA, 16 bp, H. sapiens
aggtggaaacaaccca

SEQ ID NO: 42293 - DNA, 16 bp, H. sapiens
aggtggaaatgaagga

SEQ ID NO: 42294 - DNA, 16 bp, H. sapiens
aggtggaaatgaggaa

SEQ ID NO: 42295 - DNA, 18 bp, H. sapiens
aggtggaacgagagactt

SEQ ID NO: 42296 - DNA, 16 bp, H. sapiens
aggtggaagatagtga

SEQ ID NO: 42297 - DNA, 16 bp, H. sapiens
aggtggaagatgcagt

SEQ ID NO: 42298 - DNA, 16 bp, H. sapiens
aggtggaagccattat

SEQ ID NO: 42299 - DNA, 16 bp, H. sapiens
aggtggaaggggaggc

SEQ ID NO: 42300 - DNA, 16 bp, H. sapiens
aggtggaattgaacaa

SEQ ID NO: 42301 - DNA, 16 bp, H. sapiens
aggtggaccacctgag

SEQ ID NO: 42302 - DNA, 16 bp, H. sapiens
aggtggagacacagcc

SEQ ID NO: 42303 - DNA, 16 bp, H. sapiens
aggtggagattcccaa

SEQ ID NO: 42304 - DNA, 16 bp, H. sapiens
aggtggagctgcagtg

SEQ ID NO: 42305 - DNA, 16 bp, H. sapiens
aggtggaggatctgga

SEQ ID NO: 42306 - DNA, 16 bp, H. sapiens
aggtggaggccaggga

SEQ ID NO: 42307 - DNA, 16 bp, H. sapiens
aggtggaggctgaagt

SEQ ID NO: 42308 - DNA, 16 bp, H. sapiens
aggtggaggcttccaa

SEQ ID NO: 42309 - DNA, 16 bp, H. sapiens
aggtggaggtgcagtg

SEQ ID NO: 42310 - DNA, 16 bp, H. sapiens
aggtggaggtgggcag

SEQ ID NO: 42311 - DNA, 17 bp, H. sapiens
aggtggaggttgcagta

SEQ ID NO: 42312 - DNA, 16 bp, H. sapiens
aggtggagtctgcaga

SEQ ID NO: 42313 - DNA, 16 bp, H. sapiens
aggtggatattattat

SEQ ID NO: 42314 - DNA, 20 bp, H. sapiens
aggtggatcacctgaggtct

SEQ ID NO: 42315 - DNA, 16 bp, H. sapiens
aggtggatcatctgag

SEQ ID NO: 42316 - DNA, 16 bp, H. sapiens
aggtggatcctttgag

SEQ ID NO: 42317 - DNA, 16 bp, H. sapiens
aggtggcaaagccagc

SEQ ID NO: 42318 - DNA, 16 bp, H. sapiens
aggtggcacatctgga

SEQ ID NO: 42319 - DNA, 16 bp, H. sapiens
aggtggcagagagaga

SEQ ID NO: 42320 - DNA, 16 bp, H. sapiens
aggtggcagagctgga

SEQ ID NO: 42321 - DNA, 16 bp, H. sapiens
aggtggcagagctggg

SEQ ID NO: 42322 - DNA, 16 bp, H. sapiens
aggtggcagaggcaga

SEQ ID NO: 42323 - DNA, 16 bp, H. sapiens
aggtggcagaggccaa

SEQ ID NO: 42324 - DNA, 16 bp, H. sapiens
aggtggcagctgcagc

SEQ ID NO: 42325 - DNA, 16 bp, H. sapiens
aggtggcaggaagaag

SEQ ID NO: 42326 - DNA, 16 bp, H. sapiens
aggtggcaggagagaa

SEQ ID NO: 42327 - DNA, 16 bp, H. sapiens
aggtggcagggctggg

SEQ ID NO: 42328 - DNA, 16 bp, H. sapiens
aggtggcagtgagctg

SEQ ID NO: 42329 - DNA, 16 bp, H. sapiens
aggtggccaggagcag

SEQ ID NO: 42330 - DNA, 16 bp, H. sapiens
aggtggccaggcgcag

SEQ ID NO: 42331 - DNA, 16 bp, H. sapiens
aggtggcccatgcctg

SEQ ID NO: 42332 - DNA, 16 bp, H. sapiens
aggtggccctcttctc

SEQ ID NO: 42333 - DNA, 16 bp, H. sapiens
aggtggccctgggcag

SEQ ID NO: 42334 - DNA, 16 bp, H. sapiens
aggtggcctctaggag

SEQ ID NO: 42335 - DNA, 16 bp, H. sapiens
aggtggctcacacctg

SEQ ID NO: 42336 - DNA, 16 bp, H. sapiens
aggtggctcacgcctg

SEQ ID NO: 42337 - DNA, 16 bp, H. sapiens
aggtggctcatgcctg

SEQ ID NO: 42338 - DNA, 16 bp, H. sapiens
aggtggctgaggcctg

SEQ ID NO: 42339 - DNA, 16 bp, H. sapiens
aggtggctggagctga

SEQ ID NO: 42340 - DNA, 16 bp, H. sapiens
aggtggctgggaggtg

SEQ ID NO: 42341 - DNA, 16 bp, H. sapiens
aggtggctgggtgtgg

SEQ ID NO: 42342 - DNA, 16 bp, H. sapiens
aggtggctgtctacaa

SEQ ID NO: 42343 - DNA, 16 bp, H. sapiens
aggtgggaaaggaaat

SEQ ID NO: 42344 - DNA, 16 bp, H. sapiens
aggtgggaactggagt

SEQ ID NO: 42345 - DNA, 16 bp, H. sapiens
aggtgggaagatgact

SEQ ID NO: 42346 - DNA, 16 bp, H. sapiens
aggtgggaagatggtt

SEQ ID NO: 42347 - DNA, 16 bp, H. sapiens
aggtgggaagggctgg

SEQ ID NO: 42348 - DNA, 16 bp, H. sapiens
aggtgggaatggaaca

SEQ ID NO: 42349 - DNA, 16 bp, H. sapiens
aggtgggaattatggg

SEQ ID NO: 42350 - DNA, 16 bp, H. sapiens
aggtgggagaattgtt

SEQ ID NO: 42351 - DNA, 16 bp, H. sapiens
aggtgggagccaccac

SEQ ID NO: 42352 - DNA, 16 bp, H. sapiens
aggtgggaggagggct

SEQ ID NO: 42353 - DNA, 16 bp, H. sapiens
aggtgggaggatcatg

SEQ ID NO: 42354 - DNA, 17 bp, H. sapiens
aggtgggaggatggctc

SEQ ID NO: 42355 - DNA, 16 bp, H. sapiens
aggtgggaggattgcc

SEQ ID NO: 42356 - DNA, 16 bp, H. sapiens
aggtgggcaaagggag

SEQ ID NO: 42357 - DNA, 16 bp, H. sapiens
aggtgggcagagcagg

SEQ ID NO: 42358 - DNA, 16 bp, H. sapiens
aggtgggcagatcaac

SEQ ID NO: 42359 - DNA, 16 bp, H. sapiens
aggtgggcagattcct

SEQ ID NO: 42360 - DNA, 16 bp, H. sapiens
aggtgggcagattgct

SEQ ID NO: 42361 - DNA, 16 bp, H. sapiens
aggtgggcagggccag

SEQ ID NO: 42362 - DNA, 16 bp, H. sapiens
aggtgggcatggtggc

SEQ ID NO: 42363 - DNA, 16 bp, H. sapiens
aggtgggcattattca

SEQ ID NO: 42364 - DNA, 16 bp, H. sapiens
aggtgggcgcggtggc

SEQ ID NO: 42365 - DNA, 17 bp, H. sapiens
aggtgggcggatcaccc

SEQ ID NO: 42366 - DNA, 17 bp, H. sapiens
aggtgggcggatcgctt

SEQ ID NO: 42367 - DNA, 16 bp, H. sapiens
aggtgggctccaccca

SEQ ID NO: 42368 - DNA, 16 bp, H. sapiens
aggtgggctcccacgg

SEQ ID NO: 42369 - DNA, 16 bp, H. sapiens
aggtggggacactgag

SEQ ID NO: 42370 - DNA, 16 bp, H. sapiens
aggtggggcagggcat

SEQ ID NO: 42371 - DNA, 16 bp, H. sapiens
aggtggggcccttggg

SEQ ID NO: 42372 - DNA, 16 bp, H. sapiens
aggtggggcctctggg

SEQ ID NO: 42373 - DNA, 16 bp, H. sapiens
aggtggggcctggtgg

SEQ ID NO: 42374 - DNA, 16 bp, H. sapiens
aggtggggctttggga

SEQ ID NO: 42375 - DNA, 16 bp, H. sapiens
aggtggggggctcagc

SEQ ID NO: 42376 - DNA, 16 bp, H. sapiens
aggtgggtaataaact

SEQ ID NO: 42377 - DNA, 17 bp, H. sapiens
aggtgggtagccctggg

SEQ ID NO: 42378 - DNA, 16 bp, H. sapiens
aggtgggtagtttgca

SEQ ID NO: 42379 - DNA, 16 bp, H. sapiens
aggtgggtgcggtggc

SEQ ID NO: 42380 - DNA, 16 bp, H. sapiens
aggtgggtggaacact

SEQ ID NO: 42381 - DNA, 16 bp, H. sapiens
aggtgggtggatccca

SEQ ID NO: 42382 - DNA, 16 bp, H. sapiens
aggtgggtggatggat

SEQ ID NO: 42383 - DNA, 16 bp, H. sapiens
aggtggtagagctggg

SEQ ID NO: 42384 - DNA, 16 bp, H. sapiens
aggtggtcctcccacc

SEQ ID NO: 42385 - DNA, 16 bp, H. sapiens
aggtggtctcatatgg

SEQ ID NO: 42386 - DNA, 16 bp, H. sapiens
aggtggtggagcagag

SEQ ID NO: 42387 - DNA, 16 bp, H. sapiens
aggtggtgggcacctg

SEQ ID NO: 42388 - DNA, 16 bp, H. sapiens
aggtggtgggcgcctg

SEQ ID NO: 42389 - DNA, 16 bp, H. sapiens
aggtggtggtgatgat

SEQ ID NO: 42390 - DNA, 16 bp, H. sapiens
aggtggtgtttgttta

SEQ ID NO: 42391 - DNA, 16 bp, H. sapiens
aggtggtttttaaaaa

SEQ ID NO: 42392 - DNA, 16 bp, H. sapiens
aggtgtaaggaaggta

SEQ ID NO: 42393 - DNA, 16 bp, H. sapiens
aggtgtaaggaaggtg

SEQ ID NO: 42394 - DNA, 16 bp, H. sapiens
aggtgtacatcaccat

SEQ ID NO: 42395 - DNA, 16 bp, H. sapiens
aggtgtatatatgttt

SEQ ID NO: 42396 - DNA, 22 bp, H. sapiens
aggtgtccaagaagaaagctca

SEQ ID NO: 42397 - DNA, 16 bp, H. sapiens
aggtgtccaccatcat

SEQ ID NO: 42398 - DNA, 16 bp, H. sapiens
aggtgtgaaccaccat

SEQ ID NO: 42399 - DNA, 16 bp, H. sapiens
aggtgtgagccaacat

SEQ ID NO: 42400 - DNA, 24 bp, H. sapiens
aggtgtgagccaccacacctggcc

SEQ ID NO: 42401 - DNA, 21 bp, H. sapiens
aggtgtgagccaccacgcccg

SEQ ID NO: 42402 - DNA, 18 bp, H. sapiens
aggtgtgagccaccacgt

SEQ ID NO: 42403 - DNA, 17 bp, H. sapiens
aggtgtgagccaccagg

SEQ ID NO: 42404 - DNA, 16 bp, H. sapiens
aggtgtgagccaccat

SEQ ID NO: 42405 - DNA, 17 bp, H. sapiens
aggtgtgagccaccgtg

SEQ ID NO: 42406 - DNA, 16 bp, H. sapiens
aggtgtgagccacggc

SEQ ID NO: 42407 - DNA, 17 bp, H. sapiens
aggtgtgagccacttca

SEQ ID NO: 42408 - DNA, 16 bp, H. sapiens
aggtgtgagccatgca

SEQ ID NO: 42409 - DNA, 16 bp, H. sapiens
aggtgtgagccatggc

SEQ ID NO: 42410 - DNA, 16 bp, H. sapiens
aggtgtgagccgctgc

SEQ ID NO: 42411 - DNA, 16 bp, H. sapiens
aggtgtggaggggcag

SEQ ID NO: 42412 - DNA, 16 bp, H. sapiens
aggtgtgggatatagt

SEQ ID NO: 42413 - DNA, 16 bp, H. sapiens
aggtgtggtgacatgt

SEQ ID NO: 42414 - DNA, 16 bp, H. sapiens
aggtgtggtggcacag

SEQ ID NO: 42415 - DNA, 17 bp, H. sapiens
aggtgtggtggcatgca

SEQ ID NO: 42416 - DNA, 20 bp, H. sapiens
aggtgtggtggcgcatgcct

SEQ ID NO: 42417 - DNA, 16 bp, H. sapiens
aggtgtggtggctcat

SEQ ID NO: 42418 - DNA, 16 bp, H. sapiens
aggtgtgtctgacctc

SEQ ID NO: 42419 - DNA, 16 bp, H. sapiens
aggtgtgtgtatgtgt

SEQ ID NO: 42420 - DNA, 16 bp, H. sapiens
aggtgtgtgtgtccag

SEQ ID NO: 42421 - DNA, 16 bp, H. sapiens
aggtgtgttggcacac

SEQ ID NO: 42422 - DNA, 16 bp, H. sapiens
aggtgttcaaggccag

SEQ ID NO: 42423 - DNA, 16 bp, H. sapiens
aggtgttcaaggctgc

SEQ ID NO: 42424 - DNA, 16 bp, H. sapiens
aggtgttcaataaaca

SEQ ID NO: 42425 - DNA, 16 bp, H. sapiens
aggtgttggcagagct

SEQ ID NO: 42426 - DNA, 16 bp, H. sapiens
aggtgttggcagggct

SEQ ID NO: 42427 - DNA, 16 bp, H. sapiens
aggtgtttaataaaca

SEQ ID NO: 42428 - DNA, 16 bp, H. sapiens
aggtgtttatattatt

SEQ ID NO: 42429 - DNA, 16 bp, H. sapiens
aggtgtttattgtagt

SEQ ID NO: 42430 - DNA, 16 bp, H. sapiens
aggtgtttctttcttt

SEQ ID NO: 42431 - DNA, 16 bp, H. sapiens
aggtgtttgagaccaa

SEQ ID NO: 42432 - DNA, 16 bp, H. sapiens
aggtgtttggatcatg

SEQ ID NO: 42433 - DNA, 16 bp, H. sapiens
aggtgtttgggtcaca

SEQ ID NO: 42434 - DNA, 16 bp, H. sapiens
aggtgtttgggtcatg

SEQ ID NO: 42435 - DNA, 16 bp, H. sapiens
aggttaaaactatttt

SEQ ID NO: 42436 - DNA, 16 bp, H. sapiens
aggttaaatgagatca

SEQ ID NO: 42437 - DNA, 16 bp, H. sapiens
aggttaaatgaggttg

SEQ ID NO: 42438 - DNA, 16 bp, H. sapiens
aggttaagtgaaataa

SEQ ID NO: 42439 - DNA, 16 bp, H. sapiens
aggttaagtgacttcc

SEQ ID NO: 42440 - DNA, 16 bp, H. sapiens
aggttaatacacaaaa

SEQ ID NO: 42441 - DNA, 16 bp, H. sapiens
aggttaataggtgcag

SEQ ID NO: 42442 - DNA, 16 bp, H. sapiens
aggttacagagaaaag

SEQ ID NO: 42443 - DNA, 16 bp, H. sapiens
aggttacttccaaatc

SEQ ID NO: 42444 - DNA, 16 bp, H. sapiens
aggttagaagttcaag

SEQ ID NO: 42445 - DNA, 16 bp, H. sapiens
aggttagggtttcaac

SEQ ID NO: 42446 - DNA, 16 bp, H. sapiens
aggttataatgagcta

SEQ ID NO: 42447 - DNA, 16 bp, H. sapiens
aggttatagtgagcca

SEQ ID NO: 42448 - DNA, 16 bp, H. sapiens
aggttatatgcaaata

SEQ ID NO: 42449 - DNA, 16 bp, H. sapiens
aggttatcaaatttgt

SEQ ID NO: 42450 - DNA, 16 bp, H. sapiens
aggttatttattttct

SEQ ID NO: 42451 - DNA, 16 bp, H. sapiens
aggttatttgcttttt

SEQ ID NO: 42452 - DNA, 16 bp, H. sapiens
aggttcaagcggttct

SEQ ID NO: 42453 - DNA, 16 bp, H. sapiens
aggttcaaggaattct

SEQ ID NO: 42454 - DNA, 16 bp, H. sapiens
aggttcaagtgatttt

SEQ ID NO: 42455 - DNA, 16 bp, H. sapiens
aggttcaatttttttt

SEQ ID NO: 42456 - DNA, 16 bp, H. sapiens
aggttcacaccatttt

SEQ ID NO: 42457 - DNA, 16 bp, H. sapiens
aggttcagagggtaca

SEQ ID NO: 42458 - DNA, 16 bp, H. sapiens
aggttcaggagattct

SEQ ID NO: 42459 - DNA, 16 bp, H. sapiens
aggttcaggcaggaga

SEQ ID NO: 42460 - DNA, 16 bp, H. sapiens
aggttcatccatgttg

SEQ ID NO: 42461 - DNA, 16 bp, H. sapiens
aggttcatccgtgttg

SEQ ID NO: 42462 - DNA, 16 bp, H. sapiens
aggttcatctctgtga

SEQ ID NO: 42463 - DNA, 16 bp, H. sapiens
aggttccaggtggaca

SEQ ID NO: 42464 - DNA, 17 bp, H. sapiens
aggttccagtgagccga

SEQ ID NO: 42465 - DNA, 16 bp, H. sapiens
aggttccatgatgccc

SEQ ID NO: 42466 - DNA, 16 bp, H. sapiens
aggttcccacactgcc

SEQ ID NO: 42467 - DNA, 16 bp, H. sapiens
aggttccgtgatgccc

SEQ ID NO: 42468 - DNA, 16 bp, H. sapiens
aggttctaagaggcag

SEQ ID NO: 42469 - DNA, 16 bp, H. sapiens
aggttctccagagaaa

SEQ ID NO: 42470 - DNA, 16 bp, H. sapiens
aggttctctgtgaggg

SEQ ID NO: 42471 - DNA, 16 bp, H. sapiens
aggttctcttctggcc

SEQ ID NO: 42472 - DNA, 16 bp, H. sapiens
aggttctgaatctcac

SEQ ID NO: 42473 - DNA, 16 bp, H. sapiens
aggttctggagtcaga

SEQ ID NO: 42474 - DNA, 16 bp, H. sapiens
aggttcttagaaactg

SEQ ID NO: 42475 - DNA, 16 bp, H. sapiens
aggttcttcagagaaa

SEQ ID NO: 42476 - DNA, 16 bp, H. sapiens
aggttcttgccttagc

SEQ ID NO: 42477 - DNA, 16 bp, H. sapiens
aggttcttgctctgtt

SEQ ID NO: 42478 - DNA, 16 bp, H. sapiens
aggttctttattctgt

SEQ ID NO: 42479 - DNA, 16 bp, H. sapiens
aggttctttgcagatg

SEQ ID NO: 42480 - DNA, 16 bp, H. sapiens
aggttgaaacagtttg

SEQ ID NO: 42481 - DNA, 16 bp, H. sapiens
aggttgagaaaccctg

SEQ ID NO: 42482 - DNA, 16 bp, H. sapiens
aggttgagaaccactg

SEQ ID NO: 42483 - DNA, 16 bp, H. sapiens
aggttgaggcagatgg

SEQ ID NO: 42484 - DNA, 16 bp, H. sapiens
aggttgaggccacagt

SEQ ID NO: 42485 - DNA, 19 bp, H. sapiens
aggttgaggctgcagtgaa

SEQ ID NO: 42486 - DNA, 16 bp, H. sapiens
aggttgatctcgaact

SEQ ID NO: 42487 - DNA, 16 bp, H. sapiens
aggttgatgtgggagg

SEQ ID NO: 42488 - DNA, 16 bp, H. sapiens
aggttgattccatgcc

SEQ ID NO: 42489 - DNA, 16 bp, H. sapiens
aggttgcaatgaggtg

SEQ ID NO: 42490 - DNA, 16 bp, H. sapiens
aggttgcacagctagt

SEQ ID NO: 42491 - DNA, 16 bp, H. sapiens
aggttgcagacagctg

SEQ ID NO: 42492 - DNA, 16 bp, H. sapiens
aggttgcagagagccg

SEQ ID NO: 42493 - DNA, 16 bp, H. sapiens
aggttgcagagagctg

SEQ ID NO: 42494 - DNA, 16 bp, H. sapiens
aggttgcagcgagcca

SEQ ID NO: 42495 - DNA, 16 bp, H. sapiens
aggttgcaggagctga

SEQ ID NO: 42496 - DNA, 16 bp, H. sapiens
aggttgcagggaggcg

SEQ ID NO: 42497 - DNA, 18 bp, H. sapiens
aggttgcagggagttgag

SEQ ID NO: 42498 - DNA, 16 bp, H. sapiens
aggttgcagtaagttg

SEQ ID NO: 42499 - DNA, 16 bp, H. sapiens
aggttgcagtgaccag

SEQ ID NO: 42500 - DNA, 16 bp, H. sapiens
aggttgcagtgagcaa

SEQ ID NO: 42501 - DNA, 16 bp, H. sapiens
aggttgcagtgagcac

SEQ ID NO: 42502 - DNA, 16 bp, H. sapiens
aggttgcagtgagcga

SEQ ID NO: 42503 - DNA, 16 bp, H. sapiens
aggttgcagtgagcta

SEQ ID NO: 42504 - DNA, 17 bp, H. sapiens
aggttgcagtgagctgc

SEQ ID NO: 42505 - DNA, 18 bp, H. sapiens
aggttgcagtgagctgga

SEQ ID NO: 42506 - DNA, 16 bp, H. sapiens
aggttgcatgagctga

SEQ ID NO: 42507 - DNA, 16 bp, H. sapiens
aggttgcatgttcact

SEQ ID NO: 42508 - DNA, 16 bp, H. sapiens
aggttgccaatgctgg

SEQ ID NO: 42509 - DNA, 16 bp, H. sapiens
aggttgccatgagcca

SEQ ID NO: 42510 - DNA, 16 bp, H. sapiens
aggttgctgcaaaagt

SEQ ID NO: 42511 - DNA, 16 bp, H. sapiens
aggttgctgtgagtca

SEQ ID NO: 42512 - DNA, 16 bp, H. sapiens
aggttgctgttatttt

SEQ ID NO: 42513 - DNA, 16 bp, H. sapiens
aggttgctttgggtag

SEQ ID NO: 42514 - DNA, 16 bp, H. sapiens
aggttggaagaatttg

SEQ ID NO: 42515 - DNA, 19 bp, H. sapiens
aggttggagaagagagtaa

SEQ ID NO: 42516 - DNA, 16 bp, H. sapiens
aggttggagtacagtg

SEQ ID NO: 42517 - DNA, 16 bp, H. sapiens
aggttggagtgcaatg

SEQ ID NO: 42518 - DNA, 16 bp, H. sapiens
aggttggagtgcggtg

SEQ ID NO: 42519 - DNA, 16 bp, H. sapiens
aggttgggaagggtag

SEQ ID NO: 42520 - DNA, 16 bp, H. sapiens
aggttggggaccgctg

SEQ ID NO: 42521 - DNA, 16 bp, H. sapiens
aggttggggtgcagtg

SEQ ID NO: 42522 - DNA, 16 bp, H. sapiens
aggttggtctcagact

SEQ ID NO: 42523 - DNA, 16 bp, H. sapiens
aggttggttcatgaag

SEQ ID NO: 42524 - DNA, 16 bp, H. sapiens
aggttgtagtgggcca

SEQ ID NO: 42525 - DNA, 16 bp, H. sapiens
aggttgtatgtgtcta

SEQ ID NO: 42526 - DNA, 16 bp, H. sapiens
aggttgtggtgagcta

SEQ ID NO: 42527 - DNA, 16 bp, H. sapiens
aggttgttgccatgga

SEQ ID NO: 42528 - DNA, 16 bp, H. sapiens
aggttgtttagtttcc

SEQ ID NO: 42529 - DNA, 16 bp, H. sapiens
aggttgtttcttcact

SEQ ID NO: 42530 - DNA, 16 bp, H. sapiens
aggtttaaaacatttg

SEQ ID NO: 42531 - DNA, 16 bp, H. sapiens
aggtttaaagaaaaat

SEQ ID NO: 42532 - DNA, 16 bp, H. sapiens
aggtttaactctgaga

SEQ ID NO: 42533 - DNA, 16 bp, H. sapiens
aggtttaaggaaagaa

SEQ ID NO: 42534 - DNA, 16 bp, H. sapiens
aggtttaatcaactca

SEQ ID NO: 42535 - DNA, 16 bp, H. sapiens
aggtttacagaaaatt

SEQ ID NO: 42536 - DNA, 16 bp, H. sapiens
aggtttaggaggaaaa

SEQ ID NO: 42537 - DNA, 16 bp, H. sapiens
aggtttatcaatttta

SEQ ID NO: 42538 - DNA, 17 bp, H. sapiens
aggtttcaccatcttgg

SEQ ID NO: 42539 - DNA, 24 bp, H. sapiens
aggtttcaccatgttggccaggat

SEQ ID NO: 42540 - DNA, 17 bp, H. sapiens
aggtttcaccatgttgt

SEQ ID NO: 42541 - DNA, 16 bp, H. sapiens
aggtttccagctggaa

SEQ ID NO: 42542 - DNA, 16 bp, H. sapiens
aggtttctcaggtgat

SEQ ID NO: 42543 - DNA, 16 bp, H. sapiens
aggtttctccatgttg

SEQ ID NO: 42544 - DNA, 16 bp, H. sapiens
aggtttctggccagaa

SEQ ID NO: 42545 - DNA, 16 bp, H. sapiens
aggtttgaatcctggc

SEQ ID NO: 42546 - DNA, 16 bp, H. sapiens
aggtttgccaaagatc

SEQ ID NO: 42547 - DNA, 16 bp, H. sapiens
aggtttggaaacctcc

SEQ ID NO: 42548 - DNA, 16 bp, H. sapiens
aggtttggccatttta

SEQ ID NO: 42549 - DNA, 16 bp, H. sapiens
aggtttggggactcag

SEQ ID NO: 42550 - DNA, 16 bp, H. sapiens
aggtttgggtggggac

SEQ ID NO: 42551 - DNA, 16 bp, H. sapiens
aggtttgtagcctagg

SEQ ID NO: 42552 - DNA, 16 bp, H. sapiens
aggttttaaaaatgtt

SEQ ID NO: 42553 - DNA, 16 bp, H. sapiens
aggttttaagctctgc

SEQ ID NO: 42554 - DNA, 17 bp, H. sapiens
aggttttaagtttttga

SEQ ID NO: 42555 - DNA, 16 bp, H. sapiens
aggttttatccctggg

SEQ ID NO: 42556 - DNA, 16 bp, H. sapiens
aggttttattcattct

SEQ ID NO: 42557 - DNA, 16 bp, H. sapiens
aggttttcaccaaaaa

SEQ ID NO: 42558 - DNA, 17 bp, H. sapiens
aggttttcaccatgttg

SEQ ID NO: 42559 - DNA, 16 bp, H. sapiens
aggttttctgttttct

SEQ ID NO: 42560 - DNA, 16 bp, H. sapiens
aggttttcttcttggg

SEQ ID NO: 42561 - DNA, 16 bp, H. sapiens
aggttttgatagattg

SEQ ID NO: 42562 - DNA, 16 bp, H. sapiens
aggttttgctatgttg

SEQ ID NO: 42563 - DNA, 16 bp, H. sapiens
aggttttgctcttgtt

SEQ ID NO: 42564 - DNA, 16 bp, H. sapiens
aggttttggatttatt

SEQ ID NO: 42565 - DNA, 16 bp, H. sapiens
aggttttgggacttgg

SEQ ID NO: 42566 - DNA, 16 bp, H. sapiens
aggttttgggataggc

SEQ ID NO: 42567 - DNA, 16 bp, H. sapiens
aggttttgggggaaca

SEQ ID NO: 42568 - DNA, 16 bp, H. sapiens
aggttttggtttcagg

SEQ ID NO: 42569 - DNA, 16 bp, H. sapiens
aggttttgtttgttcc

SEQ ID NO: 42570 - DNA, 16 bp, H. sapiens
aggtttttaaaacaga

SEQ ID NO: 42571 - DNA, 16 bp, H. sapiens
aggtttttaaagaaaa

SEQ ID NO: 42572 - DNA, 16 bp, H. sapiens
aggtttttgattactg

SEQ ID NO: 42573 - DNA, 16 bp, H. sapiens
agtaaaaagatcagtg

SEQ ID NO: 42574 - DNA, 16 bp, H. sapiens
agtaaaaagctgaaca

SEQ ID NO: 42575 - DNA, 16 bp, H. sapiens
agtaaaaatacagtgt

SEQ ID NO: 42576 - DNA, 16 bp, H. sapiens
agtaaaaatatggcat

SEQ ID NO: 42577 - DNA, 16 bp, H. sapiens
agtaaaacaaaattat

SEQ ID NO: 42578 - DNA, 16 bp, H. sapiens
agtaaaacaggcaaaa

SEQ ID NO: 42579 - DNA, 16 bp, H. sapiens
agtaaaacctcattaa

SEQ ID NO: 42580 - DNA, 16 bp, H. sapiens
agtaaaagaaacagga

SEQ ID NO: 42581 - DNA, 16 bp, H. sapiens
agtaaaagactggtta

SEQ ID NO: 42582 - DNA, 16 bp, H. sapiens
agtaaaagaggaagtc

SEQ ID NO: 42583 - DNA, 16 bp, H. sapiens
agtaaaagccatctat

SEQ ID NO: 42584 - DNA, 16 bp, H. sapiens
agtaaaataagggtga

SEQ ID NO: 42585 - DNA, 16 bp, H. sapiens
agtaaaatagtggtta

SEQ ID NO: 42586 - DNA, 16 bp, H. sapiens
agtaaaatatacagaa

SEQ ID NO: 42587 - DNA, 16 bp, H. sapiens
agtaaaatattttgtt

SEQ ID NO: 42588 - DNA, 16 bp, H. sapiens
agtaaaatggataaat

SEQ ID NO: 42589 - DNA, 16 bp, H. sapiens
agtaaaattatctgtt

SEQ ID NO: 42590 - DNA, 16 bp, H. sapiens
agtaaaatttcaggat

SEQ ID NO: 42591 - DNA, 17 bp, H. sapiens
agtaaacagacaaccca

SEQ ID NO: 42592 - DNA, 16 bp, H. sapiens
agtaaacagacagcct

SEQ ID NO: 42593 - DNA, 16 bp, H. sapiens
agtaaacatacatgtg

SEQ ID NO: 42594 - DNA, 16 bp, H. sapiens
agtaaacatttaaatt

SEQ ID NO: 42595 - DNA, 16 bp, H. sapiens
agtaaacatttgaaaa

SEQ ID NO: 42596 - DNA, 16 bp, H. sapiens
agtaaacattttaaat

SEQ ID NO: 42597 - DNA, 16 bp, H. sapiens
agtaaacatttttaaa

SEQ ID NO: 42598 - DNA, 16 bp, H. sapiens
agtaaactaaggttaa

SEQ ID NO: 42599 - DNA, 16 bp, H. sapiens
agtaaactgaggccca

SEQ ID NO: 42600 - DNA, 16 bp, H. sapiens
agtaaactttaaaaag

SEQ ID NO: 42601 - DNA, 16 bp, H. sapiens
agtaaagaaaaaccca

SEQ ID NO: 42602 - DNA, 16 bp, H. sapiens
agtaaagaaagtggtt

SEQ ID NO: 42603 - DNA, 16 bp, H. sapiens
agtaaagacaggcata

SEQ ID NO: 42604 - DNA, 16 bp, H. sapiens
agtaaagagatggaga

SEQ ID NO: 42605 - DNA, 16 bp, H. sapiens
agtaaagcacttctca

SEQ ID NO: 42606 - DNA, 16 bp, H. sapiens
agtaaatacatttaaa

SEQ ID NO: 42607 - DNA, 16 bp, H. sapiens
agtaaatatttcaggc

SEQ ID NO: 42608 - DNA, 16 bp, H. sapiens
agtaaatattttagat

SEQ ID NO: 42609 - DNA, 16 bp, H. sapiens
agtaaatattttatga

SEQ ID NO: 42610 - DNA, 16 bp, H. sapiens
agtaaatattttcact

SEQ ID NO: 42611 - DNA, 16 bp, H. sapiens
agtaaatatttttggt

SEQ ID NO: 42612 - DNA, 16 bp, H. sapiens
agtaaatcccaagtaa

SEQ ID NO: 42613 - DNA, 16 bp, H. sapiens
agtaaatctattttta

SEQ ID NO: 42614 - DNA, 16 bp, H. sapiens
agtaaatgctcaacaa

SEQ ID NO: 42615 - DNA, 16 bp, H. sapiens
agtaaatggaaaacaa

SEQ ID NO: 42616 - DNA, 16 bp, H. sapiens
agtaaatggaaatata

SEQ ID NO: 42617 - DNA, 16 bp, H. sapiens
agtaaatggtgctggg

SEQ ID NO: 42618 - DNA, 16 bp, H. sapiens
agtaaatgtatgttta

SEQ ID NO: 42619 - DNA, 16 bp, H. sapiens
agtaaatgtttattaa

SEQ ID NO: 42620 - DNA, 16 bp, H. sapiens
agtaaatgtttctttt

SEQ ID NO: 42621 - DNA, 16 bp, H. sapiens
agtaaatttattttcc

SEQ ID NO: 42622 - DNA, 16 bp, H. sapiens
agtaaatttcaaatgt

SEQ ID NO: 42623 - DNA, 16 bp, H. sapiens
agtaaatttttagaga

SEQ ID NO: 42624 - DNA, 16 bp, H. sapiens
agtaacaaaaacagca

SEQ ID NO: 42625 - DNA, 16 bp, H. sapiens
agtaacaaatatggta

SEQ ID NO: 42626 - DNA, 16 bp, H. sapiens
agtaacaataacaata

SEQ ID NO: 42627 - DNA, 21 bp, H. sapiens
agtaacaatctgatctctctt

SEQ ID NO: 42628 - DNA, 16 bp, H. sapiens
agtaacagcagcagca

SEQ ID NO: 42629 - DNA, 16 bp, H. sapiens
agtaacagccattctg

SEQ ID NO: 42630 - DNA, 16 bp, H. sapiens
agtaacagtaaaataa

SEQ ID NO: 42631 - DNA, 16 bp, H. sapiens
agtaacatcaaaaatc

SEQ ID NO: 42632 - DNA, 16 bp, H. sapiens
agtaacattgaatgta

SEQ ID NO: 42633 - DNA, 17 bp, H. sapiens
agtaaccaaaacagcac

SEQ ID NO: 42634 - DNA, 18 bp, H. sapiens
agtaaccaaaacagcatg

SEQ ID NO: 42635 - DNA, 16 bp, H. sapiens
agtaaccacaacagca

SEQ ID NO: 42636 - DNA, 16 bp, H. sapiens
agtaaccaccattcta

SEQ ID NO: 42637 - DNA, 16 bp, H. sapiens
agtaactaaaacagca

SEQ ID NO: 42638 - DNA, 16 bp, H. sapiens
agtaactatttttttt

SEQ ID NO: 42639 - DNA, 16 bp, H. sapiens
agtaactgaaataaaa

SEQ ID NO: 42640 - DNA, 16 bp, H. sapiens
agtaactgaaatgaaa

SEQ ID NO: 42641 - DNA, 16 bp, H. sapiens
agtaactggaactaca

SEQ ID NO: 42642 - DNA, 16 bp, H. sapiens
agtaactgggactaca

SEQ ID NO: 42643 - DNA, 17 bp, H. sapiens
agtaactgggattacag

SEQ ID NO: 42644 - DNA, 16 bp, H. sapiens
agtaacttgcccagga

SEQ ID NO: 42645 - DNA, 16 bp, H. sapiens
agtaagaaaatatttt

SEQ ID NO: 42646 - DNA, 16 bp, H. sapiens
agtaagaccccatctc

SEQ ID NO: 42647 - DNA, 16 bp, H. sapiens
agtaagaccctatctc

SEQ ID NO: 42648 - DNA, 16 bp, H. sapiens
agtaagactctgtctc

SEQ ID NO: 42649 - DNA, 16 bp, H. sapiens
agtaagagaggaagtc

SEQ ID NO: 42650 - DNA, 16 bp, H. sapiens
agtaagagattaacaa

SEQ ID NO: 42651 - DNA, 16 bp, H. sapiens
agtaagatgatatctc

SEQ ID NO: 42652 - DNA, 16 bp, H. sapiens
agtaagcactcaataa

SEQ ID NO: 42653 - DNA, 16 bp, H. sapiens
agtaagccccagtgtc

SEQ ID NO: 42654 - DNA, 16 bp, H. sapiens
agtaaggaaactgatg

SEQ ID NO: 42655 - DNA, 16 bp, H. sapiens
agtaaggacattaaaa

SEQ ID NO: 42656 - DNA, 16 bp, H. sapiens
agtaaggatacagaag

SEQ ID NO: 42657 - DNA, 16 bp, H. sapiens
agtaaggtcacattca

SEQ ID NO: 42658 - DNA, 16 bp, H. sapiens
agtaagtaagtaagta

SEQ ID NO: 42659 - DNA, 16 bp, H. sapiens
agtaagtacttaataa

SEQ ID NO: 42660 - DNA, 16 bp, H. sapiens
agtaagtatttattga

SEQ ID NO: 42661 - DNA, 16 bp, H. sapiens
agtaagtgctcagtaa

SEQ ID NO: 42662 - DNA, 16 bp, H. sapiens
agtaagttctcaataa

SEQ ID NO: 42663 - DNA, 16 bp, H. sapiens
agtaagttgcagacat

SEQ ID NO: 42664 - DNA, 16 bp, H. sapiens
agtaataacaacagta

SEQ ID NO: 42665 - DNA, 16 bp, H. sapiens
agtaatatatgttcat

SEQ ID NO: 42666 - DNA, 16 bp, H. sapiens
agtaatatcaaagatc

SEQ ID NO: 42667 - DNA, 16 bp, H. sapiens
agtaatatcatcctct

SEQ ID NO: 42668 - DNA, 16 bp, H. sapiens
agtaatcaagttaaaa

SEQ ID NO: 42669 - DNA, 16 bp, H. sapiens
agtaatcccagctact

SEQ ID NO: 42670 - DNA, 16 bp, H. sapiens
agtaatcctcccacct

SEQ ID NO: 42671 - DNA, 16 bp, H. sapiens
agtaatcctcctgccc

SEQ ID NO: 42672 - DNA, 16 bp, H. sapiens
agtaatgaagacagtg

SEQ ID NO: 42673 - DNA, 16 bp, H. sapiens
agtaatgaagagccaa

SEQ ID NO: 42674 - DNA, 16 bp, H. sapiens
agtaatgatgataata

SEQ ID NO: 42675 - DNA, 16 bp, H. sapiens
agtaatgcaaattaaa

SEQ ID NO: 42676 - DNA, 16 bp, H. sapiens
agtaatgcttgcttgc

SEQ ID NO: 42677 - DNA, 16 bp, H. sapiens
agtaatgtgatgtctc

SEQ ID NO: 42678 - DNA, 16 bp, H. sapiens
agtaatgtgcccaagg

SEQ ID NO: 42679 - DNA, 16 bp, H. sapiens
agtaattatttgttaa

SEQ ID NO: 42680 - DNA, 16 bp, H. sapiens
agtaattctcccacct

SEQ ID NO: 42681 - DNA, 16 bp, H. sapiens
agtaattggagaagtt

SEQ ID NO: 42682 - DNA, 16 bp, H. sapiens
agtaatttaaaataca

SEQ ID NO: 42683 - DNA, 16 bp, H. sapiens
agtaatttaatcatgg

SEQ ID NO: 42684 - DNA, 16 bp, H. sapiens
agtaatttatagaatc

SEQ ID NO: 42685 - DNA, 16 bp, H. sapiens
agtaatttgcccaaaa

SEQ ID NO: 42686 - DNA, 16 bp, H. sapiens
agtaatttgtagattc

SEQ ID NO: 42687 - DNA, 16 bp, H. sapiens
agtacaatatcacaat

SEQ ID NO: 42688 - DNA, 16 bp, H. sapiens
agtacaatggcatgat

SEQ ID NO: 42689 - DNA, 16 bp, H. sapiens
agtacagaatcaagtt

SEQ ID NO: 42690 - DNA, 16 bp, H. sapiens
agtacagacgggtttc

SEQ ID NO: 42691 - DNA, 16 bp, H. sapiens
agtacagagaattccc

SEQ ID NO: 42692 - DNA, 16 bp, H. sapiens
agtacagatttttttt

SEQ ID NO: 42693 - DNA, 16 bp, H. sapiens
agtacagcagcatgat

SEQ ID NO: 42694 - DNA, 16 bp, H. sapiens
agtacaggcgcacacc

SEQ ID NO: 42695 - DNA, 16 bp, H. sapiens
agtacagggcctggca

SEQ ID NO: 42696 - DNA, 16 bp, H. sapiens
agtacagtggcactgt

SEQ ID NO: 42697 - DNA, 16 bp, H. sapiens
agtacagtggcatgat

SEQ ID NO: 42698 - DNA, 16 bp, H. sapiens
agtacagtggtacgat

SEQ ID NO: 42699 - DNA, 16 bp, H. sapiens
agtacagtggtatgat

SEQ ID NO: 42700 - DNA, 16 bp, H. sapiens
agtacagtggtgagat

SEQ ID NO: 42701 - DNA, 16 bp, H. sapiens
agtacagtggtgtaat

SEQ ID NO: 42702 - DNA, 16 bp, H. sapiens
agtacagtgttgcaat

SEQ ID NO: 42703 - DNA, 16 bp, H. sapiens
agtacagtttgaaatc

SEQ ID NO: 42704 - DNA, 16 bp, H. sapiens
agtacataaacagata

SEQ ID NO: 42705 - DNA, 16 bp, H. sapiens
agtacatcaaaaagat

SEQ ID NO: 42706 - DNA, 16 bp, H. sapiens
agtacatttttaaaaa

SEQ ID NO: 42707 - DNA, 16 bp, H. sapiens
agtacatttttattca

SEQ ID NO: 42708 - DNA, 16 bp, H. sapiens
agtaccagcccagagc

SEQ ID NO: 42709 - DNA, 16 bp, H. sapiens
agtaccatattgtttt

SEQ ID NO: 42710 - DNA, 16 bp, H. sapiens
agtacccaatagtttt

SEQ ID NO: 42711 - DNA, 16 bp, H. sapiens
agtacctacctcacag

SEQ ID NO: 42712 - DNA, 16 bp, H. sapiens
agtacctactgtgtgt

SEQ ID NO: 42713 - DNA, 16 bp, H. sapiens
agtacctagaacagtg

SEQ ID NO: 42714 - DNA, 16 bp, H. sapiens
agtacctaggactaca

SEQ ID NO: 42715 - DNA, 16 bp, H. sapiens
agtacctcaggatgtg

SEQ ID NO: 42716 - DNA, 16 bp, H. sapiens
agtacctggaaaatcg

SEQ ID NO: 42717 - DNA, 16 bp, H. sapiens
agtacctggcacaaag

SEQ ID NO: 42718 - DNA, 16 bp, H. sapiens
agtacctggcactaca

SEQ ID NO: 42719 - DNA, 16 bp, H. sapiens
agtacctggcatgtag

SEQ ID NO: 42720 - DNA, 17 bp, H. sapiens
agtacctgggactacag

SEQ ID NO: 42721 - DNA, 17 bp, H. sapiens
agtacctgggattacag

SEQ ID NO: 42722 - DNA, 16 bp, H. sapiens
agtaccttttcatata

SEQ ID NO: 42723 - DNA, 16 bp, H. sapiens
agtacgagaccagcct

SEQ ID NO: 42724 - DNA, 16 bp, H. sapiens
agtactaaataaatat

SEQ ID NO: 42725 - DNA, 16 bp, H. sapiens
agtactaaatatggaa

SEQ ID NO: 42726 - DNA, 16 bp, H. sapiens
agtactatgttgaata

SEQ ID NO: 42727 - DNA, 16 bp, H. sapiens
agtactcactcactat

SEQ ID NO: 42728 - DNA, 16 bp, H. sapiens
agtactcagagggaag

SEQ ID NO: 42729 - DNA, 20 bp, H. sapiens
agtactcttaaagcaatccc

SEQ ID NO: 42730 - DNA, 16 bp, H. sapiens
agtactcttaagcaat

SEQ ID NO: 42731 - DNA, 16 bp, H. sapiens
agtactgaaagaaaat

SEQ ID NO: 42732 - DNA, 16 bp, H. sapiens
agtactgaataatatt

SEQ ID NO: 42733 - DNA, 16 bp, H. sapiens
agtactgcctggctac

SEQ ID NO: 42734 - DNA, 16 bp, H. sapiens
agtactggaagtccta

SEQ ID NO: 42735 - DNA, 16 bp, H. sapiens
agtacttcatattttt

SEQ ID NO: 42736 - DNA, 16 bp, H. sapiens
agtactttttaaagct

SEQ ID NO: 42737 - DNA, 16 bp, H. sapiens
agtagaaaaatatttt

SEQ ID NO: 42738 - DNA, 16 bp, H. sapiens
agtagaaaacaaatag

SEQ ID NO: 42739 - DNA, 16 bp, H. sapiens
agtagaaaatatttgc

SEQ ID NO: 42740 - DNA, 16 bp, H. sapiens
agtagaaactgtactt

SEQ ID NO: 42741 - DNA, 16 bp, H. sapiens
agtagaaatgatacca

SEQ ID NO: 42742 - DNA, 16 bp, H. sapiens
agtagaactacaaaac

SEQ ID NO: 42743 - DNA, 16 bp, H. sapiens
agtagaagaaaatatt

SEQ ID NO: 42744 - DNA, 16 bp, H. sapiens
agtagaaggatggtta

SEQ ID NO: 42745 - DNA, 16 bp, H. sapiens
agtagaataaaactag

SEQ ID NO: 42746 - DNA, 16 bp, H. sapiens
agtagaatgatttaaa

SEQ ID NO: 42747 - DNA, 16 bp, H. sapiens
agtagaatttctatat

SEQ ID NO: 42748 - DNA, 16 bp, H. sapiens
agtagacactggagac

SEQ ID NO: 42749 - DNA, 16 bp, H. sapiens
agtagacatttttcca

SEQ ID NO: 42750 - DNA, 16 bp, H. sapiens
agtagagaaggggttt

SEQ ID NO: 42751 - DNA, 16 bp, H. sapiens
agtagagacagaggtt

SEQ ID NO: 42752 - DNA, 16 bp, H. sapiens
agtagagacggagttt

SEQ ID NO: 42753 - DNA, 16 bp, H. sapiens
agtagagacggggctt

SEQ ID NO: 42754 - DNA, 28 bp, H. sapiens
agtagagacggggtttcaccgttttagc

SEQ ID NO: 42755 - DNA, 16 bp, H. sapiens
agtagagagggggttt

SEQ ID NO: 42756 - DNA, 16 bp, H. sapiens
agtagagatcatgcca

SEQ ID NO: 42757 - DNA, 16 bp, H. sapiens
agtagagatgcagttt

SEQ ID NO: 42758 - DNA, 16 bp, H. sapiens
agtagagatggttttc

SEQ ID NO: 42759 - DNA, 16 bp, H. sapiens
agtagagattgagttt

SEQ ID NO: 42760 - DNA, 16 bp, H. sapiens
agtagaggccagggat

SEQ ID NO: 42761 - DNA, 16 bp, H. sapiens
agtagagtattgaagt

SEQ ID NO: 42762 - DNA, 16 bp, H. sapiens
agtagagtgaaatatt

SEQ ID NO: 42763 - DNA, 16 bp, H. sapiens
agtagagttgggtttt

SEQ ID NO: 42764 - DNA, 16 bp, H. sapiens
agtagataacttgttt

SEQ ID NO: 42765 - DNA, 16 bp, H. sapiens
agtagatacagggttt

SEQ ID NO: 42766 - DNA, 16 bp, H. sapiens
agtagatgaagaaaat

SEQ ID NO: 42767 - DNA, 16 bp, H. sapiens
agtagatgctattatt

SEQ ID NO: 42768 - DNA, 16 bp, H. sapiens
agtagatgggactaca

SEQ ID NO: 42769 - DNA, 16 bp, H. sapiens
agtagatgggattaca

SEQ ID NO: 42770 - DNA, 16 bp, H. sapiens
agtagatgtctaaaat

SEQ ID NO: 42771 - DNA, 16 bp, H. sapiens
agtagatgttcaataa

SEQ ID NO: 42772 - DNA, 16 bp, H. sapiens
agtagatttgtttaca

SEQ ID NO: 42773 - DNA, 16 bp, H. sapiens
agtagatttttctaat

SEQ ID NO: 42774 - DNA, 18 bp, H. sapiens
agtagcaagatttattgc

SEQ ID NO: 42775 - DNA, 16 bp, H. sapiens
agtagcagcagcagta

SEQ ID NO: 42776 - DNA, 16 bp, H. sapiens
agtagcagctaatatt

SEQ ID NO: 42777 - DNA, 16 bp, H. sapiens
agtagcagggactaca

SEQ ID NO: 42778 - DNA, 16 bp, H. sapiens
agtagcagggattaca

SEQ ID NO: 42779 - DNA, 16 bp, H. sapiens
agtagcagtagcagca

SEQ ID NO: 42780 - DNA, 16 bp, H. sapiens
agtagcattaaaaaaa

SEQ ID NO: 42781 - DNA, 16 bp, H. sapiens
agtagcattatttata

SEQ ID NO: 42782 - DNA, 16 bp, H. sapiens
agtagcattccatggt

SEQ ID NO: 42783 - DNA, 16 bp, H. sapiens
agtagccagagaaaaa

SEQ ID NO: 42784 - DNA, 16 bp, H. sapiens
agtagccaggactaca

SEQ ID NO: 42785 - DNA, 16 bp, H. sapiens
agtagccaggactgca

SEQ ID NO: 42786 - DNA, 16 bp, H. sapiens
agtagccaggattaca

SEQ ID NO: 42787 - DNA, 16 bp, H. sapiens
agtagccagggagtgg

SEQ ID NO: 42788 - DNA, 16 bp, H. sapiens
agtagccattatttta

SEQ ID NO: 42789 - DNA, 16 bp, H. sapiens
agtagccgggactaca

SEQ ID NO: 42790 - DNA, 17 bp, H. sapiens
agtagccgggattacag

SEQ ID NO: 42791 - DNA, 16 bp, H. sapiens
agtagcctaaatgaca

SEQ ID NO: 42792 - DNA, 16 bp, H. sapiens
agtagctaagactaca

SEQ ID NO: 42793 - DNA, 16 bp, H. sapiens
agtagctaggaccaca

SEQ ID NO: 42794 - DNA, 16 bp, H. sapiens
agtagctaggactaca

SEQ ID NO: 42795 - DNA, 16 bp, H. sapiens
agtagctaggactata

SEQ ID NO: 42796 - DNA, 16 bp, H. sapiens
agtagctaggactgca

SEQ ID NO: 42797 - DNA, 16 bp, H. sapiens
agtagctaggactgta

SEQ ID NO: 42798 - DNA, 17 bp, H. sapiens
agtagctaggattacag

SEQ ID NO: 42799 - DNA, 17 bp, H. sapiens
agtagctcacgcctgta

SEQ ID NO: 42800 - DNA, 16 bp, H. sapiens
agtagctcagattaca

SEQ ID NO: 42801 - DNA, 17 bp, H. sapiens
agtagctcggactacag

SEQ ID NO: 42802 - DNA, 16 bp, H. sapiens
agtagctgaaactaca

SEQ ID NO: 42803 - DNA, 16 bp, H. sapiens
agtagctgagactaca

SEQ ID NO: 42804 - DNA, 16 bp, H. sapiens
agtagctgagactacc

SEQ ID NO: 42805 - DNA, 16 bp, H. sapiens
agtagctgagactata

SEQ ID NO: 42806 - DNA, 16 bp, H. sapiens
agtagctgagatgaca

SEQ ID NO: 42807 - DNA, 16 bp, H. sapiens
agtagctgagattaaa

SEQ ID NO: 42808 - DNA, 17 bp, H. sapiens
agtagctgagattacag

SEQ ID NO: 42809 - DNA, 16 bp, H. sapiens
agtagctgagattata

SEQ ID NO: 42810 - DNA, 16 bp, H. sapiens
agtagctgaggccaca

SEQ ID NO: 42811 - DNA, 16 bp, H. sapiens
agtagctgatactaca

SEQ ID NO: 42812 - DNA, 16 bp, H. sapiens
agtagctgcaactaca

SEQ ID NO: 42813 - DNA, 17 bp, H. sapiens
agtagctgcaattacag

SEQ ID NO: 42814 - DNA, 17 bp, H. sapiens
agtagctgcgactacag

SEQ ID NO: 42815 - DNA, 16 bp, H. sapiens
agtagctgctcaataa

SEQ ID NO: 42816 - DNA, 16 bp, H. sapiens
agtagctggaactaca

SEQ ID NO: 42817 - DNA, 16 bp, H. sapiens
agtagctggaactata

SEQ ID NO: 42818 - DNA, 16 bp, H. sapiens
agtagctggaatgaca

SEQ ID NO: 42819 - DNA, 17 bp, H. sapiens
agtagctggaattacaa

SEQ ID NO: 42820 - DNA, 17 bp, H. sapiens
agtagctggaattacag

SEQ ID NO: 42821 - DNA, 16 bp, H. sapiens
agtagctggaattacg

SEQ ID NO: 42822 - DNA, 17 bp, H. sapiens
agtagctggaattgcag

SEQ ID NO: 42823 - DNA, 16 bp, H. sapiens
agtagctggattacag

SEQ ID NO: 42824 - DNA, 16 bp, H. sapiens
agtagctggcactaca

SEQ ID NO: 42825 - DNA, 16 bp, H. sapiens
agtagctggcattaca

SEQ ID NO: 42826 - DNA, 16 bp, H. sapiens
agtagctgggaataca

SEQ ID NO: 42827 - DNA, 16 bp, H. sapiens
agtagctgggaatata

SEQ ID NO: 42828 - DNA, 16 bp, H. sapiens
agtagctgggacaaca

SEQ ID NO: 42829 - DNA, 16 bp, H. sapiens
agtagctgggaccaca

SEQ ID NO: 42830 - DNA, 16 bp, H. sapiens
agtagctgggaccata

SEQ ID NO: 42831 - DNA, 16 bp, H. sapiens
agtagctgggacgaca

SEQ ID NO: 42832 - DNA, 17 bp, H. sapiens
agtagctgggactacaa

SEQ ID NO: 42833 - DNA, 17 bp, H. sapiens
agtagctgggactacag

SEQ ID NO: 42834 - DNA, 16 bp, H. sapiens
agtagctgggactacc

SEQ ID NO: 42835 - DNA, 16 bp, H. sapiens
agtagctgggactacg

SEQ ID NO: 42836 - DNA, 16 bp, H. sapiens
agtagctgggactact

SEQ ID NO: 42837 - DNA, 16 bp, H. sapiens
agtagctgggactaga

SEQ ID NO: 42838 - DNA, 16 bp, H. sapiens
agtagctgggactata

SEQ ID NO: 42839 - DNA, 16 bp, H. sapiens
agtagctgggactatg

SEQ ID NO: 42840 - DNA, 16 bp, H. sapiens
agtagctgggactcca

SEQ ID NO: 42841 - DNA, 16 bp, H. sapiens
agtagctgggactgca

SEQ ID NO: 42842 - DNA, 16 bp, H. sapiens
agtagctgggacttca

SEQ ID NO: 42843 - DNA, 16 bp, H. sapiens
agtagctgggacttta

SEQ ID NO: 42844 - DNA, 16 bp, H. sapiens
agtagctgggagcaca

SEQ ID NO: 42845 - DNA, 16 bp, H. sapiens
agtagctgggagtgca

SEQ ID NO: 42846 - DNA, 17 bp, H. sapiens
agtagctgggatcacag

SEQ ID NO: 42847 - DNA, 16 bp, H. sapiens
agtagctgggatgaca

SEQ ID NO: 42848 - DNA, 17 bp, H. sapiens
agtagctgggattacaa

SEQ ID NO: 42849 - DNA, 17 bp, H. sapiens
agtagctgggattacac

SEQ ID NO: 42850 - DNA, 17 bp, H. sapiens
agtagctgggattacag

SEQ ID NO: 42851 - DNA, 16 bp, H. sapiens
agtagctgggattacc

SEQ ID NO: 42852 - DNA, 16 bp, H. sapiens
agtagctgggattacg

SEQ ID NO: 42853 - DNA, 16 bp, H. sapiens
agtagctgggattact

SEQ ID NO: 42854 - DNA, 16 bp, H. sapiens
agtagctgggattaga

SEQ ID NO: 42855 - DNA, 17 bp, H. sapiens
agtagctgggattatag

SEQ ID NO: 42856 - DNA, 16 bp, H. sapiens
agtagctgggattatg

SEQ ID NO: 42857 - DNA, 16 bp, H. sapiens
agtagctgggattatt

SEQ ID NO: 42858 - DNA, 16 bp, H. sapiens
agtagctgggattcca

SEQ ID NO: 42859 - DNA, 16 bp, H. sapiens
agtagctgggattgca

SEQ ID NO: 42860 - DNA, 16 bp, H. sapiens
agtagctgggattgta

SEQ ID NO: 42861 - DNA, 16 bp, H. sapiens
agtagctgggatttta

SEQ ID NO: 42862 - DNA, 16 bp, H. sapiens
agtagctggggctaca

SEQ ID NO: 42863 - DNA, 17 bp, H. sapiens
agtagctggggttacag

SEQ ID NO: 42864 - DNA, 17 bp, H. sapiens
agtagctgggtttacag

SEQ ID NO: 42865 - DNA, 17 bp, H. sapiens
agtagctggtactacag

SEQ ID NO: 42866 - DNA, 16 bp, H. sapiens
agtagctggtactaga

SEQ ID NO: 42867 - DNA, 17 bp, H. sapiens
agtagctggtattacag

SEQ ID NO: 42868 - DNA, 16 bp, H. sapiens
agtagctgtaactaca

SEQ ID NO: 42869 - DNA, 16 bp, H. sapiens
agtagctgtgactaca

SEQ ID NO: 42870 - DNA, 17 bp, H. sapiens
agtagctgtgattacag

SEQ ID NO: 42871 - DNA, 16 bp, H. sapiens
agtagctgtgattgca

SEQ ID NO: 42872 - DNA, 16 bp, H. sapiens
agtagcttacgcctgt

SEQ ID NO: 42873 - DNA, 16 bp, H. sapiens
agtagcttggactata

SEQ ID NO: 42874 - DNA, 16 bp, H. sapiens
agtagcttggattaca

SEQ ID NO: 42875 - DNA, 16 bp, H. sapiens
agtagcttgggactac

SEQ ID NO: 42876 - DNA, 16 bp, H. sapiens
agtagctttaaaaaaa

SEQ ID NO: 42877 - DNA, 16 bp, H. sapiens
agtaggagcaagagag

SEQ ID NO: 42878 - DNA, 16 bp, H. sapiens
agtaggcaaagaatat

SEQ ID NO: 42879 - DNA, 16 bp, H. sapiens
agtaggcatttaataa

SEQ ID NO: 42880 - DNA, 16 bp, H. sapiens
agtaggctgaggtggg

SEQ ID NO: 42881 - DNA, 16 bp, H. sapiens
agtaggtaggactaca

SEQ ID NO: 42882 - DNA, 16 bp, H. sapiens
agtaggtattcaataa

SEQ ID NO: 42883 - DNA, 16 bp, H. sapiens
agtaggtctgggatgg

SEQ ID NO: 42884 - DNA, 16 bp, H. sapiens
agtaggtgctcaaaat

SEQ ID NO: 42885 - DNA, 16 bp, H. sapiens
agtaggtgcttaatat

SEQ ID NO: 42886 - DNA, 16 bp, H. sapiens
agtaggtgcttactaa

SEQ ID NO: 42887 - DNA, 16 bp, H. sapiens
agtaggtgggaccaca

SEQ ID NO: 42888 - DNA, 17 bp, H. sapiens
agtaggtgggactacag

SEQ ID NO: 42889 - DNA, 17 bp, H. sapiens
agtaggtgggattacag

SEQ ID NO: 42890 - DNA, 16 bp, H. sapiens
agtaggtgttcaacaa

SEQ ID NO: 42891 - DNA, 16 bp, H. sapiens
agtaggtttggtttct

SEQ ID NO: 42892 - DNA, 16 bp, H. sapiens
agtagtagcagcagca

SEQ ID NO: 42893 - DNA, 16 bp, H. sapiens
agtagtatgaacattt

SEQ ID NO: 42894 - DNA, 16 bp, H. sapiens
agtagtattccactgt

SEQ ID NO: 42895 - DNA, 16 bp, H. sapiens
agtagtcattcaggag

SEQ ID NO: 42896 - DNA, 16 bp, H. sapiens
agtagtcccagctact

SEQ ID NO: 42897 - DNA, 16 bp, H. sapiens
agtagtccccccttat

SEQ ID NO: 42898 - DNA, 16 bp, H. sapiens
agtagtctccccttat

SEQ ID NO: 42899 - DNA, 16 bp, H. sapiens
agtagtcttttcaaca

SEQ ID NO: 42900 - DNA, 16 bp, H. sapiens
agtagtgggattacag

SEQ ID NO: 42901 - DNA, 16 bp, H. sapiens
agtagtgttctggaat

SEQ ID NO: 42902 - DNA, 16 bp, H. sapiens
agtagttactgaataa

SEQ ID NO: 42903 - DNA, 16 bp, H. sapiens
agtagttcattctttt

SEQ ID NO: 42904 - DNA, 16 bp, H. sapiens
agtagttcccccttat

SEQ ID NO: 42905 - DNA, 16 bp, H. sapiens
agtagttctcaaagag

SEQ ID NO: 42906 - DNA, 16 bp, H. sapiens
agtagttctcaacagt

SEQ ID NO: 42907 - DNA, 16 bp, H. sapiens
agtagttctgcttttg

SEQ ID NO: 42908 - DNA, 16 bp, H. sapiens
agtagttgctacttct

SEQ ID NO: 42909 - DNA, 16 bp, H. sapiens
agtagttggaattata

SEQ ID NO: 42910 - DNA, 16 bp, H. sapiens
agtagttgggactaca

SEQ ID NO: 42911 - DNA, 17 bp, H. sapiens
agtagttgggattacag

SEQ ID NO: 42912 - DNA, 16 bp, H. sapiens
agtagtttttttaaaa

SEQ ID NO: 42913 - DNA, 16 bp, H. sapiens
agtagtttttttcaat

SEQ ID NO: 42914 - DNA, 16 bp, H. sapiens
agtataaaatacatac

SEQ ID NO: 42915 - DNA, 16 bp, H. sapiens
agtataacaacaacaa

SEQ ID NO: 42916 - DNA, 16 bp, H. sapiens
agtataactttttttt

SEQ ID NO: 42917 - DNA, 16 bp, H. sapiens
agtataataacaataa

SEQ ID NO: 42918 - DNA, 16 bp, H. sapiens
agtataatgatttata

SEQ ID NO: 42919 - DNA, 16 bp, H. sapiens
agtataatggcatgat

SEQ ID NO: 42920 - DNA, 16 bp, H. sapiens
agtatacaattcattg

SEQ ID NO: 42921 - DNA, 16 bp, H. sapiens
agtatacacatacaca

SEQ ID NO: 42922 - DNA, 16 bp, H. sapiens
agtatactctgtgatg

SEQ ID NO: 42923 - DNA, 16 bp, H. sapiens
agtatagctactcctt

SEQ ID NO: 42924 - DNA, 16 bp, H. sapiens
agtataggtttgaaaa

SEQ ID NO: 42925 - DNA, 16 bp, H. sapiens
agtatatagaaatgca

SEQ ID NO: 42926 - DNA, 16 bp, H. sapiens
agtatatataaataca

SEQ ID NO: 42927 - DNA, 16 bp, H. sapiens
agtatatcaaagagct

SEQ ID NO: 42928 - DNA, 16 bp, H. sapiens
agtatatcactgatgg

SEQ ID NO: 42929 - DNA, 16 bp, H. sapiens
agtatatgaaaatatg

SEQ ID NO: 42930 - DNA, 16 bp, H. sapiens
agtatatgtttttaaa

SEQ ID NO: 42931 - DNA, 16 bp, H. sapiens
agtatattgaagaaat

SEQ ID NO: 42932 - DNA, 16 bp, H. sapiens
agtatattttgaagtc

SEQ ID NO: 42933 - DNA, 16 bp, H. sapiens
agtatattttgaagtt

SEQ ID NO: 42934 - DNA, 16 bp, H. sapiens
agtatcaaaaagaata

SEQ ID NO: 42935 - DNA, 16 bp, H. sapiens
agtatcatgttgtttt

SEQ ID NO: 42936 - DNA, 16 bp, H. sapiens
agtatcattttaaaat

SEQ ID NO: 42937 - DNA, 16 bp, H. sapiens
agtatccagaatctat

SEQ ID NO: 42938 - DNA, 16 bp, H. sapiens
agtatctaggactaca

SEQ ID NO: 42939 - DNA, 16 bp, H. sapiens
agtatctcacatttaa

SEQ ID NO: 42940 - DNA, 16 bp, H. sapiens
agtatctgagattaca

SEQ ID NO: 42941 - DNA, 16 bp, H. sapiens
agtatctgcaaatgga

SEQ ID NO: 42942 - DNA, 16 bp, H. sapiens
agtatctgggactaca

SEQ ID NO: 42943 - DNA, 17 bp, H. sapiens
agtatctgggattacag

SEQ ID NO: 42944 - DNA, 16 bp, H. sapiens
agtatctgggattata

SEQ ID NO: 42945 - DNA, 16 bp, H. sapiens
agtatctgttgttttt

SEQ ID NO: 42946 - DNA, 16 bp, H. sapiens
agtatctttaataaat

SEQ ID NO: 42947 - DNA, 16 bp, H. sapiens
agtatgaaaatacatt

SEQ ID NO: 42948 - DNA, 16 bp, H. sapiens
agtatgacaactattt

SEQ ID NO: 42949 - DNA, 16 bp, H. sapiens
agtatgagaatgaact

SEQ ID NO: 42950 - DNA, 16 bp, H. sapiens
agtatgagttctccaa

SEQ ID NO: 42951 - DNA, 16 bp, H. sapiens
agtatgcaccaccaca

SEQ ID NO: 42952 - DNA, 16 bp, H. sapiens
agtatggaaagggaaa

SEQ ID NO: 42953 - DNA, 16 bp, H. sapiens
agtatggaatgttctt

SEQ ID NO: 42954 - DNA, 16 bp, H. sapiens
agtatgggagaaaata

SEQ ID NO: 42955 - DNA, 16 bp, H. sapiens
agtatgtaaattatat

SEQ ID NO: 42956 - DNA, 16 bp, H. sapiens
agtatgtattcttttt

SEQ ID NO: 42957 - DNA, 16 bp, H. sapiens
agtatgtgcaaaggcc

SEQ ID NO: 42958 - DNA, 16 bp, H. sapiens
agtatgtggtaatttg

SEQ ID NO: 42959 - DNA, 16 bp, H. sapiens
agtatgttttcatttt

SEQ ID NO: 42960 - DNA, 16 bp, H. sapiens
agtattaagagggaaa

SEQ ID NO: 42961 - DNA, 16 bp, H. sapiens
agtattagaaaaatgt

SEQ ID NO: 42962 - DNA, 16 bp, H. sapiens
agtattaggaggtggg

SEQ ID NO: 42963 - DNA, 16 bp, H. sapiens
agtattagggtggaag

SEQ ID NO: 42964 - DNA, 16 bp, H. sapiens
agtattatacagaata

SEQ ID NO: 42965 - DNA, 16 bp, H. sapiens
agtattattattacta

SEQ ID NO: 42966 - DNA, 16 bp, H. sapiens
agtattattcacaaca

SEQ ID NO: 42967 - DNA, 16 bp, H. sapiens
agtattattgactata

SEQ ID NO: 42968 - DNA, 16 bp, H. sapiens
agtattcaaaaatcaa

SEQ ID NO: 42969 - DNA, 16 bp, H. sapiens
agtattcatattttaa

SEQ ID NO: 42970 - DNA, 16 bp, H. sapiens
agtattcatttttaaa

SEQ ID NO: 42971 - DNA, 16 bp, H. sapiens
agtattccccttgaaa

SEQ ID NO: 42972 - DNA, 16 bp, H. sapiens
agtattctataaatgt

SEQ ID NO: 42973 - DNA, 16 bp, H. sapiens
agtattctctcatggt

SEQ ID NO: 42974 - DNA, 16 bp, H. sapiens
agtattctggaatcct

SEQ ID NO: 42975 - DNA, 16 bp, H. sapiens
agtattcttaacttat

SEQ ID NO: 42976 - DNA, 16 bp, H. sapiens
agtattgatacattat

SEQ ID NO: 42977 - DNA, 16 bp, H. sapiens
agtattggcataaaaa

SEQ ID NO: 42978 - DNA, 16 bp, H. sapiens
agtattgggattacag

SEQ ID NO: 42979 - DNA, 16 bp, H. sapiens
agtattgtttgaagtt

SEQ ID NO: 42980 - DNA, 16 bp, H. sapiens
agtatttatcatttct

SEQ ID NO: 42981 - DNA, 16 bp, H. sapiens
agtatttattctttgt

SEQ ID NO: 42982 - DNA, 16 bp, H. sapiens
agtatttattgatcat

SEQ ID NO: 42983 - DNA, 16 bp, H. sapiens
agtatttcaccattaa

SEQ ID NO: 42984 - DNA, 16 bp, H. sapiens
agtatttcagaatgtg

SEQ ID NO: 42985 - DNA, 16 bp, H. sapiens
agtatttcattgcatg

SEQ ID NO: 42986 - DNA, 16 bp, H. sapiens
agtatttcattgtata

SEQ ID NO: 42987 - DNA, 16 bp, H. sapiens
agtatttccattttaa

SEQ ID NO: 42988 - DNA, 16 bp, H. sapiens
agtatttcctcctctt

SEQ ID NO: 42989 - DNA, 16 bp, H. sapiens
agtatttcctcctttt

SEQ ID NO: 42990 - DNA, 16 bp, H. sapiens
agtatttctatatttt

SEQ ID NO: 42991 - DNA, 16 bp, H. sapiens
agtatttctttataac

SEQ ID NO: 42992 - DNA, 16 bp, H. sapiens
agtatttgagtataaa

SEQ ID NO: 42993 - DNA, 16 bp, H. sapiens
agtatttgggcagaag

SEQ ID NO: 42994 - DNA, 16 bp, H. sapiens
agtatttgtcattctg

SEQ ID NO: 42995 - DNA, 16 bp, H. sapiens
agtatttgtctaaaac

SEQ ID NO: 42996 - DNA, 16 bp, H. sapiens
agtatttgtgtgtgtg

SEQ ID NO: 42997 - DNA, 16 bp, H. sapiens
agtatttgttgaaaga

SEQ ID NO: 42998 - DNA, 16 bp, H. sapiens
agtattttaaagcaaa

SEQ ID NO: 42999 - DNA, 16 bp, H. sapiens
agtattttattaagga

SEQ ID NO: 43000 - DNA, 16 bp, H. sapiens
agtattttattatctt

SEQ ID NO: 43001 - DNA, 16 bp, H. sapiens
agtattttcattaaaa

SEQ ID NO: 43002 - DNA, 16 bp, H. sapiens
agtattttctcttcct

SEQ ID NO: 43003 - DNA, 16 bp, H. sapiens
agtattttgaactgaa

SEQ ID NO: 43004 - DNA, 16 bp, H. sapiens
agtattttgctgaaga

SEQ ID NO: 43005 - DNA, 16 bp, H. sapiens
agtattttgggaagct

SEQ ID NO: 43006 - DNA, 16 bp, H. sapiens
agtattttgttaagga

SEQ ID NO: 43007 - DNA, 16 bp, H. sapiens
agtattttgttgaaaa

SEQ ID NO: 43008 - DNA, 16 bp, H. sapiens
agtatttttaaagaaa

SEQ ID NO: 43009 - DNA, 16 bp, H. sapiens
agtatttttcttcctt

SEQ ID NO: 43010 - DNA, 16 bp, H. sapiens
agtatttttgccaaaa

SEQ ID NO: 43011 - DNA, 16 bp, H. sapiens
agtatttttgttgagg

SEQ ID NO: 43012 - DNA, 16 bp, H. sapiens
agtattttttgaaaaa

SEQ ID NO: 43013 - DNA, 16 bp, H. sapiens
agtatttttttgagga

SEQ ID NO: 43014 - DNA, 16 bp, H. sapiens
agtcaaaaaatcatga

SEQ ID NO: 43015 - DNA, 16 bp, H. sapiens
agtcaaaaactataaa

SEQ ID NO: 43016 - DNA, 16 bp, H. sapiens
agtcaaaaagtttaaa

SEQ ID NO: 43017 - DNA, 16 bp, H. sapiens
agtcaaaaatcaaggt

SEQ ID NO: 43018 - DNA, 16 bp, H. sapiens
agtcaaaagacaacag

SEQ ID NO: 43019 - DNA, 17 bp, H. sapiens
agtcaaaagctagcaga

SEQ ID NO: 43020 - DNA, 16 bp, H. sapiens
agtcaaaatgaaggaa

SEQ ID NO: 43021 - DNA, 16 bp, H. sapiens
agtcaaaccataaact

SEQ ID NO: 43022 - DNA, 16 bp, H. sapiens
agtcaaactctataaa

SEQ ID NO: 43023 - DNA, 16 bp, H. sapiens
agtcaaactgtcaaaa

SEQ ID NO: 43024 - DNA, 18 bp, H. sapiens
agtcaaagaaaggggtga

SEQ ID NO: 43025 - DNA, 16 bp, H. sapiens
agtcaaagaagaaata

SEQ ID NO: 43026 - DNA, 16 bp, H. sapiens
agtcaaagacaaagaa

SEQ ID NO: 43027 - DNA, 16 bp, H. sapiens
agtcaaagagaaagaa

SEQ ID NO: 43028 - DNA, 16 bp, H. sapiens
agtcaaagcaatcctg

SEQ ID NO: 43029 - DNA, 16 bp, H. sapiens
agtcaaatagtctctg

SEQ ID NO: 43030 - DNA, 16 bp, H. sapiens
agtcaaattatttttg

SEQ ID NO: 43031 - DNA, 16 bp, H. sapiens
agtcaaattctttctt

SEQ ID NO: 43032 - DNA, 16 bp, H. sapiens
agtcaaatttatcagt

SEQ ID NO: 43033 - DNA, 16 bp, H. sapiens
agtcaacaacaacaac

SEQ ID NO: 43034 - DNA, 16 bp, H. sapiens
agtcaacaggctaaga

SEQ ID NO: 43035 - DNA, 16 bp, H. sapiens
agtcaagaaacaaaag

SEQ ID NO: 43036 - DNA, 16 bp, H. sapiens
agtcaagacagtgtgg

SEQ ID NO: 43037 - DNA, 28 bp, H. sapiens
agtcaagacccatcagtgtgctgtattt

SEQ ID NO: 43038 - DNA, 16 bp, H. sapiens
agtcaagagattgaga

SEQ ID NO: 43039 - DNA, 16 bp, H. sapiens
agtcaagatgaggtca

SEQ ID NO: 43040 - DNA, 16 bp, H. sapiens
agtcaaggaaactttt

SEQ ID NO: 43041 - DNA, 16 bp, H. sapiens
agtcaaggaacatctg

SEQ ID NO: 43042 - DNA, 16 bp, H. sapiens
agtcaaggagcatcta

SEQ ID NO: 43043 - DNA, 16 bp, H. sapiens
agtcaaggctgcagta

SEQ ID NO: 43044 - DNA, 16 bp, H. sapiens
agtcaaggtgacacat

SEQ ID NO: 43045 - DNA, 16 bp, H. sapiens
agtcaataaaaccaaa

SEQ ID NO: 43046 - DNA, 16 bp, H. sapiens
agtcaatgatggactg

SEQ ID NO: 43047 - DNA, 16 bp, H. sapiens
agtcacaaaaggaaaa

SEQ ID NO: 43048 - DNA, 16 bp, H. sapiens
agtcacacagcaagta

SEQ ID NO: 43049 - DNA, 16 bp, H. sapiens
agtcacacataacaat

SEQ ID NO: 43050 - DNA, 16 bp, H. sapiens
agtcacatggccacac

SEQ ID NO: 43051 - DNA, 16 bp, H. sapiens
agtcacatgtctctca

SEQ ID NO: 43052 - DNA, 16 bp, H. sapiens
agtcaccacacctggt

SEQ ID NO: 43053 - DNA, 16 bp, H. sapiens
agtcaccactaaagaa

SEQ ID NO: 43054 - DNA, 16 bp, H. sapiens
agtcaccatgcctagc

SEQ ID NO: 43055 - DNA, 16 bp, H. sapiens
agtcaccatgcttggc

SEQ ID NO: 43056 - DNA, 16 bp, H. sapiens
agtcaccatgttgtgc

SEQ ID NO: 43057 - DNA, 16 bp, H. sapiens
agtcacctggggagct

SEQ ID NO: 43058 - DNA, 16 bp, H. sapiens
agtcactaagtttgtg

SEQ ID NO: 43059 - DNA, 16 bp, H. sapiens
agtcactccacctctc

SEQ ID NO: 43060 - DNA, 16 bp, H. sapiens
agtcactgcgcccggc

SEQ ID NO: 43061 - DNA, 16 bp, H. sapiens
agtcactgggttccat

SEQ ID NO: 43062 - DNA, 16 bp, H. sapiens
agtcactgtgcccagc

SEQ ID NO: 43063 - DNA, 16 bp, H. sapiens
agtcacttaaaaatat

SEQ ID NO: 43064 - DNA, 16 bp, H. sapiens
agtcactttccctctc

SEQ ID NO: 43065 - DNA, 16 bp, H. sapiens
agtcacttttttcttt

SEQ ID NO: 43066 - DNA, 16 bp, H. sapiens
agtcagaagacctgag

SEQ ID NO: 43067 - DNA, 16 bp, H. sapiens
agtcagaatggctttt

SEQ ID NO: 43068 - DNA, 16 bp, H. sapiens
agtcagaattcaaacc

SEQ ID NO: 43069 - DNA, 16 bp, H. sapiens
agtcagaattgctatt

SEQ ID NO: 43070 - DNA, 16 bp, H. sapiens
agtcagaatttgaacc

SEQ ID NO: 43071 - DNA, 16 bp, H. sapiens
agtcagaccccatctc

SEQ ID NO: 43072 - DNA, 16 bp, H. sapiens
agtcagaccctgtctc

SEQ ID NO: 43073 - DNA, 16 bp, H. sapiens
agtcagactccatctc

SEQ ID NO: 43074 - DNA, 16 bp, H. sapiens
agtcagactttttttt

SEQ ID NO: 43075 - DNA, 16 bp, H. sapiens
agtcagagaaaagaaa

SEQ ID NO: 43076 - DNA, 16 bp, H. sapiens
agtcagagaagaaaaa

SEQ ID NO: 43077 - DNA, 16 bp, H. sapiens
agtcagagagagagaa

SEQ ID NO: 43078 - DNA, 16 bp, H. sapiens
agtcagagagagagag

SEQ ID NO: 43079 - DNA, 16 bp, H. sapiens
agtcagagagatttga

SEQ ID NO: 43080 - DNA, 16 bp, H. sapiens
agtcagagcacacaca

SEQ ID NO: 43081 - DNA, 16 bp, H. sapiens
agtcagaggagaaaaa

SEQ ID NO: 43082 - DNA, 16 bp, H. sapiens
agtcagcaaccatcaa

SEQ ID NO: 43083 - DNA, 16 bp, H. sapiens
agtcagcattctccag

SEQ ID NO: 43084 - DNA, 16 bp, H. sapiens
agtcagccctgcagaa

SEQ ID NO: 43085 - DNA, 16 bp, H. sapiens
agtcaggaaaacagaa

SEQ ID NO: 43086 - DNA, 16 bp, H. sapiens
agtcaggaaacagcag

SEQ ID NO: 43087 - DNA, 16 bp, H. sapiens
agtcaggaagaaacct

SEQ ID NO: 43088 - DNA, 16 bp, H. sapiens
agtcaggaccctctgc

SEQ ID NO: 43089 - DNA, 16 bp, H. sapiens
agtcaggagaatggtg

SEQ ID NO: 43090 - DNA, 16 bp, H. sapiens
agtcaggagtccaaga

SEQ ID NO: 43091 - DNA, 16 bp, H. sapiens
agtcaggcatggcagc

SEQ ID NO: 43092 - DNA, 16 bp, H. sapiens
agtcaggcgtggtggt

SEQ ID NO: 43093 - DNA, 16 bp, H. sapiens
agtcagggaagggaga

SEQ ID NO: 43094 - DNA, 16 bp, H. sapiens
agtcagggcagggcag

SEQ ID NO: 43095 - DNA, 16 bp, H. sapiens
agtcagggttctccaa

SEQ ID NO: 43096 - DNA, 16 bp, H. sapiens
agtcaggtattttgta

SEQ ID NO: 43097 - DNA, 16 bp, H. sapiens
agtcaggtggtgtgat

SEQ ID NO: 43098 - DNA, 16 bp, H. sapiens
agtcagtaataattta

SEQ ID NO: 43099 - DNA, 16 bp, H. sapiens
agtcagtattttaaaa

SEQ ID NO: 43100 - DNA, 16 bp, H. sapiens
agtcagtgagtggtga

SEQ ID NO: 43101 - DNA, 16 bp, H. sapiens
agtcagtgctctgtgt

SEQ ID NO: 43102 - DNA, 16 bp, H. sapiens
agtcagtgtaaatgtt

SEQ ID NO: 43103 - DNA, 16 bp, H. sapiens
agtcagtgttacagct

SEQ ID NO: 43104 - DNA, 16 bp, H. sapiens
agtcagttcctggatg

SEQ ID NO: 43105 - DNA, 16 bp, H. sapiens
agtcagttcctgggtg

SEQ ID NO: 43106 - DNA, 16 bp, H. sapiens
agtcagtttggaaagt

SEQ ID NO: 43107 - DNA, 16 bp, H. sapiens
agtcatagagacagaa

SEQ ID NO: 43108 - DNA, 16 bp, H. sapiens
agtcatatgtcactta

SEQ ID NO: 43109 - DNA, 16 bp, H. sapiens
agtcatattggattag

SEQ ID NO: 43110 - DNA, 16 bp, H. sapiens
agtcatccacccacct

SEQ ID NO: 43111 - DNA, 16 bp, H. sapiens
agtcatccatgaggat

SEQ ID NO: 43112 - DNA, 16 bp, H. sapiens
agtcatccctcagtat

SEQ ID NO: 43113 - DNA, 16 bp, H. sapiens
agtcatccttctgctc

SEQ ID NO: 43114 - DNA, 16 bp, H. sapiens
agtcatgaaaacaaca

SEQ ID NO: 43115 - DNA, 16 bp, H. sapiens
agtcatgaatatttat

SEQ ID NO: 43116 - DNA, 16 bp, H. sapiens
agtcatgatggcacca

SEQ ID NO: 43117 - DNA, 16 bp, H. sapiens
agtcatgcactacata

SEQ ID NO: 43118 - DNA, 16 bp, H. sapiens
agtcatgcaggcctgg

SEQ ID NO: 43119 - DNA, 16 bp, H. sapiens
agtcatgccctacaaa

SEQ ID NO: 43120 - DNA, 16 bp, H. sapiens
agtcatgctgccaggg

SEQ ID NO: 43121 - DNA, 16 bp, H. sapiens
agtcatggcagaagac

SEQ ID NO: 43122 - DNA, 16 bp, H. sapiens
agtcattataagaaaa

SEQ ID NO: 43123 - DNA, 16 bp, H. sapiens
agtcattatataaaaa

SEQ ID NO: 43124 - DNA, 16 bp, H. sapiens
agtcattatttgaaaa

SEQ ID NO: 43125 - DNA, 16 bp, H. sapiens
agtcattcagcagcag

SEQ ID NO: 43126 - DNA, 16 bp, H. sapiens
agtcattcattcattt

SEQ ID NO: 43127 - DNA, 16 bp, H. sapiens
agtcattccccatttc

SEQ ID NO: 43128 - DNA, 16 bp, H. sapiens
agtcatttctccaaag

SEQ ID NO: 43129 - DNA, 16 bp, H. sapiens
agtcatttgcccaagg

SEQ ID NO: 43130 - DNA, 16 bp, H. sapiens
agtcatttgggagcag

SEQ ID NO: 43131 - DNA, 16 bp, H. sapiens
agtcattttggaaaac

SEQ ID NO: 43132 - DNA, 16 bp, H. sapiens
agtcatttttaaaaga

SEQ ID NO: 43133 - DNA, 16 bp, H. sapiens
agtcatttttatattt

SEQ ID NO: 43134 - DNA, 16 bp, H. sapiens
agtccaaaagcttctt

SEQ ID NO: 43135 - DNA, 16 bp, H. sapiens
agtccaaacctcagca

SEQ ID NO: 43136 - DNA, 16 bp, H. sapiens
agtccaaaggccaaag

SEQ ID NO: 43137 - DNA, 16 bp, H. sapiens
agtccaaaggctggag

SEQ ID NO: 43138 - DNA, 16 bp, H. sapiens
agtccaaattctcatc

SEQ ID NO: 43139 - DNA, 16 bp, H. sapiens
agtccaaattgagatg

SEQ ID NO: 43140 - DNA, 16 bp, H. sapiens
agtccaagagttcgag

SEQ ID NO: 43141 - DNA, 16 bp, H. sapiens
agtccaagatcaagga

SEQ ID NO: 43142 - DNA, 16 bp, H. sapiens
agtccaagctactcag

SEQ ID NO: 43143 - DNA, 16 bp, H. sapiens
agtccaccactgatga

SEQ ID NO: 43144 - DNA, 16 bp, H. sapiens
agtccagaagtctgaa

SEQ ID NO: 43145 - DNA, 16 bp, H. sapiens
agtccagcagcccaag

SEQ ID NO: 43146 - DNA, 16 bp, H. sapiens
agtccagcctgaccaa

SEQ ID NO: 43147 - DNA, 16 bp, H. sapiens
agtccagcctgggcaa

SEQ ID NO: 43148 - DNA, 16 bp, H. sapiens
agtccagcctgtgcaa

SEQ ID NO: 43149 - DNA, 16 bp, H. sapiens
agtccaggaagtggag

SEQ ID NO: 43150 - DNA, 16 bp, H. sapiens
agtccaggagacagag

SEQ ID NO: 43151 - DNA, 16 bp, H. sapiens
agtccaggagctcaag

SEQ ID NO: 43152 - DNA, 16 bp, H. sapiens
agtccaggagtccaag

SEQ ID NO: 43153 - DNA, 16 bp, H. sapiens
agtccaggagttccag

SEQ ID NO: 43154 - DNA, 16 bp, H. sapiens
agtccaggagttggag

SEQ ID NO: 43155 - DNA, 16 bp, H. sapiens
agtccaggcctccaga

SEQ ID NO: 43156 - DNA, 16 bp, H. sapiens
agtccaggtgtttgag

SEQ ID NO: 43157 - DNA, 16 bp, H. sapiens
agtccagtggtgcaat

SEQ ID NO: 43158 - DNA, 16 bp, H. sapiens
agtccagttttattct

SEQ ID NO: 43159 - DNA, 16 bp, H. sapiens
agtccatctcaaaaaa

SEQ ID NO: 43160 - DNA, 16 bp, H. sapiens
agtccatctggtcctg

SEQ ID NO: 43161 - DNA, 16 bp, H. sapiens
agtccatttatattca

SEQ ID NO: 43162 - DNA, 16 bp, H. sapiens
agtccattttcaagct

SEQ ID NO: 43163 - DNA, 16 bp, H. sapiens
agtcccaagcatttca

SEQ ID NO: 43164 - DNA, 16 bp, H. sapiens
agtcccacaataggcc

SEQ ID NO: 43165 - DNA, 16 bp, H. sapiens
agtcccaccaactgtg

SEQ ID NO: 43166 - DNA, 16 bp, H. sapiens
agtcccagaagaagag

SEQ ID NO: 43167 - DNA, 16 bp, H. sapiens
agtcccagacacttgg

SEQ ID NO: 43168 - DNA, 16 bp, H. sapiens
agtcccagatgcttgg

SEQ ID NO: 43169 - DNA, 16 bp, H. sapiens
agtcccagcaccttgg

SEQ ID NO: 43170 - DNA, 16 bp, H. sapiens
agtcccagcgacttgg

SEQ ID NO: 43171 - DNA, 16 bp, H. sapiens
agtcccagctactaca

SEQ ID NO: 43172 - DNA, 16 bp, H. sapiens
agtcccagctactgag

SEQ ID NO: 43173 - DNA, 16 bp, H. sapiens
agtcccagctcctcag

SEQ ID NO: 43174 - DNA, 16 bp, H. sapiens
agtcccagctcctggg

SEQ ID NO: 43175 - DNA, 16 bp, H. sapiens
agtcccagctctgcca

SEQ ID NO: 43176 - DNA, 16 bp, H. sapiens
agtcccagctctttgg

SEQ ID NO: 43177 - DNA, 16 bp, H. sapiens
agtcccagctgctcca

SEQ ID NO: 43178 - DNA, 16 bp, H. sapiens
agtcccagctgcttga

SEQ ID NO: 43179 - DNA, 16 bp, H. sapiens
agtcccagcttctcaa

SEQ ID NO: 43180 - DNA, 16 bp, H. sapiens
agtcccaggaggctga

SEQ ID NO: 43181 - DNA, 16 bp, H. sapiens
agtcccagtactcggg

SEQ ID NO: 43182 - DNA, 16 bp, H. sapiens
agtcccagtcccagct

SEQ ID NO: 43183 - DNA, 16 bp, H. sapiens
agtcccagtgattcag

SEQ ID NO: 43184 - DNA, 16 bp, H. sapiens
agtcccagttctgcca

SEQ ID NO: 43185 - DNA, 16 bp, H. sapiens
agtcccattcacaatt

SEQ ID NO: 43186 - DNA, 16 bp, H. sapiens
agtcccatttactcag

SEQ ID NO: 43187 - DNA, 16 bp, H. sapiens
agtccccactcgaccc

SEQ ID NO: 43188 - DNA, 16 bp, H. sapiens
agtccccagaactgtg

SEQ ID NO: 43189 - DNA, 16 bp, H. sapiens
agtccccagagtatga

SEQ ID NO: 43190 - DNA, 16 bp, H. sapiens
agtcccccaaattctt

SEQ ID NO: 43191 - DNA, 16 bp, H. sapiens
agtcccctgcctcagc

SEQ ID NO: 43192 - DNA, 16 bp, H. sapiens
agtccctcccccaaca

SEQ ID NO: 43193 - DNA, 16 bp, H. sapiens
agtccctgtcctcagg

SEQ ID NO: 43194 - DNA, 16 bp, H. sapiens
agtcccttcttttcaa

SEQ ID NO: 43195 - DNA, 16 bp, H. sapiens
agtccctttttttcta

SEQ ID NO: 43196 - DNA, 16 bp, H. sapiens
agtccgggagttcgag

SEQ ID NO: 43197 - DNA, 16 bp, H. sapiens
agtcctagctacctgg

SEQ ID NO: 43198 - DNA, 16 bp, H. sapiens
agtcctcacagcagcc

SEQ ID NO: 43199 - DNA, 16 bp, H. sapiens
agtcctcagagccctc

SEQ ID NO: 43200 - DNA, 17 bp, H. sapiens
agtcctcagtaaggttt

SEQ ID NO: 43201 - DNA, 16 bp, H. sapiens
agtcctcagtccttaa

SEQ ID NO: 43202 - DNA, 16 bp, H. sapiens
agtcctcccacctcaa

SEQ ID NO: 43203 - DNA, 16 bp, H. sapiens
agtcctcccaccttga

SEQ ID NO: 43204 - DNA, 18 bp, H. sapiens
agtcctcctgcctcagct

SEQ ID NO: 43205 - DNA, 16 bp, H. sapiens
agtcctgcctcctatc

SEQ ID NO: 43206 - DNA, 16 bp, H. sapiens
agtcctgctttgttgc

SEQ ID NO: 43207 - DNA, 16 bp, H. sapiens
agtcctggagaaacag

SEQ ID NO: 43208 - DNA, 16 bp, H. sapiens
agtcctggagatggat

SEQ ID NO: 43209 - DNA, 16 bp, H. sapiens
agtcctgggattccag

SEQ ID NO: 43210 - DNA, 16 bp, H. sapiens
agtcctgggtggggca

SEQ ID NO: 43211 - DNA, 16 bp, H. sapiens
agtcctggtttctttt

SEQ ID NO: 43212 - DNA, 16 bp, H. sapiens
agtcctgttcttggac

SEQ ID NO: 43213 - DNA, 16 bp, H. sapiens
agtccttcctcctcaa

SEQ ID NO: 43214 - DNA, 16 bp, H. sapiens
agtccttggtccctgg

SEQ ID NO: 43215 - DNA, 16 bp, H. sapiens
agtcctttccccactg

SEQ ID NO: 43216 - DNA, 16 bp, H. sapiens
agtcctttccctgttg

SEQ ID NO: 43217 - DNA, 16 bp, H. sapiens
agtcctttctcacact

SEQ ID NO: 43218 - DNA, 16 bp, H. sapiens
agtcgagatcacgcca

SEQ ID NO: 43219 - DNA, 16 bp, H. sapiens
agtcgaggagcatctg

SEQ ID NO: 43220 - DNA, 17 bp, H. sapiens
agtcgaggctgcagtga

SEQ ID NO: 43221 - DNA, 16 bp, H. sapiens
agtcggccctctgtat

SEQ ID NO: 43222 - DNA, 16 bp, H. sapiens
agtcgggggttgttag

SEQ ID NO: 43223 - DNA, 16 bp, H. sapiens
agtctaaaattatttc

SEQ ID NO: 43224 - DNA, 16 bp, H. sapiens
agtctagagtgcagtg

SEQ ID NO: 43225 - DNA, 16 bp, H. sapiens
agtctatatcttttaa

SEQ ID NO: 43226 - DNA, 16 bp, H. sapiens
agtctatggtattctg

SEQ ID NO: 43227 - DNA, 16 bp, H. sapiens
agtctattggtgccat

SEQ ID NO: 43228 - DNA, 16 bp, H. sapiens
agtctcaaaaaagaaa

SEQ ID NO: 43229 - DNA, 22 bp, H. sapiens
agtctcactctgtcacccagga

SEQ ID NO: 43230 - DNA, 24 bp, H. sapiens
agtctcactctgttgcccaggctg

SEQ ID NO: 43231 - DNA, 16 bp, H. sapiens
agtctcactgtccccc

SEQ ID NO: 43232 - DNA, 19 bp, H. sapiens
agtctcactttgtcaccca

SEQ ID NO: 43233 - DNA, 16 bp, H. sapiens
agtctcagaaaaagaa

SEQ ID NO: 43234 - DNA, 16 bp, H. sapiens
agtctcagctcactga

SEQ ID NO: 43235 - DNA, 16 bp, H. sapiens
agtctcaggtgtgtct

SEQ ID NO: 43236 - DNA, 16 bp, H. sapiens
agtctcatattttgtg

SEQ ID NO: 43237 - DNA, 16 bp, H. sapiens
agtctccaatgtctat

SEQ ID NO: 43238 - DNA, 16 bp, H. sapiens
agtctccaccactccc

SEQ ID NO: 43239 - DNA, 16 bp, H. sapiens
agtctccactggggca

SEQ ID NO: 43240 - DNA, 16 bp, H. sapiens
agtctccagaaaaaaa

SEQ ID NO: 43241 - DNA, 16 bp, H. sapiens
agtctccaggacattg

SEQ ID NO: 43242 - DNA, 16 bp, H. sapiens
agtctccagtgtctac

SEQ ID NO: 43243 - DNA, 16 bp, H. sapiens
agtctcccagcaaaga

SEQ ID NO: 43244 - DNA, 16 bp, H. sapiens
agtctcccccaccctt

SEQ ID NO: 43245 - DNA, 16 bp, H. sapiens
agtctccctctttcac

SEQ ID NO: 43246 - DNA, 16 bp, H. sapiens
agtctcccttgcagct

SEQ ID NO: 43247 - DNA, 16 bp, H. sapiens
agtctccctttcccca

SEQ ID NO: 43248 - DNA, 16 bp, H. sapiens
agtctccctttccctg

SEQ ID NO: 43249 - DNA, 16 bp, H. sapiens
agtctccgcctcctgg

SEQ ID NO: 43250 - DNA, 16 bp, H. sapiens
agtctcctcatctgca

SEQ ID NO: 43251 - DNA, 16 bp, H. sapiens
agtctcctctctatca

SEQ ID NO: 43252 - DNA, 16 bp, H. sapiens
agtctcctgagtagtt

SEQ ID NO: 43253 - DNA, 19 bp, H. sapiens
agtctcctgcctcagcctc

SEQ ID NO: 43254 - DNA, 16 bp, H. sapiens
agtctccttcagttca

SEQ ID NO: 43255 - DNA, 16 bp, H. sapiens
agtctcctttccttgg

SEQ ID NO: 43256 - DNA, 16 bp, H. sapiens
agtctcctttgcagtt

SEQ ID NO: 43257 - DNA, 16 bp, H. sapiens
agtctcgctcttgtca

SEQ ID NO: 43258 - DNA, 16 bp, H. sapiens
agtctctacaaaaaat

SEQ ID NO: 43259 - DNA, 16 bp, H. sapiens
agtctctcctattaga

SEQ ID NO: 43260 - DNA, 16 bp, H. sapiens
agtctctcgctctgtc

SEQ ID NO: 43261 - DNA, 16 bp, H. sapiens
agtctctctgcttcca

SEQ ID NO: 43262 - DNA, 16 bp, H. sapiens
agtctctcttcctgga

SEQ ID NO: 43263 - DNA, 16 bp, H. sapiens
agtctctctttttcta

SEQ ID NO: 43264 - DNA, 16 bp, H. sapiens
agtctctgagaatctt

SEQ ID NO: 43265 - DNA, 16 bp, H. sapiens
agtctctgccctcagg

SEQ ID NO: 43266 - DNA, 16 bp, H. sapiens
agtctctggcagttct

SEQ ID NO: 43267 - DNA, 16 bp, H. sapiens
agtctctgtcgcccag

SEQ ID NO: 43268 - DNA, 16 bp, H. sapiens
agtctctgtcttttaa

SEQ ID NO: 43269 - DNA, 16 bp, H. sapiens
agtctcttcaatatat

SEQ ID NO: 43270 - DNA, 16 bp, H. sapiens
agtctcttcagtaaat

SEQ ID NO: 43271 - DNA, 16 bp, H. sapiens
agtctcttctaaaaat

SEQ ID NO: 43272 - DNA, 16 bp, H. sapiens
agtctcttgttctctt

SEQ ID NO: 43273 - DNA, 16 bp, H. sapiens
agtctctttgtaggtt

SEQ ID NO: 43274 - DNA, 16 bp, H. sapiens
agtctgaaaaagaaat

SEQ ID NO: 43275 - DNA, 16 bp, H. sapiens
agtctgaaaatattaa

SEQ ID NO: 43276 - DNA, 16 bp, H. sapiens
agtctgaaatcaaaat

SEQ ID NO: 43277 - DNA, 16 bp, H. sapiens
agtctgaagatgtgac

SEQ ID NO: 43278 - DNA, 16 bp, H. sapiens
agtctgaagtcaaggt

SEQ ID NO: 43279 - DNA, 16 bp, H. sapiens
agtctgaagtctcatc

SEQ ID NO: 43280 - DNA, 21 bp, H. sapiens
agtctgaccaacatggagaaa

SEQ ID NO: 43281 - DNA, 16 bp, H. sapiens
agtctgactagaattc

SEQ ID NO: 43282 - DNA, 16 bp, H. sapiens
agtctgactctggcat

SEQ ID NO: 43283 - DNA, 16 bp, H. sapiens
agtctgacttctctcc

SEQ ID NO: 43284 - DNA, 16 bp, H. sapiens
agtctgagaccagcct

SEQ ID NO: 43285 - DNA, 16 bp, H. sapiens
agtctgagatttaaag

SEQ ID NO: 43286 - DNA, 16 bp, H. sapiens
agtctgaggcgggtgg

SEQ ID NO: 43287 - DNA, 16 bp, H. sapiens
agtctgagggaggagg

SEQ ID NO: 43288 - DNA, 17 bp, H. sapiens
agtctgaggttacagtg

SEQ ID NO: 43289 - DNA, 16 bp, H. sapiens
agtctgagtctaaagg

SEQ ID NO: 43290 - DNA, 16 bp, H. sapiens
agtctgagtgacacag

SEQ ID NO: 43291 - DNA, 16 bp, H. sapiens
agtctgcagatgcaga

SEQ ID NO: 43292 - DNA, 16 bp, H. sapiens
agtctgcagtgagccg

SEQ ID NO: 43293 - DNA, 16 bp, H. sapiens
agtctgctgagaatga

SEQ ID NO: 43294 - DNA, 16 bp, H. sapiens
agtctgctggttctca

SEQ ID NO: 43295 - DNA, 16 bp, H. sapiens
agtctgcttgctttct

SEQ ID NO: 43296 - DNA, 16 bp, H. sapiens
agtctgcttttagctt

SEQ ID NO: 43297 - DNA, 16 bp, H. sapiens
agtctggaattcctga

SEQ ID NO: 43298 - DNA, 16 bp, H. sapiens
agtctggccaacagag

SEQ ID NO: 43299 - DNA, 16 bp, H. sapiens
agtctggccaacatgg

SEQ ID NO: 43300 - DNA, 17 bp, H. sapiens
agtctggccaacatggc

SEQ ID NO: 43301 - DNA, 16 bp, H. sapiens
agtctggctccagggt

SEQ ID NO: 43302 - DNA, 16 bp, H. sapiens
agtctggctcttttgc

SEQ ID NO: 43303 - DNA, 16 bp, H. sapiens
agtctgggcaacatga

SEQ ID NO: 43304 - DNA, 16 bp, H. sapiens
agtctgggcaacggag

SEQ ID NO: 43305 - DNA, 16 bp, H. sapiens
agtctgggcaactgag

SEQ ID NO: 43306 - DNA, 16 bp, H. sapiens
agtctgggcctccaga

SEQ ID NO: 43307 - DNA, 17 bp, H. sapiens
agtctgggcgacagagc

SEQ ID NO: 43308 - DNA, 16 bp, H. sapiens
agtctgggcttccaga

SEQ ID NO: 43309 - DNA, 16 bp, H. sapiens
agtctggggaggaggg

SEQ ID NO: 43310 - DNA, 16 bp, H. sapiens
agtctggtctcaaact

SEQ ID NO: 43311 - DNA, 16 bp, H. sapiens
agtctggtctcgaact

SEQ ID NO: 43312 - DNA, 16 bp, H. sapiens
agtctggtcttgaact

SEQ ID NO: 43313 - DNA, 16 bp, H. sapiens
agtctggttttgaact

SEQ ID NO: 43314 - DNA, 16 bp, H. sapiens
agtctgtacatgttca

SEQ ID NO: 43315 - DNA, 16 bp, H. sapiens
agtctgtcatccaggc

SEQ ID NO: 43316 - DNA, 16 bp, H. sapiens
agtctgtctttctgtg

SEQ ID NO: 43317 - DNA, 16 bp, H. sapiens
agtctgtgtgtgacct

SEQ ID NO: 43318 - DNA, 16 bp, H. sapiens
agtctgtgttttaaca

SEQ ID NO: 43319 - DNA, 16 bp, H. sapiens
agtctgttctcacacc

SEQ ID NO: 43320 - DNA, 16 bp, H. sapiens
agtctgttttcaggct

SEQ ID NO: 43321 - DNA, 16 bp, H. sapiens
agtctgttttctctga

SEQ ID NO: 43322 - DNA, 16 bp, H. sapiens
agtctgttttgtcagt

SEQ ID NO: 43323 - DNA, 16 bp, H. sapiens
agtcttagatatgtct

SEQ ID NO: 43324 - DNA, 16 bp, H. sapiens
agtcttcactgtctgg

SEQ ID NO: 43325 - DNA, 16 bp, H. sapiens
agtcttcagccctaga

SEQ ID NO: 43326 - DNA, 16 bp, H. sapiens
agtcttcagtgtctat

SEQ ID NO: 43327 - DNA, 16 bp, H. sapiens
agtcttcatagaattg

SEQ ID NO: 43328 - DNA, 16 bp, H. sapiens
agtcttctttatggaa

SEQ ID NO: 43329 - DNA, 16 bp, H. sapiens
agtcttgaattgccaa

SEQ ID NO: 43330 - DNA, 16 bp, H. sapiens
agtcttgctgtgttgc

SEQ ID NO: 43331 - DNA, 16 bp, H. sapiens
agtcttgctgttgttg

SEQ ID NO: 43332 - DNA, 16 bp, H. sapiens
agtcttgcttgctctg

SEQ ID NO: 43333 - DNA, 16 bp, H. sapiens
agtcttgctttgtcac

SEQ ID NO: 43334 - DNA, 16 bp, H. sapiens
agtcttggaagttctg

SEQ ID NO: 43335 - DNA, 16 bp, H. sapiens
agtcttgggagggggt

SEQ ID NO: 43336 - DNA, 16 bp, H. sapiens
agtcttgggaggtgta

SEQ ID NO: 43337 - DNA, 17 bp, H. sapiens
agtcttgggtatgtctt

SEQ ID NO: 43338 - DNA, 16 bp, H. sapiens
agtcttgtggaactga

SEQ ID NO: 43339 - DNA, 16 bp, H. sapiens
agtcttgttctgttgc

SEQ ID NO: 43340 - DNA, 16 bp, H. sapiens
agtctttaaaaaaaaa

SEQ ID NO: 43341 - DNA, 16 bp, H. sapiens
agtctttaacccattt

SEQ ID NO: 43342 - DNA, 16 bp, H. sapiens
agtctttaatccagct

SEQ ID NO: 43343 - DNA, 16 bp, H. sapiens
agtctttaattcactt

SEQ ID NO: 43344 - DNA, 16 bp, H. sapiens
agtctttacaatttgg

SEQ ID NO: 43345 - DNA, 16 bp, H. sapiens
agtctttaggattttc

SEQ ID NO: 43346 - DNA, 16 bp, H. sapiens
agtctttcacctcctt

SEQ ID NO: 43347 - DNA, 16 bp, H. sapiens
agtctttgatattgtg

SEQ ID NO: 43348 - DNA, 16 bp, H. sapiens
agtctttgatctttct

SEQ ID NO: 43349 - DNA, 16 bp, H. sapiens
agtctttgtgtgtgtg

SEQ ID NO: 43350 - DNA, 16 bp, H. sapiens
agtcttttaaaaatgt

SEQ ID NO: 43351 - DNA, 16 bp, H. sapiens
agtcttttcaacaaat

SEQ ID NO: 43352 - DNA, 16 bp, H. sapiens
agtcttttcattttta

SEQ ID NO: 43353 - DNA, 16 bp, H. sapiens
agtcttttgtgactgg

SEQ ID NO: 43354 - DNA, 16 bp, H. sapiens
agtctttttcccattg

SEQ ID NO: 43355 - DNA, 16 bp, H. sapiens
agtctttttgctaaag

SEQ ID NO: 43356 - DNA, 16 bp, H. sapiens
agtctttttttttaaa

SEQ ID NO: 43357 - DNA, 16 bp, H. sapiens
agtgaaaaaagctaga

SEQ ID NO: 43358 - DNA, 16 bp, H. sapiens
agtgaaaaactgaatg

SEQ ID NO: 43359 - DNA, 16 bp, H. sapiens
agtgaaaaattggaaa

SEQ ID NO: 43360 - DNA, 16 bp, H. sapiens
agtgaaaacccatctc

SEQ ID NO: 43361 - DNA, 16 bp, H. sapiens
agtgaaaagaacaaag

SEQ ID NO: 43362 - DNA, 16 bp, H. sapiens
agtgaaaagacaactt

SEQ ID NO: 43363 - DNA, 16 bp, H. sapiens
agtgaaaaggcaatct

SEQ ID NO: 43364 - DNA, 17 bp, H. sapiens
agtgaaaatagtaatca

SEQ ID NO: 43365 - DNA, 16 bp, H. sapiens
agtgaaacaactcaaa

SEQ ID NO: 43366 - DNA, 16 bp, H. sapiens
agtgaaacaagccaga

SEQ ID NO: 43367 - DNA, 16 bp, H. sapiens
agtgaaacaccatctc

SEQ ID NO: 43368 - DNA, 16 bp, H. sapiens
agtgaaacattttaaa

SEQ ID NO: 43369 - DNA, 16 bp, H. sapiens
agtgaaacccagtctc

SEQ ID NO: 43370 - DNA, 18 bp, H. sapiens
agtgaaaccccatctcca

SEQ ID NO: 43371 - DNA, 26 bp, H. sapiens
agtgaaaccccatctctactaaaaaa

SEQ ID NO: 43372 - DNA, 18 bp, H. sapiens
agtgaaaccccatctctg

SEQ ID NO: 43373 - DNA, 18 bp, H. sapiens
agtgaaaccccatctgta

SEQ ID NO: 43374 - DNA, 16 bp, H. sapiens
agtgaaaccccatgtc

SEQ ID NO: 43375 - DNA, 16 bp, H. sapiens
agtgaaaccccatttc

SEQ ID NO: 43376 - DNA, 18 bp, H. sapiens
agtgaaaccccgtctcca

SEQ ID NO: 43377 - DNA, 18 bp, H. sapiens
agtgaaaccccgtctcta

SEQ ID NO: 43378 - DNA, 24 bp, H. sapiens
agtgaaaccccgtctctactaaaa

SEQ ID NO: 43379 - DNA, 18 bp, H. sapiens
agtgaaaccccgtctctg

SEQ ID NO: 43380 - DNA, 22 bp, H. sapiens
agtgaaaccccgtgtctactaa

SEQ ID NO: 43381 - DNA, 16 bp, H. sapiens
agtgaaaccctatctc

SEQ ID NO: 43382 - DNA, 18 bp, H. sapiens
agtgaaacctcgtctcta

SEQ ID NO: 43383 - DNA, 16 bp, H. sapiens
agtgaaacctcttttc

SEQ ID NO: 43384 - DNA, 16 bp, H. sapiens
agtgaaaccttgtctc

SEQ ID NO: 43385 - DNA, 16 bp, H. sapiens
agtgaaactacatctc

SEQ ID NO: 43386 - DNA, 16 bp, H. sapiens
agtgaaactccattta

SEQ ID NO: 43387 - DNA, 17 bp, H. sapiens
agtgaaactccgtctct

SEQ ID NO: 43388 - DNA, 16 bp, H. sapiens
agtgaaactgtcaaaa

SEQ ID NO: 43389 - DNA, 16 bp, H. sapiens
agtgaaacttcatctc

SEQ ID NO: 43390 - DNA, 16 bp, H. sapiens
agtgaaagaaaatatt

SEQ ID NO: 43391 - DNA, 16 bp, H. sapiens
agtgaaagaagaaagc

SEQ ID NO: 43392 - DNA, 16 bp, H. sapiens
agtgaaagaagccaaa

SEQ ID NO: 43393 - DNA, 16 bp, H. sapiens
agtgaaagaagccaca

SEQ ID NO: 43394 - DNA, 16 bp, H. sapiens
agtgaaataacccaga

SEQ ID NO: 43395 - DNA, 16 bp, H. sapiens
agtgaaataatccaga

SEQ ID NO: 43396 - DNA, 16 bp, H. sapiens
agtgaaatatttttaa

SEQ ID NO: 43397 - DNA, 16 bp, H. sapiens
agtgaaatcaaagaca

SEQ ID NO: 43398 - DNA, 16 bp, H. sapiens
agtgaaatgaaatatt

SEQ ID NO: 43399 - DNA, 16 bp, H. sapiens
agtgaaatgagccagg

SEQ ID NO: 43400 - DNA, 16 bp, H. sapiens
agtgaaatggcacgat

SEQ ID NO: 43401 - DNA, 16 bp, H. sapiens
agtgaaattaaccaag

SEQ ID NO: 43402 - DNA, 16 bp, H. sapiens
agtgaaatttatagca

SEQ ID NO: 43403 - DNA, 16 bp, H. sapiens
agtgaaatttcatctc

SEQ ID NO: 43404 - DNA, 16 bp, H. sapiens
agtgaacagtcaacct

SEQ ID NO: 43405 - DNA, 16 bp, H. sapiens
agtgaacatagtaccc

SEQ ID NO: 43406 - DNA, 16 bp, H. sapiens
agtgaacatgggaatg

SEQ ID NO: 43407 - DNA, 16 bp, H. sapiens
agtgaacatttattaa

SEQ ID NO: 43408 - DNA, 16 bp, H. sapiens
agtgaacccatgcagt

SEQ ID NO: 43409 - DNA, 16 bp, H. sapiens
agtgaactggcaacct

SEQ ID NO: 43410 - DNA, 16 bp, H. sapiens
agtgaacttgaagaca

SEQ ID NO: 43411 - DNA, 16 bp, H. sapiens
agtgaagaaaatgttt

SEQ ID NO: 43412 - DNA, 16 bp, H. sapiens
agtgaagaaggcatgt

SEQ ID NO: 43413 - DNA, 16 bp, H. sapiens
agtgaagagaggctgg

SEQ ID NO: 43414 - DNA, 16 bp, H. sapiens
agtgaagatcagagaa

SEQ ID NO: 43415 - DNA, 16 bp, H. sapiens
agtgaagatgagcatt

SEQ ID NO: 43416 - DNA, 16 bp, H. sapiens
agtgaagcaggatatt

SEQ ID NO: 43417 - DNA, 16 bp, H. sapiens
agtgaagccctgtctc

SEQ ID NO: 43418 - DNA, 16 bp, H. sapiens
agtgaagctgcagact

SEQ ID NO: 43419 - DNA, 18 bp, H. sapiens
agtgaagctgcagatctt

SEQ ID NO: 43420 - DNA, 16 bp, H. sapiens
agtgaaggagaaatac

SEQ ID NO: 43421 - DNA, 16 bp, H. sapiens
agtgaaggagaaatat

SEQ ID NO: 43422 - DNA, 16 bp, H. sapiens
agtgaaggaggaactt

SEQ ID NO: 43423 - DNA, 16 bp, H. sapiens
agtgaagtggactctg

SEQ ID NO: 43424 - DNA, 16 bp, H. sapiens
agtgaagtggtgccat

SEQ ID NO: 43425 - DNA, 16 bp, H. sapiens
agtgaagtggtgtgat

SEQ ID NO: 43426 - DNA, 16 bp, H. sapiens
agtgaagtttgttttt

SEQ ID NO: 43427 - DNA, 16 bp, H. sapiens
agtgaatcaatatttt

SEQ ID NO: 43428 - DNA, 16 bp, H. sapiens
agtgaatcagaaactc

SEQ ID NO: 43429 - DNA, 16 bp, H. sapiens
agtgaatccagcagca

SEQ ID NO: 43430 - DNA, 16 bp, H. sapiens
agtgaatctgcatttt

SEQ ID NO: 43431 - DNA, 16 bp, H. sapiens
agtgaatgaacgaatg

SEQ ID NO: 43432 - DNA, 16 bp, H. sapiens
agtgaatgggaaggcc

SEQ ID NO: 43433 - DNA, 16 bp, H. sapiens
agtgaatggttaaaca

SEQ ID NO: 43434 - DNA, 17 bp, H. sapiens
agtgaatggttctgtct

SEQ ID NO: 43435 - DNA, 16 bp, H. sapiens
agtgaatgtgaaggtc

SEQ ID NO: 43436 - DNA, 16 bp, H. sapiens
agtgaatgtgtctttt

SEQ ID NO: 43437 - DNA, 16 bp, H. sapiens
agtgaattacattgat

SEQ ID NO: 43438 - DNA, 16 bp, H. sapiens
agtgaatttttcagct

SEQ ID NO: 43439 - DNA, 16 bp, H. sapiens
agtgacaaagcaagac

SEQ ID NO: 43440 - DNA, 16 bp, H. sapiens
agtgacaaagctggga

SEQ ID NO: 43441 - DNA, 16 bp, H. sapiens
agtgacacaatcttgg

SEQ ID NO: 43442 - DNA, 16 bp, H. sapiens
agtgacaccatcttgg

SEQ ID NO: 43443 - DNA, 16 bp, H. sapiens
agtgacaccctgtttc

SEQ ID NO: 43444 - DNA, 16 bp, H. sapiens
agtgacactctgtctc

SEQ ID NO: 43445 - DNA, 16 bp, H. sapiens
agtgacactggtctgt

SEQ ID NO: 43446 - DNA, 16 bp, H. sapiens
agtgacagaaaaataa

SEQ ID NO: 43447 - DNA, 16 bp, H. sapiens
agtgacagaaagcaaa

SEQ ID NO: 43448 - DNA, 16 bp, H. sapiens
agtgacagaaatgttc

SEQ ID NO: 43449 - DNA, 16 bp, H. sapiens
agtgacagagaccctg

SEQ ID NO: 43450 - DNA, 16 bp, H. sapiens
agtgacagagactctg

SEQ ID NO: 43451 - DNA, 16 bp, H. sapiens
agtgacagagccagga

SEQ ID NO: 43452 - DNA, 16 bp, H. sapiens
agtgacagatcatcag

SEQ ID NO: 43453 - DNA, 16 bp, H. sapiens
agtgacagtgagaccc

SEQ ID NO: 43454 - DNA, 16 bp, H. sapiens
agtgacatcccatctc

SEQ ID NO: 43455 - DNA, 16 bp, H. sapiens
agtgacatctcattgt

SEQ ID NO: 43456 - DNA, 16 bp, H. sapiens
agtgaccaaaacagca

SEQ ID NO: 43457 - DNA, 16 bp, H. sapiens
agtgaccaagcagaga

SEQ ID NO: 43458 - DNA, 16 bp, H. sapiens
agtgacccacccacct

SEQ ID NO: 43459 - DNA, 16 bp, H. sapiens
agtgacctctggtcct

SEQ ID NO: 43460 - DNA, 18 bp, H. sapiens
agtgacctgatggagctg

SEQ ID NO: 43461 - DNA, 16 bp, H. sapiens
agtgaccttgggcaag

SEQ ID NO: 43462 - DNA, 16 bp, H. sapiens
agtgaccttgggcagg

SEQ ID NO: 43463 - DNA, 16 bp, H. sapiens
agtgacggggaaaatg

SEQ ID NO: 43464 - DNA, 16 bp, H. sapiens
agtgactccattttga

SEQ ID NO: 43465 - DNA, 16 bp, H. sapiens
agtgactgctaatggg

SEQ ID NO: 43466 - DNA, 16 bp, H. sapiens
agtgactgcttaatgg

SEQ ID NO: 43467 - DNA, 16 bp, H. sapiens
agtgacttaaaacaat

SEQ ID NO: 43468 - DNA, 16 bp, H. sapiens
agtgacttaacctctc

SEQ ID NO: 43469 - DNA, 16 bp, H. sapiens
agtgacttgaccaagg

SEQ ID NO: 43470 - DNA, 16 bp, H. sapiens
agtgacttgctcaagt

SEQ ID NO: 43471 - DNA, 16 bp, H. sapiens
agtgacttggccaagg

SEQ ID NO: 43472 - DNA, 16 bp, H. sapiens
agtgacttgtccaagg

SEQ ID NO: 43473 - DNA, 16 bp, H. sapiens
agtgactttttaaaat

SEQ ID NO: 43474 - DNA, 16 bp, H. sapiens
agtgagaaaactgaag

SEQ ID NO: 43475 - DNA, 16 bp, H. sapiens
agtgagaaaagcaaga

SEQ ID NO: 43476 - DNA, 16 bp, H. sapiens
agtgagaacatggggt

SEQ ID NO: 43477 - DNA, 16 bp, H. sapiens
agtgagaacatgtaat

SEQ ID NO: 43478 - DNA, 16 bp, H. sapiens
agtgagaacatgtggt

SEQ ID NO: 43479 - DNA, 16 bp, H. sapiens
agtgagaactcactca

SEQ ID NO: 43480 - DNA, 16 bp, H. sapiens
agtgagaatgtaaaat

SEQ ID NO: 43481 - DNA, 16 bp, H. sapiens
agtgagaatgtgcggt

SEQ ID NO: 43482 - DNA, 16 bp, H. sapiens
agtgagacaccgtctc

SEQ ID NO: 43483 - DNA, 16 bp, H. sapiens
agtgagacactgtctc

SEQ ID NO: 43484 - DNA, 16 bp, H. sapiens
agtgagacagagaagg

SEQ ID NO: 43485 - DNA, 16 bp, H. sapiens
agtgagacatcgtctc

SEQ ID NO: 43486 - DNA, 16 bp, H. sapiens
agtgagaccacatctc

SEQ ID NO: 43487 - DNA, 16 bp, H. sapiens
agtgagaccagccttt

SEQ ID NO: 43488 - DNA, 16 bp, H. sapiens
agtgagaccatgtctc

SEQ ID NO: 43489 - DNA, 16 bp, H. sapiens
agtgagaccccatttc

SEQ ID NO: 43490 - DNA, 16 bp, H. sapiens
agtgagaccccgtcta

SEQ ID NO: 43491 - DNA, 16 bp, H. sapiens
agtgagaccctatctc

SEQ ID NO: 43492 - DNA, 16 bp, H. sapiens
agtgagaccctatctg

SEQ ID NO: 43493 - DNA, 16 bp, H. sapiens
agtgagaccctgactc

SEQ ID NO: 43494 - DNA, 16 bp, H. sapiens
agtgagaccctgcctc

SEQ ID NO: 43495 - DNA, 16 bp, H. sapiens
agtgagaccctggctc

SEQ ID NO: 43496 - DNA, 16 bp, H. sapiens
agtgagaccctgtcac

SEQ ID NO: 43497 - DNA, 16 bp, H. sapiens
agtgagaccctgtcta

SEQ ID NO: 43498 - DNA, 16 bp, H. sapiens
agtgagaccctgtctc

SEQ ID NO: 43499 - DNA, 16 bp, H. sapiens
agtgagaccctgtctg

SEQ ID NO: 43500 - DNA, 16 bp, H. sapiens
agtgagaccctgtctt

SEQ ID NO: 43501 - DNA, 16 bp, H. sapiens
agtgagaccgtgtctc

SEQ ID NO: 43502 - DNA, 16 bp, H. sapiens
agtgagacctcatctc

SEQ ID NO: 43503 - DNA, 16 bp, H. sapiens
agtgagacctgtctct

SEQ ID NO: 43504 - DNA, 16 bp, H. sapiens
agtgagaccttgtccc

SEQ ID NO: 43505 - DNA, 16 bp, H. sapiens
agtgagacgctgtctc

SEQ ID NO: 43506 - DNA, 16 bp, H. sapiens
agtgagactccctctt

SEQ ID NO: 43507 - DNA, 16 bp, H. sapiens
agtgagactctatctc

SEQ ID NO: 43508 - DNA, 16 bp, H. sapiens
agtgagactctgcctc

SEQ ID NO: 43509 - DNA, 16 bp, H. sapiens
agtgagactctgtctc

(The sequence listing continues in the following parts.)

What is claimed is:

1. A method for decreasing the expression of a transcript, the method comprising the steps of:
    identifying one or more regions of interest in a sequence of the given transcript;
    sub-selecting, within the one or more identified regions of interest, a motif, wherein sub-selecting a motif comprises identifying one or more identically conserved copies of the motif in intergenic and intronic regions of a genome of interest for the given transcript and identifying one or more additional copies in untranslated and amino acid coding regions of one or more genes in the genome of interest, wherein sub-selecting a motif further comprises using a pattern discovery technique with a pre-determined parameter of minimum size of discovered pattern and a pre-determined parameter of minimum required number of discovered copies before a pattern can be deemed as identified;
    generating one or more derived sequences from the sub-selected motif;
    creating, from the one or more derived sequences, at least one instance of the corresponding molecule that the one or more derived sequences represent, wherein the at least one instance of the corresponding molecule comprises at least one interfering RNA molecule; and
    using the at least one interfering RNA molecule to decrease the expression of the given transcript.

* * * * *